United States Patent 7,745,391 (HUMAN THROMBOSPONDIN POLYPEPTIDE) - sequence listing, part 61

SEQ ID NO: 203873 - DNA, 3001 bp, Homo sapiens
  misc_feature (2627)..(2627): n is a, c, g, or t
ggtctggagcgcggccgccgctgtcactgttggtgcgggcgcgtcggggccgggccggggcactgtaaatggcggcggagggaggcggagcggcggccacgctcagcccagatcccccgaaactttaggttcgaagccccacaactttccgggaagcgctgccgctccggaggcgtggacggaaggggaagccgaggcgggaagtctgggggaatcggcagggagccggggagactcgaacccgcggcgggggcggagtccgccagtgcctcgcgcctccgcggcccccgcctctttctctgcaccctccccgcggccggagccggagccggagccggagccgtagtcgcagccgcagccgcagccgcgcgccgggcctcgcaggcagcggcgcggcgagcgcagccgggccccctcctcgcgacctccgggccctgttgctcgggcgcacctggcgcgtgtgaggccggggccggcgttttcgggaagctagcaggaggccgggccacgcgcagcccctgccggcccaggttcctggggccgggccccgagtagtgcatgcggggcggggcggccgtgagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgagcagtgggagacatttagtgaacgctcttcaagctcacaaactctgacccaatttgattctaacattgcaccagctgatcctgtaagtcaatcacttagcttgcttgtttgagattaattttattaacccaaatttccattcattatcgtttttagctgatatgcatgattcagtggagtgcttagagggaagtggcggcaggctttttggtttttgtgtgcttaatggtgggaaagacattttttgccattccttttttctagttattttgttgagagaaaactacgtttttaaaatctggtacatgtgtctagagaagcattttttgtgacaatctattttgttaaccttatcatttgctaattaagtgtatattttatatacatactgtttatttcagtgtagtgactctttatgtattatctgtatgcttacacatcatgtaatatgtcctacatatgtaactatttatgcaatgtcatcttttattttgacatgccaaatgacatggcttttatttaattagtatgttgagtcctgttagagagaatcaagttcagcaatacaagatgttggtcaaatattccgcttatgcaaaggagcctctgtcttgtcttcttgtggcttactgtgttgctttgaaaatgctacaaagttcatatcctgatttaaaaaataaattctgtccccatagagttaatttaatatatgctacacctgtcccttgggttttttgaaaaccttagctgttaatcgttcttctccctgttcacttcnctgctttttctttttctttctctctctgtcttttttttttttttaagacaaggatgtgctaataagcactttccaaaaagaaaagagggagtaagcagaaagtgaagaaatgtgtaaaggcagaatttttaaaatgagctgagtagaaagatatggagaaaatgacataagtcgttctttctagatgatctgatcaaagacagccagcatttattaattaaatgtaaaaatggtcttgtcatctaaagagattttgaagaagtggcatttaaagataaagtataccattagcagttaatgggcctttgatgtggtttgttttttgtttttgttttttgagttggagcctgggcaacagagcgagactccatctc

SEQ ID NO: 203874 - DNA, 406 bp, Homo sapiens
  misc_feature (49)..(50): n is a, c, g, or t
  misc_feature (69)..(69): n is a, c, g, or t
agtgccgtacgaggtgacggggataataatctcctctagaaagaaatanncataagctaaaacaacagntgtgaaacatatatgtagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccaggtaatcaaagctattcctagacacatttaattactaggaagaaaaagcacgacaattaaaaataatcaaactggcccaaagtgctgggattacaggcatgaaccactgctcctggcccacaaaaatatttttaataaaattaccttcaggttatgtgtatcagttgtatatg

SEQ ID NO: 203875 - DNA, 3283 bp, Homo sapiens
ggtctggagcgcggccgccgctgtcactgttggtgcgggcgcgtcggggccgggccggggcactgtaaatggcggcggagggaggcggagcggcggccacgctcagcccagatcccccgaaactttaggttcgaagccccacaactttccgggaagcgctgccgctccggaggcgtggacggaaggggaagccgaggcgggaagtctgggggaatcggcagggagccggggagactcgaacccgcggcgggggcggagtccgccagtgcctcgcgcctccgcggcccccgcctctttctctgcaccctccccgcggccggagccggagccggagccggagccgtagtcgcagccgcagccgcagccgcgcgccgggcctcgcaggcagcggcgcggcgagcgcagccgggccccctcctcgcgacctccgggccctgttgctcgggcgcacctggcgcgtgtgaggccggggccggcgttttcgggaagctagcaggaggccgggccacgcgcagcccctgccggcccaggttcctggggccgggccccgagtagtgcatgcggggcggggcggccgtgagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagccctgatgctctgatgatgtcaggggcagagcagaacccacaggagggaggcagggttgacacagtgttccagcaggaggctaggttggaacactgcatcagatgttggggatcagccaggtgaggtaggttattcaggctctcctgctgaagctcctccaagcaagtcaccatcgatgccatcactaaaccagacatggcctgagctgaatcagagcagtgagcagtgggagacatttagtgaacgctcttcaagctcacaaactctgacccaatttgattctaacattgcaccagctgatcctgatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagcagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgttt

SEQ ID NO: 203876 - DNA, 4552 bp, Homo sapiens
ggtctggagcgcggccgccgctgtcactgttggtgcgggcgcgtcggggccgggccggggcactgtaaatggcggcggagggaggcggagcggcggccacgctcagcccagatcccccgaaactttaggttcgaagccccacaactttccgggaagcgctgccgctccggaggcgtggacggaaggggaagccgaggcgggaagtctgggggaatcggcagggagccggggagactcgaacccgcggcgggggcggagtccgccagtgcctcgcgcctccgcggcccccgcctctttctctgcaccctccccgcggccggagccggagccggagccggagccgtagtcgcagccgcagccgcagccgcgcgccgggcctcgcaggcagcggcgcggcgagcgcagccgggccccctcctcgcgacctccgggccctgttgctcgggcgcacctggcgcgtgtgaggccggggccggcgttttcgggaagctagcaggaggccgggccacgcgcagcccctgccggcccaggttcctggggccgggccccgagtagtgcatgcggggcggggcggccgtgagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgagcagtgggagacatttagtgaacgctcttcaagctcacaaactctgacccaatttgattctaacattgcaccagctgatcctgatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagcagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgttttctggagggtagattgtgtttgttggcacacccaccttttctgttccctagcatctgggatatgcaatgcttctatggctaataccacacaccaatttaatttatagaatgggctcctcatttacatctcagtcacagactcagaaataaattgtcagtttgtccttttatgtttaatattttacataaagcatctattctataaaaatctttagaaagagtttcccatttaattttgattttaaagaattatattggataaggtggttttcaccataagctaatttactctctgcagccgtctacattcttcacaaatcatgtggtacattgaagcctcttttacatgtcaacttgtgacaaatacaaacatgtgagattttatattttccttgtggaaatgtgatcaacttcatcagcgacttcgaactattttatgagattcaataattcagcagtcatgtaaacttatgaaataggtatgagtaatggcctttcttaatttttttaagtattgttttaaaacttctgaggatatcagttattcccagaataaagggaaattccttaggatttctagtttacctttagccatcttgtcactcattcttttgctatacagacaagtttttcctattaatgagtttctggagtatgccttattcaggacaatatgctgttttagattttgtttaatattaaatgatatatacatttcgatccattgctaacagcagatattccctttaagatttattctgtctataggatcatagattttaaactgcatggatatatcttggcagaatcagaagtgtggttttacaccaataaaacagcataatattttaacttttgttcatctttttaacaagatttaaagttttaagaaatagaagattttgtattttcatttctgaaagaaaaaatgtttaaatactatagattcacagtcctaaactgcaccgatagactttgttactgtaaacaagaatttgaagaacaagggaaactgacaacctcaagcttccaagattaatacaatttttacctgacaatatctaggtaaaaatatacatcagctgaagtttccaagtggctttcagtatggctttagttgttaaataataaatttaaagcattaaaggcccaggaaactactcaacacctgtttttctgagtgtctttgttttcaaagaaacatttttactcagctgtatttcattacaagcaagttttgctgtttccatttagttttgttttttaaaatatgctttttaaaaatagccttctaatttaacaatgtcaaaaatatttgttaaagcttcttagaatttagccttccaataaataacacttaaaaattataga

SEQ ID NO: 203877 - DNA, 1226 bp, Homo sapiens
aaaaagaaattttgcttaataactttattaaaaaaattgttagccacataaaataatcagttgtttagggtacatcataaacagtgctatcttaatttattgtaacacttacatacttgagtgttgagaaaatgtcatgctaataagatcctttgctgcttagccaagtgtaaatgtttaaaaagaaaaaagctctgatatcagtagtatgaccaattatcatggggtgaattttgcaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgttt

SEQ ID NO: 203878 - DNA, 3520 bp, Homo sapiens
ggtctggagcgcggccgccgctgtcactgttggtgcgggcgcgtcggggccgggccggggcactgtaaatggcggcggagggaggcggagcggcggccacgctcagcccagatcccccgaaactttaggttcgaagccccacaactttccgggaagcgctgccgctccggaggcgtggacggaaggggaagccgaggcgggaagtctgggggaatcggcagggagccggggagactcgaacccgcggcgggggcggagtccgccagtgcctcgcgcctccgcggcccccgcctctttctctgcaccctccccgcggccggagccggagccggagccggagccgtagtcgcagccgcagccgcagccgcgcgccgggcctcgcaggcagcggcgcggcgagcgcagccgggccccctcctcgcgacctccgggccctgttgctcgggcgcacctggcgcgtgtgaggccggggccggcgttttcgggaagctagcaggaggccgggccacgcgcagcccctgccggcccaggttcctggggccgggccccgagtagtgcatgcggggcggggcggccgtgagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgagcagtgggagacatttagtgaacgctcttcaagctcacaaactctgacccaatttgattctaacattgcaccagctgatcctgatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagcagatggttacagtagttcagactcttttacttctgacccagaacagatcgggagcaatgtaactcgtcaaaggtcagtatttctgtcaatgaaaagcatgttaaactatcttgctgcgttttaatgtttaaaactatttagaaccaagcacaaatgattttgttctctgaaagctgttaggttactttttgatttatgtaaaagacaagtaattttgatcctttccaacttgaatagaaaaacaaaaagaaccctgactttctaaatggtatgttgtggaagctctaaaaagaggtgataacttcttgacgatagaagttttataagtcctttttgtacctaaacaacgagaatctgtcaagtaatacatgtatagccttatggtaagtaccaaaagaattctgtgttttaaaacaccatccaaaagcacagcccagtggtgggccacctccccaccctgaagttctgcgttacatataacctttcaggcacaaacaagaagggtgtgggatagggtggaggaggctagagatttgtctgcaagggctttaccatccactaaaagctgtgtgcaggacagaagcatctttctctcctcactttttgcacgtgttgagtatcattttgctgtgtgcccagtggatgtagcgaggatgcagaatctccaagcagcttagagtcagaaggctgcttgtcttcctttctgattcttcatgtagttcttcctgtgtttcttagcattctcagtcatcttggattttactctgctgtttattcccatatatgcagatcagattaccagaggccttggagactcttttcagaatatgaaagactttggtagcaaagaagtgaatctctagggcgagttgagtttgagcatagtcacctctaaaatgagatggcctctgcggacacatgaaagggtacttcagcttaccaaaatccagaacttaataggttgaaagctaaccatatctgaaagtagactttcctttatacaattattttttttcagactattattacttttaattgaatgggaaagcgtaacactaagtatgcagtctattatgaaatcatgttgacaactaagtttcttttcaaaatttttgaggccgagcacttctgtaatcctagcactttgggaggctaaggtgggcggatcacctgaagtcaggagttcgagaccagcctggccaacatggtgaaactccgtctctactaaaaatacaaaaattagccgggcatggtagcatgcgcctgtaatcccagttacttgggaggctgaagcaggagaatcgcttgaacccaggaggcggaggttgcagtgagccaaaatggtgtcactgcactccagcctgggcaacagagtgagactgtctcaaaaaaaaaaaa

SEQ ID NO: 203879 - DNA, 2831 bp, Homo sapiens
ggtctggagcgcggccgccgctgtcactgttggtgcgggcgcgtcggggccgggccggggcactgtaaatggcggcggagggaggcggagcggcggccacgctcagcccagatcccccgaaactttaggttcgaagccccacaactttccgggaagcgctgccgctccggaggcgtggacggaaggggaagccgaggcgggaagtctgggggaatcggcagggagccggggagactcgaacccgcggcgggggcggagtccgccagtgcctcgcgcctccgcggcccccgcctctttctctgcaccctccccgcggccggagccggagccggagccggagccgtagtcgcagccgcagccgcagccgcgcgccgggcctcgcaggcagcggcgcggcgagcgcagccgggccccctcctcgcgacctccgggccctgttgctcgggcgcacctggcgcgtgtgaggccggggccggcgttttcgggaagctagcaggaggccgggccacgcgcagcccctgccggcccaggttcctggggccgggccccgagtagtgcatgcggggcggggcggccgtgagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgagcagtgggagacatttagtgaacgctcttcaagctcacaaactctgacccaatttgattctaacattgcaccagctgatcctgatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagcagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggtaggggctagagaaccataatatacattatcatttaattttaaagttaatccaacacacatacacattttatttttgtttctattacatgtcttttaaaaatatttatctggtcgagtgtggttgctcatgcctgtaatcccagcactttgaggggcaggcagatcacttgaggttatgagttcgagaccagcctggccaacatggtgaaaccccatctctactaaaaatacaaaaattagccggatgtagtgatgcatgtctgtggtcccagctactcgggaggctgaggtgggagagtcccttgaacctgggaagcagaggttgcagtgagccaagattgcatcactgcactccagcctgggtgacagagtgagaccctgtctccaaaaaaaaaaaaaaaaattatctgaaggaaaattttggattaaaagacagcagatgagaggcaatttcttttcttaatgactacttaaagtgtgtttgagtgcaaataatgaagatgggaacctgagaga

SEQ ID NO: 203880 - DNA, 758 bp, Homo sapiens
ggatggtggggctgttctagaggatcccagcaacattggactcgacctagccaccccatcagtcttagctctttcagaatgtccctcagacttccatctgatgaccctttttacaatgtcagtcttctgttgatattcaatataatctgaatttccttggatatcagtattggctgcaaatcttgtttggattggaaacctctaaggtacccctcttcctgttggaactgagagaaggaagtgtcaacaaaagttaagtcagaggtgagcagaaggggtgagggtcagacatctgaacgtgccaaccagcgtggagtagacatgaatggatcaaggtttgatgtactgggaggaagtccatgtagtcagacaattgctctacccagtggctctggggatagttaggagacctagacactgggaggacagtagcaatccataaaatgagctgtcccttacttaggaagcagttttttcataaataaggagtttggggcaaaggatatgcagtgaacctggtaaaaaaaatagcaccaacagctgagttcaggggccactcataggaccaagaatgagatgtgtttcagaatcattaaaactgaccaaagcaagtctccacgtcgtgagtttgagggatccaagttactgttcaggtaaaaaaggcaaaagtagatgccaagggatatggtttggctctgtgtccccacccaaatcccatcttgaattgtaatccccatgtgtcgaggccaatgacctgt

SEQ ID NO: 203881 - DNA, 495 bp, Homo sapiens
tgtgcgttgattgtttactaaggattattataagggcctgaaggtgtgggagtagagacagtttcaccatgttggctaggctgaactcgaattcctggcctccagtgatcatcccaccttggccttgcaaagtgctgggattacaggtgtgagccactgcctagcccagtgatccttgttctgaattactactgttatattcagaaaaaattaagttttagtgtcattttgttgaaaatgctgcagttatgtcaggctgttgtgtgttagagtacacgattgggaagtttaaatttttattctaggagatggcaaagaaagcgcaagcgccactttaaaatgacgatgaaagctttttaatttgatagaggtctttttattggcatggtacacatgcacttccactcatttgtattgatgggagtgatccctttaaccctaggttagctagagaagagaagtgtgtattaaaagaagtggttttttttttgtgat

SEQ ID NO: 203882 - DNA, 537 bp, Homo sapiens
ggaaaaggaatatttggtttgctgatcatctcattacagttgttccgttgtgtgtgctttgctggtttccgtgtgaaaatagtctagaatttgtgcatgactgaagacttttcagcagcagaaatttcatgccatagatattttttatcaaaactgttttacacttcttgttcatattacaaatagatgacaagcagctgagaccgtatctacccactccaatgagcaataatttgcaatcaagctgtctctaaacttgctctttcttaggtttataaatagtatgttctgtgaaagtattagaagtaaataataaagaaacaaatttaattcattgtgatggcatcttctaaaacataagtaatattgatttgggatttgtgaagatattaagcagtaatgaaacttgaattctccatactgggcagtcttttgattagcagaaaaatatggtcatgactttagagtttctccccaaagctcttaatcgtatcatttccacccttcattgtctcttattctttaacacttacactt

SEQ ID NO: 203883 - DNA, 212 bp, Homo sapiens
gcatcttcatcacaaaccaattccagatatgcagaggcttcttccctccctcatttacctgttttgtagccaaactgggtctcttgtgctctccttacctacctacccaatgtaactcctgagagaaactagcatagccacaaaagcaagggtgttcatccaggagattggaatctggaaagacaatttcttattttctgtgtaaaacttaa

SEQ ID NO: 203884 - DNA, 391 bp, Homo sapiens
aaatagagttacatagaggataagcaacatcgtttcttagcagtaaaggtgtccttctggagagatagagcgtgccattattctggcttgatattaacaggtcaggccaggtgcggtggctcacgcctgtaatcccagcactttgagaggctgaggcaggtggattacctgagttcaggagttcgagacctgcctggccaacatggagaaacgccatctctactaaaaatacaaaattagccgggtgtggtggcgcatgcctgtaatcccagctactcgggaggctgagacaagataatcgcttgaacccaggaggtggaggttgcagtgagctgagatcctgcgctgcactccagcctgggcaacaagagtgaaactccatctcaaaaaa

SEQ ID NO: 203885 - DNA, 590 bp, Homo sapiens
ttacaggtgaggaaactaaggcacagttagggtcttttttgtgtgttttttctcttatttatttctttaactgcccaagaccaccctgctttataaacactaatcaaatgagtatgaggctctatcactcttttttttttttttaaacttgaatacatggcttttaggccgttcagtttctgacaaattaaaaaatgttttaaccccttttcttcttatagtaaaatagttcatagtgtaacagcttttcttagcaacacctttattctgtacccaggtatagtgtttcagtgtgcacccttgcttgtaaacagcttcttaatcttttctaagcccacaggtatagaaaacaccaaattagaaatgtcaaaacatatttatattgggcagtggtacaatttgacttatttgtgttttggaagcttaaaatgggggaaacaagaatatgtgtctatttattttggcttaatgaattatgtgtttctccagaattagctgtagcatcagagtagctgtaatatttgaaacagctcttcagaacttcagtcagtgtaaggaaggtttggttactgttaatgaatcaagttgga

SEQ ID NO: 203886 - DNA, 113 bp, Homo sapiens
atatggacgacaggctcctggagggaagcagctccctggtgtcagccagctagctacaaagcagcaaagccaagactcaggcccaggagcaaacacaagaccaggaccttact

SEQ ID NO: 203887 - DNA, 301 bp, Homo sapiens
aaagcaagcagaagaaataagagcagaaatcaataaaattaaaaaaaaaaataccgaattcaaagcgtggcacagtttgaaaaagaggcaataaaactgatacatttctctttgaccagaacgaaaagacacaaattataaatatcaacaatgaagggacagccaaaaagacagtaaaaggaaaggaaatttttttttttttcagactggagtgcagtggtgcaatctggacttactgcaagctccgcctcccaggttcacgccattctcctgcctcggcctcctgagtagctaggactac

SEQ ID NO: 203888 - DNA, 962 bp, Homo sapiens
ccttccccttcccatcttctcttgaagttacctagattgcgtctattatttgaatgactcgtacaaaagagatgctatttatcgggcaaaagccgggagttcgtgccctctacgcccgcaaggaaaactacaactcccatgaggacacgggtgagattgaggccgggctccgcctccttctccctggagcttggtggacgccttcccagtgccacgtggcggggagctgatctgatcgcgggcgtgacgacggcccgcacggctagctgcttggcccgcgggcctgggcagccctggagcgggaaacgcctccgtgagaacgcatggcttcaagcttctcccttgcgctcctgatcttaggctgatcgcttttacctttaggttgaagttgaacacagttcacactgtgctcttcctccccctctttctggaattccaggcaacagatttaacactttatgaatcttgaagagctgcactcctcctaaatattgcagttaatgctgatcctttggaagcctccgaaggccacaaggctgtgatgggagcctctggcttcagttgcctttctcacaccttattttaatactcaaggtaaacccttctgtacaactttagaaataactgtcaacctaaaggaaaaacggaggcaaagttaatataaatagagaatttatttgggccaagtctcaagaatgcaaactgggagcatcacttcaagttacccttaatttaatacatgatcttagcagcagtttcaagtgagttctttgttttgttggccaggaagcttgaactcttgtctcaaaggaattgatccttccatctctgcctcccaaagtactgggattacaggtgtgggcgactgcacccggctacaagtgaatttttaaaggaaaaaaaaagaagaggcccttgctaaattgtattccaagaatttacattaaaataacaacctatcc

SEQ ID NO: 203889 - DNA, 387 bp, Homo sapiens
ggacttgcgtgtggtttacaccccccaccccttagaacattgtagtcaaactaggatgtattaaattggcacatgaggactgctaaaaaaaattgtagaggaggtccactcctgagagggagtatttctagtctcagaactgccagttaggggtttgagaccttggacaggtctctcatctctgcaagcctctacaaaatgggagaacacctagattgcaggactagctgagatgagagacctgtccaaggtctcaaacccctaacaggcagatcacttgagctcagaaatcccaaccctgcagctacaggagataggggtctcttctaaggaagtcacagcagtttttatgcagagcttgagctggtaatttgaaaccttgagctc

SEQ ID NO: 203890 - DNA, 234 bp, Homo sapiens
atccttgttaagtgctgaaatctgtttgtacagagttgtgcatccatcatcataaccaggtcatacatttttggcagtaagaccacagaaattaggctggactctcagcagtgcaccacatcaggaggtgtatggctgtcctgtctcacttctggtggtgataaccctggtcacccagttacattggtgtcctccaagcatctctagcacagagaccctgttttctccccttgt

SEQ ID NO: 203891 - DNA, 376 bp, Homo sapiens
tgtcggtgtgtgtgatgtcagtgtgttgtgtgtgggttgatatgtgtatgtgtgatgttggtgtgttgtgtgtgcatttatgtgtgtgtggtgtctgtgtgtgtgatgtcagtgtgttgtgtgtgggtgtatatttgtgcatcatgtcagtgtgtgtgatgtcagtgtgttgtgtgtgggtttatgtgtgtgtctgattttggtgtgttgtgtatgggtttatgtgtgtgtggtgactgtgtgtgatgttggtgtgttgtgtgggtttatgtgtgtggtgtctgtgtgtatgatgtcagtgtgttgtgtaggtttatgtgtatgtgatgttggtgtgtgtaatgtcagtgtgttgtgtgtgggtttatatgtgttt

SEQ ID NO: 203892 - DNA, 310 bp, Homo sapiens
ctgtctctaagcagattataattaaccaacaagggttggcctgagctctctgtggggactgggtggatacctgtcatacataagtgcttttgctttaatgggtcagcttaaagccctttctggctgtcctcccacccaagaggtaaaatggggtgatgtttgtgcccatgactacataggccattccttaccagccaagtggtctgggcagccacctgtgcttccacccgcatctggagccctcgggtggggtgtttccattttctccattccccttgacaccagcagatccaggcaggcccgtgttctg

SEQ ID NO: 203893 - DNA, 174 bp, Homo sapiens
gtgtccctttgcagcaccacctaaaaaagatccccatcttcccaggggtgctccccttggccagcctctccggacagcctccactccccaacacaaagtactaagagggtaggcacctcggcgccttgtccttgaccttctgactcttcctacagcgatcttaaaagggaaaca

SEQ ID NO: 203894 - DNA, 402 bp, Homo sapiens
attttggagttatcttaaaagctttcatttttccatcactcagtatcttaataagacacatagtcctctcaaacatctctaattcatcccttctctgcttacactaatacagacctagtatgggccctacttaccttctccttgaactactggtttccctgctttcagcttctcatttcaatccttgcaccaaaccagctagtcagcaatgtttctaaaacaaaaaatctaatgactctccctcagttaaatcatattggcacactaattcctattgaacaggacccaggcactcttatgtgtcatctgatgaggtacctagtacagtacctcacttataaagttaaatatactgtttattttattgacataaacatatctttttcccccaccaaagtgggc

SEQ ID NO: 203895 - DNA, 286 bp, Homo sapiens
gccggcccgtatctctacattacttagaggagaatgtatatctttataatattgggtcttctcatccaagggcatgacaggtctctccatatctttttaagttttcttcatataagccttgaacatttcttaagtttattccttggtagtttctttgttactgttaatttactttatttcttcattattatttttaactggttacattattttattagtttactattatatgccaaactattgattttacaaatacatttcatagtaagagctaatgttagagata

SEQ ID NO: 203896 - DNA, 222 bp, Homo sapiens
ggatatcagaaaatgttggggtgctgtctacgtctcctaaaaaggaacagttccgcaggctgctgaggaggttctaagagttgtccagctacagaaacacgatgttggatgactcctcagacctaagtatctgtgatatttagatgattcaataaaagacctatagatttggaaaaaaataaaaacaagtcacattgaaaatcacaaagcataagccatcta

SEQ ID NO: 203897 - DNA, 471 bp, Homo sapiens
atttcacctgtttctctgtatttttgtaacatgtctattagacaactcaaaattacatatgtgactcacgtttttccattggatagcattggtctggagcctcatttactccattatgcttgtggctgaacctagaataatctagtaatccttacttagaaatctatagtcatgttaaagagttttggtgacaacatcagtgtctgtcatcactagcactcgctgttctaaaccctttccatgtattagctcatttagttctcaaactgacactcacaaaaccctcctcctgcccccatgataggagacccatgtccttagtatcactgttgttatttaaattctaactggaaagaaactttaggttagactccattcacctgttatcatttagataaaagtgaaattgtacttgtaattttatctcaaaataaataaataatatgaataaaactcgaggaagtaacaatc

SEQ ID NO: 203898 - DNA, 242 bp, Homo sapiens
tcatgaaagccacgcacttccatcctttctgaaggtgcacatgtttttttgggggggtctttcttctttgtacaaggcagccatgtccttagtatcactgttgttatttaaattctaactggaaagaaactttaggttagactccattcacctgttatcatttagataaaagtgaaattgtacttgtaattttatctcaaaataaataaataatatgaataaaactcgaggaagtaacaatc

SEQ ID NO: 203899 - DNA, 569 bp, Homo sapiens
aagaaattggacactttttggcttcttttggttttcttgtaattgaaataaaaacaaaaacaaaaaaatggccagtgcagtggcttacacctgtagtcccagcactttgggaggccaaggtgggcggattgcctgagtccaggagtttgggaccagcctaggcaacatagcaaaaccccctctctaccaaaaatacaataaattatacgtgcatgggtggtgcacgcctgtggccccagcaactcaggaagctgaggtgggaggatcactggagtcctggaggggtggaggttgaactgagctgtgatcctgccactgtactccagcctgggttgcagagtgagacctgtttcaaaaaagataaaataaaaaaaggagaaatagttgatctgcatattctgtaaataaaatagctaaatagctgtctcttcatacatatatgtgtgtatatatacataagtgaatatatgcacacatgtgtaatttctttgaacatatttgttaagaattaggcatggaaaggacttcagcaacaattttttggggttatttactggggtggatctgct

SEQ ID NO: 203900 - DNA, 354 bp, Homo sapiens
ttgtcttgaaaagtagctgatttgtccagatgtggtggctcatgcccgcaatcacagcacttcgggaggcagaggcgggtgggacacaaggtcaggagtccaagaccagccctaccaacacggtgaaaccctgtctctactaaaaccacaaaaattagccgggtgtggtggtgcgcgcctgtaatcccaacactttgggaagctgagacaggcggatcacctgaggtcaggagttcgagatcagcctgaccaacatgatgaaaccccgtctctaccaaaaaacataataaataaataaacagtcctacaaatgtatgggtcaaaaacagtaagagttattcttcactcctgtaa

SEQ ID NO: 203901 - DNA, 410 bp, Homo sapiens
gaaactgactgataatcctaaaataagtgtttgagtacctcttcaaagtcatttagctcaaccgtttattttatgaaagtcttgagaggttaagtgggttattctttcagaaaagcaagggcacattaaggctgttggtgtagatttaatcaaacttcctaacagaaaaaaatacaatgtgtcaaaactagatggttttgcatccataaatattaatactatgtacaccaaaatattttttattctggtattttacatttttgtcataaagaggcaagggttggtctgtgcttagtccagtctctctcccttgctggcaagaaatgtgagcttgtgtcattgtgagaggctcctccccagagccctggcctgcatctgtatcactctggggcttagaggcaatgggccta

SEQ ID NO: 203902 - DNA, 644 bp, Homo sapiens
aggagaaatggcatgggggccaagtcatgatgaccacacagcaagcctgtgagtgatgttattatgggagtaaccaccaggtccaagtcactcccagcccctggtgtaagcatcaaggtggaggctaaaatgaaaaccaatcgaggctgcatcctatctcaaggattaggtgatatttggcaccagaagctggagtactctgggtgaaccatccagatttttctgccaagggaagggaagttgttgagtgatttgggagcctagagaatgccctctgtgggaggagagggagacaacgattgtgtttctttcactggagaccttatctccaccctccagcagcctggagaactagcagaaagtcatcctgctttcacttgctctgagcattgcaaaagttttcatagtttccagaagcttactttcccttcagcactttttaaaacctacttaccaattttatggactacttatttgacgttgtatgtgatttacaatgtgaaaaatcccaactggtctactttatgaccaggaagacggtcctactgagctttggaattgctgtacctgttctttgagctataatatatagctcaggtattttggggatattgcatccaaatctaaaatgtaagctgaaagaa

SEQ ID NO: 203903 - DNA, 333 bp, Homo sapiens
ctgtttccgtaggcttatcattttcttcttccggtagtggattttggctttctctttcctcttctcctccagggtggctgtcactgcgtggtacttccagccaacctcgtgagccaggtgccccagataggcaaactttcttgtaggcttcagacgcacaaccttgagggcagcaggaaccaccatccgctttttcttgtcgtaaggcggtgggatgcagtcaaacaccttgaggcggtccagagcggcctggcctcgcttggtcttgtggggcagcatacttcgcacagtcagccagaagatggggctgggggcccggaagaagaaaatgat

SEQ ID NO: 203904 - DNA, 514 bp, Homo sapiens
gaatcgagccggtaccgggtcgaggagaagctccagtatgaattatcttatgtgtagtaagatttgaagatcgattaaaacctttgccgcattcttcacatttgtagagtttctctccaacatgaattattttatgtgtagtaagagttgagagttgcttaaaagctttgccacattctaagcatttgtagcgtttctctccagtatgaattatcttatgtgtagtaagggttgaggactggctaaaagctttgccacattcttcacatttgtagggtttctctccagtgtgcatcctcttatgtctagttagggttgaggaccatataaatgctttgccacattcttcacacttgtagggtttctttctagtatgaattttcttatgctcagtaagggttgaggaccagataaatgctttgccacattcttcacacttgtaaggtttctctccagtatgaattatcttatgtgtagtaagatttgaggatcgattaaaagcttcaccacattc

SEQ ID NO: 203905 - DNA, 483 bp, Homo sapiens
gctctccagggcagctgtcctccatgcaatgatccagcaattcatacagctttagcctgttgctctaccaactccacaccagacctggttctttgacaaagagaatgagaagctcagatgctgtggagagacttttcgcggctttggcctgaaagtgacacatattgcttctgctcccgtttcctgggccagaagttgttatatggctctgcctaactgcaagcgtctgggaagcatagtctcccatctgcccagaaagaagaagagagctggatattgctgaacactggtaatggcatgttgtccaatcatgcttcccagaaaccggcatagtccaaatggtctgtgctccaagtgaacagaaaaaaaccctaagtctgctgccacctatacaaactaacaaagcaaaacacctcccattgtgatttctcatttctatagagtgttgaagtttccctaaataaattgtccctttcatagaat

SEQ ID NO: 203906 - DNA, 377 bp, Homo sapiens
attgcttatgtctagatttgatttgaaggtagtccttttactaccataggtggcaaagagctccaaatgtccacttgcagattctacaaaaagagggtttccaaacttctcaatctaaagaatggttcagctctgtgggatgaacacacacataacatagaagttgctcagaatacttctttctagtttttttgtgaagatatttcattttccacaataggcctcaaggcactccaaatgaccaattgcaagttatacaaaaagattattacaaaactggtccatcaatagaaatgttcaactctgggaaatgaatacacgtatcaccaagaggttgttcagaatgcttctatctagtttttatgtgaatatatttt

SEQ ID NO: 203907 - DNA, 417 bp, Homo sapiens
gagacagagtttggtctgttgcccaggctggaatgcagtggcacgatctcggctcactgcactccagcctgggtgacacagtgagaccctgtctcaaaaaaggaaaagaaaaaaagaagtggaatcatacagtatttttccttctgtgtctagcttctctctcttagcatgttatgtcacctatcagaacttcattcctttttccaagaacattccattgtatgtatatactgtgttttatttatccattcttcttttgatggacatttggtttgcttcccccttgtagctcctgtaaataatgttgctgtgaacaccgatgtagaagtatctgtttgagtccctcctacgcctatttgtaaagctgctctaactcctttttgaaacaagtgggagcagaaataagtgtttactcat

SEQ ID NO: 203908 - DNA, 466 bp, Homo sapiens
gctattgaactgaaccattagttctaatttcaaatatagtactttctgttctaaagtggttaagtcttcataataaattcaaattatcctgaaattatgtatcccttcatctattttgtccatctttttctcttttttcttgaacatatgattcatagttattttaaagttattgtctgctaactccaatatctgactcacctgctggcctgcttttattgccttatttatgattcacatgatcttgcttcttagcatgtctcataattctttactgcatgctaaacactatagagtccttatataatgttattacctacctataaaaaagacaaaaaagggctccctttgtactctggtaagcaggtaaggagggagctcatcatccaatgagggatggcgctaggttgggttgtcattttttaggaccctgtctgcttttgccttaaccctgtttctttttttt

SEQ ID NO: 203909 - DNA, 338 bp, Homo sapiens
agactggtcccacctgaaagattaggaatataagcctcaaagaactcccagaaagatgagatctaaacacaaattgtctttttatgaaacatagagaaacggaagatgcgtttaaaatgtatgacgcattttgtaaaactataaagaagaatgatctgaaaggtagcctactggaagtcattagaaagaatcaatgtccaaagcaatgaaaaaataactcaatgttcatgcctatgcaataaagcagggaagagaccacttctttagccaaatgagaaggaaactgagaatagacctactgatggtattcaagttcatcaagagttgttattaagttg

SEQ ID NO: 203910 - DNA, 492 bp, Homo sapiens
attttgttatagcagcacaaaaggtctaagacaatgactgaaggacggagctataggactcaaaagaccctggtcttgaagccagaaagacctggctttgccagtagcatggtatttcaattaagtatgattaaacactcttcgagggaatagaaaggggaaggaagaatggagatggatcatttgtttcatgccttttacttacgtgtaaggaattatgagcaggtgcctatggattttggaatatgcttctctaacactataaaaattagaaagtgaaacttatagccacaaatgtccatttaaaatttctaatgacaatggaagaaattatttagactctctcctatactattacaccatacatcattgcaaaacattttttttcattttgcccaacctccactcctgtcattccaccactcctatagtatctaaaatatagtttcttttagagagattggtgcaccactcaacttgtcagcttgaggg

SEQ ID NO: 203911 - DNA, 273 bp, Homo sapiens
cctcaggccaagtcggccacctgtttttctatagcttgcgggctacctgccctaagaatggttttcacagttttaaatgcttacactttaaatggttatagaagtacctgtctttattcttggccattcaggtttccttttctgtgaatttcctatccataattttcttacgaatttgtagtagttctttataaatttattcattcatccaacagatatttattaagtacctctgtcatgtggcagcgctgtaaataaagtgaacaaaacatt

SEQ ID NO: 203912 - DNA, 137 bp, Homo sapiens
tcccaaggtataagaccaaactacctgattctgaagcagtaacataaagaataaagtgaatacatagtgtcttataaataggtcgcagataccatggaaagagagtctgaaaatgagagatgaatgttccttccaca

SEQ ID NO: 203913 - DNA, 750 bp, Homo sapiens
gaactaactcttttaacctcattcaatgagctaatatgtgtaaaacacctggcgtataggatgcactcaataaatgctaattcttctcctcccccctctattaagagctgacaaaatcattcaggacaaagtataaatgactaattccattaaggtgttgtattttcaggctgaatttgcattttaatgagacaaggtgttttaatccaagggaatgaatcatattagtggaattgcaagctactgttgagtaaatgacatgggggattttagtctgttttttggtttgtttgttttttaaagaggtatccattgattctgtttagggaaggggggtcaaagtgtggaagcctcctgtcacccttgaaatgacttccacattcatgaaacaaatctagactgagtgcctcatttgaatcaggtcttgaagatacagcagaaaaccagctaacttggtccttcccattgctggacttagagcctagtgaggaggacaagaaggaaacgcctcacaataagatcaggtgctgtcgggcagggaatgagaggaacttcgggaactgcgggttgggggaagggctgcctaatctaacagaagtgttgttaagacctaaaccaggttgtcaaccctgcattttctcgtatcgattgatttcaaatcctgatgcctgggtcccacccccgagactctggggtattttctgtgcatcaggattcttaaaagctcccccaaatgattctgatgggcag

SEQ ID NO: 203914 - DNA, 571 bp, Homo sapiens
agtcaattatatccagattatttattgtttttctctcttttggatgcagtccttagcatacttgactattgcactttggtattgttttctgggaacacttagggcttttaaatttttttaactttttatttattttttagtaaaaataaactgttttccctaaagttccagtttccctctgagtgtaactggtgatgggatgctggcctagaatataagtggacattgaccttagagactatgcctactgtgtacagatgatgttccttaaaggtatataattcaaaatattttaaatgagccaaggaggttaattcagatgcttgcatttggtctttcttaaagcacctttatataaacaagaagggctataaatacacatgattttcaagtgtctgcatatcttgtgcagccttctggtaatgttcaggtaaaatataatgccttccctaaagattatttttaaatttttctttctattccttttcaacccctcactctcatagcccaagctgcattttatgctgtatgacagagttacaaataaattggcttattcttggattacaca

SEQ ID NO: 203915 - DNA, 447 bp, Homo sapiens
cagcaggcaaaagagagaatgagagccaagcaaaaggggcttccccttataaaaccatcagaaccagccccatgatttaattatctcacactgggttcctcccacaacatgtgggaattatgggagctacaattcaagaagagatttgggtggagacacagccaaaccgtttcacactccaatctcccagactttggggaaatgttcatgtgtgcggagggtcttttcaaccttccagctctgccttccagcaagttaaacactttcctttacaaagatgaaagagaaagaggaagctcttgccatgtaagtaacacaaagctaacagtttcatggaccacaaatgcatttttatctataaaaggaaaaataattttaattgcctttatgttctagaaaagcagcactatttctaattggtacattgagcaattatgtttaaactag

SEQ ID NO: 203916 - DNA, 214 bp, Homo sapiens
caggcgcgtgccactatgcctggctagtttttatattttcagttgggacgggatttcaccatgttggccaggatggtctcgatctcctggcctcgtgatccaccgcccttggcctcccaaagtgctgggattacaggcgtgagtcaccatgcctggcctgtcacttaccttaaatgttgtttatacccaaggtgataatcaaaatatctaatga

SEQ ID NO: 203917 - DNA, 155 bp, Homo sapiens
aagaactcttaaaactcaacaacaaccaaaaatacccaatgacaaaaatgggcataattttgaatatctatttctccaaagatatggccaagcagcatatgaaaagatattcagcaacattagtcattaggaaaatgccaatcaacataatttat

SEQ ID NO: 203918 - DNA, 154 bp, Homo sapiens
tatgtacccaataatgagattgatggatcatatggtagttctgttttaaatggtgttgagacaactggatattcacatataaaagaatgaaattagactcttatttcatatgcaaaaatcaactcaaaatggattaaagagttaaatgtgagat

SEQ ID NO: 203919 - DNA, 741 bp, Homo sapiens
cagagtcttgctctgttgccaggctggagtgcagtggtgcaatgttggctcactgcaaccgccgcctcccagttcaagcaatttttctgcctcagcgtcccgagtagctgggactacaggtgtgtgccaccatgcccagctaatttttttttatttttagtagagacgaggtttcaccatgttggccaggatggtctccatctcctgacttcgtgattcccccgccttgacctcccaaagtgctgggattacagccgtgagccactgtgcccggcctggccttggagattgttagtaggaaaattcatatcccccacttctcatgtctgcatatgctaggactgcaactggaatatttttgagcgctttaaaggccctacttccaaatatggtcataatggggggtcagaacttcaacatgttaatttgggtgggtgagaggcacaatttagtttgtaatatctactatcccacagatgtaaacgacacacaccaaacattcatctatatctccctcagttctgaactaggtagcaaatgaaaataacatttttcaggacaccaagacccttcacatagaccaaggtaaggcatatgaatttaattccaaatacaataagaaaatttcagagtttaagcagaaaagtaacacaatctgatttataaggattactctggccattgcatagaacatctgttttaaattactaagtctttttcaagcctatgtgacaagattct

SEQ ID NO: 203920 - DNA, 429 bp, Homo sapiens
ccacggagtaagaaccagaacgccagctgccccagcggcgctcgcaccatccacccttgaaattgccgtagaagagacagaaactgaaaaccatggtttcaggctgctaaaaacctaacatgaaacaaaacagaagaacaacaacaacaaaataaggttgctgaccagaactcaacagtgagggaatttacctcctgcttcatgcatgcaacatcaaaatagaagagtgacctatgggatccatggaggagctgcttcctgaatctgtgtaaagtagatcttgccgtgtgggtaactgtgactgcggtggccatgaagaggcacaactcagacctcggatctcctgctgcagagaacattgactgacagcccagcagctcctgtctggatctaccacctgttcacagtgaggccaacatcccccaggct

SEQ ID NO: 203921 - DNA, 354 bp, Homo sapiens
aactaacattctgaaagggatatgagtgatgtcattgaaaatgggaagctaggaagaaaaatcgatcagcttttcccaaaatggttcacatttcataaaacctttctgatgagctcaaggagggacgctatcagataacacaagagaaggaaacagaagttgtgtgcctgatgataaatcaacatagtagatataatgacctgtaactatgccaggtagacctaaccttattctctccctctcccttccaacgcccccacctcggctccctcttgttttgttttctctttccatcgccttctctttctccattttcttctctccctttgccattcacagtgtcttcctttcctt

SEQ ID NO: 203922 - DNA, 177 bp, Homo sapiens
agatgctgcatggctggtctcagtgttcattccgaacccccacactccagcgtgagtaccaaatggtcatgagcattgacggagcacacagtgtaccctgagttctaaagacgcaggactgtgtctgagctgccataacagaataccatatcaggtagctgacaaaaaaaaacaaaa

SEQ ID NO: 203923 - DNA, 372 bp, Homo sapiens
gtcgatccagaggatccctttgcgaaggaattgaccttatgcctcccacatctcaactcacatttgatggaatgaacaacaacaaaaaattattgagagaggcaaaagaaaccagatgttaaaaatcatggtgtgatttaggtataaatccgcgagaaggagatatactgctgggtttagatataaacctattagaagcactttttatttcaagcaggtgtgcaaagaaaaagtgctgacctgaattctgtgctctctaactaatggaataatctgcaggatgtaattagtaatggattaattaactaaggttgtttagttcatatacaacttaagagaacaatttaatctctttgtggtcaaatgttaaat

SEQ ID NO: 203924 - DNA, 233 bp, Homo sapiens
agaattcacagataggtgaggagggaatagtccttcacaggactacaaactctttgtgaatggaacagaagagaaggattttgaaaaattaactataatacttaatgggtacatttttaatgttaatgtgtgtgtgtgtgtttgtgtgttccagtatcctcagttgtaatttccctattccatgcaaattttaggacaaagatgaaacatacatgcatatgatattttgtaaa

SEQ ID NO: 203925 - DNA, 219 bp, Homo sapiens
cattgtacaaagtaagtccttccaccctagcatctataatcatgtttgtcttctcctagagattatgagttacctaagggcaagaaccttcttatccttttgcttaacacagggtttgatacctggtaggcataacttctcttaaaggtaataattcctttcctattgatccaatctcaaacctcatgtgctccctctgcctcttgtgctggagccagt

SEQ ID NO: 203926 - DNA, 344 bp, Homo sapiens
ggatcaggatgtggacacccccaaactggaccgtcaggccggggagagcctcaaggccaagtacctcatgccgccctttgtcacaatgacctccccgtcccacttcaccgccatcccggctaagcaccactctgcccatttcacccgatgcccatcaaagccccagcacccatcattcctggaataagaagcagacctcagtcagctctagggaggctgaggcggctccagggtctcactctgttgcccaggctgtagctcaatgggatagtcacagctcagtggagcctcaaactcctggtctcaagcagtcctgcctactacaggctccccagtaactgggg

SEQ ID NO: 203927 - DNA, 364 bp, Homo sapiens
cgccccctcggtccaggattaaaaagttgattcaggtggacaaggttggggtcacactggcccaactaaagtcatgtcacctctctcacatcgtagcattcttttatccttgttttacactcttaagagatagcataaagaagaaaatcaaaacccagaaaaggtttgctgtaattactccaataatttccttcagtgaaaatctcttatcactatgattttagtgacagaggaacaagcagagctctgacgtggggctgagtgcccactactaaagggcagaggctgccgccaggccaccaaggcccatctggccaggcaaggccacccagagccctcacgtttactccaaacggccattctt

SEQ ID NO: 203928 - DNA, 898 bp, Homo sapiens
tgaggaggctaaagtgggaggatcacttgagtccaggagtttgaggctacagtgagccatgatcgtaccactgcactccagcctccagacaacagagagagcccctgtctctaagaaaaaagaagaagaaaagaagatttcaaatttttctgttcagtggtttcttctctttaaaaacagaatgttatagggctcactggaattatataacatgttctcgtagatgtttaccaacttgttctgaattctgttgatgtattcagtcatatttcaaaatcagatttaaaataaaagtttttcatgcaattatgttgctttttaaataagatacactgaatatacattaaacactataaattaaaagatatagtttttatgatcagccccgccagttggtcaagacttcataaatgtgacttggcaaacttttgaacgtgaattttacatgcagtgcaactcaagcagaatgtataatttgttctggagacttggactgttttctggggttttaattgaaccagtgaaaggaatgtaactgttttgaatattgtggtttgagattaaacagagcattttaaaactagttaccattttttaatatgcaataagtggtttccctctcatttagctcatagacagggttagacactagaaagtaattatttgctttgactacttagcacattcttcattatcaaatgcatatattaataggcaaataaaatcagaaagcatacttttagttctaccataaatagtatcttggccctggccaggcacggtggctgacacctgcaatcccagtactttgggacgccaaggtgggcggatcacctgaggtcaggaattcgagaccagcctggccaacatggtgaaaccccgtctctactaaaataca

SEQ ID NO: 203929 - DNA, 533 bp, Homo sapiens
aggctagagtttagtggtgcattcatagatcactgtaacctcaaattcctaggctcaagtgatctccttccttagcctcccgagtcactacgactgcaggtgtgtgtcaccacgcctgcctgatttttaaatcttttgtagagatggggttttgctatgttgcctaggctggtctcaaacttttggcctcaagtgatcctcccatccctgcctcccaaagcactgggattgtaggtgtgagctaccaccccccagcctattccaagatttttaacctgaccatctgtaaagatggagttgccatttacagagatgggaaaattgtggaaggagctgacttggagggaaaattaagggtttggttttcgacatgtcaggtttgaaatatgttttgtagcaaattcagatgtcaaggaagagatggaaatatgagcagaagttcagagagattgagagagacagaaatctaggctaagatttgggaatgggcagagagagagaacagtatgccagaagccaagcaaaaaaaaaaa

SEQ ID NO: 203930 - DNA, 378 bp, Homo sapiens
cggcacgaggtgcctgcagtcccagctacttcagaggctgatcctcccatccctgcctcccaaagcactgggattgtaggtgtgagctaccaccccccagcctattccaagatttttaacctgaccatctgtaaagatggagttgccatttacagagatgggaaaattgtggaaggagctgacttggagggaaaattaagggtttggttttcgacatgtcaggtttgaaatatgttttgtagcaaattcagatgtcaaggaagagatggaaatatgagcagaagttcagagagattgagagagacagaaatctaggctaagatttgggaatgggcagagagagagaacagtatgccagaagccaagcaaaaaaaaaaa

SEQ ID NO: 203931 - DNA, 449 bp, Homo sapiens
tggcctgcctatgagaacggctcatgatctctatttcttctgcttaatgaccatctcgaagtaacaagtttagcctaaaataaacttgctaagttagcaaaggaagtccttagcagccaccatttctcgattcctccatcacctcccctgcccctcaactccctcatttctcccaagatatgggctccaggctgggcgcggtggctcacgcctataatcctagcactttgggaggctgaggtgagcagatcactgaggtcaggagttcgagaccagcctggccaacatggtgaaaccccgtctctactaaaactacaaaaattagtcaggcatggtgcacgcctgtaatcccagctactcaggaggctgaggcaggagaaccacttgaacctgggagtcagaggttgcagtgagctgagatcacgccactgcactccagcctggggaca

SEQ ID NO: 203932 - DNA, 371 bp, Homo sapiens
ttttttagagctatcatgagcttgtgtgaggaggttgattaaaaggagtgtcctcataggtcacgcatgcagccccatgacttggccatatctcaccttgtcagagctctatgcagatatttattctcaaatggatctgttagtgaattctattccatggtcaaatctttagcttgcagaagccatgttgaaggtaattcaacatgtgtggtcagcagtctcacctatgatgatgacccagattttcactgggtgtgatactggacacattcctttgttttttttttggttttttttttgagacagagtctcgctctgttgcccaggttggagagcaggggttcaatcttgtctgggcaccgagctcgaat

SEQ ID NO: 203933 - DNA, 449 bp, Homo sapiens
aagggcactgctggtcaggatgcccgtgcagagcgcccacctgggagtggggctattcccggggtgccgcccgccctgtgcttttacttccttgacccttcccctcctgaagctgggttccagccgtgaggttgacaaacttttgagtctcatcatcttctcccaggccttcaagggaaaccactaccctggagaacaagggcactgtggcttctgcttcagagaggtactgagagggtccaaactgcagctgtgtgactctgagcaggttactcaacccctctgggccagagtttcttcaccttcaacatagagaagaccaaagtacttatgccttctggaggtaccgggtggttcaggcaagtgcctggcacacaggaagcactgtctgagcgtcagctaggactgtcattttctcagagcaaactcaacccagcaggtacccgctg

SEQ ID NO: 203934 - DNA, 419 bp, Homo sapiens
aagaacatcagataagacaaggcttgagctgaccacagaaagaacagctagagatgggaaggagaatttcagaaaggggacctgcatgtacaaaaagtactgagacatgaaataataacatatattcagggaactgcctataatcttacatataagcacagggctacattaatgatgaaagaagaaataacaggataacccagtaatgacagtgacttaactgcctggagagtcaccagccacaggccaaattcttttctgccttgggaccattacacaccctcttcccttacctggagtattctcccggctaatgttcacttgtccttcagatttcagtacacatgtcacttccacagaggggcctttcttaccattccataccacaatagatttatcttggtattctctctcatagc

SEQ ID NO: 203935 - DNA, 580 bp, Homo sapiens
actgtagagcagttactaaaatccagcatggttctaaaaatcttagggtttagagtttagtcttgtatatgagagacatttctggtaactctttgtctattaaggtaaaggcttgcaggaatgtagttaaagaattagtggtcttcataatatataaaatatttcaactcaacagctggcctatactgatacatcagttgacaaagtcttcaagactgttttcaatacatttggctaacctgattttggtgtgtctcaaatgcatgtatttagtttctttctgtgtttcagtaagaattcctttatctcagaatagagtagttcctgtctttcatgtccgcccagagcctctgggaacagacacctcagtaggagggcctgaagaatgacacatttctgttgatgctttggtagagtctgaaatgtaggatagggagagactgtgaaataagattgctgggctttgatttcctattattggccagacttacccaccctttttccttggaataccttttcttccctgtctgctccattgatcgtagtcttaccccagatccccaaaccccagctcctgtag

SEQ ID NO: 203936 - DNA, 445 bp, Homo sapiens
aaagaatccaagcaaggatcatacatttaatttagttgtcagaatattttctatcttaagctggaaggcagctacacaggtgttgttattctttgtgcctctttgtatttcactattttaagtaatttttaaagaactactttcactcacaagtgtgaatcaattcaactcttatttacagaagtgaatcaccaggaacagtagccaatccccacatcctttctacctggcttcgggatgtaactcatcactgacatctgaaggcaggtgtgttcccaggtcctagaaactgactctgtcctgattgcagttgaacacattttggggacacctccctgactggccccaacctgtccagctagactcctcctgtcctctggaggtcatcaaagactgaggttgcaaagggcttctctgtttgcagagtaaacagagggggttgtga

SEQ ID NO: 203937 - DNA, 500 bp, Homo sapiens
gtgaaatgacagtcctacgctgccctatcctgtaagattaaacagagaagagttgcctctcaattattcaccccaaatatacagacaatgcaacaatatttcacagtaaattttgactatttgtggctctgcccctatttgtgctcaaaattgtaattcaataattattaatattatttatttatattttgtgctacttctcttaactgtgtttatgtcttaaccacatagacccttgttttccctactatatacacagtttttggccagcagctctcgtccaatgaaagagctcaagaaaatgtcttttttaaataacagaagacatgttgaagaaaaaaaaaacaactggaagattattttattctgaaacacagtcttgctcggtcacccaggatggagtgcagcctgtaatctcttcactgcaaccttcgcatcccgggtttaagcgattctcctacctcagcctcccgagtagctgggattacaagcgcgccacc

SEQ ID NO: 203938 - DNA, 467 bp, Homo sapiens
cagggcactgatgacaccattgatgttctcttcggggacaagtgcatgatcaaacttgaaagtactgtattagttttttcagaataataactaaatatgagagtgacccctaaagaatcatttggcaaacttgggtatcaaggctactgctaagtacatcgtcaacgaaaaatcacccgtgatgacattgcccatactaaatgttaagggtcataattatcactttattttgaattccaggagagtttaagaattgttgacatccagccaggcatggtggctcacacctgtaatccccgagctttcagaggcctaggcaggaggcttgcttaaggccaggtgttcaaaaccagcctggagacaacatagcaagatcctgtctctaaaaaaaatttaaaaatcagccaggcatggtgtacttgtagtcctagctactcaggaggctgaggcaggaggattggttgagc

SEQ ID NO: 203939 - DNA, 349 bp, Homo sapiens
cctcctatctggattttcaagtttcttttttgtttgtttgtttttggatgtttctgtttgctctgtctctttctttggaaagtacttgtaggatcagctgtttttgaagacgttagaaaatacagacaagaacattttcctcactttttaaaatggattaacatatggaggaagtgggataattttgattttgtcttagtcaaaatagcctattttaaatattttgttggctgggcatggtggctcacgcctgtaatcccagcacattgggaggctgaggcaggatcatggctggaagccaggagttagagaacagactgggcaacataacgagactcccattgccaca

SEQ ID NO: 203940 - DNA, 519 bp, Homo sapiens
attgaatgctacttgaaagaaaattattgatctataccacacataagagttttgaaatcttcccatcagagtatattgcacctttagcataaaaaaggctctgatttattttactttatttttttgcaaatagctgctttatagttctttaagttcaattcaatattactctttgttaaactttaaaaaagtcttcattactttcctttgttaaaccatttctgcattcttcagataatccaggatggtttcagtaattaaaataatttagcttcatcactgttcaacataatcactgttaagcatgttaattcagatactgatccttaacatttttgactgttatgatggaggcctggccacagacgtaccttgtgcatgtttttaaaaaacctaacctgttaataatctactccaggttctaccagtaacccaggggatatttgttttcttttgtggcttcttccaaggaatcatatcaaattcctttggaaaacttgtattatttgcatccatcgt

SEQ ID NO: 203941 - DNA, 344 bp, Homo sapiens
agcaggcagaggttactgctgaatctgtctgtcatgagccttcagaaggctgagtgaactgacttagcaccgggcacagcggtggatgctgacttttccagggaggaatgtggggttggagtttggtctcaggcctggagtactccttgaagtggtttctcttgtctcagtgatgtgagttcttctttaacttgtgattctcaaatgacggtgatcactgggaaagttggtacctgagcaagtcacatggtgtctagaggtgccaccacattccacaatagcgctttgtggggggatcacgcagtgggatcaggtgactggggcaggaggcgttgccagtgcca

SEQ ID NO: 203942 - DNA, 598 bp, Homo sapiens
ggttgaagtgatgacaaagaaagaaaccatggtccctttcctacaagtctagaagaaagaactttagggaagaaaacagtcacataaccgtatgggtagagatatattacaaatgcttcagaagcacagaagagggaagtaataacttggtcagtggaggtacttttcagctgtgtttactgtagagattataaaatatttatttttattaaatggagccagcaattttattactcatttggacatattttaaggtatacctcaaagatatttttaattttttaaccatatgagatatgtctaataaacatggcaataaggtccaatggcattcggccttttacatgtattgtgccaaataaagacaccaagattttaccaggctccttattcttgaggttatttctgctagtcaggagtagagtcaaatgagctctttgtaaatcactgtgtcagatttatagagaaaggaagcttgtaaaagtgtttcttgtggtcattaaatgccctttgttttctgcctagagcttgctatattgatggtctaaccaacatatccaagaaatttatggggttgtagttttgatctcactcagtg

SEQ ID NO: 203943 - DNA, 1001 bp, Homo sapiens
tggaccatatcttctggggagtttggtcatgaacatggtttcccatttgttgtggaccaaactgtgcccttccccttgaattcctgcgttgaagccctaactcccaatgcagctgtaattgaagatagggcttttagggaggtaattaaggttaaatgaagtcatagggcaggaccctaatctaataggattgatgtccttataagaagagggagagacaccagagatctctcctcccccctcacttgtaaacagaggaaaaatgaccggaggacacagcagggaggtgggtacaagccaggaagaggggcctcgccgggaactaaccctgacggcaccttgatccgggactttgggcctctcaaactgagaaatacatgtctgttgtttaagtcactccctccacagtaatctggatggcagcctgagcttaccaaggcaccgtctgcatcagccagggctctccagggagacagccaataggagatggatggatggatggatggctagatagacagacaagcggacagagagagagagagacaggcagacacagacagacaggcagacaaatggctagatagacaagcagacagagagatagagacagacagacacaaacaggcaaacagacaggcagacaaatggatagatagatgatagatagccaggcaggcagatagacacagacaggcagacagacagacagacagatgataggttgggttcagtgactcttacctgtaataaccagcacattggtaggctgaggccggtggatcacttgaggccaggagtttgagaccagcctggctaacagggtgaaaccccatctctactaaaaatagaaaaattagctgggcgtggtggtgcatgtctgtaatcccagccactcgggaggctgaggcacgagaatcacttgaacctgggaggtggaggttgcagtgagctgagatcacgccactgcactccagcctaggcgacaaagtgagactccatct

SEQ ID NO: 203944 - DNA, 394 bp, Homo sapiens
gtaagtcaagttagactaagctgaacctagaaaaaacgtagacacaatgatgcccatttaaaagcaatattaaaaaaaattaaacaatctagaagatcctcttgcagacttgatgcatagccataataataggcatctttccagtgtcatgaaagaggaacgtgctgcaccctataggctttggagacagacagctggagttagaaacagctctataatgctcggtgtgtgatcttgggtaggtatttagtgtcttgaggcatctgtttcttcatctgtaaaatgaagacaacagaagcacctcccacctgggaatattgacagtattgaatgagatgatgtcgtaaaacaatacggtgcctggtatataggaggagataaatacatattaact

SEQ ID NO: 203945 - DNA, 502 bp, Homo sapiens
cagaatgggttgctgtttttagcacaaaccatgcagggttgggtcacctcaaagcattttcttcagcctggcttgtactctataggggagttggtagtaggtgtggggaatctataggaacaatagagttagctatgagaactgacttcacaaaaagggaaatttcacacaccccaatttcagcttctaaagtgatatattttaaaagcttcatttgtatccttgtctgccagttacacagtatattactgttcaaacccagtagggtctgcaatcgaaaggtgctcttgcagcctgacattcacaaaccaaactggtcattctctttagtgtgattcagtaaaatctcagttaatgttttgggaaagggattctgatttatgacatttctgatttacaagggctttccttagaaaatacctttcggtttgatacttaccactggaaattggttcgatacttaccactggaaatctttataaaatatagtgatctgtttgct

SEQ ID NO: 203946 - DNA, 273 bp, Homo sapiens
agatgcctagaccccactccacagcgaatacatgaggaagtggtgtttttaaagcagttaattttttctaattaaaatcatatattaacattcaattacaaaaatatataacgtggccaggcgcagtggctcacgcctgtaatcccagaactttggaaggccaaggcgggcggatcggtggtataggctataccaccagtgttttgcttttcttatactgtaaaatggtgaaggtggggagtgttagtgatcagaagtggggtggtatagcct

SEQ ID NO: 203947 - DNA, 678 bp, Homo sapiens
tctgccatcagatatcaaggtacctgatgttagctgtaaacactgaaggtaaacaaattacctggggggaaaccattgccaaagggccatcccaagacacttctgctattcaattatgaaccttttaaacaatagattacatacactcaatataatttaggaaacttgcctgcctgtctcacaggtaaatccagctgttccgacatagtaatctggagcagcgttgagacaaaattcagagatttgtgtgcctacaaagaaaaaaagtccattttaaacttctgcaaataaatatactttaaaattacagatcaaagaggctccaatacatttccattgcttggcttgcacaaaaggctcttcataactggttccagtcttatttctcatcactcccttatattgaactttaaggaatttgatgacttaaattctaaaactttttggatgttttcattagcctgtatagcactgcacttcccatttatcccaactagcattcttttttctttaatttttgagacagagtctcactctgtcgcccaggctggagtgcagtgacgcaatcttggctcactgcaacctccgcctccccaggttcaagcgattcctctgacttagcctcctgagtagctgggaaataggcgtgagcaacaatccagactttcattcttttag

SEQ ID NO: 203948 - DNA, 382 bp, Homo sapiens
agacctgatcattaaactgggctttacaacaagaactgtactgtattcactttgtatctctagattctataaaatatagtagatactcacactgaattgaatgaatggatgatttaagagcagatatgattattgtgattaaacatttgtgtagccctgagcttgttggtagtttaggcaaaaaccatgtaacttgtataatagtcataatctaagaaaaatttaccatttcttcaaaacaggcagaatttttaattcttagaagtgtgttatttagtttccaaatatttggagattttccatctttctattactgatttctgatttaattccattgtggttccagaacacccttcctataacttaaattgttttaaatttg

SEQ ID NO: 203949 - DNA, 106 bp, Homo sapiens
caagtcctttgaggaatggcatggaatagcgtctaaggcattggtagcaattagctttggcgatgaggcaagctgtctttgtagtctaagtaagaaagatcttcac

SEQ ID NO: 203950 - DNA, 578 bp, Homo sapiens
gccttggcctcccgaagttctgggattacaagtgtgagccaccccacttggccagattttctcatttttcttgagtcagtttcagtagtttttatatttctaggaatttatgcatttaatctaaattattgaattagtggacatacggttgttcacagtattgccttataattccttttatttctgtaaggttggcattaatgccttctcttttattcttgattttagtaatttgagtcttttcttcttttatcttagtcagtctagctaaaggtttgtgaattttgttggtctttttaggacctttttttttttttttttttgagacagagtttcactcttgtcatccaggctggagtgcaatcttggctcactgcagcctccgcctcccgggttcaaacaattctcctgcctcggcctcccgagtagctgggattacaggcgctcgccaccatgcctggctaatttttgtatttttagtagagatggagtttcaccatgttggccaggctggtctcgaactcctgacctcaggtgatccgccctcctcagcctcccaaagtgctggattataggtg

SEQ ID NO: 203951 - DNA, 376 bp, Homo sapiens
gctgggtgtggtggctcatgcctgtaatcctagcactttgggtggctgaggtaggagaatggcttgaggccaggagtttcagaccagcctgggcaacatagtgagaccctgtctctacaaaaaaacagaaaaattagctgagagtggtggcacatgtctatagttccagctactagggaagctgagaccggaggatcacttgagcctagaagttcaaggctgcagtgaactatgatccttccactgcactccagcctgggagacagagcaagccccttttctctacaaataaaataaaaatcccccacagtcttgaggactatactatcttataataggtgtttagtaattatttgttgaatgaatgaatacaaaa

SEQ ID NO: 203952 - DNA, 4135 bp, Homo sapiens
  misc_feature (41)..(41): n is a, c, g, or t
  misc_feature (63)..(63): n is a, c, g, or t
cgccggtggctcggcggcggcggcggcggcggcggcggcgncggcgtcgtctacctccagctnctcctccctcctcctccgtctcctcctctctctctccatctgctgtggttatggcctgtcgctggagcacaaaagagtctccgcggtggaggtctgcgttgctcttgcttttcctcgctggggtgtacggaaatggtgctcttgcagaacattctgaaaatgtgcatatttcaggagtgtcaactgcttgtggagagactccagagcaaatacgagcaccaagtggcataatcacaagcccaggctggccttctgaatatcctgcaaaaatcaactgtagctggttcataagggcaaacccaggcgaaatcattactataagttttcaggattttgatattcaaggatccagaaggtgcaatttggactggttgacaatagaaacatacaagaatattgaaagttacagagcttgtggttccacaattccacctccgtatatctcttcacaagaccacatctggattaggtttcattcggatgacaacatctctagaaagggtttcagactggcatatttttcagggaaatctgaggaaccaaattgtgcttgtgatcagtttcgttgtggtaatggaaagtgtataccagaagcctggaaatgtaataacatggatgaatgtggagatagttccgatgaagagatctgtgccaaagaagcaaatcctccaactgctgctgcttttcaaccctgtgcttacaaccagttccagtgtttatcccgttttaccaaagtttacacttgcctccccgaatctttaaaatgtgatgggaacattgactgccttgacctaggagatgagatagactgtgatgtgccaacatgtgggcaatggctaaaatatttttatggtacttttaattctcccaattatccagacttttatcctcctggaagcaattgcacctggttaatagacactggtgatcaccgtaaagtcattttacgcttcactgactttaaacttgatggtactggttatggtgattatgtcaaaatatatgatggattagaggagaatccacacaagcttttgcgtgtgttgacagcttttgattctcatgcacctcttacagttgtttcttcttctggacagataagggtacatttttgtgctgataaagtgaatgctgcaaggggatttaatgctacttaccaagtagatgggttctgtttgccatgggaaataccctgtggaggtaactgggggtgttatactgagcagcagcgttgtgatgggtattggcattgcccaaatggaagggatgaaaccaattgtaccatgtgccagaaggaagaatttccatgttcccgaaatggtgtctgttatcctcgttctgatcgctgcaactaccagaatcattgcccaaatggctcagatgaaaaaaactgctttttttgccaaccaggaaatttccattgtaaaaacaatcgttgtgtgtttgaaagttgggtgtgtgattctcaagatgactgtggtgatggcagcgatgaagaaaattgcccagtaatcgtgcctacaagagtcatcactgctgccgtcatagggagcctcatctgtggcctgttactcgtcatagcattgggatgtacttgtaagctttattctctgagaatgtttgaaagaagatcatttgaaacacagttgtcaagagtggaagcagaattgttaagaagagaagctcctccctcgtatggacaattgattgctcagggtttaattccaccagttgaagattttcctgtttgttcacctaatcaggcttctgttttggaaaatctgaggctagcggtacgatctcagcttggatttacttcagtcaggcttcctatggcaggcagatcaagcaacatttggaaccgtatttttaattttgcaagatcacgtcattctgggtcattggctttggtctcagcagatggagatgaggttgtccctagtcagagtaccagtagagaacctgagagaaatcatactcacagaagtttgttttccgtggagtctgatgatacagacacagaaaatgagagaagagatatggcaggagcatctggtggggttgcagctcctttgcctcaaaaagtccctcccacaacggcagtagaagcgacagtaggagcatgtgcaagttcctcaactcagagtacccgaggtggtcatgcagataatggaagggatgtgacaagtgtggaacccccaagtgtgagtccagcacgtcaccagcttacaagtgcactcagtcgtatgactcaggggctacgctgggtacgttttacattaggacgatcaagttccctaagtcagaaccagagtcctttgagacaacttgataatggggtaagtggaagagaagatgatgatgatgttgaaatgctaattccaatttctgatggatcttcagactttgatgtgaatgactgctccagacctcttcttgatcttgcctcagatcaaggacaagggcttagacaaccatataatgcaacaaatcctggagtaaggccaagtaatcgagatggcccctgtgagcgctgtggtattgtccacactgcccagataccagacacttgcttagaagtaacactgaaaaacgaaacgagtgatgatgaggctttgttactttgttaggtacgaatcacataagggagattgtatacaagttggagcaatatccatttattattttgtaactttacagttaaactagttttagtttaaaaagaaaaaatgcagggtgatttcttattattatatgttagcctgcatggttaaattcgacaacttgtaactctatgaacttagagtttactattttagcagctaaaaatgcatcacatattcatattgttcaataatgtcctttcatttgtttctgattgttttcatcctgatactgtagttcactgtagaaatgtggctgctgaaactcatttgattgtcatttttatctatcctatgttaaatggtttgtttttacaaaataataccttattttaattgaaacgtttatgcttttgccaacacatcttgtaacttaatatactagatgttaaggttgttaatgtacaaaaaaaaaacccttatactcacctgcgttttcatttgtttgacatttgtctattattggatttcattatcatatgaacttgtcagtgggaaacaaactgtctaaaaatttttctcttacgtttaacatacaatcatgtgaaatttaggcagagttcgataaattactggcaaaaacaaaactcttttataaagattttctaatgttgactttaatactctaacatggtacaaaccaaatggtaaaatcccaagtcatttcttttttcatctctatttagcaacagaattaagtggatgaagatattctactatgcattaaatcttgaactttataaaacatgtacaaaaattgtacaagataagttccacctggtaatgtctttccctaatacagggttgcgcttgcattggaccctagggatttgcactaaaattatatcaaggtctcagatgagcttagtgcacaagcactatcactttaaatactattatttgctaccacagcaactatatatttccatagcttttggctgggggcgggggacatttttattacaacttgaaattgctttgctggtttcatatttatttgttgtatttaaaaaatacattgttgtaagagtgattttttcaatatattttattcctgggggggatcatgctacactctcaaaagaaaattaagaaatcattcagatcatcccccctttttaagtagtgtgaattgcaaaacccaacatattttttttactgtcagttgcggtttatttattctttaactgtctgttttagtagtttaatgattatgaaaaatgtatctgtgtgtgatttgctatttattaaattttaagtactttgctgaatgtcattttaaagcatgtttgaagtcttgtgtatttgtctgtgttaatgctgtcaggaggaactgactaagatgttttaatatgtatcaaaaattaaaatgattttttttattgccttgaggtactttttaaatcaaa

SEQ ID NO: 203953 - DNA, 4078 bp, Homo sapiens
  misc_feature (41)..(41): n is a, c, g, or t
  misc_feature (63)..(63): n is a, c, g, or t
cgccggtggctcggcggcggcggcggcggcggcggcggcgncggcgtcgtctacctccagctnctcctccctcctcctccgtctcctcctctctctctccatctgctgtggttatggcctgtcgctggagcacaaaagagtctccgcggtggaggtctgcgttgctcttgcttttcctcgctggggtgtacgcttgtggagagactccagagcaaatacgagcaccaagtggcataatcacaagcccaggctggccttctgaatatcctgcaaaaatcaactgtagctggttcataagggcaaacccaggcgaaatcattactataagttttcaggattttgatattcaaggatccagaaggtgcaatttggactggttgacaatagaaacatacaagaatattgaaagttacagagcttgtggttccacaattccacctccgtatatctcttcacaagaccacatctggattaggtttcattcggatgacaacatctctagaaagggtttcagactggcatatttttcagggaaatctgaggaaccaaattgtgcttgtgatcagtttcgttgtggtaatggaaagtgtataccagaagcctggaaatgtaataacatggatgaatgtggagatagttccgatgaagagatctgtgccaaagaagcaaatcctccaactgctgctgcttttcaaccctgtgcttacaaccagttccagtgtttatcccgttttaccaaagtttacacttgcctccccgaatctttaaaatgtgatgggaacattgactgccttgacctaggagatgagatagactgtgatgtgccaacatgtgggcaatggctaaaatatttttatggtacttttaattctcccaattatccagacttttatcctcctggaagcaattgcacctggttaatagacactggtgatcaccgtaaagtcattttacgcttcactgactttaaacttgatggtactggttatggtgattatgtcaaaatatatgatggattagaggagaatccacacaagcttttgcgtgtgttgacagcttttgattctcatgcacctcttacagttgtttcttcttctggacagataagggtacatttttgtgctgataaagtgaatgctgcaaggggatttaatgctacttaccaagtagatgggttctgtttgccatgggaaataccctgtggaggtaactgggggtgttatactgagcagcagcgttgtgatgggtattggcattgcccaaatggaagggatgaaaccaattgtaccatgtgccagaaggaagaatttccatgttcccgaaatggtgtctgttatcctcgttctgatcgctgcaactaccagaatcattgcccaaatggctcagatgaaaaaaactgctttttttgccaaccaggaaatttccattgtaaaaacaatcgttgtgtgtttgaaagttgggtgtgtgattctcaagatgactgtggtgatggcagcgatgaagaaaattgcccagtaatcgtgcctacaagagtcatcactgctgccgtcatagggagcctcatctgtggcctgttactcgtcatagcattgggatgtacttgtaagctttattctctgagaatgtttgaaagaagatcatttgaaacacagttgtcaagagtggaagcagaattgttaagaagagaagctcctccctcgtatggacaattgattgctcagggtttaattccaccagttgaagattttcctgtttgttcacctaatcaggcttctgttttggaaaatctgaggctagcggtacgatctcagcttggatttacttcagtcaggcttcctatggcaggcagatcaagcaacatttggaaccgtatttttaattttgcaagatcacgtcattctgggtcattggctttggtctcagcagatggagatgaggttgtccctagtcagagtaccagtagagaacctgagagaaatcatactcacagaagtttgttttccgtggagtctgatgatacagacacagaaaatgagagaagagatatggcaggagcatctggtggggttgcagctcctttgcctcaaaaagtccctcccacaacggcagtagaagcgacagtaggagcatgtgcaagttcctcaactcagagtacccgaggtggtcatgcagataatggaagggatgtgacaagtgtggaacccccaagtgtgagtccagcacgtcaccagcttacaagtgcactcagtcgtatgactcaggggctacgctgggtacgttttacattaggacgatcaagttccctaagtcagaaccagagtcctttgagacaacttgataatggggtaagtggaagagaagatgatgatgatgttgaaatgctaattccaatttctgatggatcttcagactttgatgtgaatgactgctccagacctcttcttgatcttgcctcagatcaaggacaagggcttagacaaccatataatgcaacaaatcctggagtaaggccaagtaatcgagatggcccctgtgagcgctgtggtattgtccacactgcccagataccagacacttgcttagaagtaacactgaaaaacgaaacgagtgatgatgaggctttgttactttgttaggtacgaatcacataagggagattgtatacaagttggagcaatatccatttattattttgtaactttacagttaaactagttttagtttaaaaagaaaaaatgcagggtgatttcttattattatatgttagcctgcatggttaaattcgacaacttgtaactctatgaacttagagtttactattttagcagctaaaaatgcatcacatattcatattgttcaataatgtcctttcatttgtttctgattgttttcatcctgatactgtagttcactgtagaaatgtggctgctgaaactcatttgattgtcatttttatctatcctatgttaaatggtttgtttttacaaaataataccttattttaattgaaacgtttatgcttttgccaacacatcttgtaacttaatatactagatgttaaggttgttaatgtacaaaaaaaaaacccttatactcacctgcgttttcatttgtttgacatttgtctattattggatttcattatcatatgaacttgtcagtgggaaacaaactgtctaaaaatttttctcttacgtttaacatacaatcatgtgaaatttaggcagagttcgataaattactggcaaaaacaaaactcttttataaagattttctaatgttgactttaatactctaacatggtacaaaccaaatggtaaaatcccaagtcatttcttttttcatctctatttagcaacagaattaagtggatgaagatattctactatgcattaaatcttgaactttataaaacatgtacaaaaattgtacaagataagttccacctggtaatgtctttccctaatacagggttgcgcttgcattggaccctagggatttgcactaaaattatatcaaggtctcagatgagcttagtgcacaagcactatcactttaaatactattatttgctaccacagcaactatatatttccatagcttttggctgggggcgggggacatttttattacaacttgaaattgctttgctggtttcatatttatttgttgtatttaaaaaatacattgttgtaagagtgattttttcaatatattttattcctgggggggatcatgctacactctcaaaagaaaattaagaaatcattcagatcatcccccctttttaagtagtgtgaattgcaaaacccaacatattttttttactgtcagttgcggtttatttattctttaactgtctgttttagtagtttaatgattatgaaaaatgtatctgtgtgtgatttgctatttattaaattttaagtactttgctgaatgtcattttaaagcatgtttgaagtcttgtgtatttgtctgtgttaatgctgtcaggaggaactgactaagatgttttaatatgtatcaaaaattaaaatgattttttttattgccttgaggtactttttaaatcaaa

SEQ ID NO: 203954 - DNA, 3939 bp, Homo sapiens
agttctggcggctgggaagtccagcatcgaggcactggcagatttgatgtctgcttgtggagagactccagagcaaatacgagcaccaagtggcataatcacaagcccaggctggccttctgaatatcctgcaaaaatcaactgtagctggttcataagggcaaacccaggcgaaatcattactataagttttcaggattttgatattcaaggatccagaaggtgcaatttggactggttgacaatagaaacatacaagaatattgaaagttacagagcttgtggttccacaattccacctccgtatatctcttcacaagaccacatctggattaggtttcattcggatgacaacatctctagaaagggtttcagactggcatatttttcagggaaatctgaggaaccaaattgtgcttgtgatcagtttcgttgtggtaatggaaagtgtataccagaagcctggaaatgtaataacatggatgaatgtggagatagttccgatgaagagatctgtgccaaagaagcaaatcctccaactgctgctgcttttcaaccctgtgcttacaaccagttccagtgtttatcccgttttaccaaagtttacacttgcctccccgaatctttaaaatgtgatgggaacattgactgccttgacctaggagatgagatagactgtgatgtgccaacatgtgggcaatggctaaaatatttttatggtacttttaattctcccaattatccagacttttatcctcctggaagcaattgcacctggttaatagacactggtgatcaccgtaaagtcattttacgcttcactgactttaaacttgatggtactggttatggtgattatgtcaaaatatatgatggattagaggagaatccacacaagcttttgcgtgtgttgacagcttttgattctcatgcacctcttacagttgtttcttcttctggacagataagggtacatttttgtgctgataaagtgaatgctgcaaggggatttaatgctacttaccaagtagatgggttctgtttgccatgggaaataccctgtggaggtaactgggggtgttatactgagcagcagcgttgtgatgggtattggcattgcccaaatggaagggatgaaaccaattgtaccatgtgccagaaggaagaatttccatgttcccgaaatggtgtctgttatcctcgttctgatcgctgcaactaccagaatcattgcccaaatggctcagatgaaaaaaactgctttttttgccaaccaggaaatttccattgtaaaaacaatcgttgtgtgtttgaaagttgggtgtgtgattctcaagatgactgtggtgatggcagcgatgaagaaaattgcccagtaatcgtgcctacaagagtcatcactgctgccgtcatagggagcctcatctgtggcctgttactcgtcatagcattgggatgtacttgtaagctttattctctgagaatgtttgaaagaagatcatttgaaacacagttgtcaagagtggaagcagaattgttaagaagagaagctcctccctcgtatggacaattgattgctcagggtttaattccaccagttgaagattttcctgtttgttcacctaatcaggcttctgttttggaaaatctgaggctagcggtacgatctcagcttggatttacttcagtcaggcttcctatggcaggcagatcaagcaacatttggaaccgtatttttaattttgcaagatcacgtcattctgggtcattggctttggtctcagcagatggagatgaggttgtccctagtcagagtaccagtagagaacctgagagaaatcatactcacagaagtttgttttccgtggagtctgatgatacagacacagaaaatgagagaagagatatggcaggagcatctggtggggttgcagctcctttgcctcaaaaagtccctcccacaacggcagtagaagcgacagtaggagcatgtgcaagttcctcaactcagagtacccgaggtggtcatgcagataatggaagggatgtgacaagtgtggaacccccaagtgtgagtccagcacgtcaccagcttacaagtgcactcagtcgtatgactcaggggctacgctgggtacgttttacattaggacgatcaagttccctaagtcagaaccagagtcctttgagacaacttgataatggggtaagtggaagagaagatgatgatgatgttgaaatgctaattccaatttctgatggatcttcagactttgatgtgaatgactgctccagacctcttcttgatcttgcctcagatcaaggacaagggcttagacaaccatataatgcaacaaatcctggagtaaggccaagtaatcgagatggcccctgtgagcgctgtggtattgtccacactgcccagataccagacacttgcttagaagtaacactgaaaaacgaaacgagtgatgatgaggctttgttactttgttaggtacgaatcacataagggagattgtatacaagttggagcaatatccatttattattttgtaactttacagttaaactagttttagtttaaaaagaaaaaatgcagggtgatttcttattattatatgttagcctgcatggttaaattcgacaacttgtaactctatgaacttagagtttactattttagcagctaaaaatgcatcacatattcatattgttcaataatgtcctttcatttgtttctgattgttttcatcctgatactgtagttcactgtagaaatgtggctgctgaaactcatttgattgtcatttttatctatcctatgttaaatggtttgtttttacaaaataataccttattttaattgaaacgtttatgcttttgccaacacatcttgtaacttaatatactagatgttaaggttgttaatgtacaaaaaaaaaacccttatactcacctgcgttttcatttgtttgacatttgtctattattggatttcattatcatatgaacttgtcagtgggaaacaaactgtctaaaaatttttctcttacgtttaacatacaatcatgtgaaatttaggcagagttcgataaattactggcaaaaacaaaactcttttataaagattttctaatgttgactttaatactctaacatggtacaaaccaaatggtaaaatcccaagtcatttcttttttcatctctatttagcaacagaattaagtggatgaagatattctactatgcattaaatcttgaactttataaaacatgtacaaaaattgtacaagataagttccacctggtaatgtctttccctaatacagggttgcgcttgcattggaccctagggatttgcactaaaattatatcaaggtctcagatgagcttagtgcacaagcactatcactttaaatactattatttgctaccacagcaactatatatttccatagcttttggctgggggcgggggacatttttattacaacttgaaattgctttgctggtttcatatttatttgttgtatttaaaaaatacattgttgtaagagtgattttttcaatatattttattcctgggggggatcatgctacactctcaaaagaaaattaagaaatcattcagatcatcccccctttttaagtagtgtgaattgcaaaacccaacatattttttttactgtcagttgcggtttatttattctttaactgtctgttttagtagtttaatgattatgaaaaatgtatctgtgtgtgatttgctatttattaaattttaagtactttgctgaatgtcattttaaagcatgtttgaagtcttgtgtatttgtctgtgttaatgctgtcaggaggaactgactaagatgttttaatatgtatcaaaaattaaaatgattttttttattgccttgaggtactttttaaatcaaa

SEQ ID NO: 203955 - DNA, 577 bp, Homo sapiens
tcagaagacagtggagtaacgtatttaggatactcagggatggaaaatgggagctaagggtttagccacatagaacttcaggtataaaggccacagacaaacttgcaagaaataaggacatatttttcccataaatagttactgcggaatctcctggagaatatatgttaggtaatcagaatgatgggagaaatatccatgtaaggactgctggcagtgattggctgctcaaaaaacataaaaataaagacaaccatacaactcttgacaaaaccatacaacaccatcaataaattagtcttgccaaaaaagaaaggaaaaatacaacttaatataatcaagcctttagatctaactgtcaatttccaggagaattggacagagagagaggggaatgtgaattagtgaattagataaataatatcatggggctgcaatcagcaaaccccaggctgtgtgaaactctacaggacaaacaaccctgtttcttcaacaaaatttccaggatagagagggagacagagagagaggaaaggtacagattaaaagagatataagagatatattaactggccaa

SEQ ID NO: 203956 - DNA, 478 bp, Homo sapiens
gagatgctggctggtgggatgtagcagccttgagtcagggcagtgacagtagaaagtgaagaaaatggggaaatgtctctgtttaatggctgtgaattctagagagacatgaggaaaccaataaagttttgtctcatgctatacacagaagattctaggacttgtatcataaatgttgaacccactctctcaactgacctccacaaggcactgtgaacactcctactctttcttgaatgcttttaaacaagtctgtgttaatgggccaagtctggcctgccatctatttttataaataagcttgtattgtaactcaatcaagttcatttgtttacatgttgtctatgaccacttttgcactaaagtggaagaattgagtaattgcaatagagactatatggctcacaaaacctaaaatattaatatctgtctcttaacaaataaaaatttgcccatctctgctctgaaagaatgtaag

SEQ ID NO: 203957 - DNA, 302 bp, Homo sapiens
ctggctcctgcacccactcacctgggtgctcctgcgtgctccccctaccatgaggagttgagagctgcggactgaggaagtaaggcacccccgtcgcgaggcccacgaaagggtcaaggaaaatttcttgtttcattgggtttctggcacttgcatctgaaagagctacagagacacagggctgtgattagaagcccgatctttccccctacggtccgtatctgatccttgcacatggtgctagtgatagaccaagatctcttcttgtctctgaaagaggacagacagaagctacagttgcc

SEQ ID NO: 203958 - DNA, 202 bp, Homo sapiens
ggtagggaggtggttttgaagatgacatgaaatttggtgtttgagtagatgagatttaattttcggaaaacatttcactcataaaacggatatcaacccagtgtcagcactgacctcctgatgtcaatgtcatcatgcaagcatagctaaaataagcctcaaagtaaaacaaagaaacattgcatctcagcacaacacgatt

SEQ ID NO: 203959 - DNA, 557 bp, Homo sapiens
gggagaggaagttggggtacacaggtgtaggcacgctcagtcctcacagcccccaagagaagtccatggataatcagtaacactgacaaatcaaacattacaacataaacacgtttaggagcccagatgtaaatattttttaaaaaaataactaaaagacggccgggtgcggtggctcatgcctgtaatcccagcactttgggaggctgaggcgggcggatcacgaggtcaggagatcaagaccatcctggctaaaacagtgaaaccctgtctctactaaatttacaaaaaaattagccgggcgtggtgactggcgcctgtagtcccagctactcgggaggctgaggcaggagaatggtgtgaaccccgggaggcggagcttgcactgagctgagatcgcaccactgcactcaagcctgggtgacagagcgagaccccgtctccaaaaaaaaaaaactaaaagactttatgtggctccattttaccttttagacaatatgcatgtattactttgataaaaataaaagtaactgaaagaaatccatgtagttaagaac

SEQ ID NO: 203960 - DNA, 474 bp, Homo sapiens
ggcccatccttacagtgggatgatcgaatcttaaaagggaaggcagttctgacacctgctccagcacggatgaacctcgaaaacacaatgccaatgcaggaagcctgtcacgagaccacgtgctgtccggctgcacttgcatggagctcccaggacaggaagagtcacaggtagggaaaggggaggcaggctgctgggggtgggggctgactgctcatgggtagggtttccttttggggtgagggaactgttctggaattggatagtggtgacgggcacagaactttgtgcttctattaaaagccactgaatttatttattttattttaatttttgggtgacagagcgagaccccgtctccaaaaaaaaaaaactaaaagactttatgtggctccattttaccttttagacaatatgcatgtattactttgataaaaataaaagtaactgaaagaaatccatgtagttaagaac

SEQ ID NO: 203961 - DNA, 927 bp, Homo sapiens
  misc_feature (927)..(927): n is a, c, g, or t
ttaaaataaaaaggttgaaaaagttataccatgtgtatggaaatggcttaactcagcaggcctgggttattcaaaccctacatatttccaagaaatttgcatttatgactggcccttggtcaattcctagaaaccaagttcttggaatgatatgtctaatatggatatttttgcaagactgagaccttgggctatgctgtatcagttttcaagatagtttatgcaaacaatgtgacatatggtgaacacctgcttttcctctgaggatctggatcttgagaaactgaggctagttacacaggtgctgtatgcccacaaaaaaaaaaaaaaaaaaaaaaaaaaaaaaaaaaaaaaaaattccagaaacgcggggcacacccaagtggggggctacacctttcgcggggggagacattctctttaacaccgggtggtgcccaaaacaccatttgcgaagagggaaacaacagctgggtgcgcggggggaaaaccacccggtgatacagggggaccactacaacaggtcttcacccggggtgtccctgagtaattcccacacgggggggggcgctatacccctacacgggatttcagcccgcggaaattttgacacgtcgcaaacaacggtggtgtatttgtggttttataagagaacttttgggaaccgcggggggggttttccaaaaaaacaacggggggcggagggagattatctggtggtacccttaacaatgtggtgtaaacttctaacacaagaaggggggtgtccgcctaattggttacaaattactccaaaaacgttgttttgaaggcgcgaggattttatatcagaagagattttcaaacaagcttgtttgtggtcccactctctggtaaacatataaaggaaggggtagaataaacagaatataatcgagacaaacatgn

SEQ ID NO: 203962 - DNA, 857 bp, Homo sapiens
tggtgattgtataacataatatattaagttatcttagggcatagcatttgcattatgcattttctttactctcgtttcatttgttttccttctctcatgcagtaagaagtatatttttgtggattaccctatcaggaaacaggaacttttattaaatttcttgttggcatgacctctttcttgataatacctgaggaagttgttagtttagtatttcataaagagagcagggttaattgcaaacaatcataccttcatgataaattgaaccatttataaatacctacagtaattatgatctgacaaatgtatacaaccaccaattacttttttccaggatcctgatgctctgtgcccattctggctggtctttccttctagtgtcttaactgatgggatgatggttcacttctctgactccagagctgcccgtggtcaaagttcagccctcatgtattttgtgcatttctgtgtggctggtgaaaatccacatgtgtaatttgccgacggttcctcatttcccccatactttcctcctcctgtgattgcttctcacagtccctgcttctgtcttttgtggaaggaactttatttgcattcttagttgcaggagagaaaaatgacatctaaaaaaaaaaaaaaaaaaaaaaaaaggacctctcatacacaccccacctcaacacacacaaaaaaaaggggggggggggaaaaaaaaccccgggggggcgccactccccccccttttttaaaagggcgcccacaagggggataaaaagacgagtgcggggggaaacaccgtcgggggacaacgtctctgtggtctggaggcaaccccctcggggggtcttgggaccccc

SEQ ID NO: 203963 - DNA, 488 bp, Homo sapiens
gaaacattgtagctgcatgtgagtggtgtgaatacatccatcttacagttttcttagggttcacatctaagtgactgaatgtgagagatgcctaattcaattatcatgtattggatgttgttttgcttcttttgagtttttaaagataaaatttgaaggtaagaattagagctaaaatctcaagaataatcttaaaatcctaattttcagaggtataagtatgtataatatacatatttatatgatatgtaaatatttatgtgtttatatacatataaacacatttttagattaaaaagagcaaacaacttattttttaatgactagtataatcacgaagttctttgcaaataatttattgtctaaaatatagaaattgcaaattttatatgacaatgtcaaaaattggtcaggaaccaaattttagaatgaaaatttttactttacaatacatagctaaatccaattttttttttttttttttttct

SEQ ID NO: 203964 - DNA, 369 bp, Homo sapiens
gcgaggtgatctagaggatccctcataggttcgctggggattaagttagttccattccacatttaagacaataagcagagaatggctaaaaaagccaatttgttttgggctttgtttgatgacagtagagaaggtttaacctagggcttttaaagctctttctagagctgaaaggagcaagtcaaaatgattttataactaattgtgacagtggagttttttagattagctatgttcttaaagcaagttagagttctttgttttctgggaaaatacttaagattctattctagaggtgttttgaaagacattgtggagaaagtattatggcctgcccagtatgccttaggagtacctgaaacggcaaga

SEQ ID NO: 203965 - DNA, 1200 bp, Homo sapiens
gccgctgcactccagcctgggagacagagcaagactccgtcacaaaaacaaaaaacaaaaaactgtcatatcaaaaactaaactaaaatggtaatatctgttagatattacaaagtcaggcaaattatgattcatggcagccactaatgacccaaaggagagaaagaataattagcagattctaacctaatgggaaaaaaactaaatgaatagggatgggggacttacattctgttagaggaaattgaggctgtcatataaaaggaataggtaaggcaaactgtaaattcctgtttacacaaatgcccttctgataaatctctgcattgcccacagtccatgattacctctcccttattttaagtaatatttaacacattaaaaatggattaccacccaaggaattgctcccgacccagaaagtgcaggtagtgttgaaggtttgaggggaagaggaatgattagagttggttgtgtctcaggaagaagccaacaggaggaaccttattttgagtcaggtaaagaaggtgggagtgaggaggcatcccggtggccaggtatgaagctgggagctgattgctgcacattactcagctgaattaaatgtgccctcacatctgtgtgtgtgcgtacatgcaaatgtacatgtgtatgagttagttggaggggtagacctttattttcctgtcctgtaactttcctttgcaaactaatctgtattcagaacagtgttgcagttaagaaccacccagcttgtccatgaaacaggttctctcaccccatctccccagttttagagaaggcaggaaagaaaaggcagtgcttttcttttttcctggccgtatgcggggcaggaagaagccagcagagcttgaaagagaaagtaaaccttctgggaaataaacggcttggcttccctattgtggaggaggagtgcaaattattagggggatgtttgggtagtttttgtagaagccatttctgaaaactgatttggattagtgaaggtaagcccaatttaggaaaaccctgcccagtctggtgtcagccacctgtttcccgctttgtttgattgatttgattagtttgtggtattctgacctctcatttttattacaagagttggaagatttgagtctgaacttgagcacctgcttcggtgaaagcttcctaaaatgcatgttttttcacattttttct

SEQ ID NO: 203966 - DNA, 306 bp, Homo sapiens
caagcagttaatacagactcacatatggcattgaggacatcattaaaactcagtaagacaaaaatattgcctgatattaaagcagccacagagaaaagcaggaaagtttactgggagaaaggatgggaggagaatactgcctaatacttcctcattggaataaccacacctaggcattagtattaccccagagcaagagcttcttagagacagacacagaaagactacctcagccggcatgaggcctttctcttttattgatacggagctccaagaagccccattttaagtctgtatttcttactg

SEQ ID NO: 203967 - DNA, 379 bp, Homo sapiens
tgtgtgtgcttatgtatgctaactgatttggaaatcagtattaatgagcagttaatgattgtgggacaagaaagcattaaaaaatcttaaagagtttggctgggcatggtggctcatgcctgtaatcccagcactttggaagtcccaggcaggtggatcacttttgttaggagtttgagaccagcctggccaacatggtaaaaccccgtctctactaaaaatacaaatattagccaggcatggtggcattcacctgtaatcccagctacttgggaggctgaggcaggagaatcacttgaacccgggaggtggaggctgcagtgagccaaggtcacaccactgcactccagcctgggcaacagagtgagactctgtctta

SEQ ID NO: 203968 - DNA, 514 bp, Homo sapiens
tctctgccatccactgaaggcaggatagatagaggcaggcagacaatctgaacaaaatgagctttccaggaaggtgcaaaactggaggcagagatacctggcaacactgagcactgaaatctcctttcttttgcctgattgcatttatatgaaaggtccagaacaggcaaatttgtagagacagaaagtagattagtggctgcctagggctgggtgggcggatgggaacaaaggggttgggagcagatggggagtgaatgactgctcatgagtccagagttgctttttgaagtaataaaaatatgctaaaattgatcatggtgattgttacacaactctgtgaatatactaaaaaccactgaattaaaagtaaaggcagtaattaaaattctaggggttttttttttttttttttttgggaggcaaagtctggctctgtcccccgggcggaagggcaggggcccaacctgggcccagggaaacccccgcccccagggttccccgcatcccccgg

SEQ ID NO: 203969 - DNA, 648 bp, Homo sapiens
caatatcctacttcatctgacattcaaaatatattatgaaacaaaacaggtatcccactgaaagcctaatatgatgtctcaagcatttcactctaagagaagacaatatagatcgcctttgtcttctgtggtccttttaagaagtacattctctcatatccagagacacatatacactgacttaaatatagagaaaaaaaaatcagggttatataaaatcattaaaaatcattaactattttcaaaacagagccccaagaaagtaaaattttctctgggtataactccttgtgaaaatgcaaggccgagaaactggcaagcatgtaatcaaagaccccacccaaacacatttgaaaccctgcatatgtttttctgtgatgggttcacggcatctatattaaacattatggtaggtgctgatcttccttggctgtagtgtgaagagataaacagtgtcaaagctcaaagaagccaagggcaatacatgaccagtataagccatgactgctttccaacagaaaatatttgattcgtgcttttcaagttgaaaacatctgagcaagtttaagataagatctaaagctcaactatgggttagtcttacattgcacaataaagtagttattaaccacatgtgactactgagca

SEQ ID NO: 203970 - DNA, 512 bp, Homo sapiens
catggtcccgggtcactgcagctccacctcctgggtgcaagtgattctcctgcctcagcctcctgagtagctgggatttcaggtgcatgccaccacgcccggctaatttttatatttttagtagaggcggggtttcaccataatggccaggatggtctccatctcccgaccctatgatccacccaccttagcctcccaaagtgttgggactacaggcatgagccaccacgtccggcccatttaactgctataatactttcctgttggtggttttaccagtgcaaactgagcagcttaaaacaccaaccagttattatctgttttcatgagccaagggtctgggcagggtttaactgggtcttctattcagggtcacaatacggcaaccagagtgtcagttggagctggggtctcattggatgctcagtgtcttcttccaagcttattcagtctgtgaactgaattcaattacttacaattgttgaatgaaggccctcaactcctagagctgc

SEQ ID NO: 203971 - DNA, 430 bp, Homo sapiens
aggcagatgtcaagtgcgagcatatttccaggcacatcataaacctatgataaatggctgccatttctattattagcatggggctggggccatagcaaagcccaaccatgggaggaacagcagaagcagggagagagcaaaggtctgaagaggcatctggggaagctgtgggagcccttgcgtggccctttccatgtcccctttgtcgcacagcttccctgggcctctgttcccagagtgccctcccacccccttgacaccccagctgagttcaccaacctcacacgctccccacttcctccccagggagggtcgctctggggagttttgagcaagctctgggaacgcagtttgaggctgaaacaagagcattgcagggaaaagggaagagaggaaaaaaaaaagacctgcccagcctagaatcccaagc

SEQ ID NO: 203972 - DNA, 481 bp, Homo sapiens
ggctcacattatatggctactggacagcactgatataaattatgcttttcatagttttatcataaaggggaccagaagatgggatggtagctggtggtgaagtggggtaaagagaaacttttttcccctgaaatgggagaattgcagcatgtttgtatgtgggaataatatagtcaaaagtagaagttgatgatgcagcagaagagacaggggacaaatgatgtcctggagtaggtgagtgcatttgggttccagcgcataggtggagggtggccgaagggttatggactgttcatacagagtgacaggagaggaagcagaatgtgaggtttgcaaacaaaggtgagtatttatggacatgggagtgcttggaagttcctcttttgtaatcttagtgacatagggagccagtcttcagctgagaaaagaggatgggggaggaggttctcttctgacatacactatagaccacagaatttgg

SEQ ID NO: 203973 - DNA, 857 bp, Homo sapiens
ctttggccttctgaatatgacttgcagctgggtagggaagtagtgcaatattatccacagattgaagattctttcaaacaacagaaataatcaagaattcactgtggaggattttcccctccagagagtaacagatagattgatgcgtagatctaggtatgcttattaacaaaccattcctgtttcatgggatgtacatgtggcagcatctggattatttaatgtgttaatatagtcagtttgtatatgaataatttaaaacagtagcaagagataaaagtagctcatctgaagaagggttgtttgagagctttttttctgtcaagtataattttactctcaggttaaatgaaatttattaagatgcaatttgctcctgggaggtatttgtgagtttaaccacagtctgtcttggaagatattatgacagtaagtaaatgtcacctggataatactgatccattcacagaagggagaaaaagtgtgttgggtcaattaaggtggtttaaaaatgtgttgactctgaagaagaaaagtatctaaagtacacaactctaacaaatctcaaggccagtgggactttacagactgagcccaattgtgttgagtctgtgtattgtatatacttaacacaagcaaacacagactttttctacaaatgaaaacatgtctgctgagcagttgactcagtcatctggaataaatgttctttatttgtgtttccatgggtaaaatcaagttaatgaactgaaccatcacaatttctcttatttaatttttaaaactctagattaccctgtcttctatctctatgtaattcctgtgttagagcaaacataggaaattgtcaatatggc

SEQ ID NO: 203974 - DNA, 441 bp, Homo sapiens
gtcaccgtctttggagactgtgctgtagtttccagaccccaccaccgcctcctgacagcctagttgccgtatgagcagacctgttacccttacaggaccactagggcacctctcaggggtctagcaggcttaggtttggggacatggaattgatagcaagatctaaggcaaggagcagggatgtggacggctggatctaggcctctgatccatacctgctctccctaaaatatagaggtactagcgatggaggccaggcgccgtggctaatgcctgttatcccagcactttgggaagttgaggcaggtggatcacctgaggtcgggagtttgagactaagctggccaacgtggtgaaaccccgtctctataaaaatacaaaaattagcctgtcatggtggtgcatgcctgtagtccttgctactggggaggctggggcagg

SEQ ID NO: 203975 - DNA, 393 bp, Homo sapiens
cgtcttataaacaatagatatttatttctcacagctctggagtctagaagtcctagatcagggtgctggtatggtaaggttctggtgagggccctcttcacgattgcagatgaacaatttctagtgtatcttcacatggtggaaagaagatgagagagctctctggcatcctttttataagggcactcatctcactcatgagggcttataacctaattacttcccaaaggtcctacctgggttaggtctacctgggtagacctaaccatgcagcacagaccaattagccaaatgcaaaatagactagattcttaccacaagtatcctataaacactgcaactattctttccagaaggaccctaatcttatgtgagaacacctactgtggggga

SEQ ID NO: 203976 - DNA, 778 bp, Homo sapiens
ctcgtcagaaatgtgtgtgcgtgccagctgccctgtgctcagccaccttaggagacccattgctctgtcgccatagtcttcatgtcccgtgttccagatacccctctcattcctatgatctggaaacttccacgtcatgagggtgggaggggtgaggaaggtaccagaatgctcctagccaatcagggcttctagcttgccacacaaggtttctagtttcatttgacatttgtggacattttaacaagattctgttttgagcccaccaagttgcttttcccatcttttcactctgccctaatatagcatggaatgctgcttggtgctgttcccttgtcttcctggttgttctccctgcttctttctttctccctttcctttcctctctctgtttttctctgttgctttctcagttttgcttatgccctccccctccccacctcctttccttctcccatttttaaaatgcatggacatcttagttttttgagcatgttttgatctgcaggctaaggtggtttaaaactctgagaggcttaattatttatcttggtttctgggatggaagcagaacccatagtctatttactctctcccagggagaaaaaggaaccttgccaaattgagggtgagagggggtggtgcttgctcccctagagttccttctgacccagaaggaacagacagaccctgaggccactagcccccatgaatctcagcctctgggaggcagggaggactgagcatgctcccttacacccctcccctccttccctgc

SEQ ID NO: 203977 - DNA, 393 bp, Homo sapiens
gctaaggagccttctcttacttccttttggtagaaattatcattactttacatgggaagaaagtctgtttgggtacatttcacgcacctgttcttcccttctgaattctatgggatctatggatttattcaatgaacatgtctgtgataccaggccctgagctggggtcagctgaggatttccctgtgatcaagtaacgaaagggtcctgtcctgaaggagcagatggtatacacaggaacgccatcatgatccagggtcggggatgctgcagggggtgagttgagcccgcctgctggtgcctgggagggtcaaagaaggtgacctctaaacttgaaggagggacaagcaggtatggaattggccaggtaagggttagtggaggcagatgaga

SEQ ID NO: 203978 - DNA, 156 bp, Homo sapiens
tataatgagccatgatggagccactgtactccagcatgggtgaaaaagcgagaggctgtctctaaaaaaataaagtgcagattcactgggccagacaaaggcgtgaattactattttccctaaccccccttacatgaaaattgtgtacttctcagt

SEQ ID NO: 203979 - DNA, 265 bp, Homo sapiens
tggggtccccagccgcctccccttccctggcacatcctgccatgaaaccttatgctgtcccatctcttaaaatttccctgggagcaaatttctcatttcatcaaagctctcaatttccttactctgccaactttcttaaaatagtctatatgggatctcttcgtgggctcatggcctcaccctggggagggcggtgggggttgcaggtgctgcccctgagctcatttcccccaaagtgacaccttttcagacaagaggtgcacag

SEQ ID NO: 203980 - DNA, 690 bp, Homo sapiens
aagatggtgaaattttacaataaattaagaagctttttagctttttaaaagttaaattaaaagctttacgataccacaagctagttcaaaaacataggaaattgtgcattcaggtccaaaattatgatttttgtatcatgcaaaacaatgaacgaagaaaattacacaactacaaagaactgaggttttgaagtgcccataacgtgcattaaaattttagttcattaacccttcccagctcaatgttacttttacaaagcacagtgtactgtcatgtaaatcaaaagctaaccagttcaaagaagcaaacactttaagttagaggtgaactgcatggcagaattccttgatggcagccagtacttaaaaaacagttaatatacccatgcctcccaccagacttgagacctcaagattggcacctagcattctaacccctttaactatttggacacctcatatctcctgggtaatgtaacagcctttatcatctctgaacacaatgaggagaaaaggagcttctatcctctccccagcaaggaaaaattttaaagtaagatgttgttcacgtatgatttgaagtctggtttttatcttctggtgcaagagggtgagcaaagctgttacaaactccctggagagcaaaaagatctataagttccctttaagcaagcccaccaaccaagcaac

SEQ ID NO: 203981 - DNA, 524 bp, Homo sapiens
caaggaaagcaaaacctagataagaaagtagtactgtacagtttctctccctgtgtcatcaattttttactttaactcattcccatcagcatataaaaatactgtaattcctctcatcttgaaaaaaaaggtttctcttgaccccacacttcactccagctgcccagctactcctttcacctagtttattcacagaactccaaaaaactatttcagacctcttttcttctcaaacactcaatgctaccttccaatggcctcttatttccaacagcctcactctcaccagataagtgtgcatattattttgccgggaaaaatgaaagcaatcagaagagaactttcaattattcccattccattatccacctacccatctgcactggtgccctgtatcctgccttcgttactgttcttatgaatgaacggtccatgcttctacttaagggcaacttctctactccttacactattcctcatcacccaactaaaaatattaacacaaattacaactactccctcac

SEQ ID NO: 203982 - DNA, 397 bp, Homo sapiens
ttcttgtgagaattgaatgaggtatttgatgtgtgtcacatagtaagtactcaatcaaacataagtatgaccattattattttaaacaaagctaattttctgttaactaatgttatttcctggtctgggcttggtggctccacctgtaatcctagcacttagggaggctgaggcaggtggatcacttgagtccaggagttcgagaccaacctagccaacatggcaaaaccctgcctctactaaaaatacaaaattagccgggtgtggtggtgcacgtgtataatctactcgggaggctgaggcatgagaatcacttgaacccgggaggcattggttgcagtgagctgagagcacaccactgcactccagcctgggcgacagagcaagactccatctc

SEQ ID NO: 203983 - DNA, 844 bp, Homo sapiens
gaattcgagacagacttgctgaagaggagaaagcatgggaggagttgcaggactgagtattaacttgatgacttggaacaagcaaggactgagttacagggactgggtcctttctctggcctgtcttgaaaatgtttcctggcctcccagagtctatttccccttctccaaaacacaagagttgaccagataacttctgagatagatccctttgagttagagaatcacatttctagcttgactgcctgggaagcccagtacagggctaggctccttcagaaggcccccgcatctcaggttagaaaaaagctggggcaagagcggacccctgaatggcttgagcaaccagtatttggtctccctgccaggctagctagagtttgtttgcaggcttcaagagccttagggaattataacatcttcattttgcagagaaggcagctaaagccatgagaaggaaggtcacgtggtgagaagagagctctgaaaatcccggacagggaagagccagcaggacacagcaggagacaaagagagaaaaatactgaaccaggcaaaaatgaaaagaaggcaggagtagggctgagaaaggtgatcagggacaaggggcaagagagatacttggatgaaagtagggaggtacaaattccagtggtggggcagggcagtgtcctcaggtagcactgcatttcagacctgctattgtaccttgcagaccagcttctcctttccctcagatgtcttaaattgttaggacttggccgggcgtggtggctcacgcctgtaatcccagcacttggggaggccaaggtggatcacgaggtcaggagatcgagaccatcct

SEQ ID NO: 203984 - DNA, 452 bp, Homo sapiens
atagtattggggggtacttttgtttatttgtctttgtaatgagacagtgtctggggtgtaaataagtaaaataatactagcatgtagttaagaaatacacaggatggccgggcgcagtggctcacgcctgtaataccagcactttgggaggctgagtgcaggtagatcagctgaggtgggaggactacttgagtccaggaatttaagaccaatctgtgtaacataaggagatcctgtctctacaaaaaatacaaaaattagctaggtatggtggtgtgtacctgtagtcccagttactcaggaggctgagggcagaggatcacttgagcccaggaggttgatgcttcagtgagccatgattgtgccatgcactccaacctgagtgacagaacgagtccctgtcccaaatacacacatgcacatgcaacaagaatataaaacattttttatta

SEQ ID NO: 203985 - DNA, 513 bp, Homo sapiens
aaaaaaaaaaaaggaaaagaaaagaaagtgagtaaaggcttttgggttataaagagaaagggagaaggatgatccagactagaaagaagattattcctttcttagctcaacctttttgctccaaaaaaaagaggaggaaggggccaaacatagattatcctgcaccagagggccagctccttaaatctgagtctcatcccaaccaccatcatttgtaaaaaccaagggtgcattcattacctgcagtgcgtggatccctgtggtgccatcattatcatttgaagctccatctctgaagcctctagctttgtaaggacctacagaccacttcccaagtcattgcaggtttatttttgtcgcatttgagcataacctcagatttggcatacaatacgaatgtcaccttgaacagcttctccttgaatgggggcctactctccccaggtgcagtgagcaccgtcgtctttacatgagtgggcctacaccaccctgctgagtaaatccatctgttct

SEQ ID NO: 203986 - DNA, 111 bp, Homo sapiens
ggtgctgggcagggagaaagggctctgtctaatcccagccttaggcacctgcccacagccacggccatgctgagcagattagagggtagtagaggcctgttagcagccaaa

SEQ ID NO: 203987 - DNA, 343 bp, Homo sapiens
ggttcaagccattctcctgccgcagcctcccatgtagcttcttaagatgtgaagatttttaaattaagatgactcttgggatgaaccatttggtgttggttaaagacttttactgacatatttttaataatctttttaacttttattttcaggtcaatggcacatgcgtaggtttgttatgtaggtaaactagtgtcacagggatttgttgtgcagattatttcaccacccagctattaagcctagtacccattaattgtttttcctgatcttctgcttcctcccaccatccaccctcccagaggccccagtgtctgttgtttccctctatgtgttcatgtgt

SEQ ID NO: 203988 - DNA, 311 bp, Homo sapiens
ttactgtgaagggaaaagagagtgagtggagtactttttaaagacatggccaaaggacccaatagaaatgaaatgataatataaaaggagaagtaggtagacatggctcagtgtcagctggaacccaattaagatttacatttaaaatatagggttaaatttccaccactcatttttgctattatcaacttcacctaatagcattcaccctttttaaagaggcttatagatgcatgggagaaaaatgaatatcgctttgaaaagtgtatttgtatttcaaatcattaaaacagagtctggcaccaggagaa

SEQ ID NO: 203989 - DNA, 401 bp, Homo sapiens
tgtttctatcctgggatttcactcttttctccaaagtgatcttatctataaattatttctgaactatgcttaaatatgctgcttaaaactacccaaagtctttctattgttgtcattttagattctaaaattgctatgaggccttgctagatttagccactgatttcctctcccagcttcatctcataaaggtctcccatctgctttccgtattccggctgtggcagaataaagttggctacagcttcttggtcacagctctattaagattgaaatatatttcttctcctcttgcatatgaactcactctaaggaggcttagcaatagaatgcagcagaaatgaccttacctaagcccctgcgctagtctttaaaaagactggcagcatgtgttttctgtc

SEQ ID NO: 203990 - DNA, 409 bp, Homo sapiens
atacagtccattcccaagagggaaagtgtaacttgtctaaggttataaaattagaggttggcagagaactcactatgtggaatgctgttagcagttttatttaatcttcacatagatgaataaatgaaacctaagaggttgaagaatttctctaaagttagtaagtggtactgggattcacacttagtttttgctaggccaaatttctgctttcaactacatcataatggttttccgtgctttgcaatgtctcagaatgggaatgcaaagaaaagcaagatattgtgatttttcattagtgcttggcatatagtaggcatttacatcagtgaagtgttagcaatatcatggtgtgcagtggaaggacttgagctagaccctgaaggaagggctgtataattttgattct

SEQ ID NO: 203991 - DNA, 555 bp, Homo sapiens
tattaaatttgtttaacacctaatttgacatcaacaatctggctacatttgaaccaatatccagacacaaaagcaatttggctgagacaagttagtttctgataaatgcttcagtgtgtgtgtatagatttttctcctttaccattttacacagataatctgaatcagaaaatactgcaactccttcctccttttgtctgccttttgttctccaaaagtaagtggaaattacatttccaagaaaggaaatgaaataattgcaggcccaaggtctgcaaaatatgtgttgaattgacagtgaaaaggatccatgtgttgacagacacagttgttagatgccataaaggcagatgtgaagctcaatttatttctcatcttgcttgttcaatgactgcttaagagacacattccagtttaatttatctacttaaagctctaatacaaatactgtggactgctgtattaacttctaaactttgaaacctaatgctcgattattcggttcttgacattctttagctaaataaaataactgatgccgtgtattttcatatt

SEQ ID NO: 203992 - DNA, 670 bp, Homo sapiens
tccgagtggaacagcgatcagtcagcggtgaccatacagggggctctcttagctggctgtgtctgcccaggtcaggagcacattgcatctaggcaccatgctgagggctgatggggcatgggcgtatcagagatagcctgcctctctgcctctttccagatcgctcattagactgttggccaggacatgctgagcccatagccctgtgacatgtcacccccttgggtggccatcagtcctgcccatgaatcagtaggttcccattcagggctgtcttgcaacaatttggaacccacctaactggattaaatgtcaaggaaataatgagagaccttgccagccatctgacatccaggttcactgtgtctgttgccttttcctggttgacagccttttgtagcctgttggaaataggttggcatggtgctcttagtgtcatggagatcaggcttaggttgtgaatgggtctagatctgagtcacagcatctccacttatgggctctgtagccttgggaaagtcacttaacctgtctgagcttcccttttcctcagctggaaaatgagaataataatatttctttatccccccaagatggctatgaggcatagggagataatttgatctttaatgatctggaaatcattcgataaagctgctaatgtagtgat

SEQ ID NO: 203993 - DNA, 436 bp, Homo sapiens
acgctgcactccagcctgggtgacagagcgagactctgtctcaaaaaaaccccaaaaaacaaaaccaaaaaacccccccaaaacacaaaactatacaatcaccacctggtgccttgactaatgagtgatgacctgctctttgaaaaacagaacacaattaccttattcaatgataagctggctgttgtgaatgcgcctcttaggtcagtaagacctcaggttggggtgaacttggatgaggcatcatcctaaactttagtttccacctctgtaagataggagtacccactgacctagcagtgaggttccagaagctataaaagatgagattcaaagtgcctggcacataattgatactcaacaaatgggattctcttccctgggggcaaaatatgcttcgcatagtggggggggcaggtatagacaaaatctaccc

SEQ ID NO: 203994 - DNA, 304 bp, Homo sapiens
ttaaatccaaagaataaaattgtgatatatatggctgctcttcaattttgctgtttattattttttaaattattatattcaaagaaaccctttccaaatagtttctgtattcatctccatgctatagaatatttcatttttaaaataaaaatgtaatagtgatcagttatttaaagtatttgtgtggttttatatcgaatgtggataattaacatatagcatgtttcatataaatatgtatgtatgtgttagagcttataatgaaagaaatagtgataaattgaataaaacagtctagcttttt

SEQ ID NO: 203995 - DNA, 359 bp, Homo sapiens
tctggaccgacacataagtgcaatgtatgttttcatatgggattcctataccttaaaagaaaaagaggcattgtttggacagttggtgaaatttaaatggggtctagcaaagatatcacatctggcccaacagctgcaatcagggctacttcttagtccacagttacccttcaaattgtttttgtttgtttgtttacaggtgacaaaatggtgaattaaatggagacatgatggggttcaccacccctgtattctttatgtttttaagggtggcactcatttctgccagaccctctgtgatgcaatattgtttttgctttactattttgcgtgtgtgtgtgtgtgtgtgtgtgtaagag

SEQ ID NO: 203996 - DNA, 302 bp, Homo sapiens
cttggttggctgtgcatttgaaacgaggcagagaagctgcttggaagctccatgaatgtgggctgggtttgtcaatttctgacctttgctttatgataagcagttgtgcttaggtgctcttccctcactacccatttggttcagtttcttttactttctttctttttttttctgttcaccctcccaccctgtttcagtttctttagagaagagctctctgatttttcttttcttttgcttgaggaataacctgtgtgttgtgtgtatgagttgtgagaatttaattgtcgtatcaatgcgca

SEQ ID NO: 203997 - DNA, 265 bp, Homo sapiens
agttggcttcaaatttgcaaaatgcccgtctccagctttgtcttttgcctcaggtctgtgtcccttgaacactccgtgctgcatcctcgtttaacatttttgcctcttcatgcagcagcctccctgtggcactctggggaagtccagtaaattctaatagagcctttatcagtgttcggtagacagatcttgatttcatcaaatatctttcctgagctgccaccagaggtgagaaccagccccctctctccctgaaccacggcgc

SEQ ID NO: 203998 - DNA, 531 bp, Homo sapiens
gagtgttagtagcccacgtctccttcttgctttagagaattaattctctttggaattggatcatctacccacaaaacacctacccaaattcctgttagaaagaagatcagctgagaaccaactgacttggtgtaattcttcggcaccaacactgaagcatgagggacggaagggatcaatgcaaatttaaatccaaaggatttacctttaatcagattaccaggagaaaataagagttgagcagccctttagcttactacacttgattttgtggcctctcccagctgtgtgggtaatgccagcctggggccgttctctttcctgtctgcagaaggcggtgggtgtggcaggaatgtccctaaatatcccctcctctgggagagttgaaggttcagtgccaggatgactggtgacttaaactgagtatcccccagacttccccaggatgattttgttgctctccagtcagtaataggtgactagatcccagtggttcattaagctgagaaaaagtagaggaggcataagtta

SEQ ID NO: 203999 - DNA, 250 bp, Homo sapiens
aaaacgcttagcctagccacacccccacggtaaacagcagtgtttagcctttagcaagaaacgaaagatgaactaagcttaaacaggttgggagatgtcagtatgaagtttagaaacttctattctgaaagaatctcggagcagttgtaaatggagggaaaattgtatgtacacttggttttcaactcttcagcatgagcagctgttttaacagttgagttgctagccactgtcaggaatagaatatttt

SEQ ID NO: 204000 - DNA, 585 bp, Homo sapiens
ttaaagtgttggactagccaggtgtggtgactcgcgcctgtaatcccagcactgtgggaggcccagacagaaggatcatttaagcccagacattcgagaccaccctggataacataatgagatcctcgtctctacaaaaataaaaataaaaaataaattgcactaaaatacttgattattgaagtttgaaatccacttctacgggcacgaagccacttagctccaaagccaaggagcgctttggagaagaggtcccaactggtgcagatccaaggtttcccatgggtggggaggcaggatggggggggcgcctgcaaagaggtgagggctgtacgatctccaaggaatttgggagcaggggtcccgcttttctccgccgggcgcccccagccagctggttgccgagcccacgccccatctgcacaccaggacccggatgtgcagcgcgcggggtgtctgggcccgtggagcctgcaccgcgctgcgctgcaaggcgcctcactgtacgcactggcggccgttgcggcggagcaaccatcccctgcccgacgccgccgggagtctggagacgcacctggcggccgc

SEQ ID NO: 204001 - DNA, 337 bp, Homo sapiens
atacaaaaatcaatgaaaagtggcagaaataaatacttttttatcagtaattacattaaatgtaaatttaataaactttccaattaaatggtagatacttgcagattggatcaaaaaataatccaagtatgggctttctacaaaacactcattttagacgtaaagacacacataagttgaaggtaaaaggatggaaaaagatatttcaggcaaatagtaatcaaaagagaacaggaggggctatactaataccaaacaaaatagactcaaatacaaaaacttttttaaagagacgaggatattatataatgataaaagtgtcagtcacctaagatgt

SEQ ID NO: 204002 - DNA, 472 bp, Homo sapiens
agggaagtcagttgccatgtcatgaggtcatgtaagcagccagtggagaagtccatgtggaaaagtccatgtagtgagaaactgaggcctcctgtcgacagccagcatgaactcattacgcatatgagagtgaaacatcatggaagtggatcctctagccccagatgaaatgttgagctggttggctcctgtcacatggtatagagcagagtccatttgcaatacacaagaagagaagcataacatcaacctggtgacaaatagagattgtgtgtttactacagtctgaagaaactttgtcctcttcccacttttttccagaatgggcagaaggagtcactgaacaaaaacgaatctaagcatcaattctggctttagaactgccttgtcctgcctagagaagacctaagggcagggaaaatctcccagtatcggatgagaccttaataaaccctacaagccaattagggtt

SEQ ID NO: 204003 - DNA, 366 bp, Homo sapiens
agggaagtcagttgccatgtcatgaggtcatgtaagcagccagtggagaagtccatgtggaaaagtccatgtagtgagaaactgaggcctcctgtcgacagccagcatgaactcattacgcatatgagagtgaaacatcatggaagtggatcctctagccccagatgaaatgttgagctggttggctcctgtcacatggtatagagcagagtccatttgcaatacacaagaagagaagcataacatcaacctggtgacaaatagagattgtgtgtttactacagtctgaagaaactttgtcctgtgagtatattagagtctaatgagggcaataaataaatagcaatactcaaaacagccacatgg

SEQ ID NO: 204004 - DNA, 408 bp, Homo sapiens
gtgatctgcgtcttccccgaaatgacctaccatagcatttctgccactcccagtcactgcttggcagcacccatgagaagcatagactcaatgtgtatgcagagctggatgcaaggagcacagcagctgaagccatcagttttcaccccacagctgaagatctgtcagtgaatatgctcaaggttgccactataattttgggtcacagggtagtgcttatactgatgcaaacaagatccaaagggatgcctggttcaaaaggtgggaggctttctgcaagtgaaagatgaggaaaaactttaaaaagtttattttaggctcttgatcctcattgttatgatgcatccttgtaaatttgtcccaagaaaactttattaaaattcatttatttaatgagattaaccacag

SEQ ID NO: 204005 - DNA, 687 bp, Homo sapiens
tctactcactgacattagagcttcctggtggggtggtacttgaactctgagtaggaaccaagtgggcaggaggggggtacagagcaggggctgagaggttggctcaggttggctctctgggagcctgactgtaagtctatagttttattttattttgctgttgtgagaaatctttgataagttagaacagtggttctcaaaatgtgatcttgggacccatcagggttcccgagacctttgtagggtgcctatgaagtaaaacatcttgtcataacaatattaattatttgcctttttcgctctcattctttcttaggtggaatgttctagaaggcatatgatgtgatcttgcaacagattgaatgcagaaacagagatgagcgtccagccatcttccattaagccagattttaagagactttcaaaaatgtgtaacaatgctactcttctcacaaattatttttggtttgggaaaatatattttaaaatatgtttgcattaatatagagttggctattttacttgctaaattcataaatattttgtaaatacccaggtttaatttatgtaataatatggtaactacagataactataacccatataagcaaaagctctttggggtctccattaattttaagaatcaaaaggagacatgagaccaaatttaagaactgctgggtcaga

SEQ ID NO: 204006 - DNA, 434 bp, Homo sapiens
atgcagatctaggccataggaactagtcttgaggccactgggccaacatcaactgtgagaccaactgattgtgagatgcagcctgcttttcagaaatgtgaaaatgtgaaattgatgcaatatggtagttgcaaagcaactgtctgtgagtatggggaccagttcttattagaaaagcctaagaacaatgtagccagatggtgctggaagcctgcaagaaagtgaatctggactctgaatgttagattcaggcgatgtggcttgctaaatgcagttttgtcacctgttagatggctagagcctgggggatcacagttaagggtctgagaggctgaggcaggagaatcgcttgaacctgggaggcagaggttgcggtgagccgagatcgcgccattgcactccagcctgagcatcaagagtgaaactccatctca

SEQ ID NO: 204007 - DNA, 416 bp, Homo sapiens
tactttggtacaacacattgcatatataatactgttttttaacagttatacacaaatcaaaataagagacttcttcagacaaatgttcaaaattattttctttgtcctgtgtaatcaacccattttttcttaaaacatcccatgtagctgatttccccagaaaaaaagaatattataaatcactattgtcttcgttttcaaagggggaagggcaaggaataataagagggttcagaaagttctaagaaatctgtcttggatttcaaactaagcctaacagaatgaattgtataaatacagaatgtgttgtgtttcacagttttattctctgtttcctacccaatctcaccttccttcagggtacattttaaacttattcctcagttttgtaggtcctttcagtatagggtaaggga

SEQ ID NO: 204008 - DNA, 199 bp, Homo sapiens
tggtgccatcagacacagtggtccaggagctgcaatgcgttgctgatgaggatggtcacacatagctctgccctcatggagcgtcccagggtgaaatgagacctcccctgagaaccgactcccagggtaggggaaatcagtctgcaggcaaagaggaattcaaatttagcctgaagcacaggttttctgtgcttctagg

SEQ ID NO: 204009 - DNA, 242 bp, Homo sapiens
cttgcctccttccctgctttctaaccacacatcttcctatcataaaccactaagcaccacctactgtgtgccaccgtgcattaggttaggctgtccttgacagcccaaaggtgaataagacatggctctgccctcaatgagtttacagtctggcaacaagcctgcatcaattaagatacgtttggttacaagtaacagaaggcccagccatcagtggttgatttcagaaagtctgaaggtgg

SEQ ID NO: 204010 - DNA, 1007 bp, Homo sapiens
gtgactttctagagatagagcagatggaatcaatctggctgagacctattcctggaggtgaggaagatgacagaaatagaggaattttaagagctaggtgcagtggttcacgactctagtcccagctactcaggagactgaggtgggaagatctcttgagtttttgagtttgaagccatgatgagctatgattctgctattgtactccagcctggctgccagagtgagaccccatttcttaaaagaaaaaaaaaaaaaggaagagagagagagaaaaactttgaaaggttcttgagaggtacagctcctgagagttgtcactttgagaacaattgatgagggaagctaccgcagccccggatgtagagttatttattctaccactggagattcctaatgaacagaattgtctctgccattgcaacatgagctccctttaatggggtgctcatcaaaaatcttttgattttctttcttactgcaaagaggtattataatttcccacctggcaatctatagatgttagaaggtgagatgagaactattgaacaatttattcatacgacccttatatttttatgtggttctcagagtgccattgaagtttgtgaactttgaaaaaaggccttatctcaacaggtgacccttgaaaaacatgggggttgatgcacacattcgttatatagtaaaaaactacatgtgatgtttgacttccccaaaacttaactaccagtagcttaccgttgactgggagtcttactgatagcataaacagtcaattaacacatatttcatatgtcatgttcattatagcttattgtatactatgttcttacaataaattaagctggagaaaagaaatgttattaagagaatctcaaggaaaagaaatatatttactattcattaaatggaagtggatcatcataaaattcttcatccttgtcatcttcaccttgagtaggctgaggagtgggaggaaaataaggggctggtcaaaaacagca

SEQ ID NO: 204011 - DNA, 824 bp, Homo sapiens
gaatgttggtaactggtttttggattccccacatggctacttatagatgagaaaatgcaggagaatcaccctattcctattgatggggtcaccacctggagctggtccaccaggctctttgttcgcactcccacactgtgcaaatgctgcccattctccaaaaagcacgtgcccagcccccaatcccctctatatctcagctgaagcatcacctccattaatgaagcctagtcctttcctgcctcgtgtgttgctttgttgctgctcacacctttagacaagacttgctgccactgactcccaccagtccctgttccctggaagaaatcaaggaagcccaccttgatctcatttgagctcctaattttacagaaatagggacaaaggttcaaagggagcctcacaggtcgcatggtcaactacgcaacctgcatttaaggcctctggtagtcagagcaatgaaccacctataaagaactggaaggttgagggaagccggagaaagaaaacggactacattccacctctttctaaatcaaattccaaaaccatatttcattacaacatctacaagaaatccctaaaatgtcaagttccttcacaatcttaataggtaaaattaccaaagtaaaaatgaagggaggaaaagacgatagagaagataatataaatatctttaagtaccatgtgatttcaaaaagaacaggtttttgaatcataaaagtagatactagaacagtacaccaccactcccctctgtccctcggattattaggagtttgcaggagctcgcagcagacagtgatcgtggggtttcaggcaaa

SEQ ID NO: 204012 - DNA, 381 bp, Homo sapiens
caaacaccgcaatctggagaaggagaagaaaagaagaaggagaaggaagaagaaaagaaaggaggaggaggagaagaggaaagaaggaggaagaaggagaagaagaaagaaaggagaagaactaagaagaaaaaggagaggaagaagaagaaggaagaaggggaagaagaaggagaaggagaagaagaaagaaaagacgatagagaagataatataaatatctttaagtaccatgtgatttcaaaaagaacaggtttttgaatcataaaagtagatactagaacagtacaccaccactcccctctgtccctcggattattaggagtttgcaaaagaacagatgcggggagattgcgtgtttgaggatcctctagaccacag

SEQ ID NO: 204013 - DNA, 475 bp, Homo sapiens
cacacatacacactgtgctaagcattgttctctgtgtacctctcaaccctgctgcagaaaacagtcttggatgctgctgagagagtttctagcccacagagcagggtccctgatgtctcctgagtggaaaacacagcaagatacccaaactttcaggagggatgcttcatttgtccccagtgaggcatgccgagatggaagctgggggaggccctatgcagaggcaagcccctcctcctccctgtccctggattggctattttcagaatggaccccagcaggttgctagaagtaaggctgcctgatcagtgacacagggctatcacctgttaggaccaaagtctacaccaataagggtagagaccgtagatcatctccaggcaaaaactcaagtggtctcatgggaacacagctctggacatcatgagaatgttggacccaggttttgtgaactctaacgctattttcagccatc

SEQ ID NO: 204014 - DNA, 420 bp, Homo sapiens
acagctgccccactccaggctgaacctccccattggtagcagctttgtgtcactctggagtggagtttccagaggcaactgacagtccatatgccactgccactgcaccagtacttgcccttgctgctatgggcctgaggaagcaacaaatagcctcagttctttacttgcatctccagcatgccacagtcaccctatggggaagaggccagattgcctgacaccctctgctctgcaccaggcagggtccccgtggcatgtactagcaatgcactcactctacccccagctgatcattctgattggcagtggctgcatttctctgaagtggaactccaagaaacaaatgaaagacccactgccgttgccactgccaagtcccttctcctgttgcacccaagctgcagagggaaaacaaac

SEQ ID NO: 204015 - DNA, 835 bp, Homo sapiens
atttactttagccaacagccatgactgctaccatacaggttcaaaaaaagttatatgaatacatgggatggaatcttataagttcattttactatatgtaagcattgcttgactttagaagcaaaagtaataatgtattttaaaaaatcattaatctagctacatggagaaggaaaacactattatacaatgcaaaatgactattctaatccatttcaaaaacgctcattaaggggaagaaaaactaaaaacagaaataaatctataagactaaaggcacaaaaatagaagtgatttttcttgtaaaagatatgaactaactttcctgaagttctcttattgtaacaaaaactgtcctctgagattaagtcacctatcaatttcctaaaaatggctgaatcgtttttaaaatccccatttactcacaactctccagccccaccaagattccatttagagaaatgatttttaaaattttctcagtagtatttattctactattttccctcaattctgttctcttaaaaatatccattagagtcaagaaaaacagcagtcaggggaatacacttcttcctccccaggagaaatgcagttccacaaagggacagctggatgcccgcagtaatgatcggtagaaaagaaatgctctccctcaattgtttctccactcccacccagaattctgctgagttgcctatgctctgacttctgcctcctgccactgagctgagggtccccagtggttccccagcccaataaagagaaggcgaggcagccaaagccactgaagttgctggactttgccttccctgtctcatggaaggcatgaagg

SEQ ID NO: 204016 - DNA, 401 bp, Homo sapiens
gcctgactctaatggatatttttaagagaacagaattgagggaaaatagtagtatttattctactattttccctcaattctgttctcttaaaaatatccattagagtcaagaaaaacagcagtcaggggaatacacttcttcctccccaggagaaatgcagttccacaaagggacagctggatgcccgcagtaatgatcggtagaaaagaaatgctctccctcaattgtttctccactcccacccagaattctgctgagttgcctatgctctgacttctgcctcctgccactgagctgagggtccccagtggttccccagcccaataaagagaaggcgaggcagccaaagccactgaagttgctggactttgccttccctgtctcatggaaggcatgaagg

SEQ ID NO: 204017 - DNA, 1448 bp, Homo sapiens
tggattagaatatctgccctcctaaaggcaggcaggatggcggtcaggatttagaacaggccccggatctagactttctgagtccaggtcccagccctgcctcttccagttgtggcccttcaagatgctgactgcccctgggcctgagtttgcaactgtaaaatggggtgaactgtaactaaagctcctgtctcatagtgtaggtgaaagggtgggatgagaaggttgatcccatcttgggtccttgcgtggcttctgggaggtggtggataaacctcttccttcccttggggctttgaactccctgagtgagtcagataggtgagatgccaggtgtggaatcccagcactgaataggtgctcagcaaacaccaacatcaatgatcgtgagtcataaagggcctgcaaatttcattcagactccagactccctgctcccttcaccctggtgggctggaccacagctgtgcctgaatccgtgcagtggcggtgtgcttactgcctcccggaagagcgtcttccgcagcccagcagctctggctcaaccacgctggttaatggggaagaaaatgaggcacagagagggccagtgagccatctaaggtcacacagcaggtttgagacagagtcagggcaaggacccagcactcccctgccctcgctcttctcacccagtaaggagacgcaccctgcattgtctgcttagggccgacctgtcctgcaaacacaaatccctgaccttgggggaattcacagtctgatgcaggaggcagccaggttacagctgtcacaagctcaggtgacatgaatgctcatggaggaagcccagggcatcggatgggctcctgaagtcatctgatgcaccctgggggatcagggacaacagaggacctgccagaacagtcttgtaggaaaagccgtgtggatttcccagcacagagagcagcgccagcaccatttcagccccgactctctgaggcctcagtcatagaaccagccagttccctctggaaggaagtgtgctgggaaggtggccactcagacagtgtgggaccccctatggagcagactggctggatctatgggcgagggaaagtttcttccaccctaggatgagtgaaaggttggtggggaatggagcacaagtcatcaaggtcagggaccacgttttctgaaggcctcgggcctcagaggctctggaaggccgtggaggcaggatggcccaggagctggggatggccagaacacctagagcctccagggcctgccctgaggactatggcgaggagtagcatcagctccgggtgctgaaggaaccccctgggccttgtgcaggacactcttgacgggatggctgggcgacggagcagggtggcatcatccatcaaattcaacacaagccccacgtggaattctaaattttctagacaccatgttaaaagagtaaa

SEQ ID NO: 204018 - DNA, 477 bp, Homo sapiens
agaaatcccagaaacctttctgtaaatgaaggtcgagttttgcatcagagaaaacgtgtttgattgaggccagggtggtggagaacggaagtgacgacagacagaagccagcagaagtaaggcacgaggctccacagaatcacgggatggttgcagccagattctaacatcagaggggcaggatttgaagtggagaggctgatctgatgaggaggaaggacaaactaacttatttatttatttgtttgtttatttatgttagagacaaggtctcactctgttgcctagcctggagtgcagtggttcgtgcaatcatagctcactgcagccttgaactcctgggctcaagccatcctcccacctcagcctctcgagtagctgggactacaagctcatgtttttaaaactggctaatttttttttaatttttcttatagacacgggatcttgctatgttgcccaggctggtcttaaact

SEQ ID NO: 204019 - DNA, 125 bp, Homo sapiens
actgaacagcataaaaatgtatcttatttctgaagaactaacttgctaatgccggatattttccttgatatttgttaattgctactgttttttcaaaagttacattcttcatacccaagataagg

SEQ ID NO: 204020 - DNA, 652 bp, Homo sapiens
ctgctgcatatggcctgggcatccccttggtgataagtgacttcttgctctgagtcttgttcctgcttttgtcatgtgatgtgcctgctcccccttcaccttctgtcatgactataagcttccggaggcctccccagaaaccaagcagatgccagtaccatgcttcctgtaaagcctacagagccatgagccaattaaacctcttttctttacagattacccagtcttgtggatcacttgagcccaggagttcaagaccagcctgaacaacatagcaagatcctgtctctaaaacagattatctgggcgtggtgggaagctgaggtgggaggttgcttgagcccaggagtccgaggctgcagtgtgctatgattgtgccactgcactgcactccagcctgggtgatagaacaagaccctgttcccccctcaaaaaaagttaacacctatgcagtgcttaggcctagtgtgtgcccagcagtgttcaagtcctttaactgtactaatacatttcatctttgtaacaactgtctgagataggcactgttattacctttggttcatggatgagaaacaagtcacagagagatgttaagtgacttgcccaagtaagttgtgaagccaggaatcaaattcatgcagggtagctccag

SEQ ID NO: 204021 - DNA, 292 bp, Homo sapiens
ggactcgagctcggtccccagttacaacagctccagcctgggtgatagaacaagaccctgttcccccctcaaaaaaagttaacacctatgcagtgcttaggcctagtgtgtgcccagcagtgttcaagtcctttaactgtactaatacatttcatctttgtaacaactgtctgagataggcactgttattacctttggttcatggatgagaaacaagtcacagagagatgttaagtgacttgcccaagtaagttgtgaagccaggaatcaaattcatgcagggtagctccag

SEQ ID NO: 204022 - DNA, 578 bp, Homo sapiens
tgaggtgacttagaggatcccgcgcgttgttgttactatttaatcctccagatctattctgcatcctttacctgtgcctaggaggctgcgtcatgtactacataaactgtgctctttgttctctggctttaaatcgggtcaataaatgagaagcaacaaccagggtctctctggactcccacaattactctctccctttgcccttgctgggccaaatatggtgcaacttcctatcattgctagtccctaggtgctgcactattccttgctggattcccgtaacccttcccataccattgtaaatacctgcttcattacactctttgacctaattaagagtgttacttgtttcctatcaggatactaatagagagggacacctaactcagtctggggaagcctgggaagaattctcagaggagatgatgcttcagctacgtttttagtaagtaagtataatagagactgagcctcactctgtggcccaggctggaatgcagtggcacgatcttggctcactgcaacctccacctcccaggttcaagcgattctcctggctcagcctcccgagtagctgg

SEQ ID NO: 204023 - DNA, 582 bp, Homo sapiens
aagatattttgctaagtaaaataagccagacacaaaagacaaatgttatatgattccacttacatgaggtacctagagtatcagattcataatgatagaaagcagaatggtagttgccaggagctgggaagaggagagaatagggagttattgtttaatgggtacggagtttcagtttaggatgatgaaaaaagttctggaactggtgttggagatggtggtattggttgtgcgacagtgttaatgtgcctaatgccactgaattgttacttaaaaacagttaaagtggcaaattttatatatttactacaaaaaagacatttaaaagttcagttaccgtatctttaaaataaggttgataataccaaccagatggttctttataaggattaaataaactcacatgtgaactagtcaggtgcatagcagatacccttccccaatccccccattttttggggcagaaatttttatgtctttatgacctcaagataggaaagcacaactcaaaagattcataatttgactacctcaagacaatattactaattattatccccaaaagactacagaaacaaactt

SEQ ID NO: 204024 - DNA, 414 bp, Homo sapiens
cccaaatggaatcccccaaatggaatccccccgtctcccgggaggtctaccatattgatgccgatacttagtgcggacacccgatcggcatagcgcactacagcccagaactcctgggctcaagcaattctcctgcctcagcctcccgagtagcaaggactacaggcacatgccaccatgcccggctaataattttcgtatttttaatagagacggggtttctccatgttggccaggctggtgtcaaaactcttgacctcaggtgatccacctgctttggtctcccaaagtgctgggattacaggcgtgagcgaccctgcctggccacatgctgactctcaggccagtgctctgtccacgtttgcacctgctctcacccaaaccttctcattgtcttcagacagagccacagcc

SEQ ID NO: 204025 - DNA, 552 bp, Homo sapiens
gaaatgaaccatctggtgtgccaggccacaccttccaacacttggctctgctgggaccacaaggatgggctttctcatctcaccgtacatttagatggccatattgggtttcggatagtctcccattcttaaccatggtcttcaacagtttttgttttaaaagtgaatactcttatggtaaaaaagataaatgtgaaatagaaaatactgtagatctacagatcaaagttatatttgaaaaccacatttaattgtatattcacatatttttgtaattcacaaaaaatatacccatctgtaacttttcaacattcttgagtgttttgaaaattaacaatttgttctaaaacttgagagttacatagttttgaaatatttcaaagttcagttcaaacacacacaaaactcctggataccacctggagctaaattcaataccaatcgaattttttaggtttgcaaaattgaactaaagaagtaccactgagttgagggcatgtcaagatctagcattaaaccaattcagatttgtacttggaccagcatattcca

SEQ ID NO: 204026 - DNA, 90 bp, Homo sapiens
gtaatctcattctttctacctcaagggataaaaatcagttcttttttgctttattttgtttgtttagttcacctcgttcccctcctatag

SEQ ID NO: 204027 - DNA, 401 bp, Homo sapiens
tctgagcatatgttttttgtttttctttgtgatagaaataacaatatataaataatatcagataatgtataaagagacacagcgtccttgcttatcatttgctagttatcaggtcaaatggtctttatctgtgtgtagacatagatcgtgacatcacatatttcgtgtgtccattatgcttctattttttctatcttatatgggctttccattcaatatcttctcagtagaggccaaatttcaatgtgaagaacaacacaataattggagaggggtgttggttgaatatgtgtgttaggatatttcaactgctctgccttcataaaggaataaacactagattacaatgcttattaattaggaagtcaatcgaagacttagaaaaaaagttcagttccaat

SEQ ID NO: 204028 - DNA, 631 bp, Homo sapiens
tccttaactatgaagctgatcgtttaactttcctgctcaaaattatttagttataccacgttatgcaaaaaaacaaaggccagtttcctaaaggtctgtttacaatctggtcttcgcctgtttttttttttttttttttttttttttttcctgctaaacctacacactgaagaaagttttgtcaagcatctgtgctgtatcatattaagattccacctggaatgtttttttacccctgtctactgaacaattccttttcatccttcaagcatagtcttatggttcattttattcttttagtgaatacttctatgatagtctttcttctctatttgtctttctttccctgttacttatagtaattacttttattactctcaaatctgtattttagatattctctattgttctcataactgtttctctagtgaaacttccttgagtgtgtatatgttgtctgtctttatatatccatgatccaaggttgggacagggtacttggcataaagtaggctcttagtacattttttgaatgaatgaaatactctgaaaggtaaataataatcaattttagcataaatgaacctcatcatgaggacatagtagataaaatcataatagtagtttagtt

SEQ ID NO: 204029 - DNA, 435 bp, Homo sapiens
cggacgcgtgggcccacgcgtccgggcccagagaggggccagtgcttgtctgaggccacacagctaggggcaaagtcaagactgaacccaggagctcctgcctcccagcctaagtacctttctgtttaccaggcaacctcccttgtaaaagtcccacatctgcatgtcatttgcatcgatcacacaaagccccacatgaaatgtggctggatgctttccaaaatatgacccaaagcaagtgtgtgaactgacttatattgatcgctgtactagccagagatgggcttatctgcttggaattttcaaaagtgtttcttttttaagtgaatgatttgattggcttttgccatttaaaaatatatccagagacatgtgatcaaatgctttcctcttcttaggccagatttcatccaaataaaagggaacctggcttgt

SEQ ID NO: 204030 - DNA, 487 bp, Homo sapiens
ttatggaacaaattatctggtccataaccacaaattagctggttccataacagcttatggaacaaattatggtaatatgaattaccataagaataactttttataattctacaaaagaaagaatcaaaaaggtaaggtgaagaactgctgtagattaaccaactggatacttactaaacataatttcacatggggaaaataattacttcttccaactttaaaagtctttacaaatatgcaaaatcactgtaaaaactaccttcctgcctttgttcttcctatttagcggagatacttccatgtagctatcacctcatgaacccaatttttgtggaaggatcttgggctgaactcttgttctgctttatgcattgccaatacaagtatctagaaatctccaagaccgaaactaaaatcagagagcaaatttcattttctttatattggcttgaatttgtacaagcagccagttactgagcaaaaatcc

SEQ ID NO: 204031 - DNA, 507 bp, Homo sapiens
aaatcacataatgagggcccatgagagaaatgccttgtgtgaagtccacctctgacaactgtgcaggacttgatgacacatcctttgatatcatccttacccctggcttcaccttactgtcttatttgtattttcggtttgcaccaatggcctccttaatgtttgagggagctgtgctacatagaactctaaaagctgctagcaataatttttcaagcaaggcaaagcataatgaaaaaaattaatatgcttttcaaattctattatctctaattcccacctcactatgctcttcacttgaaaacgtggaaagtaaaaagataatttatcttcctcctgcggcatgttggcaagcattcacccagcccctcttcactactcccaaataaggacttgctgatatttttagcaaaacaatttatgggtccatttttcaaaaatcaagctagttcactcctgtgcgtgctcatgcgcgcacacacacactcacactcacatactgcttga

SEQ ID NO: 204032 - DNA, 463 bp, Homo sapiens
actgagaaggattatattaatcccagctgataggggaaagagtcaaacttcccataaatgcagtctgatacaaagccaggaagaatgttgagatctaatgaattaagatacagtagtgctttctgccatcaaggaaaaaaagcaaccatgattctttctgttaaaagtgacaggaaggccggatgtagtggcctataatcccagcaatttgggaggtgggaggcaggaggatcatttgaggccaggagtttgagaccagcctgggcaacatggcaagactccatatctacagaaaatttaaaaattagccaggtgtggtggtgcatgtcggtagtcccagctactgaggaggctaaggtgagaggattgcttgagccctggaagtcgaggctggggtgagccacagttgtgccactgtactctagccttggtgacagaatgagactctggagactctgtctca

SEQ ID NO: 204033 - DNA, 352 bp, Homo sapiens
gatacgactctgcgagtccaattttgaccgtggtcagacgacttcattagaaaataaaaattcaaagactacaacccacaggaaccatgaaaacaaaaacatcaccatttgccaaaacccgtttgtctggatcgagcaagtttatactaacaaactaaagaatgagaaaaaatttatcttgcagactgtaaaagttcctctacttaaaaatggaagtattttcatttttaattacctttgatttgaattcttctctacaaagaaatctacattattaaattgtagttggccttttaatagatgaaagatatcttgagctgacctgttcctggttagctgattatagaactgg

SEQ ID NO: 204034 - DNA, 500 bp, Homo sapiens
ctagaggtccccccagtttcagcctgactctctccttagagcttccccaccattcagtccaggaattcctcaccctcgaaggcccagagtattttcttctaagagtttcatacttttagtttttcgatttggatcagtaatccattttgagttaatttttgtgtgtggtgtgaagaagggttcagtttcatttttttgtttgtggctattcttttgttcccaacaccatttgataaaaaagactattctgtctccattgagctgatttggcactcttgtcaaaaatcaatttacctgtaaatgtaagagtttatttctgggctcttaattaggttccattgatctttgtatctatccttttgctggtactacgatgtcttaatttctgtggcttcatagtaagttttgaaattgagaaggaagtcctctagcttcgttctttttaaagattgtttggctattctatgttccttgcatttccatatgaattttaggatccg

SEQ ID NO: 204035 - DNA, 486 bp, Homo sapiens
caagcagtttacctgcctcagcctcccaaagtgctgggattacaggcatgagccaccatgcccagcctattcctatattttcttctaagagtttcatacttttagtttttcgatttggatcagtaatccattttgagttaatttttgtgtgtggtgtgaagaagggttcagtttcatttttttgtttgtggctattcttttgttcccaacaccatttgataaaaaagactattctgtctccattgagctgatttggcactcttgtcaaaaatcaatttacctgtaaatgtaagagtttatttctgggctcttaattaggttccattgatctttgtatctatccttttgctggtactacgatgtcttaatttctgtggcttcatagtaagttttgaaattgagaaggaagtcctctagcttcgttctttttaaagattgtttggctattctatgttccttgcatttccatatgaattttaggatccg

SEQ ID NO: 204036 - DNA, 509 bp, Homo sapiens
acaatttcccatcttaacacaaatgcaaatatagcagatgatttaaactcttcatgaagagcaagcacatagatgggaaactaacaacagtgtcttagggcagggactgcctgagtgccaggaaaccaggtggggctgtcagcctcactgtgaggctgcctgagatgctttttcaccacgcatcctcagcaacttcgcttcactttgtccaaactgttgtggcatcaagaactacaggatacggccaggtggggtggctcacacctgtaatgccatcactttgggaggctgaggctggtggatcactgaggtcaggagttcaagaccagcctgggcaacatggcaaaatcccctccctactaaaaatacaaaaattagtaggacgtggtggcccacacctataatcccagctactcgggaggctgaggcaaaggaatcgcttgagccccagaagtggaagttgcaataagctgagatcatgccactacactccagccttggtgacaaga

SEQ ID NO: 204037 - DNA, 623 bp, Homo sapiens
aatagaataatggcaatttgcaattaagaattagaattattttttaaataaactatagaactaaaatcataatatccaaaattaagaatgcaatgaatagttttaacagtagattggacataaaactggtgaactggaaagcaatgcaatagaaaaatacccaaactgaaggaaagaaactaaaaagaaaaaaatgattttaagaaattaagagaaataagggatatattcaaaatgtctaaacaatatataattgcattaccagggaggagagagaatgaaatccgatagtcaaagagataatgactaaacattccaactgatgaagacatctacccacacattcagaattcacaacttcagcagataatatagggatccttgatcaaagaaaatcacacctagatacatcatcgatgtcagctttctaaaaatcaaggacaagaagaaaatattaaaatcagccaaacaaacaacacatttctttggaatgagaaaaaaaagaaaaaaattaatagctgacttctcaaaagaaatcttagaagcagataacaagccagtgactttcaaatttattttttttactatgacctacaataagtatattttatatgggcctcccg

SEQ ID NO: 204038 - DNA, 527 bp, Homo sapiens
ttgaagccgctagaaactgaacaaagactgggttggccgaaatacagctctgaagcctcataaaattcaaaaaagaattactcctcttacgcggatacagtcagttttttccaccgaaggaattgctgcggcacattactgttccttgtgttgagaatatgctgtaagagctgtgtcgagataccagtttttatattcttgtaccttcgactgctgcagaactccccaagcaagaagttcttccacagtgtccccaaattgtggaagaggctcgctcgcttctgaggaaacgttagggaacaagaaatgggatggcgaatctggactcaaaagtcttgctgtcccagatccagcagggcactacattcattactggagtagagaagcacagcaattatttgttgtacagaaaggctgtcggtgtcatccattttgcttaagtaatccccattacaagtgtttatttcttgtacttaccctcaagtatgtacaaatgcaaatatctaccctgtattacaataatcttt

SEQ ID NO: 204039 - DNA, 456 bp, Homo sapiens
taccctaacccctagttcttcttcctagcctttttctttttgctcccctattttcacaatttttttcattcttttcattgtcgtacagtcttagttccaagttttcttatgttatttccactgtgtgtctctcctggtctgatgagccagggttaaaattgaccttcacctctttttcagtcagggtgatcactttgcattcagcatgcatgttggtgagttcctaatacaagggctgcatccttttttacctaagaatcattttaaaagcaagaagtgaatagatcacattgtttttcatttaaaattaaagtagcatttaagcccaatggggaaacacatatacttacaacttggataaatttctttgttgagtagaaaaatgccttgagaaaattagtactgcctctcaaataccaaaatataatagctgggtatatttgagaagtagccact

SEQ ID NO: 204040 - DNA, 598 bp, Homo sapiens
gacagctttagaccttaaacacagtgtttaatgagtataagcaaaatagcttccacatgatttaattacttgttttattgggtacttaatatatattaaatacagacctcgaagaaatgaatttttaaaaatctatccattcaggaaaagtatgggtaacaattaaggccacatcaaagagtttgaatgtgaaaaaatgaatcagttaagggtaagtgacataattagaatcatattttagtcagaactgtaaagggtggatcagaaggacataagattactggaagagagatcacaagtggttacagaaatcatctgggtcagattattccaaagtggggtgtgtgtagcccaggcaagatgacccactggaaagagttttaaaatcagtattgagatacaattcacataccataaaaacacccctgcatgtctaacagtgctgaactcgtttatgagttttcaaaaattttaatagctccttaggcactgggaaaaaatttaaagctttcttcttcttcttttttttaatctaagcactacaaaatgttaaggtttactaatatttattactgggattgacagtggaaaatgtagt

SEQ ID NO: 204041 - DNA, 654 bp, Homo sapiens
agtgcttttgtaccttgttttctagaaaatgtattagtcttgacttctaaaagtcaaaaatgactttataatggaaaaacaattcatcaacatttaagagggttttttttaggtattctttaagatcttacaatctaaaaatggattatataagtttaatagaggattatggcagttagaaaaatggtagtttgaggtatcattctgaatcaaaatatttgctaaaatctgtctttagtatgtcagttaaggtgaactacatttaaatataagtagtatatttatgttacacattaacttaaaaatgagtaattagatttttaaatgtttgttaactatacatgaatgacataccaaatgaaatcttaaggagagagagcacattcagtgtgacgtcatgaatgaaataaaacttgtgcagtgatttagatggtttgattaatatctgagcacagtgggctgagagaagataagacatttataaacctttatttgaagttcagaactttaaatctggataattaaggaaaggagctaaatggcagaaaatcttgaaatagcgatgagtctgaataatttatacattatttaattttcctctaaaatggttatcaagaattgaaaacagtctcaaactctcacagtccccatttg

SEQ ID NO: 204042 - DNA, 443 bp, Homo sapiens
gggctttgacgtttgcagcaccagcaaagccgtctcagtaaacccgtccacgcacatcctctctccctcgcggtacagcagtgtttccggggctgcacggcagcgccctggcccgttgttctttattgttgtccccattgcacttaaaaacatttgggattggctgcagtgcaagtgatttcctagcaggacggagcagagccctctggcgccacattcctcttggcagaagcctcgctctgcgtggcactgcatctccccatctttgtgtcctggtgtcaaagcatttggcccccaaggccctgcagggactcgctgctatttgcatttcagtgcaggtagcctgtttacttggcggcttaggagcctgctgatttgggccaggaaatcaaaggaacctggaagtggagaatagtgttttcaattccgtgaaagagctcttg

SEQ ID NO: 204043 - DNA, 207 bp, Homo sapiens
actccctgtgccttcctagactttcacagcccacagaacactcttccgggctgttctcttggtctgtgctctcctgttgttttctgatgtccatgtgtgagtctcacttccccaacaccgtgttatgctctgaaggtgaggtgggctaggggctgtgtcttgaaactgctgggttcccaacgctcaccctagcagagatccctgtct

SEQ ID NO: 204044 - DNA, 1265 bp, Homo sapiens
gcaagtccatctttatggaagccagcacaaggaactgtgtgcaaataatgaagacgcttgcttggatcctgtttcaaaattctagaccagggctaccttacacagaattggtcatgttactgccaggagatttctgtgtaacttcatttattggctacagttttggcatttgaagatgtggtactcagatggggttttgtccaccattgtcaagattgtaatcttaaaaatcataccagtcattgataatttagtttatcctgaggcagtcgacttgcagaggcacagtctacaaagcctaggatgttgccactcaatggtttacattttgggacatcttttaagttgtttgtagcactgcagttcaaagtgttaatatttagagggacttctagattttatacctaatgcagtagaaccttgaagtatatttaagcttttttgttaagcttgaacagttggcaagaataatgtgagttcctatctgaaatagaatggtacattaccacttttaagttttaaaaattgatagatgttcagatgtatctcaaactcagttttatttttattccaaatattgtgaatgagaagccattgtcctaaactttggccatttttgtgctataaacatgcatttttaagttataaggtgaatcaaacaatatgtaatacagtattaggatgtaatctttgcttttgtagtactgttaaaatagagaattatgttgtttgcaccgtcttaattaaaattcttgatttttactagttgctttgcaaaaaacaaatgtttggctgcattgctaatatttgtaagtataagttgcttcaaggttgtgctgatgagtagataggatgtagtgatcttagtagtgattgaaagggagggtatttattatacaaactgtgaactgcaatgacatccttagttttggatgatgtgtattcttgtttttctttgcagcattttaatgaagattgctttgaagtgtttacgcagtagcacattagtataaaatttagtttagcacagtggacaaaaagtagttaaattaataacttaaaatcagtctctaatttatacatctgaagtatagcattcctgtatgcacacagtaaataatgggtagcctgggctctgtgttactttcttgtatttttatccaagttgtcagcttcttattgctgtgttgttgtgctaaactttgaaccttatttcttttattaaaaatcagtacactttctataatttagtaagatactggcca

SEQ ID NO: 204045 - DNA, 388 bp, Homo sapiens
gatcctttgttggttccaaaaatctggagggaaattttactggcctatgaaatctaaaaatctgggaccactggtctgttccacgaatttccaggagagcttggacccagagactgcttcattcacatcccatctatccataccccacacattcatccttcagtctcacttttatgcacacaacatgaacgttgagcatttagtactctcagttttaagaaattaaaaacatggttcgggtttttttttttttttctttgagacagggtctcattctgtagcccaggctaaagaacagtgccatgatttcagctcactgcagcctccacctccctggctcaagtgatccccccacctcagccccccaagcagctgggagtataggcac

SEQ ID NO: 204046 - DNA, 315 bp, Homo sapiens
gatagagacacgtttgagatctattttggaggatttgttaggttgagtctttagactggtaagaattacccttggagcaataaaatctcgattctccaagattgcctttaaggctttgatttattaagtctgcagtgaagcttgatattcttgactttccaggcagttttgatgattattttgaaaaaaaggtcaaggaaaatatctgcagctaaaaaagaaaagtagatttaagagtttgtattttttattacccagaataatttacattgtatttgttcagtaaaaataggagttttcatgctgttccaattt

SEQ ID NO: 204047 - DNA, 187 bp, Homo sapiens
tgtatacgattattacaacgaagtagtctgggggtgccttttcatcaaaggtggttagaatatctgaagtacatacagaatggtttttagtgtcagacacctaggcaagtacattagttccaccacatactatgtgccattaggcaaattactaaatggctctgaacctgtttcctcattggtaaga

SEQ ID NO: 204048 - DNA, 366 bp, Homo sapiens
aagatggggctatctgaattttaacaaggcctccaggtttgcatgctcaagattgagaaccactggcaaaagcaaacaatttgaatctgaagtcagcccacctgcatttgaatacaggccctgccacttaataactgtgatttagagcaagttagttacttaacagctaggttgaccaattgtccgagtttgcctggcactatcctgatttcagcactgaaagtactacattatcgctgtggctcacgcctataatcccagcttctcaagctgtccctgtggaatcctcaatatcggtacattcatccctatctagcatccccttcctccctcacccatcctgcaccctcagaattcattctcaga

SEQ ID NO: 204049 - DNA, 367 bp, Homo sapiens
gatagtgatgaaaatgaaattagttacattgataacttactgttatctaacccacagtttgtatttaaacttactccattttcccattaaagactttgaaagtaatttcttcccccagatgagtttccagtctaattgtatgcattgcacttagttttggtttcattagtcacctttagtctagaatgattcctcagactttatttcttttttgctctcgatatctttctagagtattgagaaattatttgtaaaatgttcttatttttttgtttccttaatatttattcatgattaaattcaagctatgcattgtcagcagagatgccataaaagtagggaggcatccttctcagtgcatcatagg

SEQ ID NO: 204050 - DNA, 371 bp, Homo sapiens
atcgttatgagttcaggtgcactaaatacataggaacacccagagaaaatgagcccgaaacaatggttctttttattttggaagtttcagacaaactctttggaaaattgaagaaatctatggatccttttcctgggaagactgtacagacatacgtattcgtgtggtttctgtgggtgtagggactggccctggtcatgtgtcaggaagccccaatccagaagatcgtcttcattttaccttggccggtgatctgactctgttctcgcgcccatctgtggttgattctctgtcgccttggaatggagcatcagatcttgaaggtcgctcattgcttttccacgcatagaactgagccacatggcaagagc

SEQ ID NO: 204051 - DNA, 482 bp, Homo sapiens
ttccaattctgtgaagaaagtcattggtagcttcctggggatgtacaagcccttactcttaagcataatctactgattgcagcctgaattacaccaccaaaaaatacttcctgctttcattgcctgtgaaacccagtgcagtgttctagcaacaaataaaaatcctgtgaagagccttggccctctaaaagcatccagaaacaaagccaatcaactatactcaacttacactacagtcaaaccctcaaggtaaataaagaccataaaaagccccatccaaatcacagcaacttcaaaagataaaggaacaccagccctcacagatgagagggaactagcacaaggactccggcaattctaaaagccagagtgttttcttacctccaaacaattgcacaagctccccagaagtggctgttaaccagattgaaatggctgaaatgacagacatagaattcagaatctagatagcaaggaagcta

SEQ ID NO: 204052 - DNA, 269 bp, Homo sapiens
tgcaggctggataaatgaggcagatcagaaaaagaccttcaatcccagaacacgaatttatcctgagggctaagacccaaccaatgccaatttcaatgagctgatgggaaggaatcatgccacaaaccaggcaatcaggctagcttagggaactgcaggagagagaaacaagacatttgcaaagtggagtcactacaagccaggagactgaagcaaacaacgagccagggagaagttatttgtagtcatgtcaggatgagggagtcacc

SEQ ID NO: 204053 - DNA, 479 bp, Homo sapiens
atggaggtgggtaaaatggtaagaaagatagcagagttgtaagttctaatcttttgtaataggaagtcaatctctaatgtaggagcataagtatatttggaaacattaaggtaataccaaaataaatagctacgattgaaaaacagatgatgacaggtgattttcaaaggaagggattttcaaatggtgtacaacctcctcgtggaggtgtcatgaaatctgcatttaagagagatgcagtaggaagctaactggaagatctgtgagccagcctcattggctaattgcatctctgtgatcagaggcaagcgggcttttttactgggagatcaaatgtcccaagcagcagtaacctaggatcttttccttggggctgtacactttccccagagaagaatcctcaagttttatgcctggaggtgtatgtccagctgttagtgctggaacatgtggccaaatggagtccggggagacttacc

SEQ ID NO: 204054 - DNA, 433 bp, Homo sapiens
cctcaagatgggggcttcgacatgggctttatggagtcataagtggagtccgtaaagaggtatctttactataaagctattgtgtaagctagtcatattaagttgttggctcaggagtttgatagttcttgggcagtgagagtgagtagtagaatgtttagtgagcctagggtgttgtgagtgtaaatcagtgcgatgagtaggggaagggagcctactagggtgtagaataggaagtatgtgccatcttgagcctgtgtctgtgtgtatgagtgtgtgtgcctgtgcctgtgtgtggctgtgtgtgtctttgtgtgtttctgtgtgagtatgtgtgtctatgatggtggggatgatgaggctattgtttttagtgaattcctcgataatggcccatttgggcaaaaagccggttagcgggggcagacctcct

SEQ ID NO: 204055 - DNA, 873 bp, Homo sapiens
cagagtcgagtcccacctcctaccaaaatctcatacaaaaacagcatctgctgccccgaagctggccagacattgcgaaagagggaagaatgataaagcagaattgcagatccaaaggaggtaaccatttctgaggcatctgagacacgttggaagtctgcactctggaaattatacacaaatgggcacactcatggacaagatgggaaaataaatgcctcaagaagctgcacagattgccccaagactctcaggaggtgctgctatcaccacagagcagcccgattgcggctggcgtgtgcctgagctggctgtccctctggccacatgtccggtgctacagggtcttcaagggtgtgtggggctgggcagcatccgccaggcccaggccccgggaactgaaggtgtttcctccacgtcagcctctgcacctcctaagcacacacctgctgcaggtgccgggagtcagtgcctgagacacctgaggacgcctcctccttgaaggctggagtcgactgactgcatcttgtactgattttgcggggatttctggtctttttttatccaatgcacgctggtccccgccgctgctggagtgaggctggttgtctctgagtgggctctgcaccctcacagcaggcatcctgacccctttctttcccactccaagctcacatgctggatcccgcaccacagacagccccgaggccggctcacaagaccagatggccagctcgccatttctactttcggtgtccaggagtttttcttttgtctttacttgtttattgaggaatgaagagtcaatgaagactgatcaagacactgccttgaaagggtttcatgggcaaagaacaaaagcaaatcaaaggg

SEQ ID NO: 204056 - DNA, 459 bp, Homo sapiens
ctatttgtggtttcaggtgtctactaggggtttggaacatatttctcaggggtaagggggcactatatatttcactttccacacctcataaattctatatggtcctccctattctactattctaggcagcgaatcaagagaaagataaaccaacaaataaatgattaaacaggttcgaacaatgcttctcattgtgttgtaaagaaaaaacaattttaggagatgacaagagagaaagaaacagggtgaaggaagataatctgttgagatgaggtctctgggaaagagaaatgaagatcttatagagagagctcttcatgatgaagggacatgtgttcctcgagtagaaagagacgacccctccccctccccaatgaaaatggtcaattgtccactctggaaaggatctccaaatccaaagtggtcatatcttcttcttcttttttttttttttttttt

SEQ ID NO: 204057 - DNA, 404 bp, Homo sapiens
ttgttttaactctgccaaccccagcaagtcagctataacaatccctgacaaaagaaattgaaccaagacacacaaagttttagtaacttacctaaggtcacacaagagcctatgaaggaatcatgagaccagactcttaactgaaatacagtgctggttttttggctctggggctggagaaggacccagctttcctgaagcatgtggctacctgatgcctgaacaaaatcaggggtctatgacccaagaataggtggggatggcttctagaggggaaactaccatgacttctatagcctgctgcactgggaccaatgtatctttaaatctgagaattgactgagttggtaaaaaccactttatttatagttagaagctctccctgaggtcgtggttaggagatc

SEQ ID NO: 204058 - DNA, 522 bp, Homo sapiens
ctgggatcacaggcgtacgctaccacaccctggctaatttttgtattttcagtagagacagggcctcaccatgttgcgcaggctggtctcgaactctcttgggctcaagtgatcctcccacctcggcctcccaaagtgctggagttacaggcttgagccactgctcctggccagcttctactttaaacctcagctatttatcaaggaaaaaagaatttcccttctttctacatgaaattcatcactcagtgttcccactcacccatgctcctgtctgtttaaatgtcacttcctcagaaccccaatctgagctaatgcctattttctgtttttcgttcattctaaaatttgtcatcatatatttgtacatttcttgatttcctactccactgttactggacccaccaaggcaggaactgtgtctctttaccactacagttcctgtatcttttaggtgcgtagtatttcttggtgagtcagtcagtctccagacaggtgcagcgtagaatgggtaccgagctc

SEQ ID NO: 204059 - DNA, 476 bp, Homo sapiens
ttggggaaatctcataggttcgcaggatggacacttgaaaacaatctatggaattaagcaaaactttaatattaggcattaagtattattgttcttttagttcactgagtagttgtggcactcagataatattaatgcaatagccacttggtaaaaccaaagaaataaacaaattcacctgtatgacctgtatgacaacataagtgatcatgtcctagtatgactgaatgcaggaattagtaattgaactgaaatcaggatactgttagttctggggaagaaagaaggggaacaggatcaaggatgtgcacatgagactttaactgaaaatatgactaatgtttggaaaagacaaagttgggtggtggatacatagatgttcgttatattttcccttacatttttctatatgtgtgaagtctttcctaattaaaaaattagtaattgattgcctgcgaacctatgcgtcactaaag

SEQ ID NO: 204060 - DNA, 641 bp, Homo sapiens
tgtaaactagctgtcatttagcagccctgtgatatactgctggccgagtttcgtaagaaagcttctatgtttgtatagattttagattatcattcgctttatttaagaaacattcattaagtactttcagtgtgtcaggaaccttggtagccaaaggacaaatgacataaaaaccacacagatggcctctttcttgagcagcttttgttggaaataatttatgactaatattatgatggagtgagatggtgtcttactagtaagaccagaaatacttaaattctaattcaaccaattcttgagatcccttagggagctaggtataccaaaattcaagttagaatttgttggcttaggcataggcccctgcctcacaatccagagaactaggttattctatatggaatatgcctttttcctttaccagctaaacctgactttcctttctacgtgttagcttaaattcaagtcgtctcaaattttactactctactaaggcaaaaaactactggtactaaaagaaaatgagcaagaaatgtccaacaagctagatcttgttgaatagttagcaattcagatgtcttactacctaccaacaaactgtccccctccattaccttggcccagtttctatatttgga

SEQ ID NO: 204061 - DNA, 608 bp, Homo sapiens
atctaaagtagtcaaactcttataaacagaaagcagaatggtgattgccagggatcgggatgaggaagaaaatggaaattgttgttcagtgtttacagggtttcagttttgcaagataaaaagttctaaagatctgttgtccaacaatatgcatgcagataacatcatattaaacatggttaagatagtaaattttatactatgtaattttttaaccacaattttaaacatcactgtagatgttgtagttgtgtttggggtccacgggtggggaggagcttgggaaggaatggcatgagggaagtgagagaccacaattaaggagcaacacaggagatgagggtggcttggactagatagccaggtagaaggagaggaagggatgaaccgggggttcgtttcagagtcaaaatcaagatttgctaataaattaaatatgggaataaagaaagaaaagaatcaagagtggctcctagtatttgtttgagcaaatgggtggaatatattgatatatacttaaaaagaatgactggggaaaggaagaagttggccaggatgtacaaccaagtattcacgtttgaatttatttaatttaagataggtattag

SEQ ID NO: 204062 - DNA, 388 bp, Homo sapiens
ccggaaaaattggtatcaaagaaaaatttaaagtatctatatttacataaatatatatagtcatagaatattaagcaaaaagtaaattattaatagttcatgacagaaaaattgcaggcagggcatgatggctcatgcttgtaatctctgcactttgggaggcccaggcaaaaggaatgcttgtgtccaaaagtttgggaccagactgggcaacctagtgagaaaaaacctcataaaaaaaacagaaatcagccaggcatattggcatgtgcctatagtctcagttactgagttgggaggatcgcttgaggccaaaaggccaaggatgcagtaagccataatgacatgactacactccagcctgggtgacagagtgggaacctaagga

SEQ ID NO: 204063 - DNA, 677 bp, Homo sapiens
cactgaaccctgacacactgcatcaccactttacagataaaaaaagactcttacataaaacatctgatttgcatcccttcaacaatcactaatattgttaaaggggattttatctctttaacaacattagggagacaagacaggaatttcccctacttaacaagaaaatttaagaactaggaacagtagtgagctccccagcactggacagattcaaacacagatgcacactgaagaggggcattaaaaaggacatctaagcttcagatgggtcattaaaaaaaaacagatgccttttaaggtatcttccaagagtttctgtggttccataacctgcctcaaaaatcaagcaaggctgggccatgagcaaaaagagcaaaactccatctcaaaagaaaggaaagcaaacaaaacctcacagcacccgtcagaaagttcccaattccttgtatgtatctgtgggcacctgcctatttgcaggagcctgctatatagtcatcaagtcaagacaagcatctctgctctcaatggcctatctagggcaggggagatcattcataaacatgtaaacaatgaaacactgaatttggtactggtactgtccagcagggccgtgtggtaagcagccttgaggagggttgccgagggagtctgagaagatgcctgtggagttgaga

SEQ ID NO: 204064 - DNA, 434 bp, Homo sapiens
ctggtaaatcctttaccaactgtgaagactgccctggctagtagcacccgtggcacattctacatcattggaaagaccaaaagatcttatcaagataggaaatacaactaaagaaaagtggaggcattttgagcatagtttgacgatgatggccctgtaatgtgggtatctcataagtggctggctctgcctggctgcccaacacaatcttgctaactaaggtgatgctggccaagccttctcctgtttgcagtactgtttcttctctccttcagtcttacagcatttcagtcatgtttggctgcattttctttcttctctccaattatttgaaatgaagtgaaactaatagttgatattaaagactttgattttttttcctatatttttaagcaacataatctttttcctaaatgacatcctacccagaactt

SEQ ID NO: 204065 - DNA, 339 bp, Homo sapiens
aaaccccaaatcctcattataccaaggagccatattttggggtgaagttgcctgcaccccttcattactaacaagttatgctactgaactccctttcaaaagcttgagttaacgattaacaccctgcccttcacaagacatactcatcaacccagagaatggtggagctggcctggcactcagtgacccggaggcttttcaaactgctggggagagctagctctccatactcaccccagggttttcttatacaaagatgcatttcattctgcatgtagaatatttaagatatccaaagaagctgttaccactttttatctttttatgagatctggaaaa

SEQ ID NO: 204066 - DNA, 568 bp, Homo sapiens
gacggctgcacggaatgggcagtgtcactcgggagaagatggaacacggcagagacagcatggcccgaggacagcgtgggagccacaggcttccagaagagcaatggggcgagcggtttccctgcctccctctggggtcagcagaaaaggaacagtggccctggagactatgcttcatgctccctgctgcttttgtggctggaacttcatacggccacagggagaagcttctgttcccaaagcattatgctaacagtaccgtgacaaccagaaatacctctccagttaaaactccaccagcgccaccagccaccaagatgcagactaacccaaggtgctcctgtgtcctcatctcactgcagcccacagtgcttgactgggacacacggtttgggaaatctgtgtgttttgtgtctgcgctccccttgttatagaagtagtgtgtgtgttgtgtattgtgtatctgttctgtgtgtgttgtgtgttggtgaagctgctgtcataggtttatctgacaccaccgtatcccgttccgcctggctggtgctgaagagcaggctttttatga

SEQ ID NO: 204067 - DNA, 230 bp, Homo sapiens
ttttcccaatagctctagtaccccagggaccaaactcttcttgcccaagttttattagtggcgccagttcaggacccgaggccaggcttggcaggatgatctttagagaggagctttgaacataggccagagactcctggtttccattggatgtcttctatcgagtgcagatacatagagctctggcttttttgttgttaatttctctttttatttatttttacctataa

SEQ ID NO: 204068 - DNA, 468 bp, Homo sapiens
  misc_feature (396)..(396): n is a, c, g, or t
  misc_feature (398)..(398): n is a, c, g, or t
  misc_feature (409)..(409): n is a, c, g, or t
aaattttgaggtgtgagtaaaattaaagagtctcccaaccagtgaaggatgaggagagaagcaatactgtaggagttttaagatctccacaggagcactactaaagcccatccacagtgaagcaagagaatcatctttaaagggctttggagacactatgatgaatgtggactcagcaaagaggcaggcaagcaaagtcccagggataaccacagtcctatgcaaaatgacagagaaaaagccagtagagaccattaagtacccaatagtaccttcccattaaggcacttgaagtatggctctacctctgggacttggtatgaacatatattatcagaagcctagtaggtctattttaaaatgttataatagcttgacatagatctctcaaatctntntgcatatcaantcatagaggtacagccatagctcatgtgccttaatgggaaggtaatattggctacatag

SEQ ID NO: 204069 - DNA, 427 bp, Homo sapiens
tgtattctgaatcatttaggaggtgaaaggcatgatgactggaatcgcttaggagtggcgggagagaaaataaacgtggcaaaatcttcctgttgaatttacccggttgtgtaggggtcagggctcacttgactattttctcccacttttttgtgtttggagacaatttttttaaagcgtgttcatcggctactgacacatcatgctaattgaagtgttgggtgcaggtttaaaaagtttcgagggaattggtgtgtccgtgaacaatccacgacaaacgtggtggggcccgcgggagcgctgcggcccaagacagtgtgacaagcgggaagatcacgagtccgcaagacaccaagcctccagaaatgctccagaaacgctccagaaagcctttaaagaacggatttgaacccagccacctccttaa

SEQ ID NO: 204070 - DNA, 293 bp, Homo sapiens
aagttgattgagctttgactaggttactaaattaaaatttttaatgcattgctatctcattgtatcattatttgctataataaatctctggattttattttcgaatatttgaaaactggagtatattttatttcttcttacctgaacaaaaaaatgtggaaaaaatggtttgggttttgtttttgtgtttgttttgttttttgtttttttttttcatgctacatttttatagtaactacctgtattagacgtttttccccagtgttttaagtatttatgtaaaactccacatg

SEQ ID NO: 204071 - DNA, 648 bp, Homo sapiens
agaggcaggatatgataaagtttgaaagtgtaagccttgaagtaaaattgacagggttcagatttagctgtgtgagcactaggcaagtggaattagtaattaccatcttcaaagaggtttagggttgatattacataattcatgtaaagtccttagctttctggcatacaatgctgagtaaagtaagtgttacctgttagagtaataatagttattattaccattgtttaattattctttctacattaacttgagattttcacctgtgagtgatttgcagttgtatacttttgctaatgtcccattttaagccatgccgataaagacaaggttgttatagaggaagtgagaggtaggcatcaaagtgtgccttctctgattctagcagcagaatcttataaccaggttaaatatttcaggaatgcattcccagcactgtcagcagatgagtagatacacttgggaatgagtacattttaatgaagttatttcccagccagtgcattggtttgtctttgttataacatgctgaatttcttcactctcctttcaatttttgactgtgaggccatgtggtgactattagtagagagaagaaggtgagtggctatgcgtatttgtaatgtacgtataaacccaagatgagag

SEQ ID NO: 204072 - DNA, 162 bp, Homo sapiens
aggatgtataaaataaattatctagtggatgaaggtgagattgggattgtgagagtactggaaaccaagtggaaattctaaactaacagttctgttactctggtaaatattaagtatgcaatagatctcagcccatgagaaacacaggatgaaattgaggag

SEQ ID NO: 204073 - DNA, 363 bp, Homo sapiens
caaccctctctattcctgataagcttcttgctagagggctcattttttttccctgaactgttctctgggcgtcactgggaattgtctcaccccccaaccccagttcaagacatcttctacagctctgccaaaaggatctctctaaataacgatttcgaccccatccctcccctctgggaaatcccctgggagctccccactgcctgtggcttgagcccgagtccccacaccgggcagataccctttggcttggcctgtgcgcccctgcggcacactagctgtttggagcaatgctgcgtttctcggaacgtggcagcatctgcacatattcacacacctccacgcatcctaggatcactcttc

SEQ ID NO: 204074 - DNA, 470 bp, Homo sapiens
gagaatggcacatttgaacgcctgaagctgagaaatcaccatattctcatgcatagcactggagtgggccacagtgttctttttaaaatttgttgagatgccccttgaaagaatgctgtgtattcccatcacacattcttaaactgatatttaaatgtttttctcagctgggcatggtggcctatacctgtaattccagcacttcaggaggccaaggaggaaggatcacttaagcgctttgtagagtgaggcctccatctctacaaatatatttttttaattagctgggtgtgattgtgcatgcctgtagccccagctactcaggaggctgaggcgggggaatcgcttgaacccgggaggcggagattgcagtgagctgagatcgcgccactgtactccagcctggtgacagagcgagactccgtctcaaaacaaaaacaaaaacaccgctgggaatagacagatcaagg

SEQ ID NO: 204075 - DNA, 354 bp, Homo sapiens
ttttagcataattgtggaatataaagaggttttgtctatgtgggttatatatatttattgtaaaataaactagatagaattttaaaatatttaattatttattaaataataataaatcaatatattaatataaatagcacatattgtatgaaaaacaaccagatattataaaacaaagatttaataggaatagtgtcacttttttgcatttttacaaatcttttaaatgtctgtctgaataatagatagctggattctcatatatgctttaatattctctatctgttgtaatattatataccatatagtttctggaaacattaattttctactaatgagagaatgagagagaag

SEQ ID NO: 204076 - DNA, 479 bp, Homo sapiens
cttaatcatatctaggaatataaaccggtatagagtatataatatttcgtatgggatttttctacgtatttataaattagggaaaattaggtttcaagaactgcttttctttctttgtttccacttaatgatgaaacagaatatggctactatttgctcgtcaattaggtaattggtttagcatgttcagtagaagcagacacatttgattaatgcacatgaaaaactttaatgtgaacctactcacaatgattttccagataaatccttctttgttgcactggtaaatctgtgctagtgatttatatgatatttatgattgcagcagtgattctgttactatccttttgggaaacagaaaattaaatcatgatttgagggaaaaaatgattctgacttaatcagttaaattgccatacaattctggaatagacagaataattgcatgtcagattaaatttgaagtgatagatttgtat

SEQ ID NO: 204077 - DNA, 250 bp, Homo sapiens
cgagatcacgccactgcactccagcctgggcaaaagagcgagactccgtcccccccgccaaaaaaaaaagttacatagaggcatatgatatgaaaatgaccaacttctatgtccttccacagccctgaagaacactgccagaactcttttccatctaaatgtgccctgtagttactcaagttttttgagaccatatgaccttctccttcaccaaaagaaaaacagagacatggccgggtactgtggctca

SEQ ID NO: 204078 - DNA, 475 bp, Homo sapiens
ttctaaatactccccactttggccttaactcagaccttcctcacttcttttttattttattttattttatatgtatttatttattaatgcatttttgagttagggtcttgctttgtcacgcaggctggagtgcagtggcgccatctgggctcactgcaacatcccgtccccgggctcaggcaaccctcccacttcagcctcctaggtagctagggctacaggcgcttgccaccatgcccagttaatttttatttatgtttttatttattttatttttttagtagagacaggatttcaccatgttccccaggctacttttttagaatgctctttgatctttccgccttcggtctgattccttttaatccattctccacctcactggtaaaaatttttgtgctatatgtagtcatgctccttctttatttaaaattccactagtggctccccataacattcattataaaggtcaaaa

SEQ ID NO: 204079 - DNA, 522 bp, Homo sapiens
catcttggattgcaggaagacatggtctatgaattacagaaaaccacacacagagataagatgaaaagttaggaagacaagatacaaagagagatgcgataagaatggatgtcaaaaaaaaatgcaatccaagaattaaaatccctcatggaggtggaaagaagcaaaattgacagtgtagaaaatggaaacgttgatttggaggtgaaccttgagaggtcttttacaggaaaagagcatagagttagacatgataagtgaaaataaatagttaactaagaaaagtgatagattctgataaatataaacaatgggaattcagtttaagacttaacagtattactaatcaagaaaccagaacaacagaaataagtgataatgactttattgaagaaaacattttcaggctggaaaaagactggagtatatagattgactgggctcacaaattccaggtaaaatcaattttaaaacacccacacctagacacatattgaccacattttataattacaaagacca

SEQ ID NO: 204080 - DNA, 381 bp, Homo sapiens
cgcaggccaacaggatcctcccgatatcaaccctgcacctctccttcataaattattcagcttcctacactattaaagtttaccacaaccaccaccccatcatactctttcacccacagcaccaatcctgttggctggcgcaatcctgttggctggcgacctacctgaaacaacctccatggacatgcccctttatctcctatttcatccctaccccctataacaactctgtgagtgctctgagaggtgggggacagctcacggtcacacatccactgaggatgcaatcccaggtatgtcagctacaggaccggttgtctgaccccacccaacagaacacaggggagcagttcaggatgaccctatgcagttggcggccca

SEQ ID NO: 204081 - DNA, 342 bp, Homo sapiens
agcaacataccttgttctgtgatttctcacgccatcaaaaccaaagatcagggctggctgttctgggttttgcaaggttcacctgctggaagttaagtgaagtcagtcattttttttgtcttgttcatacaaaatccacagtacctagcacggtacctggcacatagtatgtgctcaaaaagtatttgtactttttgagtactaaaatctcagcacaggcaaacagagagaggggagaagacacagattccagaggtcagtagatcaaggctactataaccaacatgatttagggagactctgtggttcaaaatgattccccagcggccaggtctgggctct

SEQ ID NO: 204082 - DNA, 1026 bp, Homo sapiens
gtactgcttggccatccagcagctttatgacacacacaagaacccccaggggcttgtctgtgctgtttcgctggctgctcccacagccacaggccctagacccatcctcttggaggtccttctagcgctgcctatgtggagattcttccccactcatcttgggggtttggatttgttgcataaagcagctgatgtgtttcccacagggtcctgccagctaagccaagggcccatgcattggcactggggtctagcagagagaggggagcaggatggcccggcctacctcaggcagcctaacctatgagcccatcctgagtactcctgatggagatggggaggtgcccagacagacagcaagtggggcccagccgcctcatcagaatcagggccaggctccacctgggaacaggcccgtagcctacagcccacggcccctgagagcagggtcatcacactccaatgagtcatgtgcattttgaatttcagttgctgcccagcccctttgccaggccctaatgtcttccagatctctggtggagaatgtgcccctgctcatcaacagatagctggctgggctggctccttcctgcctggtgcctcccccggctgcctttagcaagtgctgactgcactgagtccactgggaccttttccttttgggtttcgaggctcctcccactcacccccaccctagtgctggaagaagtgagtctgcagctgaagggttgctggggagtcagtctttcctcttacttaggaggggaccaggcatacacacactgtcacaggtcagccaggccagtcagggaccagtgactcaccttcctcctcagcctcctggcagccggccagccctaccccggccctgccgggacgaaggaggccacccactgtctagacagataacactgtgggtatacttatctgcagggcaagctcatgagaaaaatttttttcagggaattttgttttggggtctcctgagagttcccctgtggcccagtgtcttctgttttcttcttt

SEQ ID NO: 204083 - DNA, 595 bp, Homo sapiens
aaaagaggaaaaatagaaactgccagtcctcttaggaattaggcccagaactggcaaagcaagattgtggcatatcttgctggttcaagcaatgagaggtcagccgagattcaaaggactccatagattccacctttcgatgggggagtgacatacaagtacatatatagaaggcaggaattgatggtgggccccttggagataagctaccacaaaccacaaggaaattttttagttaatatagctttgtaaacacataatatagttttaaatagatgaggttccattatttttagtaggttaaaatccatgcactaaaaaatatgtctaaatgtatagaaagccaatttcagacataaattcaggtgcagcaggaacacagaaagttgtattagattctgaagttgtctccatggaaaaaataatacagaccaaatacctgagtcactttaaactagtctggaagaaaaatatgcaatatgggtcaatgttgtatcggcaaggaggtaccactggtctttttaaccctaatatctataatgtgttttaatatttgtcttcttttgtggtcaataaaactatgtgataaagttta

SEQ ID NO: 204084 - DNA, 478 bp, Homo sapiens
atccagtagttaggacaaatgaaccaaaatttgaaatagaaaacagataaagcattccatctcaagtatagacaggtgaactaaaagagctataattacaataatagtgcctttcaaagtataacttcttgtttccaaaacactttcacttgtatatgtatcattgagttcttatgaaattaagcatcaattctttgaagtttgaaatatatatatatatatatatatatactccagacaaatataaaaaggaacacttgacactgtgaagagtaaatttatagactccattagccaaggaatggtggaaatgagaggtggaacaatgtagaaagagaaatcaaaggcagcaaacaggcttcagcctgggtcagctctgatctttggatagtggccactgaagtgctagactgagaaaatcttaggtcatgcctagcctcagtggttagtaataaattagccatgcctgttacaatca

SEQ ID NO: 204085 - DNA, 459 bp, Homo sapiens
gtcctttcacataataaattctgccctcctcaatgtgtctgcatgcttaatttttcctggtcacgagagaagaacccagatgtagctgaactaaggagcaaaaacccgacatctatacctgctacagcacagatgcagcatgaaaaattatgctaagtgaaataagccagtcccagcagaccacttgctttttatttcagaggcttataggcaaatctatacaaagaagctgggtggttccctagggctgagggaggaagggaaaactagtgaagatggctaaatgatgtggggtttgtttttagggtgatgaaaatgttctaaaattaattgtaatgatgacggcataactctgaaaatactaaagttaatgaattgtatactttaaatgaatgaattgcatggtgtgttcattatttctcaataaacctgttacccccccaccccgaattaatttgg

SEQ ID NO: 204086 - DNA, 410 bp, Homo sapiens
aggatgttaggcatggtttgtgtgcaggctattataggtacttcctttccaaaaaggtgatatttagtgctacaaattagttatcatatcagtattagaagctttgttaggaattccaaataatacgcaattgtgattatacacaaggtgtttgcaagccccatcttgtaggtattattaagccacagaatattttatacattttaataattaatagtcaaacaccttgctaaatactactccttttgaggagaagtagtagagaaagaatacaattggctgtttatatttttgtcttattcataaagagaataaaattatgtaaaagtatttataaggaatttatcatcccaaatgcattttaatagttgtagataaatacttctgttttgagaaggcttcagagctgt

SEQ ID NO: 204087 - DNA, 543 bp, Homo sapiens
cctatgcgtccccatgttcccactcttttaaacttccaaatactttgcaataaggtccttttgagtagaaatactgggttctcattaagcaaccctttacctcacttctggagcacaaaactgtaaacatggtttcgtaaatggcaaccattcattattcaataaatatttacccaacagtgatcctatgctaaggtgctaggtgccaggaatgcaaaagtgaacaatacaaacatggctcctcctctctgattttaaaattctattcaattgtcccttaaatgtttattaatacattcttatggtctgatcattattcagggaggtcaagttcctcagtagagggcctgatggaaaataggtgatgaataatcatgattactggagcagggaatacatacacatgtccacaacatgtaaattctcaactcagcttgacctcaggagcacaaacattattatagccctgtcacctgaaactcaagtgtgtcccacagattctgggcaggcaggaagtattgaatgcccatttgtgttctctga

SEQ ID NO: 204088 - DNA, 116 bp, Homo sapiens
ttaagaagagagagagaagggaaaatttccaggacctttgtcttgtggcactagctttgttttaggacagcataagacctgcaaatatctccaccttaagaaaaatgaactaagat

SEQ ID NO: 204089 - DNA, 348 bp, Homo sapiens
agcaacattttaagtccttgctaaggattaactcacttattcctcaagtcaccgctattcactaggtactacgttatcccacatagggaaactgaggcacggagagatgacgtaacctgcctcagcagcagaggcgaatttgctctgagccaccacactatactgcttaataccaagttgtttcctctgcttttccataatttccaatttttctacacagggcctgaagcacaattttttttttcttttgagacagtctctctgtcgcccaggttggagtgcagtgatgtgatctcagctcactgcaacctcttcccaggttcaagcaattctcctgcctcagcctcc

SEQ ID NO: 204090 - DNA, 706 bp, Homo sapiens
gtgatgaaactgccatttaagagaggtgttgtgtttccatagaaatgcccaataaacttctgggcaagatagattttaaaaagcaagaggatgaaaactacccacctactacaatgtcctaaaaagcaaaatataggtccttgtggtgttatgatttataatggttttcaaccaggttcctggtccataactcccacagcccttgttacagtcttttgtgataatgttgggtcaggaaacagaatctctttcctgccttcctttcacctggcccgaggcaggaatctaatctttccccacctttcagattgtgggtctcaaaccctcccctgagagggctaagcactgtaggaaggaacgtttccaaaaaacccaagaaagctgggtacagggagtttccggatagctgaacacctggaggttcctggagggtggcacacaagggaggggttggaaactccgcacctctttccccatgccttgccctgtgcgtctcttcatctgtgtcctttgcaaaatatcctttataataaaccagtaaacataagtgtttccctgagttctgtgagccactccagcaaattaatcaaaccctaagagggggttatgggaacctcgacttgaagtcaatcaatcagaagttccagaggctcaggtttgcatgtctgcagggggcagggcagtttcagagacttgagtttccaac

SEQ ID NO: 204091 - DNA, 199 bp, Homo sapiens
tgattagttgccctctcaaccataagcagcctataaacagggcctggctccatccttgttacttccccattgcactgaattcagtatttttccctcaaggtagatagttgtggggcagcatccctaaaaatgtccagttatataatggcatccagtaaatgttttcttaattacttacctccattaacaagctttatgc

SEQ ID NO: 204092 - DNA, 489 bp, Homo sapiens
agatggggttaagaactagagaagaatgagcatcacccagaaatcttaggcttataactagaaattattttaggttatctccctttaagaggaagatctccctttaggggggattatgttgagtgaaggtattaagattgttcatgttgaagaatgcatgtccacatagtgtacgtttgcctacccagtgttatctttttcccctctgagaatagcacttcacctttcctttgggaaactacccatttcccatgccatgtgagcccagaggataatgtgtaagaggtatatgagtttctgagaggaatgtgagaggtcttcacctgcccagattcctgacttaatctttaagtcttcttgccctgtagactctgaaaaatctcatccatttccatggccttggtttctaactgtatattgataatttccagattcctacctttggccttgatatgtgtcttgagctccagatctgaatgcccacctgta

SEQ ID NO: 204093 - DNA, 376 bp, Homo sapiens
tgcatgtgttgaagcccggggtgtgggggactgtggtcacgtactcgagggggcttcagagacctctgggaagccctttctgcccactcgaagcctgcccctgtgcctgacaatcttccatcgggagcgatgtcataaagaagaaatggaattcagtgggaagagtggtggactcggggacaaaagatctgggtttgcgccctggctctgacctaactcaccagcattattggaggcacgttaggtaggtgcttgtcagagtcctgcgttctaggtgctttacaggtgtccacttactggatcttcataacacacctatgaagcagggagtgtcatctctatttcacagctgaagaatctgaagctaagtgtcatg

SEQ ID NO: 204094 - DNA, 292 bp, Homo sapiens
ataaaagagaagaggaatccagtttacaacaataaatgacaaaagagacctgtggtgggtaagacatgtacaagatgacaagctttgaggaagtacaaggtctggtctgggagctgtggacccaataagcaaagactctggaaagacaaatgcatagttgttcatgggccgtggaggccctcgtattgtataaaaagggttccaggagcttgggataaattaaccactttgtttcccccttttcatcatctagctcggtacagtcctctttagcagtgttttgagtcctaag

SEQ ID NO: 204095 - DNA, 586 bp, Homo sapiens
ttcaactttttatatatccagaaatgggattgctgcatcgtatggtagttctatgtttaatcttttgagaaacctctatattgtgtttcacagcagctgcacccttttatattcactgtgggtcagttctgacctcctcaagccctacttttcctacctgtaaatgtgagtagtgatgggaatcttctcatagcatcattttgaagactacctatgtaatgcagataaagcacttgacatgatggaagactaacaagtagccatgatgcttagtattatttccattttataggagaaggatgtgaagctcagagactttggctgcgggaagggaaaaccagtgcccctcccctccttgatcagagtcaacatttaggttttaaggttgaaagtcattgtctgtgtcttcaaggtaccataactacctagagtttcatggcctgaaagagacctggagcttgtttatacctccctcccccactgctgtatctgggtcttttggggtatagcccatttactgaacaacgaaaactttggggatccccaagatttctgttctcaacattgaattgtactgttggttgac

SEQ ID NO: 204096 - DNA, 714 bp, Homo sapiens
  misc_feature (533)..(533): n is a, c, g, or t
gcagatacgatcgagctcggaccccgattggcgccatttcaagttttagccatcactgtgggtgtgtagggtatcgcaatgaggctttgattcacatttctttaatgactaattatacaaaacacatgaaaagattcttactggccatgtgtttctcttaagtgtccaaatcttccatccatttataaagcaggctgaggccgggcgcggtggctcatgcctgtaatcctagcactttgggaggccaaggcgggtggatcacctgaggtcaggagttcgagaccagcctgaccaacacaaagaaacccagtctctactaaaaatacaaaaaattagccgggcctggtggcaggtgcacacctgtggtcccaattactggggagactcaagcgatcctcttgtctcaaccttccaagtagctgggactacagacattccgccaccatgcctagctaacaaagggtattttaagggtgaagagataaataggtggggtgaggtctgaaaggattcccagcacaggagcttctgtncctgtgggtgggttggggaactcattcttgttcacctacctgtcagcctccacattcagttctctagaaactccccaaccctgtcctcttgggcattttatggagatgtcattggataggcatgattgaaatgtggacaaccgtgttgaaatgtcgccatccggggtcctctggaacagcc

SEQ ID NO: 204097 - DNA, 647 bp, Homo sapiens
aaaaattgtttttttcaatatcattctagaggtagttaaaattgaatcaatccattcaatccattatctttatgtaatctactcctaggtagctgatactatagtaagatgtaatttttttttgtctttgcaaaggtgttcttgttgctgacaaggaacagcagaatagtgaacaagtttgtggctaaacattattcccagattttaaaaaatgttcagtgtgcacaattgttactaccagatctttgtcaaaataatctttctgtcactgaataactgacccataaaacaatagagcatattgacctagtgtgcagggtaagcaatgagtaaataagaaatggttgtaaaatatttaccaaatgtaactttctaatttgggtagctttaagatgggtcaaaataaaaggaatgctattatttgtgaagaattacaagtttacatatgtttattcttgccagtcttttactgaaaattcctagaaatgatatcctttcctttatatataccataatatttgtatgatattcctctccaaagataggggtaatattatacattgataatagtcattcattattgaaaaactaacaatacactaagtactccactgcatgggacatagtagccattcaataaatgatag

SEQ ID NO: 204098 - DNA, 392 bp, Homo sapiens
accgagatccccatacagcggagggtaagaactggtgttgaagctgactaatctcaaaaacatttccacttgctttagtataaacagactgcaactcattctatctgcaatcatttcaatagattctgatccagagcctcccagggttgccttacgctttttttcctctaccaactggaaacttggttcttcatctttacagcatttaaaggtacaaacaatacgaacatttcataataccagatgctgggagccacaggcctagaacatattacagagccaccaagccacgttcattttgaaaagattacattaatgctgttttcaaacttataattaccagccttctagaaactccttaccatcttgagtaactgaaagcataaagtggc

SEQ ID NO: 204099 - DNA, 774 bp, Homo sapiens
ttccacttctcaaagcaccaccccagggccacattcacttgggactggattcgatacaatttcaaaacgggagtcggaattccttaggaccctctgtggacaaaaagctgatacccctgttaccacaaggattcctgcacttcttctagtttgtagctttccaggagacctggcagaaacaacaaatcaaatctccatgcttaacaatcctttacctttgaagactttaaaaacaaatgaggacaccatccctgctcattcaccctgccatccgagtgcaatctacaaagtgctctcctgctgattgtttcatctccattaacgcccttgtgaagcattcccattctaccagtgaggacgctaagaacccgaggaaggtaaatgatttgcccaaggttgcacagctaccatgtggcaaaaccagaacttttcttaaaaatctagcgttctttccaccaaataacagctaatatgaacaatcagacatggggctctcaaggaaaaggttttcatgataactttgttgtgcctcggatttcatctgtcattttttgaatagctaaatgactgagaagtctaaagagctgaggaatctaaacgagaaaagatgcctccttgtctggaaagagggtgggtcatctttacagattaatgaagcggcacagaaacatcggtaggagggggatgaagattacacatgcagttaagaagtaggctgggctgggaatctaaccctgaaaaaagacagattgcgtttatccctggattagcagt

SEQ ID NO: 204100 - DNA, 530 bp, Homo sapiens
ttcatggctcatactccttggtctccatggtctatttcctgtcttttacacctgtcggccttccccctgcaccccttagtagcaggctctgcttccagctctttctgtgtctgaggggacctgccttgttcatccctgttcatgtttacgtgtgtgtgcacacatgtgtgcgtgtatgtgatagtcaaatacagcccaaaggaacagaacaagcaatagaagaagagaaagagcacaaacattactaggcatcttctagtcccaccagctatgtgtgaccgttggcaaatcccttttcaccctgcagttttttcaaatgtgaaatgaagataacaattatcacctcacatgactgttataaagtacttggcacatgcaggttcttaagaactgtcagctgaggctgggcgcagtggctcatgcctgtaatcccagcactttgggaggccgaggtgggcagattgcctaagctcaggagttctagagtggcctgggcaacatggtgaaaccctgtctctactacaaataca

SEQ ID NO: 204101 - DNA, 324 bp, Homo sapiens
attattagctggtgagaacacttcattggctgaaagttcttagctgggtcacctatggttctactggaagaatgttcttcttaaggacattcattctccatgagcaactagacatgggaggcgtggtaggcaaggagttaagagccagctgtacagacttagctgcccctgtcctcagtctcctgaagagcaaacctagatctaaaaaagaggcagatgctatgaaaatgggggcttgcaaataagaaataaggagggaaagatattttccttgttcaacatttcactggtgcagaaatatgacctagagtttattgtctaaat

SEQ ID NO: 204102 - DNA, 387 bp, Homo sapiens
caatgagaaaaatcttgaaattacctaaatgcctaacaaagggactcagttaaatgaacaagggtgcatattggaatgctatgtagttactaaaactcttggtatagaagagtttaatgacaggatgctaatgcaacacaaagtggaaaaaataattcacttcctcaccccaaagtgtgtgtgtatagatgtatattctatgtatattacagaaaaagaaatggaaggaatctatttcaaaggggtaacagtggctaactctgggtggaattatgatttaaattttctcaataataaaatcagtgctaagaattattgctaagtaacttgcactgttctaaattctatctcggtctatctatcattaaattgtttaattcttacaaa

SEQ ID NO: 204103 - DNA, 470 bp, Homo sapiens
agaaacttgacttttaatctagcttctacacacaaggcttgggaagttgcttattcaacaatttaacaaaaattaacgatgtaattccaatcaaatctaaacctctagccacaaaaccttaaattcaaggtgctgatcttaatctaaaaaacctcatgtggtttgggttctggttaccttagagatttgactctaagcacccaaaggcaattaagattagatgaaatacttggccgatggttcactactgaaacctgatgaactggaatcctctgattttgtgtgtctcttttcagatagggtgaccaaccattctggggttttgtttgtttgtttgtttttcagacacagtctcagtctgtcacccaggctgcagtgcattggcacaatcttggctcactgcaagctctacctcctgggttcaagcgattctcctgcctcagcctcccaagcagctgggattacaggcg

SEQ ID NO: 204104 - DNA, 873 bp, Homo sapiens
tgtcagcctcccaaagtgctgggattacaggcgtgagccactgcgcccggccaaaaaggaaggaaattctaatacatgccgcagcatgggtgaactttgatgacattatgctaagtgaaacacgcctgtcacaaaaagacaagtattatatgatgccacttacatcagtcaccttcagtagtcaaattcagagacaggaagtagaatcatggttgctggagaaaggggagaattgggagttattgtttagtggatatagtataccaatttgggaaaataaagttttggagtttggttgcacaacagtgtgaatgtacttaacttttgaactgtacactaaaaaaatggttaaggtggtaaattttacgtgtattttaccacaattttccttaaaaaaggaatgacattacactttcttctgggtgatggaacaagaccctaaatcttaaaaaaaaaaaaaaaaagaaagaaaagtctgataaatgctacaaaatggttgaaccatgaaaacatgctgaaataagccagacacaaaaggacaaatattgtatgattacatttatcaaaatacctagaattgttaggtccatagagagagattaaaggttatcaggagctgggaaaaagagataagggggagttattggtacagagtactgtagtctgaatatttatgtccccccgaaattcatatgttgaaacctagtccttaatgtggtagtattaagaggtggagcctttgggaggtgatgaggtctaagggaggtagtgaaaaattttggaaatagtagtgagaattgcacaacattgtgaatgtagttactgccactgaattgtacatttaatggctgaaatggcacactttatgttaca

SEQ ID NO: 204105 - DNA, 553 bp, Homo sapiens
tgtcagcctcccaaagtgctgggattacaggcgtgagccactgcgcccggccaaaaaggaaggaaattctaatacatgccgcagcatgggtgaactttgatgacattatgctaagtgaaacacgcctgtcacaaaaagacaagtattatatgatgccacttacatcagtcaccttcagtagtcaaattcagagacaggaagtagaatcatggttgctggagaaaggggagaattgggagttattgtttagtggatatagtataccaatttgggaaaataaagttttggagtttggttgcacaacagtgtgaatgtacttaacttttgaactgtacaccttaatgtctatactggcacattttatgtgcattttaccacactgttccttatatctggatcggcattctaccctcttctgcctctcggaacatgacccttagcttctctcattggctctacaagatcttccatctcttcctccttcgctgtccatcttctccagtcatgctcttcatccgccccattctctacgctcctttgtccatctaccccc

SEQ ID NO: 204106 - DNA, 278 bp, Homo sapiens
cgatcatgtctacagctttcttgtgataccttacaactataagtttaaagagatgcaaaggatgagtatcttgtgcattttaatattaacactaaaaactgttacatcactaaaaatttaggccgggtgcagtggctcctgcctgtaatcccagcaattgggattacaggcctgagccacctcgcccagccagcactaagacttttacagccgatggtgtaaacatttcatttcccgactttcacaccttctctaaacaaacactttttttcactttg

SEQ ID NO: 204107 - DNA, 416 bp, Homo sapiens
gagcatttaacagactacagtataaacataacttttacatgtgctgggacatcaaaaaattcataagactcactttattataatattcacctactgcaatggtgcagaactgaacctgcaatatttaaggtattcctgtgacgacaatgaattataacccactgaatgaaataggcctatgaatccatactgatataaatgaagaaatgaatagggaagaagagaaagctttcttgcattagaaggtcaactaataaatgtagaaggaatgatagagttagaaaaatgaacactgacaacaatcacagtcaataattgattcaggcaagaatcatcagtagatgttcattttgatgagaagcagaatatttacagttaaaacatagtcttaacatgaggtagtattaattacaaag

SEQ ID NO: 204108 - DNA, 359 bp, Homo sapiens
cacatcccatatacaccttctcctggttgcgagccttgggcaagttgctcaaccacagtgtgcttcagtatcttcatctctaaaatgttgccagcaattttcctgataggctgttcatagaagaaacgaagtaatatgtgtaaaataattagaagattagcacatagatggatattattattactcatattactcatgtagaaaatcctgttcttgattaatgaattagataaaattaccaaagataatagaatcttgacctgccttgagaagaattaagtctattaaagaagatgagatagatcaagtgtggccacactggctttgatgtctgaatcgaagttggaattccaccctct

SEQ ID NO: 204109 - DNA, 329 bp, Homo sapiens
atctaatctcacttccttctggcttagagaatgggctttgaaattacagccaagtttgaatttctgctccaccaccaagtagctctgtttccttgaactaggaatttttttttttttttttttttgacaaagtcttactctgtcgcccaggctggagtgcagtggcgccatctcagctaactgcaatctcttacttctgggttcaagaaattctcctgcttcagcctcccaagtagctgggactacaggtgcaagccaccatgcctggctaatttttgtatttttagtagagacggggtttcaccatgttggccaggctggtcttgaac

SEQ ID NO: 204110 - DNA, 765 bp, Homo sapiens
catacatctttcttacagtatatataacctaaaatttaaatatagattttctcttgatttagttttttgtttttgagacagtcttgctttgtcactcaggatggagtgcagtggcacgatctcggctcactgcaacctctgcctcctgggttcaagcaattctcatgcctcagcctcctgagtagctgggactacaggcgcacgccaccacacttggctaatttttgtatttttagtagagatggggttttgccatgttggccaggctagtctggaactcctggcctcaggtgatctgcccacctcggcctcccaaagtgctgagattacaggcgtgagccaccaagcccggcctcatgttattttttaaagctgttttccgatttgtaggactctgtttcatttatgccaattctcaatgactggcagtagtgcttgtgtcagatgggacaagtactttgcagcgtcccacacaaaggttgtcagagtctcttatgaaactaattttgttatgagccatgtaattaattaatattggtgtttcagtggagtgtggctaccactccagcaggctcaagtcttcctctctgccaggtcttatgtacacacacctgttggtaaggaaaattgtatagtttttagtttggatgtattgggcttcactttatctgacatttctgggtccccatcttcttggaatcctgcttatgacacacgtaccttgtctattgcaaatgttttcttcctaaattttaacttaaaaac

SEQ ID NO: 204111 - DNA, 377 bp, Homo sapiens
attttagatgtaattaaggaggcaataattgtcattcctgcggcagcactagcagcctatccaattcgcggtatatagagagttaagataaatgtaaaaccaaaaaaagcagacacctaaagacaaatgcctcatactctatcaagcccgtagttaatcactgttgccccaaaagctacttcattatggtaaccgagaaaagcagagcacaattatgcagtttaaaaggtttcaatcagaatgatgaatggtggtctttgggtagcttattaacatgtttagaaacttatttgtttgagtgggtttttttattgaaagaaaaaataaatcccagaaggtcagcacgcctctaaagactttctggttggaaatctcta

SEQ ID NO: 204112 - DNA, 257 bp, Homo sapiens
actactagaagaaaacgtagagcaaatgctacaggacattggtttaggcaaagattttaagtctgtggcctcaaaagcacaggtagcaaaaacaaaaataggcacatgggactatattaaataaaaaagcttctgcacaacaaaggaaacaaatcaacagagtaaagagacaatctgttgaatggaagaaaacattgacaaactattcatctgccaaggactaatatccaaaatatgcgaggaactcaaacaacagc

SEQ ID NO: 204113 - DNA, 155 bp, Homo sapiens
ggagggaagtaaattgatattgaggctgagaataaaattgcaggtttctagccttgattttctacctctcacctactttgtgcctatgtaaataggctgtttcttcatggccaggaaaaaatgaaatagctgactattgacaattccagaaagca

SEQ ID NO: 204114 - DNA, 427 bp, Homo sapiens
tttgatgcctctaagccccagtttcctatctgtaagatggagacagtaatttccccatagacttgtctagggaattaaatgagactcctgtgaaaagtgctcagcacaggacatgatgtggaagtactcaaaaaagttgaaactggccgggcacggtggctcatggctgtaatcctagcactttgggaagtagaggcaggaggatctcttgagttcaggagttcaagaccagcctgggcaacatagtgagaccccacctctaccgaaaatcaaaaaaattacctgggcatggtggtgtgcgcctatagtcccagcactttgggaatctgaggtgggaggattgcttgaagccgggaggttgaggctacagtgagctgggatggtgccattgtactccagcctcagcaacagagtgagaccctgtctt

SEQ ID NO: 204115 - DNA, 820 bp, Homo sapiens
gatgggtcagattataatatgttcatatgtctaaggcaggaaattagatacaagatgaaatctaagaaagttctgtgattgggtttctcccacagaaggaggagaaaatccctgcatctctggttatgcaaataatatgcaaattacagtgattacatacttgcttagaaaattttgattacctcattttgacttcaggcagagttgggacaccaaaagggaatgtttgtcaacagtccagagttgttagatttcttccaggggaaatgaaagggtaaatttcttaccaaacacaagggttttaaataagtttttcaaactccttaatgtctcccttccacaaagcataccaaaaaaaaaaaaaattacaatagagtcaaaatgtgatctgtagacaaaatgaaggacaaatggttttcccccctaaattttactccagggtacattttctcctctttctttgtcgaacaatgtgaagtaagggcttggattttgtcctgcagatggttttgcaatcagttctagccatttctctaagtctgggcttcaaatctgtcagttgagagtgatacagttgcctgtcccatggtggtgttaagtgaggctgagagcatcaaacaaatgtcccagctcctgccacagttgcatccttgacacgttccagtggtgcccgagcaacactgcaaagaccccctgggatgtctgttggcaagaaaaggtggagccactgccctggggggctgggaagggagttagagaactactgtcttaacctaaaatttgggcagaatctgccttggatcaaatttaaaatcttttc

SEQ ID NO: 204116 - DNA, 533 bp, Homo sapiens
cagtgtgcaatgcatggtggactctgcaatgtgcagttgaattgagaagcatcttacttaatacctcatattttctgactgtaaccacttgtttcaaattcctatcaggagtctcacaataacttggcctatatagctaaatgagtaaagtaaaacaaacagctctctgaagaatggattgccttggtttcacatattcttcttttagagcaaaatgttagacctactttagaaaaataaaattataaaactttaaagttaaaagtaaaactaccagaaacttcagattcattataaatctgaaaatgaatttgtcaatgttcgatcttattaccttatttatatcagatagctatttagagtttacaaaacactttcacaaaagattttctatttgatataatcataatatatctgagatagaatttttgcattgaaattgccttatgtgtaggttaaaatagtcaaatattgtcaattttgtattcttcaacataatgatacccattttagagaggagtaaacccaggcat

SEQ ID NO: 204117 - DNA, 190 bp, Homo sapiens
ctctacatcccccgactacctgggttctaatcccagctccccagtttaccggctgtgtgacttcaggcaactgccttgggtctcaggtctctacctgtaaaagaaggaaaatgacaggacctatctcaaagggttgacataagaaagaaatgagtctccagcctgggcgacagagtgagactctgtctca

SEQ ID NO: 204118 - DNA, 428 bp, Homo sapiens
ttagatctgagttccctccatacagctgaccccgcccgggagtgtgtctccagctctgtgtcctctgcctgagctgaggcctctgtgtgtgctcggcatgggttgggcctggggtgagagtgaccgttgaatcagtagccccaaaacatcgtttctggggagccctcagctgtcccagtgtcctgggtaagtccctttccctctccacgggagaatgacagcacccacctctggtaacatattacatgcccagtgctgggcacagaacaaacgtgggagccatttggcagatggggaaacagaccccataagctcagtcaccaacacactggaggctggggtggtgcccagtgtgctgggatggccagtgctccagccaggggacacagtgggcatccagccacctccacccccacagggctggtccc

SEQ ID NO: 204119 - DNA, 371 bp, Homo sapiens
tagtaaaccatatgtttccttcccctttgtatatcttcccccagtatttagaacaagggttccatctcctggctggccatgtcttctgtgtaatgggaagagatgagatcattcaccaggtagttggttcagtgtgcagttgggaagacactgtgggttagagaaggcagataggaaactccttgtaggagtggaaagcattgagagggattctgacatttctttcttagagaacagggcctgtgtaaaggatgctcaactattcagcagtcttaatccaattcttgctttagacataagccgtttatctttctttcataatgaaagcatatattttcaaattccagatgcaatgtcataagataaagaag

SEQ ID NO: 204120 - DNA, 508 bp, Homo sapiens
gcaatctttagaaagtatgtttagtgacattctagactttgcaattaattattgtagtaattgctaaatttattttatatttgctttctctttttatattataaaaatcttcacactgaaaagttgaaagacttttgcagtgaacatttatataactccccgctaaattttactattagcattttattgtatttgctttccatatatctattcatccctgtatatattcatttatcttgttttttaatacatttcaaaatacttgcctccttttttgaatgtctcttctgtaaaataattaattcaggctataataggcttaatgtgtcttttccacattgaaataattagttagaaaataccatgttgtaaccaccagtaataagtaattcaggcaaggaccttcagtgatgggaaaccattgagtgaaagtcagacccccatgacatgcaatttacctgtataacaaacctgcacatgtacccctgaacctaaaataaaagttaaa

SEQ ID NO: 204121 - DNA, 190 bp, Homo sapiens
atggctcagattatgtgtcagccttgatgttcatgaaaacctagaatgataagatcatgttcctcaaggaaattccagatcttggttagtctatcttgtggttaaaaagatccttaaagtagagcaatttgaaactcttaataatctttaatagtgtttccttttaattaaaaatatattcttcctgata

SEQ ID NO: 204122 - DNA, 498 bp, Homo sapiens
ctgctctattccttacagctgggtcgtaaaatgaacaagcctgtgttcttgatcatgtgtgttcccagcgtcagtctcttgtgtctgtggggatgagtgggtgaggagcattctgtgaggctggtacaggcccattcctaggctttaatgctctgtttgcagtgagccctggaaaattacttagtggaaaggcaccagatgaaacatgtctcctgccccatagctaccattcaaaagggaaaataaccaaactggaaaaccttcttctatttctctattctgatagctagctgtactaaatgctatggccagtccctagaaactggtctttgttttgtttttgtttttgtttttgatttttctgttttgcagctgaattttggcttggaatcaccaactctgcctgtattgtgatccccaagactccagacctcagagtcacctgctggcttagaggagtggagtgctttctatgtaatgaaaaggtggcaattaatg

SEQ ID NO: 204123 - DNA, 437 bp, Homo sapiens
gcagaaaaaaatgtggcttctacaaggttacagagtgaggaatgagctaagaaccagggcctcctggcttctaaaagggttcagtttctaccacactgcactgagggtcaaaactctaagtcaggggacagggtagctggcaagtcagttccagcaggaactggtcacggctttgaccattatctattttggtaaatagaccctggtattcttgctggagttcataggccataaagtccagttgggaacccccaggaacttcttaggcaagacctcaccaaatacactggactcagaacattccctgctcatgaaccttccataactctccactgcctacagaagaaattccaacaccctcacctaccccacccctgactggcatccaggccccactccatctgctctcatctaattccaaagaccttatcctccaa

SEQ ID NO: 204124 - DNA, 425 bp, Homo sapiens
ttccagctctaaaattcaaaacctttatttttatttctttatttatttaaattaaattgtccttatctaaatggtagaaagaattctcactgaaggaactaaccactagatctttacgttttgtctcaggttttctgttgttgttttatcaacttaaaaatttccaacatgcaaagtagaggtctgaggcaaagttctgatttctatggaatgatatccgagatttgagttcatggagattagaagcgttaatggaaagaggttaataacaacctcaagtcacattcacagtttcagaaacttatagaaaagggtgaaaggggccatgtgtggtggcttatgactgtaatcccagcactttgggaggctgaggcgggtggatcccctgaagtcaggagttcgaaaccagcctggctgatatggtg

SEQ ID NO: 204125 - DNA, 447 bp, Homo sapiens
ctgcttggagtgcctcaccgagccagctaacaacggcgtgcgtgagcacagggaaaggcttcttgagaaatgaaaactaggttgtaaggtttaggaggggaataggaaggttagctctgtccagccgaaagccttttggtaagttgggggtccttgaaattcctgggtgactgcatcttggtgacttctctgaatagaccttcgagggcactggggggtgattgttggagggcttggggagctcaggcagcacttgtgtgggaacgtggctgttacaggaactgcagaaactgggactgggttcctggggaaaggattgggggtgttggaggcgctggcaggggagttatggggaggcgttcttatcagtgtgcgaatagtgggcgttcaggcagcgggaaatccgggtccttgcgtgttgtgagctccctggagttacgttcttgc

SEQ ID NO: 204126 - DNA, 127 bp, Homo sapiens
tgggggagggatgcagtaggaagtgcaggtgccaggaccaacatctagccaggaagtactggtaagtggttagaagtggttagaagtaaattgcctggtgcggtggctcgtgcccataatcccagca

SEQ ID NO: 204127 - DNA, 1258 bp, Homo sapiens
ctttaagacagagtgctaagcttaaatgtgaggagatatttagcagcggaagcatcatgaatgttttccctttaagtctgtggcacatttctctgaatatcctcagtaatggccagttgttttcctcttgagggtaggtttgaattttgaaaaccattagaagtcattatcttgcctggtgaataaaaatgagttagcagggtatttaaaagtcctcagcagtccagcgctaatttacttttttcctagatttacttgcttttgccagaaccttcaagaacatttatgccctttggcttttgatgttcatctgtttttttctcttcctcctcttaccaaaattttacttattcttcaggcacaacgcagattttctttcctttgtgaaattctcctgaatttttaacttggtttacttcctcttcattgttaacctatcactgtttatatacccttttttagagtatatttaacgcaaccaccttgtgctttggtctgtgtagtctagaatgtgagcagtttaagcagaaggatagtagcatattcatctttatgtttctgaacaggaccacagtgtagtaagagttcagtgacattaatttaaatgaaatcaatctatcagtgatgttaggttaaaatgaggcaaaactgtaaaacagtgagaccagatttcttacatgacgcttatgccagttacagatgagatacttcacagattctgaataatggcagtattgaatgtatactttcccatgatgaattaaagaagaaaatactgtctagatgtagtgtgtgatttttaaaataagtttaaaaattagccaaaatactggcatggctctgtttagtaggattacagaagcactttgttttaaacttctttgtactttttgtgatttccaagttttctgataagacatgaattgcttttagaatttaaaaaatcctattgataaaatttaagtcagttttattactctgtgatcatgtggggatcataatataacatgatacattagaagcctttttacttgtagttttccttgttacttagtagtagtaagattatatatcacagatggatacattttggcttcaacaaatatggtttcatttattgagtaactgccataggtggagcactgtgctgtaatgatagcacatttttgatagaattggaacccaagatatgtatttgatcttatgatctattattcttgtttgttttaaatttaacaatttaattgggcaaaaaaaa

SEQ ID NO: 204128 - DNA, 286 bp, Homo sapiens
gcagaaactgaaaaccagtttttagagactctttaacatcactcgctcttttagaagtggctccgaacagaggggtctcctcacccttgttgttgaggtactgagctgagggtggcattgagcccctccaggacttgagttctcattggccccactaaagtcatccagccgccaggcacgagcagatcgtggtgcctatttgcccacattcctgccctgtgtgacacaaggagaacttgctggagccctttcatacatgtagctaaataattcttagtgcttaagt

SEQ ID NO: 204129 - DNA, 981 bp, Homo sapiens
ggttagttgtgcctgttgtataggtagggtggaaatactatataatgctgccctattgtatgtcttttctcaactccatgttctcttggtagcatgaaattgggttatggtggcagtatttacaccactacatatcagagtgtgatttatgattttgttgagtgtgatggagaaaatgttaacgatgcagattaaacttaaaagtgtgtcatgtccatagcccttacattgtgaatagtccccatacatgagaaaatattcctccagtatttgaaaactattatttgattcagcaaagaagttgctttcatcactgactagcaagtgacattctcacatatatctttgttgtttaactttcctcttacttctaacataaatgaaaatctcaaccaatatttataccaaaactatacatgctcatcagttgcaaccctaggttggctttgtgtacaagagtttggcaaaaatcaaagcattctttgagaactaatgatgtacaaagagtatataataaagagtaatctatagtttattatcatttgtaaattgtgtgctacacattctttacatccgtaaaattgaaataaactatgtacatacaaaaaaaaaaaaaaagaaaaaaaaaaaaaaaaacaaacaaaaaacaaacaaaaaaaaaaaacaagggggagaacacaaagaaggaaaacccagagaagaagagacacaaaaaaaaacaaagacaaaaaatagagcaccacaacccacaaaaagcaacgcaaaaacgacacagaaacaaacaaaacacaccagcaaaaacacaacaaacagaaaaacaaagcaaggcacaaaaaaacacagaaagccaaataacaacaaacaaacgcaaaaagaaaccagacagaaaacgaagaaaaaaaagccgagaacacatacacgcagaaagaagaaacaacaaccgagaggaagcaaacaagagagggacaacacaacaacaca

SEQ ID NO: 204130 - DNA, 214 bp, Homo sapiens
cccccagggccctggcaaaggccgggcacccagcccaggagactccacaaagggttaaggggcgcaggcggctgtgcccacagtggggcggagcagccgggctggtgctgggccaggagcacgggcgaaggcgctgcattttaatgaatcgttattgccggcgaggcctttgtctttctttatccggtgcacaataaaagaattaattagacag

SEQ ID NO: 204131 - DNA, 283 bp, Homo sapiens
atacgtgaaatgctctttgagaggctctttgaaataaaaaacatttttctaaatacagaaaatagattgctaagaaagaaaattttggattagattgagtactgtattatatattatggaatgtatttagtactgacctattaaaaaatcaggtcagatttgaaaacaaaaacatctcttaaaatgcttatgtttaataagaaattggcactttatcaaacttatgaatctgctttcattagaaaatggtttcatgttttctaatcctttgaatatgtaggtt

SEQ ID NO: 204132 - DNA, 605 bp, Homo sapiens
ccaacaccacacttggctaatttttgtacttttagtagagatggggttttgtcacgttggctaggctggtcttgaactcctgatctcaagtgatctgccaccttggcctcctaaaatgctgggattatagatgtgagccactgcgcccagcccccagttcttacatagacaccatataagtggcaggcagaataatagcacgccctaaatgtccacatcctcatctccggaacctgtagatgtgttgtcttacacagtaaaagggactttacagttgtgattacagtccgggtcttgatatggggagatgatcctagattatccaggtgggacgaatgtaaccacaggtgtccttatcagtaaaagcaagcggcaggaaaatcagtcagagccagagagagagagactggaagatgctccgcagctggcttgaaggatgaaggatagggttacatgccaagaacaggaggcaacttctagaggctggaaaaggcagggaaggattctctcctagatggtccagacagctctgctgacaacttgattttagcccactgaaacccatttcagatttcatcgagaataaaattgtgttgttttaagcc

SEQ ID NO: 204133 - DNA, 519 bp, Homo sapiens
aagcagttaatacagactcatctacctcatgctgaagtattttatctagcacttaagactaatatggttgaaccacatccctttatggctctgggtttatgatgtacactaatgtgtcataaaaccataatgtacatttggtgaccacaatcatcttatcaaagagctctgttggaagtgaggctgatgcatgagcttccataccttaagctctgttttccaagttggtggttgtatgattatatatagaagcgtcatggtcatatttgcccttgctccccttctacccactacgtgtaccagttaggagtttatttaatgggtgtcgtatgattttcttgtctggtttacctcttgatggtccacatttcataaatcatatctcctcatatatacaggaaagcatatgttgaaatcactgaaattacataacttgctcccctttgaatcagtttccttcttatcactttgaacatgctcatttcaggcatctctacgctacggagtgtgccctacaaa

SEQ ID NO: 204134 - DNA, 466 bp, Homo sapiens
gtgtccatctgtcctggactacaaaagatttgcagaacctgcctggagacacgtctttgtattaactattgcaattcacaccttctctgttgaagggcttggagcctccttgtgctaatgtggcagcctttctgcctcctgtgggtaaggactgcagtgaaatcagatcaccgtgactgaacgcagttctgagccagctgtcgacttacactgctcagttctgttttttcttcctggccttctcacgcccaggccctgagcccagtggatttcaccatgctgggttgctcataaaaaatggtttcttcctgatgcttttggtggcagactgaatatcatcaatcatgctgcaagaaggaaacacagattcccagctgatggcattgtcatgtttatgacacatccgaaacagtaacagatggtctgtattaaaagtgtaactggtgagtgagtgctttcataatca

SEQ ID NO: 204135 - DNA, 522 bp, Homo sapiens
cggcgaggaataaattgctccccacccagctgcggtgcgacgcccccagcgtcccaggggagccggtgcgtcagctcacggctggccaaggcggggccgtacaaaagctagcgccgcgggacccccttcatgggcttctaccctagcagactgagcgctggaggccgctccacgcgcgagctcgaaccacggagggctctcagctcggacaagcgtcgctgtctaagagctccaagctccacggaactttgattttatgcccgggagcccggtcatccacttctgcatctcagacaagcgccggaggctcgtgcagcttcctcgcgtcctcttcctggacgcggggcgcccaccttagtcatagcccctggtcccggcactgctcacgccgtcggtttccccactgcccaggctccctcagcccgaaccctgcgtctctgttcacattggaacaccccctcacctcatctcagcttgcttttaccgaggtgtgtgtgtgtgtgtgtgtgtgtgtgtgtgtgt

SEQ ID NO: 204136 - DNA, 501 bp, Homo sapiens
gtatttttcacttgctatttttactgttaaaaatttattgaagtattttaaaaattcattcaagtgtttattcagcaaacctgttttttgtgtctttggcatgtgaagggcattgtgtgaaaccatgctaacaaacaggaccaggactgtatcgcccctttcagatctgcagctaaatgattactgtacagtgtggtaagtttaagtgatgtagttatttctcatgtattgtggaagcacagaagagaacttaaacgaaccccagggagtagagatactgggtcagggaaagtttcttggaggagataatgtctgaactaaagtgtttaaggatgaatagatgtttttccgggcaagggcataatgaaagatttttccaggcagtcagtaagacatgagcagagacctagaggtgagatgttgcatgatgtgcttgagaaacagaagcagttctgtggattgtcaagtgagttgtaagaaatgacctgaaaaaaagaagaa

SEQ ID NO: 204137 - DNA, 347 bp, Homo sapiens
atcaatgtattgtttcatggggaatctctgggagatgcaatagtaaaaattattgattttattaaacttcagctgttgagtaaacacttttaaaatattctacgtcatgaaattgggaagtatgcacaaagcatttctggtcaaattgaaatagaatggtttccttgagaaaaaacacgtgtacaactatttgtgttacaagtcaaaccagcagcttttttcttgaaatgccattgttacttgacagaagcagcaaagtatgcttattcagactaaggtatctggcagacattttctcaaaaatgaatgaagtgagcctgtcactgcaaggaaaactgacagtattt

SEQ ID NO: 204138 - DNA, 204 bp, Homo sapiens
tctgcatgtcagtggggctcaatcaataacaatataaagagaatgaatttaataaatctaaatggatgatgctctaattttggatataactaatggaaaatgtaaatgacagcttaaacttccacattgtttattaaacatgtgataaatatagccttttccctgcatagtactcctgaggaatcttctcatctggagactcat

SEQ ID NO: 204139 - DNA, 355 bp, Homo sapiens
ttttcagcatctcaacatagttagtaatattatagcaattattttatgaagatctaaaacatacagggagatctggcatgcaacattattacacaggttatctattggtgtaatacaccacattaacagattaaggaagggaaaaataatgatcacatcaacagatgatgaaacaattcttattcatgtcaaacaaaatctttgcacacttaggataaaaggggattttgtaatcctcatgcaatcttatatttagtgataaaacactggaagacttcaaaatttgagactgggcaggaatgctcattatcactgcttcggtacatcctatgagatcttcaatacaaaaaggcaa

SEQ ID NO: 204140 - DNA, 507 bp, Homo sapiens
cctaggaatggagttgctaggttgaagtaaattgtatctctaagaagtttgaccacttacaatcccactagcagtatttgagaccatcttagactatgttctctctaacacttggacttgctatacactataattctaataatttgaccacagattcttttgagttttgtacattcacaataatactatgcatgaataaggacaattttgtttcttctttcttttttaattattttgcttgctctccctacctcatcttttttgcttgttttattacatttattacaatcaccaatacaaatgccagtggagtaaaccttggtttgtttctgttcttgaaaaaaatgctttgattattcatcactaagtaggacattggctatagactttttgaaaacctgaatggatattgaattttatcagttgattttctgtatctattgagagaatcatgtgttttgttccttttatcttttaaagtaataaattatattgctatattttata

SEQ ID NO: 204141 - DNA, 172 bp, Homo sapiens
atggctgaaggtagaagggcaagacagcatgagagtgaaagtgcaagagcaggaggaggctcaactcacttttgttgttgttgttgtttgttcattttgaggaagggtttttctctatcacccaggctagagtgcagtgacatgatctcggctcactgcaagctctgtctcc

SEQ ID NO: 204142 - DNA, 309 bp, Homo sapiens
acagtggcaagccctgtgaacataactgtggaatattagatgggcattgggcatttatagaaaagaaagaaaccaattgtgttgcagtctctctgagaggcattcatggatcattctcatggatcattcaacatatgaggtggcaacaggttaaaaaagggggagtccctttcccttctttataacgtcccataaagcagaagaacttttcttcattgcatgattttagttcaccatggtgatatactcaaaagaatggaacaaatttattgcgagaaaggcaaatgaagataaaactttggagaaact

SEQ ID NO: 204143 - DNA, 986 bp, Homo sapiens
aactaaggatcaactgtgtagtcagtagtgggatttcagtcatgaagatttgacgatttctctaagacgcccactaatgccagcagaagcatgtgagagatcaaataccctaggaaagaaaaccctctccctggtaagaggggaagaagctgggttactatgtattcctaaaaccttaagaacaaaggaatatcagaacaatcatattttaaccagaacagggtggtaaggactaatcacacacataacgttggtcttatactgtgaccgccctccctggtgagacacagtaaaatttaggggtcaataaagtcattttattctttctttttgttaccttctattttctttttcttcccaaggtgtgtacttcagggtttaggacctaataaattagcagaggtgtacgtgccaacactcttcgttgccatctttctatctttgacaatagtaagtttgaaacttactttacagaaacctggtcctaaatataaaaaatactaagcagtttcagcttgtggaagacagaattatacttggtttttaccaatttactatgtggcatatgacaagaaactttacctagaataatactgaatccctgggatttttttatttgagacagagcatcactctgtcacacaggctagagtgcaatggtacaatctcggctcactgcagcctccacttcccccagttctcgtgcctcagcgtcccgagtagctgaggcacaagaatcgcttgagcccgggaggcagaggttgcagtgaggcaaggttacgccactgcactccagcctaggtgacagagtaaaactatctgaaaaataaaaataaaacagcacttgtcaaacattagtgttcataaaagttacctggagttcatcagcaaaaattcccctcatgactcggaaggggactgagaatctgcatttctttctacccagctcccaagtgatgctgacagtgaccctgatgcttttaaca

SEQ ID NO: 204144 - DNA, 655 bp, Homo sapiens
atattgatatctttctctaggtttgggaagttctctgttattatctctttaaaaatctttgtattttgatctttctttctacctcctctaggattttccttagattttccttctctatagttcatgtatacagcatgtaatgaaatacgcatatattctagtgtgctactagtagtggctgccacttaataaataagggattgaagaatagtggcttagagttggagagacagtatttagccatggaaaatttaagaaccacttaggactggttagggtttagagtcagcagttacagagcaatattaaaagagggtttgattctaagttatgattctaagttagaaatgaaagacaaccttgggccaggcaagtgaacttgctttctaagccaactccagttccttgaaaagttaaacatagagttactatatgacccaaaaagcccatttctaggaatgtacccaagaaaagtgcaactatgtaaactatacactaaaacctatgtatgaatattcatagcattattcataatggccctaaagtagaaaccacccagatggccatttagccaactgaccatttttatttttatttaatcattcatgtttatttctccacctaaaatttgtgttcctactgtgcataaggcact

SEQ ID NO: 204145 - DNA, 365 bp, Homo sapiens
catgaggggggaagttataccattatattagaaaggactcaaagcccttcccaaagcacagttttagaagagtagaataaatacatagaaaacactcgaagaaagcatttaagattattcataatgaatatctttggccaataaaattctgagtaattactaatttattatacttctcaatgtatcgcaatttttataaatatatacatcttttatgaggaaaaaaatggtccaagaaattcagcttccatcttaacattaaaaaatccctttcatgaactgtaactaggggccacaatgagtaaccactaagtacttccaattttttaaactccaacagagttaaaaagttcatgacaatggac

SEQ ID NO: 204146 - DNA, 269 bp, Homo sapiens
cacccagccaattataattcttcatactactactatgtatattctgtgaaactctcaaaaacattcttaaatgaacacatactttagcattcttctaatttacaaaaatagaattattccatcacaacaaacaagctgtaccagtttggcatgacattctcagtggctctgtgctggttcctactttctttttctaagtattctgctattcttttctaactgtcctacccattcctctaaatgactgtaggtgagaagtgtgagctggg

SEQ ID NO: 204147 - DNA, 591 bp, Homo sapiens
tctgtgtccccacccaaatctcatgttgaactgtaatccccagtgtggtaggtggggtctggagggaggtgactggattaggagggtggatttctcatgaatggtttagtactatctccttggtactcctcatgatagcaggtgagctctcacaagatctggttgtttaaaagtgtgtggtatctcccccctcactctcttgttcctgctttcactgtgtgacatgcctgctcccgcttcacaatctgccagtaaattgtggcaggttatgagtgtgtgtaatttatgagtgctgataggatgaaagatagaaaatgattttagatagaaagaaaatcattctggaagctttgagtcttccttttgtaatctatgttggttcttttttaacatcccctgtttcagcacttactgacctggagtctgtctcacaatgactaaatgtaatataagattctaggatgtacactagaacagaaaatggaaactaaataaaaactgaggaattctgaacaagtatggtctttagataataataatatgacaatattgatgccttaattgtaatgaatgcaccacactaatataaaa

SEQ ID NO: 204148 - DNA, 610 bp, Homo sapiens
taaatcagcatcagttctataattatcattagcaagtttgcatcagtggctcacatcacttgaaaagctcaacttaaatgatttgtgaatgtactcatctgatacattgaacactctccatagatacaaacaggtgcttgcatattgctttatgtaaaatggaaagtctgcacatgcatattgtatgaaatacattttcaattcaatattaaaatattatttccatacttgaaatattaagctatatagagacacccaagatacctgtgctttaaaagctcagttggggtgagcagtgtaaggaaatagaaaactattactcatacttaaggctagacctgatgtcttcctcattttcagaatgttcaaataggaatctggcaaggatgattgacaggaagaagtatccaaatgcaattcatctgtattttcattgtttctattcttgaattattgatattgccagtagtcgtttgccatgaaaacaaatcaaaatacgtatggtaagcacttacttgaatgcaacacttttacatgttaaaaaatatttacagtacaccatgcttataatttaacaaaatggcaaactggtagggagaataactatagc

SEQ ID NO: 204149 - DNA, 429 bp, Homo sapiens
tttgaaatgctgaggatctgtttacacaggccaactccttacgaaagggtgttggatgaggagccctcagtgtcttgtaaattaagggatcaactggagtttgtccagccttcctagctggagagagtcttatttacatgagaagcaaggctaggtgattaaagagacaagcaggataaaattcaaagtaacgagttaaagtaaaaacaaggttaggcatttcagttacaagaaggttcctgggctacaccccgaccctagagtttcttattgagggcctgaagtggacctgagaatgtgcatttctaacaaattcccagatgatgctgatgctgctggtctaggaaccacactttgagaatctctgtgctaggctgtattagtctcttctcacgctgctaataaagacatacctgagtctaagtaatt

SEQ ID NO: 204150 - DNA, 441 bp, Homo sapiens
ataatagaggacttaccaaattgggtgcagccactcatactgtgtcttgatttgtagataaagaaaatgatgaccctccctaggtactgatttagagtgacatttctgtgaaaatagagaaatacttacatatccatagaacacatatatgcatttaaaattgtatatgagcatgacatatacatacatatttgtgtgcatgacacctgcatccttgtatgtttaaatacgatctggcaattgcattctttggtatatacccaaatatttgaaaacttatatccactcaaatcctgcacatgaatgttatagcagcttatacacaactgacaaagattggaagtaaccaagatatcctgcaatagagaagtggataaactaactctgaaacattcatacaatggaatattcttcaggaataaaaagagatgaactaccaag

SEQ ID NO: 204151 - DNA, 821 bp, Homo sapiens
caacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggtttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgttcctggacctgcctaaagctggagaagcgacttggaggcacgtggtcggggaggacattgcctggcagtgacctgtaccacccaaatgcccaagttttaatcgacccggttcttgggtcttcgaggatgtggccgtcaaaggccaacgcctggattaaccccgagaccttcaaatgggggaacccctgtgttaacccctttagacaggtcttggacagaacaggttattcctaatggtcctggttgatgccataatggcttatttggcccatccaacggcaatatcccggaacat

SEQ ID NO: 204152 - DNA, 120 bp, Homo sapiens
atgggatatcacccaaaagcaaaaagaactgaagggaaaaaaaaaccctaaacaattttctgtcattatatcattgatggtggagttggtagtctaacacgggtgttctaatatgtatta

SEQ ID NO: 204153 - DNA, 457 bp, Homo sapiens
atgcaattaaggcagagaagaaataagatggaaaatggggagaaataaacagattcttttccattaagtattgttttgagatttctaattttttcaggacctctaagaaaattgtgaggtgtcacttctctcttctgggtctatctgtaattgaatctaggtcactattctaaggcaagaaaagtctgctttccactttcctacatcaggctgaaatttgggggagggacaagggtcttgcaatttcatttaaaatgtaatggtggatgaactgataagcaaatacggaaaaaagagtctgcttaaaagaaaaaaaaggcatggttttaatatgctacagatggggggaaaatgatttacatgagagtttatttcctctttgctgatatgaaagaattacagatacaaaacccactgatctatagaataaaaaaagaaaagaaatgttattttcctg

SEQ ID NO: 204154 - DNA, 440 bp, Homo sapiens
gacacagagtctctctttgtcacccaggtgggagtgcagtggcatgactgtagcttactgcagccttgacctcctgggatcaagtgatcctcccaccgcagcttctcaagtagctggaactacaggtgcatgccaccatgcctggctaatttttcgtggtttttatagaggtggggttttgccctgttgtccaggcttgtcttaaattcctgaactcaagccatctgcctgcctcagcctcccaaagtgctaggattacagacatgatccactgcacccggcctgaaaacattctattgtgaaaattgtaatctagtaaaaatgaaagaggctcaacgcctgtaatcccaacactttgggaggccgaggtggggttggattgcttgagcccaggaattcaagaccagcctgggcaacatggtaaaccctatttctaccaa

SEQ ID NO: 204155 - DNA, 504 bp, Homo sapiens
atgtttggtaagaatggtaaaaccccagtgttaaatccagtatgcaaggaacataaatgtttactataggctttttatggatgagaaagaaatactgaatttacaggtcttccatgaaaatcaatcccctttcttcacacaattatactttataggtttcattttatccgtgatatcattaaatctaccagtatagggaaaggttttaactaggttacatacatacatgcacacgtttgcatgcatatatatttatgtatataaaagttgtagtttgattcatctgcaagtgacagaaaaaatatggcataaaaaaaaagtttatttctcagtcatgtaaatgaagtccagagccagatggtggaactctgtaaggctccagcatgtcagagatgtaggattgaactttcatctcatggtcaaagatggctgcttaatctccagccatcacatctgcattccaaacagtaggaaggcaaggggcaaacaagagtgtgtgtttct

SEQ ID NO: 204156 - DNA, 402 bp, Homo sapiens
aattcaaaatcccatgcctaccctaaaatggacatttctccggcagatctgagactgaggctatttgttcattcattcaacaaatatttattgagcacctactagaaaccagaatttgtgctagggactggagctgtaagggaaacaagattccagggccctgtccttatggagattacattcttgtacactgtaatgcaagtggtgagcacagcttccatcttgtcacagtggtgagcacaacctacttctctgaccattggacaaaaaattgcactccccacttaccttgtcttattttatatttctttgttgctgatctttcagtctttgcatgcaaaaatgtatcctctttgagggtgctttatgatgttcattgctgaatcccaagcacctagaacc

SEQ ID NO: 204157 - DNA, 284 bp, Homo sapiens
ggctcggctcctgattgagaagagacgagatggaggactcctcctatgataatcatctcgagggcgacgaccccgagagggaggtgggccacgatttctagagaagagacgagatacaaggagaagagacgagatgaggtcagcctggtggaatattcctggggtagaatcagccacttacaagagagtctccacttgcctttcttgccaatactggtagccacttgcatttattctttcccttcttctcatccttctctgtgtcctgccttttctattcatct

SEQ ID NO: 204158 - DNA, 539 bp, Homo sapiens
tagtgcccatcagtagatatatggataaagaatatgtggtacatttacacattcgaatactatttggccattaaaaaaaatgaaatcccgtcatcagcaacatggatggaactggaggacattatgttaagtaaaacaaatcaggcacagaaagacaaatactgcatgatctcactcatacgtgggagctaagaacatgcatctcatggaggtagaaagttgattgctggttaccagaagctgggaagagtggtggggaaaggaggagatgaagttgattaatgggtacaaaaatatgcttagaagaaatggtaacatctagtattggttagaaaagtagggtgactgtagttaacaataattagttgtattgctggaggagaggaattggaatgatctcgacctaaagagggtgtgaatatgatgacggatgtcccagttgccctggtttgattgttaagcctatgcgtatatcaaaatatttgtaccccccaaatatgtacaactattacgtactactaataaaaaagcatattgct

SEQ ID NO: 204159 - DNA, 333 bp, Homo sapiens
ggtttgagaggaggaggctttaagttcatgtggtaatgctgcattctggagtcaagttgaaatgactttggagcccaagtatttcagaaaatctgtacctctactcttccctagggcattactgtttcagaatcaacagtatactgagaacctgtttaaaatattcttaaatactcttcatttttacaaatgagataatattgcttatttagaaatattattaacttttctctatatgttgtggctatttatttatttatttgtttttgagagagtctcactctgctgcttaggctagaatatagtggcacaatcttcgctcactacaacttc

SEQ ID NO: 204160 - DNA, 507 bp, Homo sapiens
gggtcggggtgggggcgaagggccgcttggcctctgtagggtcgggactggaagggtgtgccctcgccgtcctcgccttcgtcttgcacgggacaagatgtcacgattccgaatccaaacctcagagacagcccccatccctctcgttagccacccacacaccccgctcagcaacaataacaacctgcatttagggaacgtgtgttatgtgccaggccacacaggcattatctcatgtactcctcacaggcaccttatcaaggagatgctgttgttacctgcattttacagatggggaaactgaggctcaatgcattaaggactgccaggaagccctgtcctgtggctgtgatgatggaaatgttccctgtgttgttcagtatggtagtcactggccacaagtgagcactggaaatgtgcctattgagactgaggaactgattttttcattttgtttaattgtaattaaacagttacgtgtggctgtggtattggacaatgcaggtc

SEQ ID NO: 204161 - DNA, 502 bp, Homo sapiens
cacccaaaactgctctcatgttctaaaggtgactgtgtggggtttgaaccttggcgcccactggacagtggtgagcactcaccaccctgaggcctggcagcctgtctgtcactggagagcgttcagcactgacactgacattagcagatcacagagcttttcagcccacgtatgtatctctgtgaggcaggacaaggcctgcttgtcagtgagccattgaggtttgcagcatgcagtgcaagccagtattctggcctaggtactgaggaaaccacagaatggggatgtcagccccagggagactaactcctagtgagggcttccagacccacaggctacctccagtcctgttcagctaaatcaaacagactgcagaattcttccaattatgctttacaacttgtattaattgtaaatatgctctgtataaatattaaaattgctaattactattttaggaagacttaagacctaattagagcaagattttaagaaacagaaa

SEQ ID NO: 204162 - DNA, 263 bp, Homo sapiens
gtttcaaaggtcaacactccaatgaagagcttcctcagctgttcaggctttttaggagactctgacttagacaggacggcagtgagaagagagaatctaacggtgcttcttcaatggcatttacaggcagaaaggttaatttttgtatttttagtagagatggaatttcaccatattggccaggctggtcttgaactcctgacctcaagtgatctgcccgcctcagtctcccaaagtgctgggattacaggggtgagctaccg

SEQ ID NO: 204163 - DNA, 588 bp, Homo sapiens
agcacttttcccaccctcagccctgaggtgaccccagaaggggaaatggtgacccaagtccagctgctggcctgtctgtctgtgctttccagcccaagaactgattccctctctgagaaaattggaaaggctcctggaggctgctgagaagctttgatgtagaggtagcaattgaacagattgtcctttagaagcagccaaatttcattttccagattgaaagacagacttccaagaaaatttttctttttaatgttttgttctagcatccaaaaaagacccaacttcagatccgggcttcagagtttctcagggctattcttgtctaggtggagggtggttggcccattctcagatggcatgtgtcttaatagctgtatggctggccaggccagccttcagctccctcctgctgggctctgagaggaagtcgacttgacagctgctaggcacctcccagtaagctcaccaaagtattttggtgtcactttgtgacagacttggattcaaactgcagccctgccactagcttgttaatattgtggctgcccacacgttacttagtttgagtctgtttcctcatctcta

SEQ ID NO: 204164 - DNA, 462 bp, Homo sapiens
gttagcaggtgacacaaccaagattcagacccaggttcttcgtctaccctaacagtattgccaaagagagattccaaagttaccgcctggccactgggtaaacctccgcagcagagagacctactttatgtttcattttcaagctcctatggagcccagcagagagagctgacaaggaggaatactgcgaggggctcacagactaagacaatctgctgggaaattaggagtttgaaacatccaactaagaagcctaaggtttagactgcatcatattctaataacaacaggattataatatcaaatgagactctctgaccctgcaaatctggaaccagctgtatagggactttgaacctcccttttctccaatctgctggtgtttgtcatcctaatatatacctcatattttctttctgaaaataatttttaaaatatacccatcatacatacggcagcaca

SEQ ID NO: 204165 - DNA, 601 bp, Homo sapiens
gtgcgcggcgatttagaggatcccacgacaccctcctctttcctggcaccctaacatcctctcttgccacatcactcaggccccagacccagctattgccaagctctggcctccaaggaagttaaataacaataataaaaacagtaacaatgaccagcaaggaccccagtttctccacttgctagttgtgtgatcttgaagaacctgaacttctccgagccttagtttgctcatctattaaaatgagggcagtaattctacttgccttgtagagatcttgggaaggttagatgtgaaagccatgagcaagggcttggtgcattccacagaggaggcacagtgttagttgacggaaagaaagaggagggtggtcgtgggatcctctagatcaaccccagcaactgaatacaaccagacgtgtcagcttcatttttatagatgaggaaatcgaggcccagtctctggggtgaagagattctcaaagtcacacaccagcaggcacagtcacaaagccaagtgtgcccccaggtctccttccatattccttccaggcccttgtgccttcacctgttcctgtgtctgtcctggatgcacgttgtct

SEQ ID NO: 204166 - DNA, 597 bp, Homo sapiens
aaatcagtatcttcttacttacagaagtgagtagtaggaaacactactgcaaacttttgtcaaaggatatttatcctttgagccaaagcaccctgttttcatagttctgcttcctaatgtggttttctgagacctgtttgatcatttcctttttaactagaaatctaacaaagtctgcaaattacttgggatcagaaggatggctataattgagatttaaaaagtaaactcaattacaaagaattgtttggaatgtaaacttgagccttactgtcacctattggcggtcgtggttttgaagatgacccctctggagctggatgaaatttaaaactagaatcaggctcagttcagtcacctggacagacatttattgagcacctattgtgaaccagcaactatgcagaggatagaaacctgaataagaagcaatctttggccgggtgcggtggctcacgcctgtaatcccagctacacaggaggctgaggcaggagaatcacttgaatccagaaggcagatgttgcagtgagccaagatagtgccattgcactccagcctgggcaacaagagtgaaactgtctcaaaaaataaaaaaa

SEQ ID NO: 204167 - DNA, 479 bp, Homo sapiens
aaatcagtatcttcttacttacagaagtgagtagtaggaaacactactgcaaacttttgtcaaaggatatttatcctttgagccaaagcaccctgttttcatagttctgcttcctaatgtggttttctgagacctgtttgatcatttcctttttaactagaaatctaacaaagtctgcaaattacttgggatcagaaggatggctataattgagatttaaaaagtaaactcaattacaaagaattgtttggaatgtaaacttgagccttactgtcacctattggcggtcgtggttttgaagatgacccctctggagctggatgaaatttaaaactagaatcaggctcagttcagtcacctggacagacatttattgagcacctattgtgaaccagcaactatgcagaggatagaaacctgaataagaagcaatctttggccgggtgcggtggctcacgcctgtaatcccagcactttgg

SEQ ID NO: 204168 - DNA, 353 bp, Homo sapiens
aaaaatagatgctaaggtaacacaaaaaagatagaaatttaccataagattttataaggaaactaattttattttaataggtagctttaatttggtctctgtttaccaactggaccactgagctcaggacagagcccattaaagaagagggatgacaaagtctttgcaatttttagatcctaataatttaaatatgtgaaaagaagacacaattggaagggagaggacctagacctttaaaaatcaaggatttcactgaatcccaggtccccaagaagagtaaaatgccatgggaaccataatgtgcaacacttccacagtttactttgctacaaaggcatttttttcattgt

SEQ ID NO: 204169 - DNA, 440 bp, Homo sapiens
ggatgtcataatacaatcttttctgacttcagtaccatgctcagaaagatctagtacaccaagattaaaaaaagaatctacatatgttttcttctaatacttctgtgttgtagttgttcttatttctattaggaattttttggatgtaggaatgagggtaagggttcagtcttttttttactccaagagaccagtttctcctgcattattcttgaataactcatttattatctactaatgtgaaacttgtcctttgtcatatattagttttctacacacactctatgcctgctgatcatatgtacacacactcatgcacagtctcgtctaacatgcttatacgttctgcttgcatgtcttgttctaccctcatgtgtgtgctgctcacatgctatgcattctatgtttaacctttactaccttttgaattccaaaagctt

SEQ ID NO: 204170 - DNA, 185 bp, Homo sapiens
ttcccgcttgatccgcttatgatttaaaaaaaaaaaaaagtctgcagtaagtgtttttactgcaatatattggtggtatttccttaaaataaattactagcaatggaatcgataactcaaaggataatattgttttaaggccttgtgataaatattgtaaatttgccttttaggaaggttgtgcc

SEQ ID NO: 204171 - DNA, 400 bp, Homo sapiens
accctgcttcttactagcttcatataggcaaatctcagctgccctgtgcttttattttcttatcttaaaatggagcacttgaacttggtcataactaaaatacactaatttctaaatttcttaatttcagaaattccacagcctatcttcccccatgacatcagttaacaaagttcctcccagactattcatccaaagtagaaacttagatctttatgatgatcttcacggttccacatggactgcctgcttcccacttcccccttctacttggcttcctactgctctccaggtcactctgacctcttcatatttcctcatacccactaggtaccctccaaaacagcctttgcaccaactggaatgctttctctctctagataactgtatggcttgcttt

SEQ ID NO: 204172 - DNA, 578 bp, Homo sapiens
tgagtagaactgatgtatgagaccctttaagaccattatccaactgcagtttgcttggcagagttagcattaatgcaccctttgatctaggcacctggaggcaggtaagacaggctctgcgtgcaccaccgtccctggacctgttgtggcggactccttgaagcaagatcaacttgggctttgtttgagtttttaaagtcttttttttttaatgtaaaatttgtcattttaactttttaagtatacagttcagtggcattaagtttatttgcatttttgtgcagctttcaccacttccatctcccaaactttttcatcatcccaaactgaaactgtacttattaaacagtaactccccttcctcaagacctggcaatcaccattcatcttcatttctataaatttgactattctagacatacgtgtaagtgggagcatacaatatttggtttttttagaggggggttctggcttaattttataaggtgttaacttgttcctcaaaatgtgttctataaactggcagcatttgcatatcttggaacttgcttgaaatacagaatgtccagatctactga

SEQ ID NO: 204173 - DNA, 612 bp, Homo sapiens
atttgagacaacacatgtgaaatgttgccaaccaaggaagcttatagggactctgcccagggcttttattgggtgctgaacacataggtatactctgccagacatataccaaaatgccagactcccagaaggaaagcaagtgttcatcataaactatattgtttgcacaaacagtttaggcataatgagctactcttatcagttctgggaataatggtaacccttctcaaacccaagtttctagttgccaaccttgtaagcaggcctctcaaacagtagcagtcctgctgtgttaacctttctctgaatatataactttgttttttaagatattcatgtctcaaattcacttctggagtttactgctagatatgtaaggggacctctataaacagggaaacttcccacctcctggtggtggatctccgatgtgaaagttttctttgaaatttttatggctgatttcaggacctcttcagtttttacagccttttccagcttacagttagacagaggaattaacaattactaatgttctgttccacgccagaccttgtgcagacatttcagaaagtatctgtcatttaatttcattcaccctaaagcatagat

SEQ ID NO: 204174 - DNA, 724 bp, Homo sapiens
ggtccacggcttcattcttgaagtcagtgagaccaagaacccaccaattccggacacagtgtcaggcgcctgtagtcccagctcctcgggaggctgaggcaggagaatggcgtcaacctgggaggcggagcttgcagtgagccgagatcacgccactgcactccagcctgggcgactgagcaagactccgtctcaaaagaacagcaacaacaacaacaacaacaaaccatagtcctttgtcagtctttagtctactacttctgacctattaacagctcctggccttccatttctagttatcccagaaggacatactggaacaccttgcaggttacacactttgatggcactaactgcatgttagaattgtgtggcaaagaactgaaggcatcagtccaaaagcccaaagaactaaataccgccaacaaccccatgaacttggaagtgggtcctttcccagtgagctctggagatgacaaaagacagacaacaccttgattgtagtctgtgagaaaacctgaagcagaagacccagctaacttgtgctcagattcctgaccaatacaaattgtgagacaaatgtgtaattttttaagccaagtttttgataatgtaatatgaagtgatagataactaatacaaaatagagaactggatacatatgttcacgagctattctggcataaaaatacattcaataaaaaacttgttgctactctgtaaa

SEQ ID NO: 204175 - DNA, 454 bp, Homo sapiens
  misc_feature (42)..(42): n is a, c, g, or t
  misc_feature (55)..(55): n is a, c, g, or t
tataagtctttataagcggtctaaggcccaaaggacagaagnaccaaagcaaaanttttggttacacactttgatggcactaactgcatgttagaattgtgtggcaaagaactgaaggcatcagtccaaaagcccaaagaactaaataccgccaacaaccccatgaacttggaagtgggtcctttcccagtgagctctggagatgacaaaagacagacaacaccttgattgtagtctgtgagaaaacctgaagcagaagacccagctaacttgtgctcagattcctgaccaatacaaattgtgagacaaatgtgtaattttttaagccaagtttttgataatgtaatatgaagtgatagataactaatacaaaatagagaactggatacatatgttcacgagctattctggcataaaaatacattcaataaaaaacttgttgctactctgtaaa

SEQ ID NO: 204176 - DNA, 1072 bp, Homo sapiens
agccattgcaactggaggcccagcggaggaagggatcaagaagaggatgcagcccagagcccaggaccgagcatccaccggcctctggagatggcgtggtctccagttgcatcggggcttcagggcccatctgaagtgctgatcaaaccaggcagacacaccatgctggtgaaggcaggctttgtagatgcggggctgaattgagcagccacagaacctctgcagctctggggccagtggcagaacttctagaagtacctgtggggtgggaaaccccagccacaaaagcagtgagctgacttccaggcctgaggctttgcctgcaggcctcatctcagcccatgggacagattcctggtttttttagtttggccttggggtagatgataccttcagctgtccaccctgcaatacctcacctcctgccttctgacccagtactctgcagagcgggggaatggggccaggggacaggggcagggaagaggaagaagcaagagctgccagtgtgctccaaaccaagagagccctccacatgattctgggcacagctgaggaggagtgcaagctcaactctgctcaccacacttaagaagcaggcaagggaggatgaagggcaaaaacatggggtcctgaggcccttttactccctctaccctgctggaggtgaggatgagaggtgagacttcgttggactgtgctcctggccagttgatctcacccaactcattacatcagtagcctggtcacagggtggacactctgacctcttcttagcctttcattggcaatactaccagctctatatatgcccttatagggcctgaaccttggctcaggtggatgggcttggaggtaaaataattgaatgggtcaggggtaggaggagagatgagtctctgccaaggctgtgtgatgtgtcatctgagagagtgggtaacccctattcccagcacatggccatttatttagagccagggagggggacgagaattcatattcaaatgtgattctttcttaattactaccagttgttcaggtgagggaatcagggaaggccagattaataatc

SEQ ID NO: 204177 - DNA, 456 bp, Homo sapiens
tataccacagttgtttttccttagctcattgttaattctctaattagaaacattcttacttaaataattatttttctaataaaaaaggagagttatgtcttatttctcatttcaactataagaaaatatgttcttatcttggacccgttatctttaagctttttgatcatttcccttacgattctttctggtaagtgaatgagaatcatcacttagtagttctaattatgtcctaccaaagcagaaagaaccacatacatcaatagtcaaattggtagaaaattgagaacaccgaaatgcctttaacaagaatgatgtgaatataagtgacatgcattcgtttttttaaaatctagataaacttctgagttatttagtccaatattatttggaagggaaatggaactaatttttaacaaaacatattttatttgagctgctataaaaataaatttg

SEQ ID NO: 204178 - DNA, 261 bp, Homo sapiens
tctcccagatgagaataacatattaaaccagtgttaccaaaatgactatactgaacccagctttattggggtagaaaaacgataacgagtacaactgtgtagctcttgctctgccaccaccaccatcccatgccctccccattcactctcccctaatctgtgaactgctttcacatttcatagcctcaccttctaaaggtgggttttgaaacacagtacaatatttctccttatctaagatgagaacaattagagagcaac

SEQ ID NO: 204179 - DNA, 311 bp, Homo sapiens
tcctgggctcatgtgatctgcctgccacggcctcccaaagtgccgcacccggccagcttcctctttgaaactacactcactctcatggccaggtacagtggctcacacctgtaatcccagtgttttgggaggccaaggggggaggatcaagttgaaggctagcctgggcaacacaacaagacctcatctctacaaaaatgtaaattatacttgctctcttgacgacatcagtctcaagcaattttttttttttttttttgagacagtctcgctctgtcgtccaggctggagtgcagtagcgcgatctcggt

SEQ ID NO: 204180 - DNA, 483 bp, Homo sapiens
cgataactgcagggtacgctgctacaaatgacgtctgcgtttgacaaggatgagcagaaccggagcgtgtgcgtcaattcaaatctgtgacactggcgcaaaatgtgagaatgggctggggtgccaggcggccagtcacggctagggcacagttccaagaagggccacaggggcccgcagggacacttaccccaagccctccagaaacagctgctgcaggtcagcaccagcaccagggccaggcacacagtctcatcggcacgtctgccactggctgtctgcaaagtgcttccctttcacaacccacccacacagctcaggactgaggtccgcccaggcaaaggggcctctcggttccagaatcctttggcctgacaggcaactacagatactttcgtggactctgctgaaacctgtctgagactatggagctttacgtggctaaggaagagaaaaaatatgtttggagtccttgcccactga

SEQ ID NO: 204181 - DNA, 627 bp, Homo sapiens
attttattgacagggtctcgctctgcccccaggctggagtgcagtggagcaatctcagctcactgcagccttgagctcctgagctcaagcagtcctcccacctcagccttccaagtagctgagacaacagatgtgcaccacacctggctaatcttttttttttgtagagatggggtctcactatgtcgcctaggctagtcttgaactcctgggctcaagcgatcctcctgcctcagcctcccagagtgtgggattacaggcatgagccactccacccagccaacatccccatttttaaaaagcattggtgcagcgaatcacttgaggataggagttcaagaccagcctggccaacatggtgaaaccccatctctactaaaaatacaaaaaaattagctgggtatggtggcaggtgcctgtaatcccagctactcaggaggctgaagcaggagaattgcttgaactcgggaggcagaggttgcagtgagtcgagatcacaccactgcactccagcctgggcaacagagtggcactccatctcagaaaaaaaaaaaatttttttaataaaaagcactggtgcagtggtgaatctgtggtctccaagacaacccagacatgagagcactg

SEQ ID NO: 204182 - DNA, 513 bp, Homo sapiens
agtgagaccatttcttttgagttattacctgaatagaaagatgattacaagattagcatttcagggtatgaaagactttagaggttatgtttgactttgggtttagagtaagggaaattgggccacatgaatgttaactggtctactaagatatctcagccctagagctagtctagaatcctggtccagccaatagagaatcatgacttttgaactatgttccctgagtacccttttctactgttggccgggcatggtggctcacacctgtaatcccagttctttgagaggccgaggtgggcagatgacttgaggtcaggacaagaccagcctggccaacatggtaaaaccccatctctactaaaattagctgagtgtggaggtgcgtgcctgtggtcccagctactcaggaggctgagaatcacttgaacctgggagacggaggttggttgcagtgagtcaagatcacgccactgcactccagcctgggggacagagcaagactccgtctca

SEQ ID NO: 204183 - DNA, 201 bp, Homo sapiens
tttacattttgtgtctcacaatcagatggtcttcctcccttctttctctctggggtttttcaaatttaacaatttcaaggacatttatgtgaattacagttgaccactgaacaacatgggggttaggggcactgaccacatgtgcagttgaagatctacatctaacttttcactccccagaacttaaccactatgagctta

SEQ ID NO: 204184 - DNA, 507 bp, Homo sapiens
gaaatatttgtctctggaagagtcactgaatatgtaaatatatcctgcatcaaagaaatcactgtacctttgtttagtccagtgtttaatgattatggtgcctccctatgtagcacatctattaatgtcccatagaattattgttatgtgtaagagcattttggaaacatagctccaaatgaatagctttctagaggggaatttgatattgaccagttaagactatcaaattaaaagttaaactcagattgtgaccttctgcttttgtctcatttactcctttgtttccatcctgaagttgcaactgtcatctctacgtagattatttggactttaccttttctatcttacctgtttcctgggtagttcttttatttgtgaatttaaaaaaagcaaactttattcttttaagaataatacatgttcaagttggaaaattagaaaatataacctggcaaaattaagcagtataattctactcataatcccactaccagagataactgt

SEQ ID NO: 204185 - DNA, 847 bp, Homo sapiens
ctacagaaaagatataacgattgaattagactcttaaatatctgtggatgtcaggttgaatacaagcagctattcagtgttttactctggcaggagaacaagtcccctggaggtcagaagccatgcaggtccctggaagtgtgagcagattgttaaaatggtatcaaagatgggctggcatgaggccagagtctatccttgatgctcacctgaggtctagggctaaactcttgcctttacctgttccatgcttagccgttcctgctttttgcctagaacctcagtgctattgctcacacagacccagctcatgtccccaggccatgaccactgcctccccttctcccacctgtgcaggtgttaagcatcagtacataactgaggagtaggagggcagcagcccaaatctttgatgaagaacctctttcgtatcaacttatgctttggaacgagacactgttggatgggaatctggcttctaacaaactgattggttggactcatgccttattctttcggagccttagttttgtcatgtgtagaatggggagtattgctagctattcccatagggagtgagagagagtgtaagtaaaatgcaatggcaggcacagggatggttgccattatcagttacattattatgaggattattttctacctagatcaggtataaggtggatgtattattggcattcctaggactgttttaaaggaagtacctatgaggcctcatgataagccagatgtccagaagccagcttgagaccagggctcctggtcacttaaaagatgtttggggctgggcgtggtggctcacacctgtaatcccagcactttgggaggc

SEQ ID NO: 204186 - DNA, 1124 bp, Homo sapiens
taaggcatgttactgtactgaatactgtaggcagttataacacaacagtaagtatttgtgtatctaaacatagaaaaggtatggtgaaaacatgatatgaaagattaaaaaatggtatgcctttataaggtacttgccataaacgggacttgcaggactgagaggtgctctgggcgagtcagtgagtgggtggtgagtgaatgtgaaggcctagaacctgtagacgttataaacactgtatgcttacaaattttatttttaaaatttcttttttcagcaataaatttattgtaacttttttactttatagtttttttatttttttaactctttaactcttgtaataacacttagcttaaaacacgaatgcattgtacagctctacaaaaatattttctttatatccttagtctataagctttttttaaaaagactttttaaactttttgttacaaactaagattcaaacacatacattagcctagaccaacacagggtcaggatcatcagtatcactgtctcccatccccacatcttgtctcacagaaaggtcttcagggacagtaacatgcatggacctttcatctcctatgataacagtgccttctcctggaatgcttcctgaagggcctgcctgagcctgttgtatagtaactgtctttttaaaaaaataagtaggagtacactctaaattaataatgaaattaaagtaaatacaaaaaccagtaacgtgggtgtttattatcaagtagtatatactgtccataattgtagtgatatgcttttttaagtgaaagcaagtttattaagaaagtaaaggaacaaaagaatggctattccgcaggtaaagcagtctgtagtggtatactttgtatgtaattgcagcgcagatttgtttgcaccagctaatgcgatgggctatgacattaacccatcactaggtgagaggaatttttcaacttcattataatcttatgggaccaccacatatatgcaatctgttgtcgatctaaatgttatatggtgcattactataggtgtgcaaagcactcgaggacttccgtatgacagagctcctccttcatgtctgcttggtgcaccctgatcaccctgaatgtatcttt

SEQ ID NO: 204187 - DNA, 227 bp, Homo sapiens
tttcaatatttaggcttccatttatgaacataatttttcttttctttaatgtctttcagtgttttttttataattttttccataaaggactagcattttttttttttcggttagagttatgtctaatttacagttttcatgtctcttgtgactggaatcttttcttattttcagttttgtaactgtttgttactagtgtatagaaatgctaataatatttataaatc

SEQ ID NO: 204188 - DNA, 320 bp, Homo sapiens
gcctggctaattttatatttttagtagagatgaggtttctccatgttggtcaggctggtctcaaacccctgacctcaggtgatccatccaccttggcctcccaaagtgctgggattacaggtgtgagccaccacgtccggctgcactttttattcttgatccacctggtttgcaactcacagataaactgtttccacctatgacacatgagtcttccaccttccatgtcctctggactttgtccctgttataatattcctgtctcttgttctggtttttggcatctcacacattgtccctgtttcagtccggtctcctgt

SEQ ID NO: 204189 - DNA, 584 bp, Homo sapiens
aataatacaaatatgcatacttaccacatatggttcaaaatatacacacacttggaacaagccagcaagtacagcaaaatgttaactagtgaatacagaagcagggtatacaggtgctcacagtactatttttttaagcgtgaaattttcaaaatattataaaaagctagggcaaaaaggctgtattatttccaggggtctccctcatttgccactgtgaaagaaaaataaaatctcaggaccccaaactcactatgccagagggaaagttaagcctggaaactgaatcacgaaaaaactgccttacttttgttcccaaacagctgtaatttcacatgcttactttatcttacgtaaaatgtagatttactgagcacaagacgaatgcataattgactttttcccccactcctttcttttcacatgtaaaaatgtagattcactgagcagtactaatcagagcctcccaagaatgtaaccacttgcctcattgcctacccactctcccttttttttcttcccctcctgctttctctttccactttaaatattgaagttcccaaaatcctcttcagaaaaagcac

SEQ ID NO: 204190 - DNA, 596 bp, Homo sapiens
gcacttcccttccccacttctgtattgtttaaagagaccaccctcttcccttcccagcacttccatattattgccacctgcagagcttcttattgcaaccaaagcctctgtaatcatttgagggccaggttgatactcaccacctgcagagcttcttattgcaggagtaccaagtaagtagctcttgatgtcaggcctttacttcttgttaaaggaagtaaagccccagaatggttttcagggtttttcttgactcggacattttacctctgtgacagcagcaactatcacttcccaaatgtggggcagcaagtccgtaaggaagtctgaagtcctggcccagggcactttcacccactgactgtgggactataaattgattcaactctgtttgattcagtttgtatacatcatttgaagttgtaacattagaatatttttacatccagaaatttaattttaagactttattctatggaaataaagtacagacccaacaaagacttaattacaaggaatgttcctggctgcattaaaaaaatataataaggaacaggtcagggatggtgactcatgcctgtaatcccagtactttt

SEQ ID NO: 204191 - DNA, 172 bp, Homo sapiens
cagcaggacaataaaactcagacactaaatatgcttgctcctgtcctctaaccttagacatatctgatttggtcaaatggaagagaaccacaaaagatgggctctgagtaatggctcccttggttttctgagaacttgacttgcgtcacacgatcattcctgcttatctcct

SEQ ID NO: 204192 - DNA, 636 bp, Homo sapiens
tgtcttttgtgactcaacactctccctatattctgttggtttacaagggtcctgccaggttcaaggcaaggaagttcatcagacttcctctcttgatggaggagtgtcatgttacctaagaggagcacataggatgggatgtatgatatatgttggtgtgtaccacgctacttgtcatccttgcatcatttcctccagatcaagggatctgattagccaggattaggtcatggtctgacccccagactctactaggggtggagaaagaggtttggctcccctctgcttctgaaggcaaaggtaggtccctagagctatcctaccaccaagactccacatagcctggaagagagaacttgcccttatctgaagtacctagagtaggcagattcatggagactgtaagtaaaatagagaggttcccaggggttggaatggagggagaatagggagtaattgtttattattaaggtagtttcaatttgagatgatggaaaagtcctggagatggatggtgtgatggttgcacaacagtgtgaatgtatttaatgccactgaattgtatgcttacaaatggttaaaaggataaatattgtggcatgtatattttactacatatagacacacagattgttg

SEQ ID NO: 204193 - DNA, 293 bp, Homo sapiens
ctccagcctgggtgacagagtgagactctgattcaaaaaaaaaaaaaaaagaaaaaaagaaaatgaaacactgatttagattatctaaatggtggatttccaacttttgagtatggagaacccctttttaagatagatagatgatagatagatagatagatagatagatagatagatagatagatagatagatagatgatagatagataatcagacatccatgtgattggattgtgtttagtgtccactgatttttttaagtgatatacaatgggaagaagctactttatgtc

SEQ ID NO: 204194 - DNA, 389 bp, Homo sapiens
tgagatcgtgccactgcactctccagcctcctcggtgacagagcgagactctgtctcaaaaaaaaaaaaaaaaacagaaaaaggtgctattaaagataccaaaatataaggcactttcctttattctgcaatctgtctctccacttttcatagtattttttcatttgttatttaacatcatgttttgtcaggtgaggacatttactcagccagtgcagcactcactggtatccaggggccataggtgatttgacgcacccacatggcccaccagctgttgagttccacctccagccagccactggaccaacatgcagtgccctggctgggggcaggaaagtctaacaaaccatttcattccactgtcctcctggccaaacccacagagg

SEQ ID NO: 204195 - DNA, 620 bp, Homo sapiens
cagaggataaatagcttgatatagctgtagcagctagggagaagacttaagattcaaacccaataatactacactagaatttggttgggtgcggtggcttgtgctcgtaatcccagcactttgggaggccgaggtgggcagatctcttgagatcgagacagcctgggcaatatggtgaaaccctgtctttacaaaaaatacaaaaagctactcaaggggctgaggtggggaggttaaggctctggtgagccgagattgtgccaccacactgcaatctgggtgacagaatgagaccctgtctttaaaaaaaagaatcctacgctagaattgattaccaacccttaaactcaactatcagctaccagctgtcttagtagtcaaacttattttctaggtttaattatccataaactagtctgataatgtcttttaaaggttgtgtcccgtatttattttgagaggaattaaaatttaaagttttaaatggcatggaataatgatctcaacttttgatcatcttcccatctgtaaagtagtaggtacttccactatatgtatatttacgtttatgcacgtgttactgcctttggtgtactaaagcttactttttgtcaaacttc

SEQ ID NO: 204196 - DNA, 446 bp, Homo sapiens
taaagaaacaagttaagggcaagattcttgccaagaagaatcaatgtgtgcgagaatcaacgtgcatattgagcacattaagcattctaggagccgaggtagctttctgaaacacatggaggaaaatgatcagaaaaaggaaaccaaagggaaagtgtcagcatgctccacccagagaagtgcactctgagaaccaataggaaggagcctgaactgctggagcctcttccctgtgaattcatggcataataggtggtaataaaagacctctggactgtaaaaatgtttctcttcattgagtagaagtgtagtgtcctcttccgcaaagaaacatttaaagcaaatttaaattgttgtcctaattcattgtgtaatatctttactattcaaatttaatgtatttcttgctgaaagatgtgaggtggcttattatgcaacaaattact

SEQ ID NO: 204197 - DNA, 428 bp, Homo sapiens
ggagttactattcgccagcaggaacctgtagaacaataaactgtgcttaaacatagagcacccaataagtttcctaacatgtgggacatattgtggtttgggaccttcataaggggagcttcatttctaaactctgagaaaccaaatgaataatgcataggttatttactcgatatgtcaaatgtccctagggacccatatgaggtatttaacaagaactacttcaagtagtggaaacccccataagtgcgagataatcagactatcacttgacttagcttatttcacaactaggaccctgagagttagaggaaaccgtcatggtacagggtaaatctctcctttggaaatctggaaggcggctctctgttagtaggagatgaagcatattactactggcatccaggctaaaacaaggacaatcactc

SEQ ID NO: 204198 - DNA, 550 bp, Homo sapiens
caaccactaaaaaagctatgcaaggagataccttcaaaaatactataggtaaatcaaaattgaattttttaaaatgttcaagtaaaagaatgttcatctacaggaagacaggaaaaatgagaacagagaaatgataaacaggaacagtgtaaaacaaaattataaatggaagacatagctttaacacatcaataactacattaaatgtaactggtctaaatgtatgaattaacacaaagaaattggcttagtgcattaaaaactcaacacaactatatggtgtctacaaaaaactaacttcaaatataatgatataggtaggttgaaagtaaaaggatggaaaaagatgtatcatgtgaacattagtcaaaaaaaaagcaggagtggctatattaatactagataaagtagatttcagtgcaaagaaaattgccaaagacagagggggacattacgtaatgataaaaaggtcaaccctccatagcaatcttaaatgtctgtacatcaaatgacaaagctgcaaactatgtgaagcaaaacaacaacacca

SEQ ID NO: 204199 - DNA, 248 bp, Homo sapiens
aggttgcaaatggctgagtaactgaataaaatatgtgaaaatataataataatatctattctgctgtgctattttcttaaagttccaataatcaaataaaagaagctttaatttgtttgttttaatacatgataagttcttattattttagaaatgttttttgaaattaacctctaaaaatatcaatactgtctaataaactggcctgtcattaaataaataaaataaacaaatttcaataattatct

SEQ ID NO: 204200 - DNA, 367 bp, Homo sapiens
agttgacgctgaggatcagcttctgtgagtgggaacaggacctgtgcactcctggaccttcagcactattctgaggactagttttctgaatgttttgtgttgggcacaagttattcctcctgcccctttttactctgttcaaagacctgaatctatttggagctaaaaaggggcccgtggtgaatttggggtacctttggagtcatgtgggtatcttaatttaaacctgtgaagtgatgtgctgtgcaagataatacattttaatacaaagcaatcaccccgtgaagaaaagttgcccttctaatacatgtttgtaaatatcaactttatttcacattttaagaatataccgtttagattcatctac

SEQ ID NO: 204201 - DNA, 228 bp, Homo sapiens
ttcttttgagaaatgtctgcacatgtcttttgctcagtttttagtgggctttttattgttgttgttattgagttgttcaagtaacttgtagatactggatattagtccctcgttagaggcataatttgcgaatattttcttccatcctgtaattttgtctttttagtctgttgatagtttattttgttgtgtagaagacttttagcttgattaaatcccatttgtcta

SEQ ID NO: 204202 - DNA, 424 bp, Homo sapiens
ccccactactcccaagtgcgcacagcgagaaggaggctgtctgcaacccagggagagagacttcaccagaaaccaaccttagtcttggactcccagcctccagaactgtgagaaaatgtctgttatttaagccacccaatctgtggtattttgttacagttgcctgagcagattaatacaccctctgtacttaaactttataacccagagcttccagctgacaacttgggttcatgaaagacaaatctgcttggaagagagggagcaaagagttctggtcatgccatttgagccctgcatcaagcctctcatgaagctagagctgtccctggactgttcagtttttgctcaaaccacacagcttcactttgagttttctgttttctgttgtttgcaacataaaggttttttgttgttgtttgtt

SEQ ID NO: 204203 - DNA, 456 bp, Homo sapiens
agctgtgatgtaagaagtctggataccctcttggagaaatgcgcatgaagaggagatgtggaagggccacatggagaaggaggagcccatacaggacagcaggagagaaggaatcccatcaatgcaccagtcccagcctagcccagccctccaggttctttccagggtacctgacatgtgaggccaccatcttgactcagccagcccagtctagctcccagatgacttcagttccagctgccatctggctgcagcagcataaaagtcccttggtgagatcagtggaagaactgctcagccaacttataaagttataagagataataaatgtttgttgtccattttaagccactgcattttagagtggtttgatacatacaggtagataaccaaaaagtaagtgcctaggacagcgcctgccatacagcaggcattcaataaatattggctgactaa

SEQ ID NO: 204204 - DNA, 459 bp, Homo sapiens
tgcttggccaccctctctgtacgctcaccagaccattctgtgctctggggcacagggagttggacttggggcatgggatccctggcttctgtctgcatcttcacagcaatggctggctacagcctccaaaggtcaaggccccatctcctcccgcagccactcacctgtaggcctctgttctattactcctccctgggccctgctgcccatgctcctggaggtccccttcctggactggcatctcctaaggcataaccatcagggtcttaaccagctgatttcaaaagtgcccaggtagccatcagacccatggggctgccctcacccctgatgttatcagtccttgtgtcaagtcccacttcctgccctgggctcctcagtgtaggctaccaaggtacttcccagctgaagcagtataagaaggggccagccctgagtgaacatcgtgggtcatttagg

SEQ ID NO: 204205 - DNA, 484 bp, Homo sapiens
gcccagagaaatctcttgcgtcttgcttttcgtaatgagtttcattatgaaatgtgttctgggatatatggtgagaattcactggtaaaaacccattctcaataacctaagatttagaaaggactatcaggattaaactatagctatttttctctctgagacatctcataaacattctttgtgtgtatttgatacagtcgcatttgctattcataattgtaggattgggcatttccttgtttcccagaataggaagcatgtgttaaattgtaaatttgggtcttatttaataacaactatattgttggaaggttatccttggaaatataacattttagttttgatgatatgtacaaataacaaccacagaaacatttattgccatcaaacaattactgaagaaagcatcttccaattcttgttcttacagtttatgtagcataggggaagaaggacacagtactagaaagagcatttgagcagc

SEQ ID NO: 204206 - DNA, 370 bp, Homo sapiens
taagacatcttgttataacaatttttacttattttaaatatacaattaaattactatcaactatagtcaccctgttgtgctatcaaatactaggacttaattcattctttctaggagtttttgtacccattaaccatccccacgtatccccaaccctccaactacccttcccaacatctggtaaccatccttctctcctctatctccatgagttcaatagttttgatttttagatctcacacataagtgaaaacatgctttgtctttctgtccctggcttaacttagcataatgacctctagttccattcatgttgttgcagatgacaacatcttattctttttgatgactgaatagtactttattgtgt

SEQ ID NO: 204207 - DNA, 504 bp, Homo sapiens
cactgtgctcatctctgtagattgcattggggtgtataaatatgaaatctggttccctcaaagaatccacaaaacttttgtgataattacaactagaagccttataaataacaaattcattttgaaattttgaccacatattaagtgcttaccctcgatactttctgttcattctctcttaagctcccactatccctgagaagtaggcactattatctcccatcttaaagacgagcaaaaatctgcagctgagactggttaggcaatttgtcaaatcatagaactagcggaatgccagaactcaaacccatatttccaaagactaaatacatgctgctctttaagaaagtttgacagactaaagcaaggtttgagagggaaataagccatttttctggtactttctgactgttctgtagccagttttgttcaacaaatctaaattttataaaatctaaattttatgatgtaaggggaaaaaataaagttgtttttgaaactaaa

SEQ ID NO: 204208 - DNA, 877 bp, Homo sapiens
actctgaccttgacagaccaaacctctcctccactcaaccatttttccctcttatatgcttttaaatcctcctataacccataactctcctttctggatgtgttacaatttatccagaaacttctaggcttggcctgagccctataaccacagcaactcaaacagagctttactaaaccaacgtgaatggcagcagtcatttcagaaccccagagaccactggttacttatcagttggggaatgcactgctctatctgcccaaatgtgtaaccccaagtctgccaaagtactgaaccttcatggactacaaatgtggtcactaaaaaaatactctaattatatccactgtgctcccagtgcacttcattcattccacatggggacaatagaaggctttctgggagaacggatgatggcagccctgttatagaaagacttccaatcttcccagcctgaccaacatggtaaaaccccatctctactaaaaatacaaaaatcatccaggcatagtagcacaccagtaatcccagctacttgggaggctgaggcaggagaatcccttgaaccaggaggcagaggttgcagagagcagagatcgcgccaacacactccagcctgggcgacagagcgagagcaagactccgtctcaaaaaaaaagaaacaaagaaacaagacattaaaaggagagcccactagactttaaaatgtaaactttgtgctgcagaatttcatgaaaaagatgaaagagcaaactacagactgggagaatacatttgaaaccacatatctgacaaagaacttgtatctaagatatataaaaatctctgcaaactcaacagtagggaacacttgttctattttatagaataaagccac

SEQ ID NO: 204209 - DNA, 334 bp, Homo sapiens
tctgaaacccaccaacatagcttacttcttcaaataagaaatcaatctcacagacagaaagagaacttaatttaaacagaaacccacaaattgcaagtaaatgcttagcacagtagttcccagtttatggacaaataagtctgtcagttcccagggggcccataaagcattttcccatggaaaccgtgttattgaaaagcctaatttgcttgtgttctgtggctcaggagaggaggaaaatatttaacacataccctccttaggtctgattcggcaagcatttctcttgaaggtactcttacttctcagctcccccattacagggattctaaga

SEQ ID NO: 204210 - DNA, 2141 bp, Homo sapiens
  misc_feature (676)..(676): n is a, c, g, or t
cctggactacataaaaaggacattagtgagaaaactggtaaaatttaaaaatggttcttagagtagtagcagcctctcaaagttaatgtcttggtttcaataattgtactatggttacataaaatggcaacactacaggaagctggataaaggcaaatgggaaatttctacactatttttgcaaattttctgtaaatttaaaattatttcaaagtaaaatgattaaagaaacagaaaataaaaatggctacctaatgaaagtttcctaaattcaaataaagtaagtaaaatgtatgggaacagattttataagaaaacaaatgcaaggcacctgtagcctctacactgaaatatacagctataattaacagtttgctttccatcattctaccccaaattcctaagtacctaaaatattcataatgttgatattattgatttttattttcttacctgtgctttgccacattttcttgttttcccactgtgagcatagatttccttcgtaatcagaaaacatagctttcttttactaagtccctttataatttggccatatgaacaaactatttccagaaataagtaagagttacaagactctatgaatacaaagagaagatgtcacttgtttttattttaccaaatatgttcttcatagcaggcaaacatccatggnggtacaacagtaaaatgaagggagacggtgcagacaggcactaacttaaaatgtttctatattcttatgatattttctttagattttaaatattccttttactaaccagagaaggaacagttattataactggatccaaattaatagtcagaattatctctatactttaataatgtttcttttaaaagtgtaagaatacatatatagcttttagggaaaaaacatgtagacactcaacctgttctaactgctggtagctacggaacaagtgtagaaagaaaaacagatacactacttggcttccatctgtggtcaaaaaactatattgttttattcatttaaaaacatatgctagatatgtaactctcaacagcatttaaaactgtgtttttaatacagaaaatatgctagtgctgcacaatgaagaaataatttatcttaataactggaaaatactgacgataatgaaaatgttttaggcaaaatgagcacactgcatgcttcagactgaaattaattagagtttttaacgttttacaattccaccataattctttaaatggtgcatttacctcatagtaataaacacttggatcattaagtaaagtgcgaaatgtgtgtgatatgctacatttaacaacctttggccttttatttttctatacttctgcattcagttttccaatgcattgaatgagcaattgaagaccacaattagatttcctgactttgcatatttgagattcttatttcatttaatacaaaaggcaattaatataccattttacaactgaattccaactttagtgagccatgacagatactgaaatgaacttacaagaaatgcttaattaaatttactgtaaaaagcataagaatttttttgtatgatacaagttgcatatttaattagaaattctaaggctatattatgaaattaaagtcacttgggatgttcttagtaaactcagctcaaacacatatatcattaagtagaatagagctctttttaaaaaccttaccttttttctctatttagtgatgcaaacaaaagataatcaaagagatctccctttatttaatactgcaacatttcattcattatttattaatagtaaatattttttaaatagcaagatagaaaaagggcagtaacaaatttctaatttcatgtatgggaatacataaataactatttcttttcttgagcaatcacttctctctccaattcatgattctggagcagattgagtagagtaagtttttagctcctcctgtaactttttacttctttgtggcagcttttcgtagcaaagaaatagggcagtggtggtgtgtgcctgtaatcccggccactcgggaggctgaggcaggagaatcacttgaacccaggaagcggaggttgcagtgagcggagatcgcgccactgcactgcagcctgggcaattgagcgagactccgtctc

SEQ ID NO: 204211 - DNA, 2130 bp, Homo sapiens
  misc_feature (676)..(676): n is a, c, g, or t
cctggactacataaaaaggacattagtgagaaaactggtaaaatttaaaaatggttcttagagtagtagcagcctctcaaagttaatgtcttggtttcaataattgtactatggttacataaaatggcaacactacaggaagctggataaaggcaaatgggaaatttctacactatttttgcaaattttctgtaaatttaaaattatttcaaagtaaaatgattaaagaaacagaaaataaaaatggctacctaatgaaagtttcctaaattcaaataaagtaagtaaaatgtatgggaacagattttataagaaaacaaatgcaaggcacctgtagcctctacactgaaatatacagctataattaacagtttgctttccatcattctaccccaaattcctaagtacctaaaatattcataatgttgatattattgatttttattttcttacctgtgctttgccacattttcttgttttcccactgtgagcatagatttccttcgtaatcagaaaacatagctttcttttactaagtccctttataatttggccatatgaacaaactatttccagaaataagtaagagttacaagactctatgaatacaaagagaagatgtcacttgtttttattttaccaaatatgttcttcatagcaggcaaacatccatggnggtacaacagtaaaatgaagggagacggtgcagacaggcactaacttaaaatgtttctatattcttatgatattttctttagattttaaatattccttttactaaccagagaaggaacagttattataactggatccaaattaatagtcagaattatctctatactttaataatgtttcttttaaaagtgtaagaatacatatatagcttttagggaaaaaacatgtagacactcaacctgttctaactgctggtagctacggaacaagtgtagaaagaaaaacagatacactacttggcttccatctgtggtcaaaaaactatattgttttattcatttaaaaacatatgctagatatgtaactctcaacagcatttaaaactgtgtttttaatacagaaaatatgctagtgctgcacaatgaagaaataatttatcttaataactggaaaatactgacgataatgaaaatgttttaggcaaaatgagcacactgcatgcttcagactgaaattaattagagtttttaacgttttacaattccaccataattctttaaatggtgcatttacctcatagtaataaacacttggatcattaagtaaagtgcgaaatgtgtgtgatatgctacatttaacaacctttggccttttatttttctatacttctgcattcagttttccaatgcattgaatgagcaattgaagaccacaattagatttcctgactttgcatatttgagattcttatttcatttaatacaaaaggcaattaatataccattttacaactgaattccaactttagtgagccatgacagatactgaaatgaacttacaagaaatgcttaattaaatttactgtaaaaagcataagaatttttttgtatgatacaagttgcatatttaattagaaattctaaggctatattatgaaattaaagtcacttgggatgttcttagtaaactcagctcaaacacatatatcattaagtagaatagagctctttttaaaaaccttaccttttttctctatttagtgatgcaaacaaaagataatcaaagagatctccctttatttaatactgcaacatttcattcattatttattaatagtaaatattttttaaatagcaagatagaaaaagggcagtaacaaatttctaatttcatgtatgggaatacataaataactatttcttttcttgagcaatcacttctctctccaattcatgattctggagcagattgagtagagtaagtttttagctcctcctgtaactttttacttctttgtggcagcttttcgtagcaaagaaatagggcagtggtggtgtgtgcctgtaatcccggccactcgggaggctgaggcaggagaatcacttgaacccaggaagcggaggttgcgccaatgcactccagcctgggcgacaagaccgaaactccatatcaaaa

SEQ ID NO: 204212 - DNA, 241 bp, Homo sapiens
gtatctggtccaacaagaaattaccttgaaattccatattttattataaaagtgtatgcatttttgcatcctaattcattatatatctcagcttcttttattgtcaaaacactgttttaaattgtatttttctcctcaaaaggaagaattttgtcttgtttcatgttgaatccttaatgcctgaaacagtgcgtagcatataataactacacagtgattatttagtaaatgaattttagca

SEQ ID NO: 204213 - DNA, 515 bp, Homo sapiens
agcttccattcttagtcttggtacttctaagtggcattgggtcaatagctttctgcctaagaagagaattggctgggcatgatggctaacacctgtaattccagccctttgggaggctgtggcaggaggatcatttgagcccaggagttcaagaccagcctgggcatcataggaagaccccatgtctgcataaaataaaataaattagccagacttggtgacatgcacgtattgtcccagcttgtcaggaagctgaggtgggatgattgcttgagctcaggagatcaaggctgcaatgagctatgatcatacaacaccagtgcactctagcctgagtgacagagcaagaccctgtctcaaaaaaagcaggggggcatagtcacctccctaaaatattagttgaacagtatgtattcagaagtccagaggctctgtattttattaatattttcaaggcactatttctgccccacatcctgggtcacagactgggatgagcaacgggctgaaggcac

SEQ ID NO: 204214 - DNA, 777 bp, Homo sapiens
  misc_feature (357)..(357): n is a, c, g, or t
  misc_feature (359)..(359): n is a, c, g, or t
gtactttgtaccctaactctcactagcttcctttgccagatgaagctatgccatcttttatgtctgatgaggcagtttcatctgatttgaagatgatgaagaaaagttctttgcaaggttgcttattgaatattactgggaaaacaggaaaattaggaggaatgttctggagtgatttatctttttcatcaggggcccgcgttcagtccagccaccagatcaacacattctccaaactcattaactttggagaggctacccagagttcctgaagagttcatctgaaaaatgttgaaatagtcacagcccatggaatcaatgttttgggatgccatccaggattccatagcacatttntnagttgtcttaagctcctcttgaccgggacagtttctgcaaccttttttgctttcaatgaccttaacggttttgaagagaattggtcaggtgctttgtggaatgcctttctttggaatttatctgtgttttttcctcaagatagaactggagttaatgtgttttggggagaaacactatagaagtagcattagtcagtgttctccagagggacagaactaataggatacatatatacatgaaaggagcttattaaagagaattgattcacgtgatcacaaggtgaagtacacaataggccgcctgcaagctggggaagaaagaagccagtggtggatcagtctgagtccaaaagcctcaaaagtagggaagacaacagtgcagccttcagtctgtggccaaaggccccagagtcccgga

SEQ ID NO: 204215 - DNA, 526 bp, Homo sapiens
gtactttgtaccctaactctcactagcttcctttgccagatgaagctatgccatcttttatgtctgatgaggcagtttcatctgatttgaagatgatgaagaaaagttctttgcaaggttgcttattgaatattactgggaaaacaggaaaattaggaggaatgttctggagtgatttatctttttcatcaggggcccgcgttcagtccagccaccagatcaacacattctccaaactcattaactttggagaggctacccagagttcctgaagagttcatctgaaaaatgttgaaatagtcacagcccatggaatcaatgttttgggtaagattttttttaatggaattctgtctctattgctttaatttctttaatctttcactgcatgaaaaatactctaatatcttaaaatttcatgtatttccagcctaaaaataacatctattatagattttcctcattttattgtgtaaatgtagataagcataaagaagaaaataaaaattgtccagaaagaaccaca

SEQ ID NO: 204216 - DNA, 465 bp, Homo sapiens
caccaatactcatccatcttttcatctgcatcataggatacaagtgttataaccacaaataataacatattttctatgtcatttaactaatttttccaagtcagagacaggcacaccagtttcaaatagtttcagtggtagaccacaacattaggtataataggttcctagagcaattagacaactgtagcaaggaaaagaattctactgaaaatagatttttaatttagactctccatcattaatcagagagatggggtgtcaagagagaaactaacacttaatttaactgacttttctattcagctcagctaacttttgttatcattcatttatatagtaatgatgttgagcatcttttcatgtgcttattggtcaattgtatatcttctttgcagaaatgtctattcagatcctttactcattttttatttaacttaattaacttatttattttgagatggg

SEQ ID NO: 204217 - DNA, 597 bp, Homo sapiens
gacatacccaagactggacaatttacaaaagaaagaggtttattggagttacagttccacacggctggggaggcctcacaatcatggtgaaagtcaaggaggagcaaatcacatcttaggtggatggcagcaggcaaaaagagagcttgtgcagagaaacctccattttgaaaaccatcagatctcgtgagactcattcgctatcatgagaacagtgcaggaaagaccggcctgcataattccatcagctcccacgggttcctcccacaacacgtaagaactgtggagttacacttcaacatgagatttgggtggggacacagccaaaccatatcaggcccactttgcaaaatatcaaaacagaggggaaaagtataagtaactgaagagaagggtgcggtgtgctgaatacaaagatgctgactggggggagtgaatgtacctgcatcccaatttgcctgggaggtctggttttacccattgtctgacattctgtctaatttagcatttgtcctgaatatttcatttagtgatgtattattgttattagttgcattaaaacaagccaagatggattaggtagacctccacgttgta

SEQ ID NO: 204218 - DNA, 433 bp, Homo sapiens
agtttagcatttggtttctaaaaccccataagattaaaagaagaatatcaaaaaagggagaagagctgctatattaataccatctaggggtgagagctgaaagctgactgaaaggggaggggtgaaagaagaagttaaaacaacagtctgggccgggtgcggtggctcacgcctgtaatcccagcactttgggaggccgagtcaggtggatcacaaggtcaggagatcgagaccatcctggctaacacggtgaaaccccgtctctactgaaaaatacaaaaaattagccaggtgtggtggcgggtgtctgtagtcccagctacttgggaggctgaggcagaagaatggtgtgaacccgggaggcagagcttgcagtgagctgagattgcgccactctactccagcctgggcgacagagcgagactccatctca

SEQ ID NO: 204219 - DNA, 436 bp, Homo sapiens
atactactctccactttttaaagggttaaatattttcactacaaaaatgtttggaaaataaatattagatcttcagatttccttaaaagtgttataagcaataatgtaattatgatattcacataattccttcatgacagctaagaagatacacactttgttttcaacatttaaactcaccatttattactaaagtcttatagcacatttgtgctatctgaagcacaatatttaaaaattgtttctaaatacaaatgcattgaagagctaacaaaccctaagcagaagtctcatgatggaacaaggcattgctatcaatttcatttattgttaataacatactcacaaatggagcgatggttttaactgaagcttaatttgaggaaaacacagcaaatttctaaagcctttttttcttttttagtgagtttcttaa

SEQ ID NO: 204220 - DNA, 814 bp, Homo sapiens
ttttgtatttttagtagagatggattttcaccatgttggccaggatggtcttgatctcttgaccttgtgatctgcctgccttggcctcccaaagtgctgggattacaggcatgggccaccgcacccggccagaaatgtgtgttctctacctcccttgcacctctttgtggctgcacaagtggggaggaaacttgccccgccttgtgcaggtgagaggccagggcatcttaaccctctcacccgcaagagccaaagccagggctcacttcctatcaccagatgacacatgtgggctggggagggctctggtctgcgtgcagggctgcttccagcctagctgtgccactcgcaccctgctggtccttccccgacttacgtcctgaggggactcccctaccccttccagctgtgactgcaggacccaagggaagcaggactgtgccaagcaaatggaatagtggtgtaggcctctaggtgttgggtgtagggcaagaggcgggcacgagggctccttgtagaggatattataagggtccaaggtgggagacacttggctgaggtccattccaatcacttggctgaggtccattccaatcacttgatgccttgatgctggagagctttgagcagtttccttggcggtgttggggcagcaagggaacagtctggggcagagcctgtgcctcagtcttctcatctcttaactggggagggtcatgtaatacccaaccccaggtgcttgtgacgattaactggggtgggcagtgcttaacataatgcctgggaacgaggactggtgggcctagctgtgccc

SEQ ID NO: 204221 - DNA, 469 bp, Homo sapiens
cttggcttctcaccatccatcagagcaggtgtcattacagtgaaaagggcagaaggtatcttcatgtgtgggcgcactttgagatacaccctgacttggaggatctttgacatgcttcaacaaccaatggagaatgagttgcattttaatacatggtgctttaaaggtcattgattaccggccaggtgcggtggctcacacctataatcccagcacttcgggaggccaaggcgggtggatcacaaggtcaagagattgagaccatcctagcttacagtgaaaccctgtctctactgaaaatacaaaaaaaaatagccgggtgtggtggcacatgcctgtagtcccagctactcgggaggctgaagcaggagaaatcacttgaacccgggaggtagaggttgtagtgagccgagatcatgccactgcactccaacctggtgacagagtgagactccatctcaaacaaaca

SEQ ID NO: 204222 - DNA, 378 bp, Homo sapiens
atcctcacttctgttttccttacatgcagctgtctgattaatcttgctacagcacagatactgtctgcacagacatgacttaagtctggttcctggcacttgaagccccctgtgatatgaagccaatccaattttcaagtctcttcctcattccccacccaaattccacactccagcaaaggcactgttttccatttctaaaacagatagttttcaaccacacagccttttcttataaaccttatatatctgtctggaagtctcctatcttactaactgcacctcagaaatttatgcttatcttttagagctcagctcaaaccccataactctgctcaatgttactctcacctctaaatatgctaaagaattctgaat

SEQ ID NO: 204223 - DNA, 427 bp, Homo sapiens
ctccagctgtcttatgactaggaaaaaggaaacataaaaattttaaaatagctattgttaaatgactacaaaaaggtaactgtattctaagtatccaagtagcttactttatttttaagtaaatgtttctggccgggcgcggtggctcacgcccgtaatcccagcactttgggaggccgaggcgggcggatcacgaggtcaggtgatcgagaccatcctggctaacacagtgaaaccccgtctctactaaaaaatacaaaaaaaaatagccgggtgtggtggcaggcgcctatagtcccagctactcgggaggctgaggcaggagaatggcgtgaacctgggaggcggagcttgcagtgagccgagatcaagtcattgcactccagcctgggagacagagcgagagagcgagactccgtctaaaaaa

SEQ ID NO: 204224 - DNA, 787 bp, Homo sapiens
caaagcagacgctctgcccatctgtcactaggagccgccgctggcctccaactacccttccctaaaacctcagcttggagtaaacaccagatgtcaagaacacaaagcctctgatgcttgaggcagcacggcctctggaaggagatggggctggatgccctctgcctctttcgagacaccaaaggattcttgcagggttggaactgcagttttcagcctacagctttgctctgatgtttacacacactgaaagtgtgaaacatacggcaagagagagaaagaacgtgggggaagaggtcactgcagcttctctacaaagcactgactcaagtgattcagagtaaaactagtaccttggaaccaaataattaaaagccttccaaaaacaaagaccctgattaaacctgataagtaaagtttggtcatgaaaatccttattggggtctgtatgaatcatttcacttctcaggagtttctgtctagttgtgtaaagacaagctttccaaatggtactgctgggcccaaatgcttccaaccctcccttctatggctagcctggtagcctggggctaatggctaaacaagaatacgtgaaagcgggtctttgagaaaccatgccaaaacctaaatataagaaaataaaataaacatttaaaaaataaataaaaatcctttcaatgtagtacttcagaatctaatttccaggggccaattgtcaccttcagaaactaatacccacatctctataaagtcatgtcattctcaccaggtatgttttaccctcatg

SEQ ID NO: 204225 - DNA, 598 bp, Homo sapiens
ctcaaagcatttacactctatttgtgacaagactcgtagttcccacatgaaagcatagttcccacagacaacaatgggcaaatcctggtaaggtacagtgtgtctgcatgacaccaaccccaggcacaagagggaagtctctgggactagtagagaaatcggtgggggttggattagtcaggattttaggagggcctgaggacgactaggatttaggtggctgcaggagtaggaacaatctttgttttagacaagaactgtgtatggcagatagaagatttgaaagcagagaggtgggaacctgcttatggagaaccttgaaaatcaggtagaggagtcttaggggggtacagaaagcagcaggaagtcatagaaatttctggttttgtttgttatagtaactcccttgctcagtatttattaagtttgagcaagagggattaaactggctaatggtggtatggggtgaaatgcagaatgcctgaagatcaggacgctggtttctcaagggctcacactgatgccggatgaggtgaggaaggcctagtcgagggtggtggaaatggggacggaaggaaggcataaagaaggccctttc

SEQ ID NO: 204226 - DNA, 416 bp, Homo sapiens
tgctgaaatggttcagaagataccaattatttacatatatagatggtggaggtgggaagagagagagagagagagaaagagaggaatacacaataaatcaaccctgataaaatgttaacatttgcggactctgggtgaaattatctggacattctttgtattattgttttgcaacttttcccaagtctaagttatttcaaaataagttttaaaaaattaaaaagtatcaaaatcaaaataagttttccttttagatgggaaaaaaaataagtgtaggattaaaagcgtgtaggctatgttcagggtagtgagaaaaatctgcagtaattactttgaaattgaagtcagtggttacacagagtgataattggaagttggcacaattccagggtgctgacactatctcccaaattaac

SEQ ID NO: 204227 - DNA, 426 bp, Homo sapiens
cctcacaaaatgctgggattcaggcgtgaggcaccatacccaagcagcattttctctttatactcaaagttctaaaatttcaccaggatatgtctaggtgtagtgttttccttttatattcattaatgctcagagaactctttcattttgaggattctagcttttctcccagggacattttattctattaatatatgtacagtctccattatattatttgtgctttcttttatagtaatatctaacattttcataactttgttttctttctttattctttttttttttttttttttagagagatgggctgtcagcatatcgcacaggctgaggccagaggatgacttgaggacaggaattctcatgtgatcctcctgcctcagcctcccaagtagctgggattacaggtgcaagtcatttcatctg

SEQ ID NO: 204228 - DNA, 635 bp, Homo sapiens
aataaatttctgttgtttataagcccctctgtttacggtattttgttataggaaccttaatggactgttggaaatttttatttagatttcataattaaaacacaaatacatagtcattataaaagtatgaccttttgatccgccatccccagggggcccatgccactgtttccaatctgggtcctctccagattttgatacacactcctaggtagtcacgtctcccctccctgctttgaaaaccactaccatctgcatatcaaccagtcaagattttgaacattaacttcttgcagtctatattataaaaccctttttaaaatttttccaaatataaaatactattagaatgttttgtgaaacatccttgctcaaacaccttagtttgagggcactaactaacacccagtttggagggaaatgaaacccactcaaaggcatttgaggaagtgggagaagggacttctccagggcaagcaagagaagtgtttcagagtcaggaaaggaagctattaacgtaacttgcaagagaaagctgcagcatttacagtaatttcatcgaattttaaagtaatcaaatctgaattttataacatttggcatgaggtcatttatgtataggctcatgaggaagg

SEQ ID NO: 204229 - DNA, 494 bp, Homo sapiens
cagcttacttgaggttaggagtttgagaccagcctagccaacatggcaaaactacacctctactaaaaatacaaaaatttgccaggcacggtggtacacgcctgtaatcccagctacttgggaggctgaggcaggagaatctcttgaacctgaaaagtggagtttgcagtgagccaagatcgtgcccctgcgcttcagcctgggagacagagtaagactctgtctcaaaacaaaaacaaaacaaaacaaaacaaacaaacaaacaaaatatatccgtaggattaatactttgaagactggtcctttacctggaattttcttattgggtggccttcctggctctctacttttcatgggctttcccttccagtttctactactgcagatatgtacccctttgtactgattctggctgcccccagtcctgtgctggatgtctcacctggatgcatcctatcaaaatagctgtgtgcccccttcttaacatacacttc

SEQ ID NO: 204230 - DNA, 480 bp, Homo sapiens
  misc_feature (1)..(1): n is a, c, g, or t
ngagaattttttgtatttttagtagagaccatcctggctagcacggtgaaaccctgtctctactaaaaatacaaaaaatgcttctgcctctgcctctgccccctgcctctatggaggcaggagaatctcttgaacctgaaaagtggagtttgcagtgagccaagatcgtgcccctgcgcttcagcctgggagacagagtaagactctgtctcaaaacaaaaacaaaacaaaacaaaacaaacaaacaaacaaaatatatccgtaggattaatactttgaagactggtcctttacctggaattttcttattgggtggccttcctggctctctacttttcatgggctttcccttccagtttctactactgcagatatgtacccctttgtactgattctggctgcccccagtcctgtgctggatgtctcacctggatgcatcctatcaaaatagctgtgtgcccccttcttaacatacacttc

SEQ ID NO: 204231 - DNA, 506 bp, Homo sapiens
aactagataccctgaaaaacctctcaatacaaaacacctagaaatgatgaattaaatataatacatagtctttaaaatattgagctcaaaggaaacagaagaaactctcatacaccagaagtggtgagatgatgcttatactagtccccaatcctgtttgagggtatttggtgatcttggcgatcaagaggtttgggtttctgacatgctagtacaataggcaaggccttggcctatgcaaggtggggaggcagaatcaaggctctgcataatggctagggccctcaaaaggctatgctgccagaaaaaagatgctcaggcaaagggaaatgtcaagcaaagttgtctgtttcccctggcctctgggtagaaaagaattcagattctgcccatacacagctttgaggtttaatttatacaatctgagtggtcagaaactccaagtcaagatattaacatgaaattgttccagtttgatagcacgtccgccatctggcagaacaatt

SEQ ID NO: 204232 - DNA, 401 bp, Homo sapiens
aaaatcccagtcactcttattgtgcccacctctaatttttcatagcaatcatcatctggttattttacatctcgttccattattttaagctacatgcatatgtttattatttttgtatcctccaaattctaatacaagccctctgaagccagggtgtttgtttatttggtactatgctgtatttccagcatctactttgttgaacgaataaattggtagaagtcacaaaaattctgactagcatatgatgtacagtgatccaatctgaactaaattttaaaactgcaaactttttcatatccagctattaaataatagccaccctaaataacataactctccccaagtttagaatactatttttggcattcaaaaatcaaccagtatgtaaacactggctg

SEQ ID NO: 204233 - DNA, 451 bp, Homo sapiens
gcaaggagatcatcaaacgcagtgggcaaaggcagaatttctctctttctcatagtatttgctgtagttccacacatggtgactgaacacctggagcagaggccccgttgcacactgaattggcctcattatatcatgagcaagatcttctatcactgttactccttattgttgtgaagacttcttttatgtctggaaagacatttaggcaacttagcattgtgatagaaaacagctaaactactacagttttctaagttcaaatcaagatttcactcaccccctagcatcttactaaaacctgggtttcctataggggaggataaattgcccacaaagttatgactaccagaattgggactctgttctgtgaagtagaaataaatgcagagaccattttttcatcctagagtaagtagaaaaaaagcaacagttattttcactttctttt

SEQ ID NO: 204234 - DNA, 597 bp, Homo sapiens
taagtcccttgtaacagatggcattttccagagacagcctctgcaatttctcccatcccacaagatattcttcccatatgacctttacctcccactgctggagagtggggtttatgttctctccctcctgaatctgagcacgttcatgactcactcacaactaatagaatgtggcagaagagacgctgcgtggcctccaaggctaggtcacagaaggtgatgcaggtgccttcgtgctatagccctgagatgctgtgtaagcatctgactgcccagggccgccatgttgtgaggaagtccaagtagcccgaaagggggctgtgggttggtgttgtggcagacagtccagatacgtcccagcccccagccagctccaactgccaaacaggcacttccagaaggccctggcatcctggaatagagacaagacatctgtgctgtgccttgtgtgattctgagccataggatctgtgagcgtaatacgatggctgctgggcgccctaatgttttgagggattccttacacagcacaagtaccctggcaaccgtggctccacctccagccaggcgttatcactgggctccctgtcttcctct

SEQ ID NO: 204235 - DNA, 347 bp, Homo sapiens
ccaatctactaaccttggggaaactcaaagtagactcgttaccaccagcttcaaatacatgcatgacctctcactgcattctggataaacagcacacatttagaccccacagaggccttctccgccaggtctctgcccactcctcaggctttgtagtgtacagtgaactctctcttcctccatgttaggtctacctggccaggtagagctaatgccaggtagggtggggggcatccatatagtcagctccaggtttatggagggttcttctactattaggactttccgattcgaagcgaaggcttctcaaatcatgaaaagttatgaatattactgctgttagagag

SEQ ID NO: 204236 - DNA, 196 bp, Homo sapiens
gggcagccaatattgcttcgtcaaatacattctttaggcctttctttgtaagtgcagaacactccacatacttgacagccttcaggtcacgggccagcttttcagcagtctctggagtgataggcttctgtttgttcttggcaggtttctcaatagtagaggggtcatctctgagatcaatttgagtcccaacaag

SEQ ID NO: 204237 - DNA, 381 bp, Homo sapiens
aaaaaaaaaaaaaagaagtggattcaagatatatgtattttagatatgaaattgataagatttgtttaggtaaagaacgactcccaggtctctggtagagcaattagtttgggtggagatgtcatttcttcagatatggaaaaccaaaggaggaagaggctttttgaggggctggcagcaggagtgtttagtgaagatcggaagcaggccgggtacggtggctcacacctgtgataccagcactttgggaggccaaggtgggcagatcacctgaggtcaggagttcaagatcagcctggccaacatggtgaaacctcgtctctactaaaaaaaatattgttgtgattacctgagagaatgtaaagggagaagagaagagag

SEQ ID NO: 204238 - DNA, 650 bp, Homo sapiens
ctcacctggacgataaaagagacctaatatagcactctatacctctacatccacatttgtagttgtttactaagaaatcaagcaatggatttctcaaagcattgtaaccaaaccaaactcttcattcatctcaacactttaccatcctaggaaaaagtttactttcctcactatgttctccagcttagtcaataatatcctcatttatcaagaacttcagttaaaacctaaatgaactattaaccaggcatggtgatgggcacctgttatcccagctacttgggaggctgaggcaggagaatcacttgaacccaggaggcggaagttgcagtgcactgagatcacaccactgcgctccagcctgggtgacagagtgagactgtctccaaacaaacaaacaaacaaaaattaaaacctaaatgaactaaaacagatatttgcacaccaatgttcatagcagcattattcacaatagctaaaacatgtaaataatccaatgtctgtcaacggatgaatggataaacaaaaggtagtatatacatccacaatgaaatattattcagcctttaaaaggaagaaaattctgataacatgctgcaacatgaagctagaaataattatgctaagtgaaataaaccagacacaaaagg

SEQ ID NO: 204239 - DNA, 145 bp, Homo sapiens
tccccggcagcaggggggagaatgggggaataagatcactaccaagtccctgggggtctctcactccccatcccccggcaccctctccgagactctgcaaagcccaagaaactccctccgtgaagccgggagaagacccgccatc

SEQ ID NO: 204240 - DNA, 512 bp, Homo sapiens
attacgtgtcacccttagtggttcagctttcctaatcaaatcctaacagatacgtgtactacattcaaaaacaaaattgtctaaaaactctccttattctagcatcttcacagggttttgacattaagcttaagctacgcccataaagacagctggagaaaatgtcattatattctgctttatgtttatgatttttctccttctcttcccttattcctgtttagtaattttttctaatttcgtatatagaacactaagcttactgttttttctcttatgttttaacttgcacatttatgaatagacatttgcttcacaagtgttgatattaagtctatttgtattactcagttcgaaatgttatttttaaattttatttttccataagttattggggcacaggtggtattttgttacatgagtaagttcttcagtagagatttgtgagagcctggtgcacctatcacctgagcaatatgcactgcaccatatatatatatttttttgaaaca

SEQ ID NO: 204241 - DNA, 375 bp, Homo sapiens
aggtgtctgagcctggagatacctgtttgggaaattttgaaatcacaataccaatttacttagtagtcatagggctattcaaataatcagttttatattgggtgacttgtggtagtttgtattttttcaaggaactggtttattttacctaacatgtcaaattttgtgtgcagacttgtccatagtattcccttgttatccttttgatgtctacatggtctatagtgatattccctttttcactccagatattggtaattcacatgttctctgtttctttgtcagtcttgctagacatttgtcaatcttactgatcttatccatgaaccagatttgtttcatgaattttcttcattttttattttcagcttcatt

SEQ ID NO: 204242 - DNA, 538 bp, Homo sapiens
cccacatgggcacgaaacataccacattttacggaggatgtagccccagagaagagggaggtggagaagcataaatgaaaggcaccttttccttcctctagaagatgcacagagaatttctgaccttgtgacgtttgggagtgaggagatcccatacagaggcatccaggtatttccagagatcctgtggcaggtgaggtctgccctcgctggagccaactcgtctataatatcttcctaacagcagaacctgggtctcactctgtcccctaggctggaatgcagtggtgtgatcatggcccactgcagccttgaactcctggacccaagcaatcctcccatctcagcctcccaagtagctggaactacaggtacgggaaaactggcttagagatgttaaatatcctggattattgtcagtttaacaaaataatttcggctatcaaagatcaagtgggataaatttcagaggaagaaactgagctccttgcataccatagaggagaggtcgaggtccttccactgaagcaccaagtgg

SEQ ID NO: 204243 - DNA, 295 bp, Homo sapiens
gctaaggaatcatgagccacagggactgcagcagttgttcctttataaaacatagattcccgatatcacagaaatccatattgtaaggaaaatttatatttaaggcatacatctactttcagagataatatgcacatgttcatagaaaaatagatttaatttgcatttaataggtttggtatcaaaactttctcattgactggaggagtctcagcttcacactcttgtttttctctaaagttgatttgagaaatacgatgtgtctttgccggactttcaaagagatataaatcat

SEQ ID NO: 204244 - DNA, 2155 bp, Homo sapiens
  misc_feature (1071)..(1071): n is a, c, g, or t
  misc_feature (1269)..(1269): n is a, c, g, or t
  misc_feature (1652)..(1652): n is a, c, g, or t
  misc_feature (2070)..(2070): n is a, c, g, or t
ttggggttttcaaggttttatgagatggtcttttccattttgccttcaaaagacagaatgtcttaaaattttcactttacaatgtgcgccacattccttctgcatgatagcccattcaattatattgagacttagaaaattagtatcttaaaagatatttatatgggggtttcccacacctcttacaaatagtaactatgctcttgttttccttttgttttgccgtttccatctttgctttaaagacactgaaaaatataaatgacttgaggggactcccaaagatgaataaggatcaatggtgtcttttctactatttctagttttggattttctagattagtcttcattttctagataagatcctatgttgtatctatgttagtatcaataatcaataaaagttgaatcttagatccctttcaaattatctgcaaacttacaggataaagaagtaaaaaaaaaaaaaaaaagatgtgcacgtgcttctctgatgatttttatgaggagctgaacaagaattcaaatattaatctttttctcaaacaaaagtttatgtctgagcagcttggcaggaatacgcttgcctcctttctcttggctttctctttgttcccactttttccctcttttctttttttgtctttcttttcttatctcaatgtctctgtatctcttgtttcctagctgaagtgcatcattttctgctattgtgcttaaaaaacttggctgcaggggctctgaaatgaataaaaatgtaatcctcactgtgcccattgtgtgctctcatttgtttttgctgtatcgatttatcagcagagggaaattacttgctggaagagaggatgccagtcagaatgacatttatttcatagtacaaggaggctctccagcgtgtttccatgtaacctagatattggagctgtaaaagggcttgtaacaaggtttagtgctatgattagatcgtgtggagcaccttgctttcataacaacaggcactctgcaggagctggggcctcgggttatggtcaaccctctttttttttttttttttaaagcatagacacaganttcaacaatttcctccccacctaaacagtttctattccaaaagccaaatcttgcagacttacaagaataaaagaggtatatttttagatgcccgaagctttcatgacatcaaattaaatgcaaatagatgaaacacttgcctattaatccccttaactttttttttttggcctttccccctttattttggagaaattnttccattttaattcaccaaagcgaatcttttcattcagtgattgtaagttacatgtgcttaaggctaccaattacctgtgaaaccaaacacattctctatgtaaaaacgaaggcaggtgaggcaaattgtgacagcaattggttttgcttaaatactagaggtaaaatttcgtaggtctttgctatgattcttatatgtctgacattaggaaattaacttgtttcattatgttcctaattttccatagaactgatacagttgggatctatgtaaaagacattttttcctctaaagaatgagaggaaatgggtctgttttctaaggaatgtgctcatttgtgtaaaagtatataggagatgtctttcttttcccaccatttctncactgttgagatttgttcatttggtaatgttggcaaaagcaaaaatgattaagatttgcagaatgaaaaatattaaacttaagctggcaaatttaacgaaaatctgcacttctgtttttagcaggaattttttttttttttaataactgggtttgtgatgctgaggtgtattgggctgtgataaaatatactgtcttattaatttatttttaaaaaatctggccaggcacagtagctcatgcctgtaatcccagcactttgggaggctgaggtgggcagatcacctgaggttgggagtttgagaccagcctggccaacatggtgaaaacttgtctctactaaaaatacaaaaattagctgggcgtggtggcaggcgcctgtaatcccagctacttgggaggctgaggcaggagaatcncttgaacccaggaggcagaggttgcagtgagtcgagatcacgccattgcactccagcctgggcgacaaaagtgagacttcatctg

SEQ ID NO: 204245 - DNA, 156 bp, Homo sapiens
tgaaggccatttgtctggtgattaaaatttggaatattcaaagagagtcttcatagcaactttcaaaacgtataggtagaatatttaaaatctgtactgggatgggatgctaatggtttctcattctagcttggagttttggggcaaaggtgagca

SEQ ID NO: 204246 - DNA, 872 bp, Homo sapiens
cggttttttgatgtttttttagatgtggattttctacactcctgttgtcccaggctgtgagtgccacttgcgcccgtcttttggcgttccccgccatttttcggcggtctctggccttctaagccggtttttctcctgccttcatgcctttccgggcacagtctggagggctttaaggccccggggattcttcttggaaccctgggggccacagggtttccctgtggcccgattgtgcacataatgccctcccggccttggccaaccaagggggaatccgctttcccaaaaaaaaaaaaaaaagactttatgcaaagctttcacagccaacttccctttccttaggagggcccagcagctttgtcttctgtcccatctgggtactaaaacccaagcctgttcctggctctgataatccttccactccaccctcctctttgtgtaatactgccaaggggctacaccaagagatatggaaaataaaactgaccagataggtctccggctatttttatctctaattactgtggcaactctggggaaaccccaattgcctggagaggtctactgtgttcaccataaaccatgaagaatttagctaacagtttaattttttacttttcctagaaaatgtgatttttaaccggctcgaaactctgtttccatgatggagtttcacgtttcagacacagcaagcatggagggagatttctgagggccatggactcttgtcatgaaatcacaccacacacataaatagtggtctacaccaccaacacgtaagcaaagtcctggtttgaaactattaggatttggaataatatgccatatttctgcaaacatataattaaacattaactctgtttcaaaga

SEQ ID NO: 204247 - DNA, 654 bp, Homo sapiens
atctttttgttgtctgtagtatctcactccctaccaaaatctgtctgttcagtctatttcctttttctcttcctgctaccttccctgtttgttttctttcccttcttccctatctccttcctctccgtatgcctccttttctccccaattcccaatttgtatttctctcacaactccatcttgtttccaaaaggaggtaaggtacattacaaagattcatataaaaaaagagaaataccacaaagggaaaaccaggagagggttagtacggtatacaaattcatgctgcaaaggcttgcatattttctagaggtgagtcttagaggttgtaccagtttatatcccaattttaagtgggatatgtttgtgaagtatgtttgtcagactttttgatctatgtatatttcacttattaaattagcagttattgtggctttaatttgcatttctcttattagagaggttgagcatcttttcagatgtttaaaagccattagtgtttatgtgttcctggttctgcttatatttctttgttttatgaatattgatgctgtattatttggcccactatctgtttctccctcttaatgtaaacacccttcctgtttttctaaaatagttgtatagcattttaattgattatcattttttccg

SEQ ID NO: 204248 - DNA, 362 bp, Homo sapiens
tgacttggcaggggaagggggaggtcacactgggagagctggatgttgattctgaaggcctcccccagtaaaccgctccaacaacaaaaaggggctttctgtacattatctgcgaaaagccaagtgagggggagggaggggaaagcaatcaaagcaaagatcaattgtgttgcagacaatgtggcaagaagacagatcttgctggaaattccttctgactggactctgccaggatcagagtatttttcattccaagattaagcaaaattctttccctgtcataacctcctacccatctgtgtccaaactcccactatcatttttacaccgtgcacattttaaaacctgttttgcagcttttt

SEQ ID NO: 204249 - DNA, 370 bp, Homo sapiens
ttaattttataagaaactgtcagacctttctccaaaatgtatcatttatatgttaccataaactatgagtctccattgtaccacatcctggtcagcatttgaagtttctaattttttgtactttatagttttgaccacttgggtatgtatgtagtggttgctcattgtggttttaatttgcatttccctggtaactaaaaatgttaagcatctgttcatgtgcttatttgccatttattttttaatttaatttttatttttttgtgaaaggtctgttaaagtcttctgcaccctcacccctttgtttactggcttgtctttttattgactttttcggagttccaaagttaaagtcatgctttagtttttc

SEQ ID NO: 204250 - DNA, 505 bp, Homo sapiens
gtgttgacaatttgctatataatagagtttggccacgagagagaccagtaaagtctgacattttgagatttaagaatccttgtttattcctttattctaataaactgtagaacttcatggctaaaaaacaaaaaaggcatagaaagggatcggaatggataagacactctaaacttgtatgatggaaaatctagagtcttcctctttagccttaaagatgaatgcgctttgatctttcctctgttctcttttttatattgaatgtaaagaaactaattatactgcttgaattctctaattccttctctttgtatgctgtagacgttgatctttgtgaacaagtctgagatctttgtgtggtgaatttttgcccagtaacatcaacttttttatttgaaacaaattttgttcatctttagaatgtgaatctgttgtttctgtaactggcccatttttgagtatgtgccatgctagcatatttttagaacaatagacatggtaaaaa

SEQ ID NO: 204251 - DNA, 626 bp, Homo sapiens
tatgtcagtgtagattaatcaattgtaacaaatgtaccactctggtggagaaagttgatagaggggtgtgctatgcatatgtgggggcaaggcatatatatgaaatctctgtaccttccactcaattttgctgtgaacctaaaactgttctaaaaaataaggtctataaaagggaatataaagtatttaagaatatatagtaagataacagttgtattaataatagttgtatactttttctcatatcttgccttccccaactttttgaaatactgctaaatggaatacttttaaaataaagaaaaatattcctgtgggtgctattttaaagtgaaggtcatagtatgaagctaaaaaaaagaataacaacaataataatggttaacagttactgagtacttacactctgcaaggcattgttctaagacctttatatgtatgtcctcatttaaatcctcacaacttaatgaggtggacatcattatccttgcatgtagataagaaaaataagataccaatggtcaggctgtaattcaataaatactcactgaataccacactgtacagcaggcacttttgtatatattatctcattacatctttcaacaatctcatccattaaactt

SEQ ID NO: 204252 - DNA, 406 bp, Homo sapiens
tgcctaactacggatcaggggagatggtagatggtagtgtcattagcccaatagggaacatagaaagaaggaacaaattaggagtgttggtgattggagagcagggaagatgattattttggacacattgcatttgtagtgtctttatatagatatgtcttataagcagatctcatgtattgtaaatgtcgtacaagtgaaatgagaaataataaggacttttaatgagtacattgggcttatatcgttatgtgtatgagtccttctacttcaccttcacttccctttgggtttggtggctttgggtagaaaagaaggccaggcacaggggctcatgcctgtaatcccaacactttgggaggccgaggtgggaggattgcttgagctcaggagtttgagactagcc

SEQ ID NO: 204253 - DNA, 405 bp, Homo sapiens
acctttatttagcggatttgtcattggggaacgtatgggtggagcaattttgaaactatcatgtgttttacaggactgagcaaagtagcaaatacaaagatattattaggaactagggtctttgctgggagagaaagatgtaaatatgacctgggagaaagcaagaaagaacccttgcagggttaaataggacttcaagtttcccagcctgtgcaacacggcaagaccccatttctacaaaaaataaaaatgaaataacatgggtgtgatggcatgcacctgtggtcctagctacttaggaggctgacatgggaggattgcttgagcctgaaaggttgaggccgtggtaagccatcattgctcctctgcactccagcctgggtgatggagagagatcccgtctct

SEQ ID NO: 204254 - DNA, 534 bp, Homo sapiens
aattaattgtgcccctttcactctcaaaagtgtcccggtttggacaataaattatgtggtcaccctacttatacagggtcctcccaacccagggacaatggcattttaatagaggaccctgaaagacagaattgtctttaagactcaaagaagtaaatcccagatggtgaaattttaagcgtttatatcccagtaggcaagagaatgtagacaaagattctgctcagcaccccacaaacctaccacaaaggactatttctaacacccgatttgagggttgtgggggtcaccaggcctgtgatgagatttgaaagggcaggagtcccactgtggctcatggaagtgtctgacaagcaaggccagaaaaggggagggacagcaaaaagctgttgcttccccacctccccaggcaagagggaagcccctgcctagcatttgattgttctcaagcccccagcctccctgcaggaaagagctaatggggattggccctcttcccagcgtcaccctcagcccctggtgggcccctgggct

SEQ ID NO: 204255 - DNA, 460 bp, Homo sapiens
cccagcattaccccactgatagattctggggattgaatttggatccaggtcttttcaactccaagtttcaccacgtgaacttgagttggcataagaatcacttgaggcttggttataatataggttctgggccctccccagacctgctaactccatcaccagggaaggggccctgaaatctgatgactggtatgatcaggcaagtttaagacattatactctactgtatagcctcctttggtttaaggtcctgattctcaaggctttccatttgtaacaccttagaggtataggcattgatgccaaaaatagtaaagaagcaaatcatgtacagttgacctttgaacaacctggggggttaggagaactgacctccttgcagtcaaaaatctgtgtataacttttgactctcccaaaacttaactacgaatagcctactgttgaccagaagccttataga

SEQ ID NO: 204256 - DNA, 251 bp, Homo sapiens
agagagagagcatagggctcaataaacgggagcacccactgtgggctgggccctgcaccaggctttggatacagagctgaaggcagggccgaactcaccatggaaggtcttttatgctacgcaaaagaactttggcagtatcctgcagggggtaggagctgtcgcagatttgtaaacaaggaaatgacaaccgatctatattttagaaagacgggctgctggcagtgtggacagtgggctgaggcgggcag

SEQ ID NO: 204257 - DNA, 203 bp, Homo sapiens
ggtcaacgagttttccttacaatatcttagaatgatgttaaaaagtaccacatcaatgaattccacttctggatggcagcataagaagttccatggacccactccccagaaaaacaaagttggtaaaaaacaatgaaaaaaatccaataaattaaagtctctgtaaagtgtcctaagggaataaagcaaataaatatttacta

SEQ ID NO: 204258 - DNA, 432 bp, Homo sapiens
gtacatttttttttcattgacagtgcaaaagataccatttaggatttgattttcagaaggtaaaatataaaacattgtcaggaaattcgaatacttaattaagtaggataatggattactgagaaatagtacttggttatctatttaatcaaatgatgtaaaataattttagagtagatataggaggtaacataattgcaaagaacttcatctcttttatatgaagactgttctcttaaataatcaaggactcgaaaaagtcagcacaaagcatggaaaattattctgatgagattctgaatgtttatcttctaagaagattactcagaaggtaaagaaaaatattttacaagctcttactaagagaatacactaatccaaaaaaattattttaatagagaataaaacaaattctagttttgcatctgcata

SEQ ID NO: 204259 - DNA, 538 bp, Homo sapiens
gtataattcatgattagtcctccttcatacccgttttcctggtatcattattaataatgccccattggccaggtgcagtggctcacggctgtaatcccagcagctttgggaggctgaggtgggtggatcatgaggtcaagagatcgagaccatcctggccaacatggtgaaacctcatttatactaaaaatccaaaaattaactgggcgtggtggtgcgtgcctgtagtcccagctactcgggaggctgagacaggagaatcgcttgaacccgggaggcaaaggttgcagtgagtcgagattacgccactgctctctagcctggcgacagagcgagattccatctaaaaaaaaaaaaaaaagccccattatactcccctatgcttcccagcttgcacaacgaagtatatggttgatcactctatttataaaagcaccatcatccatacttcacatttaggcatcagtatattttaaggatgatatttcttcaatatggctccctattagacaaacaattagcatataaagaccgcatt

SEQ ID NO: 204260 - DNA, 553 bp, Homo sapiens
atgacttgtgcacacctgggtggctctcttcaagtggatgaagtgcagacacaaggcagagggctaagacttactccatagaataacgagggccattcattcattcctggtgtgatatacaccagaacaggttagaggtttcctaaaagggattgagctgccctgcctgatagtaagctccctgctattggagatattcaagcaaatagcagacagtctactaagtatgtagatgactttcccatcccgggttggattttgtaatttggaacaggagacctctgagccaaaacccattcagaagatttggaattgcatcctgactcctctctccactttctctgcctctgtttccactctccctccttgctcagcctcaggacagagcacacatgcatgcatgcacactcacatacacacatgtgtgcacacaagcacacaagagggtaaagcaattcagaaagcaagagaggagaagagtgtgagaacctgaatggggagaccatgaggggaaggaggcaggaaagacagagaggaaggaatgaagaagaaa

SEQ ID NO: 204261 - DNA, 663 bp, Homo sapiens
cctaaattgtttgaacaaacaagacagtttatgctgaactcttgctttctttctgggagtctggaatttgggggcatggtaggcagagggtacctacatgactagccccaaataaaaactcagggcactcagtctgtaatgagcttcctgtgttgtcacaattcaatgtgggaagaattaatagtcttttgtgactccactggggcactgacttctgggtgcttgcctggctttctctttgctgactgtgttttgtatcccgtccctgtaataaatcttagctgtgagcacgcttggatgttgagcactgtgagtccttctaggaaatcacctgtcctagaagtgatcttggggatactccaacacatggcacaaatcaagtcacatatgctacttaacaggacatgatgagaaaaacactgtaagattcctgtccaagatacataacctgaatctaatcacaggaaaacgagacaaactccaataagggacattctacaaaataactaacttatgattatcaaaagtcaagaatcattaatgtcaagaaaggactgagaatcttttccaaattgaaaaagactaaagaggccgaatgctaaatgtaatgtgggattctggaagaatcttcttctataaaggacattaccggtacatcctgtg

SEQ ID NO: 204262 - DNA, 207 bp, Homo sapiens
ctaaaattaacattctctcttgcctcagaggtttcatcactgctattgttgttgtcgatattgctgtttattaaaactgtattttgtaaattaccagtgagagtgagtggttttaatattactttagtgtccacatagaaattcttcagtgctgagaagataagaccccaaaagattgctcactgtacagggactcttggctagcta

SEQ ID NO: 204263 - DNA, 350 bp, Homo sapiens
cctgactcctctccattcaagttgggctctacagacaagacctcaggttaagaatcttctagaagtaaatacatactataatctatccccaggatactacaaggagcattcttctggtgctggacagaccgagggagaaaaataaacctgtcaccacaaattgtccttgaggacttgaagctgaaatcacatcacctgggtatttcaataagctccaagccattttaaagtggtctcaaactggtactgcctccaggcacctggcagaggcaaaatagccctttatggaagaacacacctgcatcctaggccttgaagaactataatttaaaaaagtgaactcatggaaa

SEQ ID NO: 204264 - DNA, 241 bp, Homo sapiens
gctaattcttaattattatgtgaaataatcataataaactttaaataattgtttttttcctcttttaattccctgcagattctgttcactctctgctatcagttgctgtgtccttaaggaatgcagacaatgttaattcaagcaaaacaatagaaagaaaatgatttgaaatgaaaacttggctttaaaaagttacataatatactctcaagctaaatataggttattttttagtatctgc

SEQ ID NO: 204265 - DNA, 527 bp, Homo sapiens
gtttttctttagagcggttattaccacctgataaatttgcctattcatttaattgttacgctgggaggctagctcctatggatgggatttctttcactgtagcatgcccggggccttagaacattaccaggccgacagtgtacacccaataaatatttgctgaatggaggaagaaggcactgccctaaacttgtgaagccttgaaggcaaagaccagcgaggtctgactgagccgaattcctaggccaaggttggtgtcggggcccacagtagccgaacaggctcacgaatgccgagtgagcaggagaggcttgtgggaagaagagggctgatgatcagttctctctgacctggtttgagaggtcccattttgtaggggttttgtgacgagaaaggcagggagtatatattccaagcaggtgttgagatgcccaaaccataatggctatccatgtgtgtctttattttagttatgttttcctttagattttagtgagaaattctattatttgataacttttaagaga

SEQ ID NO: 204266 - DNA, 1080 bp, Homo sapiens
gcaacagagcaagaccctctctcaaaaaaaaatattagaaagtcttcatgttctccaggaataggaaatccccaaagatgctgtctggaagaggtagggagggaaaaacacatagccttacagaatggacatctggtccccaacgttatgtgagcatcttgagttatgacccactccagaaaatctgttgttcgtctggacactgacaaacctctccacagccccagggacaggaaaccctgcttgctaattaatatgcgactcaactccctttcctgtggtctgctgactcatgcaggagcatcctggcagtctgtggagcccttaggctgtgatgtgactcatctgcgagtctaacagacctggtttatctcagttatggctgagcaaaatcaagcagcgtccttaagctctcctgactacagttccatatctgaaaggtggggataatagcatctaccttgcatttgaaacgccgggcatgcatgctcagatgaataactaccacagcggtgctctctctgtgccaggaactgtcaggcgtgtttcattcatatttcatcttccccagtggggcaattctcaacccctaaagtcagaaataccatccgacccagcaatcccattactggctatatacccaaaggaatacaagttgttccgccatgaagacacatgcacgcgtatgttcattgcagcactactcacaatagcaaagacatggaatcaacccaaatgcccatcaatgatagactggataaagaaaatgtggtacatacacaccatggaatactatacagccatgaaaaggaatgagatcctatcctttgcagggacatagaaggagctggaggccattatcctcagcaaactaatgcaggaacagaaaaccagataccacatgttcttacatttaagtgggagctaaataatgagaacacatggacacatagaggggaacaccacacactggggcctatcagagggtggtgggtgggaggagggagaggatcaggaaaaatagaggtgtatctgtcaccagagttcctcccttcctttttctgtatttcctttactgtt

SEQ ID NO: 204267 - DNA, 612 bp, Homo sapiens
tttggttgagctcaacaacgttcttttatctttctaagccatattcatttctcagggatgattacagaattggttaatttgaaagagttgtagcataaatattgtgactcatgaaatgtttttagtacttgttttagactttcatttcctttggtcatgctcttgtgggagatttaagcagtaatagcattttcatttttctttcctgcattccttacccatgagaaggtaatctttaatacactgtttttacttagtaagttctggtgttttaaagaaatgggttttttattcaatcataatttattgaacacctactaagtgcccagcacagaatcagatgttaatctaacataattttccttttttcaaatggtcttatttgattttttaaaaaatggatattaatgtacactagaatggagatttttgtttaccagttatttgttgctatataaatgtgggttaaattagtttttcttccttataccaccaacctttcagacttttaaaggaattactgtagaattaaaattaatagattcctcagtactggccaaactcatggatttgtggcacttcagaataatattggcttttaatgaacagaat

SEQ ID NO: 204268 - DNA, 411 bp, Homo sapiens
cggctcccagaaacccctacatcagaatctcctagagacattattaaaaatgcagtttcagaggaggttccaagatggccaaataggaacagctccagtctatagctcccagcatgagtgatgcagaagatggtagtttctgcatttccaactgaggtactgggttcatctcactggggcttgtcagatagtgggtgcagcccacacagtgtgggccaaagcagggcggggcatcgcctcacccgggaagtgcaaggagtcagggaattccctttcctagccaagggaagccatgacagatggtacttggaatattgagacactcccaccctaatactgcgcttttccaacggtcttagcaaacagaacaccaggagattatatcctgctcctggctcagagggtcccatg

SEQ ID NO: 204269 - DNA, 436 bp, Homo sapiens
aaaaaaaagccaagaaacaactgacattggtgaaagtctgtaattttcagatccattgatttacagaagaagatgccctgaacctctcagaatattttctagtgtgattttttttaatgattaaaaaaaatgaagaaaatattaaacaagaagatcaaacacatttcattgagtggtgtctcatatgtttttcttgtttgggatctatttttataattgatctttttagtggattcttgattgtagtttaacttatttctcttttgtttctttttgatgatgcatcaattctgacatttcaaaggtacagctggtcttcattagatatgtgctgttattgactttgcttaacaagaacagaccatcatcgtaccaccttgagttaactctgtgccagctggccttgctcttgagaaggtcatttctaaacagaagg

SEQ ID NO: 204270 - DNA, 515 bp, Homo sapiens
tgtaaaaagtctcagaaaaacacacaaagaatcccccaaatactcaagcttcctaatcaaataatataaaaacctatcttgggaaaagaataaatactgaaaaagctttaagtccacacacacacaaaatggacccaactaaataaccttaactaggaaaatgttctacagaatctaagacagcaaaaatgaagcatttgtaatactcacaatgttccatgttaaatacaaaaaggcagtgtaatctaacatataatatgctctcaatgaggaatgcaaagaataaaacacttaaaagaaaaaaaatgtcagcaataggggagaaagatacagaaatacagctctcttttggaaattttcctatttcattaaaaaaattctttagagataatttttctattcgacttttcttagcttctaaaatttctataatgagcttgtgagtacttttgtaataataaaagctttaaaaagtttaacaagaaattggcaaggaaaccaagtctgtttacatc

SEQ ID NO: 204271 - DNA, 338 bp, Homo sapiens
agaaagtgggggggaggagggaaatgagtgtggctctcaaagggcaacatgaggggtgcttttggtgatggaaatgttccatagcttgactgtatcaatgccaatatcctggttgtgatagagtaccacagttttgcaagatgttaccactggaaaaaatggaataaaggatatgggggaattctattatttcttataactgcatgtgaatctataattatcttttttttttttttttttttgagacggagtctcaccttgtcacccaggctggagtgcaatggcaccatctcagctcactgcaacctctgcctcctgggttcaaacgattctcctgc

SEQ ID NO: 204272 - DNA, 398 bp, Homo sapiens
gcaaaattgctcccagttgagaaccactgatgaaaatgataaatgatatactatgcttttaaaagtatccggccagttcactgccctccccgccaccccaaaggccaataagtacatgaaaagatgtttaacatcattagtcattggagaaatgcaaattaaaaaacacattgaggtgccactgcatacccaccagagctatatgttactgaaattattggtttttctcatctgatgcccccactaagccaggagcacctcggttgatttgggatctgggctttaatttggttctctcgtggattatctgaaggatcttgcacgacacttgaagaacaattcttccaacatttccctacattgtgttaaaagggatttttctgcttgttctgtaggaa

SEQ ID NO: 204273 - DNA, 522 bp, Homo sapiens
tctcattgttgttttaatttgtaattctctaatgagaaatgtttagcatcttttcatatgattattttccatttgtagtatttaataaggtgtcttttcagatcatttgcccattttttaattgagttgtttgttttccttttgttcagtgttaagatttctttgtatattttggacacaagttctttatcagatacgtgttttgcaaatattttctcccaatctctggcttgcctttttattctcttaacagtttctttaatggagaaaaacagtttttaattttaatgtagtccaacataccgatttttctttcatcgtgcttttgctgtcatcactaaaaatcatcaccagatgcaagtcatgtcaaattcatgctatgtcttttttaaaatttttattataggttcagggtgtatgtgtgcagatttgttacaaaggcatattatgtgatgctgaggtttgcagtacaatccatctcccaggtagtgagcatagtagtacccaatagatagtttttca

SEQ ID NO: 204274 - DNA, 847 bp, Homo sapiens
gtgggaggtactgggttacacctggggagaagaggatgtaaaaaaagcacagacatgagaattgtggaatgcaagcattttccgtgattagagcctattttaaatgaaatacccagatagagatgtagaatatttttcttcactgattaaaggtgccttgtgctccctcctattaatttctccctacagaagtaaccactattttaacctctaacctctatcaccataaattagtttttgcttgtttctttttcttttccttcctttttttttcttttgagacagggtctcagtctgtcaccctagctggagtgcattggcgcaatctcagctcactgcagccttcacctcccaggctcaagcgatcctcctccttcagcttcctgagtacctggaactacaggtgcatgccatcatgcctggctgattttttttttttttctttcggtagtagagatagggttttaccatgttgcccgggctggagtttttgtttctaaacttcttatggcatatttgtcctccctcccaagggtagtgagaattgatgcttgaatccatctctcttttcttctgtccttgtttggcattgttatgaattgggaggtaaatcaggtgatatttggtactatggcccttttttccccccagtgacaaaatcagagaggtgcttcttagtgttcattaatagtaatcctttagaggttagttttatgacttgatattttgtttagaatgcagagatttgaatttgcctccaccgataacatagttgcctggcttgctgtcattacagtattctctaggcatatagccaggaagtaggtggaggaagttgtggattgcc

SEQ ID NO: 204275 - DNA, 3292 bp, Homo sapiens
ggcacgaggcagctgcggcggggccggtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttcaggggcactacctctttgtccagcctgctgggcacaggccggccctggaggtggaggccatccggcagcaggtggaggctgtgttggctgggcatgaagctgtgcgctggcactcagagcagaggctgctaaggcgggccaagcgcagcgtccacttcaacgaccccaagtacccgcagcaatggcacctgaataaccgacggagcccgggcagggacatcaacgtgacgggtgtgtgggaacgcaatgtgactgggcgaggggtgacggtggtggtagtggatgacggagtggaacacaccatccaggacattgcacccaactatagccctgagggtagctatgacctcaactctaatgaccctgaccccatgccccacccggatgtggagaatggcaaccaccatggcacgcgatgtgcaggagagatcgcggctgtgcccaacaacagcttctgtgccgtgggcgtggcctacgggagccgcatcgcaggtatccgggtactggatggacctctcacagacagcatggaggcagtggcgttcaacaagcactatcagatcaatgacatctacagctgcagctggggaccagatgacgatgggaagacagtggatggcccccatcagcttggaaaggctgccttacaacatggggtgattgctggtcgccagggctttgggagcatctttgtggtagccagtggcaacggaggccaacacaacgacaactgcaactacgatggctacgccaactccatctacaccgtcaccataggagctgtggatgaggagggacgcatgcctttctatgcagaagaatgtgcctccatgctggcagtcaccttcagtggtggggacaagatgcttcggagcattgtgaccactgactgggaccttcagaagggcactggctgcactgagggccacacagggacctcagctgcagcgcctctggcagctggcatgatagccttaatgctgcaggtgcggccctgcctcacgtggcgtgacgtccagcacatcattgtcttcacagccacccggtatgaggatcgccgtgcagagtgggtcaccaacgaggcaggcttcagccatagccaccagcacggtttcggcctcctcaacgcctggaggctcgtgaatgcagccaagatctggacatctgtcccttacttagcatcctacgtcagtcccgtgttaaaagaaaacaaggcgattccgcagtccccccgttccctggaggtcctgtggaattcagcaggatggacctggagatgtcagggctgaagaccctggagcatgtggcagtgacagtctccatcactcacccacggcgcggcagcttggagctgaagctgttctgccccagtggcatgatgtccctcatcggcgccccccgcagcatggactcatggctctgtgtggagtgcagtagacatcagggacagacaaaggctgttagagagtgccatgagtggaaaatacctgcacgatgacttcgccctgccctgcccaccggggctgaaaattcctgaggaagatggttacaccatcacccccaacaccctcaagaccctggtgctggtaggctgtttcaccgtcttctggactgtttactacatgctggaagtatatttgagccagaggaatgtggcttccaatcaagtttgtaggagtggaccctgccactggccccatcggagccggaaagccaaggaggaagggacagagctagaatcagtgccactttgcagcagcaaggatccagacgaagtggaaacagagagcaggggccctcccaccacctctgacctccttgccccagacctgctggagcaaggggactggagcctgtcccagaacaagagcgccctggactgccctcatcagcacctagacgtaccgcacgggaaggaggagcagatctgctgacctcagggcctgacagtgtgggacaggctcttctttcccaaaattagggagctcttgacagaaagcagttctgatgcttacatctggaatctgaggcatcctctgactccactcaaagagggtgagggccttcttaagatacaaatggtggaggattgctgccagagaagtctggtcagagccacagggtctgcctccagccaaacgggagcttttggtgagaaggtgttggacaggggattggcgcccccctttggtttggcctccatcctcatctctcttgggccaagccagctgcctaggtcccccaagcatgggggaccccttcccacatataagttgagaaggtgcctgccatagccaggagcgcatctcaatggaaacatcactggggtcacttgggaagaggacttcggggtagaggctgggaggagcccctggacatgcctgtcctgaaagcggctgcctccattatccattcccaagatgcctgatcagaaaccaaccatgaatgaacccctggctccttcaccacccccacgattggtatgatgctgccggcacagctgggatacacacggctcccccaggcctgagctgcttcactagggaatcctgcggcaggactgcagagcagatggcagatgcacatgttggaggagagagccttgggagccactgccactccagtcctgccaccaccctgtcttcctctgcaagtgctcagggaaatggccttcccgccggaggccagctatctgcctgacaggctgtgactcttctctcaaccttggccttctcccctcttctgagctagttggttgaattttttttaatgcttaagatttgtttttctcttttcacagcaacattttcttgaatttttttctgcacagcttttccaaaataaaaaccttccaaac

SEQ ID NO: 204276 - DNA, 1963 bp, Homo sapiens
ggcacgaggcagctgcggcggggccggtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttcaggggcactacctctttgtccagcctgctgggcacaggccggccctggaggtggaggccatccggcagcaggtggaggctgtgttggctgggcatgaagctgtgcgctggcactcagagcagaggctgctaaggcgggccaagcgcagcgtccacttcaacgaccccaagtacccgcagcaatggcacctgaataaccgacggagcccgggcagggacatcaacgtgacgggtgtgtgggaacgcaatgtgactgggcgaggggtgacggtggtggtagtggatgacggagtggaacacaccatccaggacattgcacccaactatagccctgagggtagctatgacctcaactctaatgaccctgaccccatgccccacccggatgtggagaatggcaaccaccatggcacgcgatgtgcaggagagatcgcggctgtgcccaacaacagcttctgtgccgtgggcgtggcctacgggagccgcatcgcaggtatccgggtactggatggacctctcacagacagcatggaggcagtggcgttcaacaagcactatcagatcaatgacatctacagctgcagctggggaccagatgacgatgggaagacagtggatggcccccatcagcttggaaaggctgccttacaacatggggtgattgctggtcgccagggctttgggagcatctttgtggtagccagtggcaacggaggccaacacaacgacaactgcaactacgatggctacgccaactccatctacaccgtcaccataggagctgtggatgaggagggacgcatgcctttctatgcagaagaatgtgcctccatgctggcagtcaccttcagtggtggggacaagatgcttcggagcattgtgaccactgactgggaccttcagaagggcactggctgcactgagggccacacagggacctcagctgcagcgcctctggcagctggcatgatagccttaatgctgcaggtgcggccctgcctcacgtggcgtgacgtccagcacatcattgtcttcacagccacccggtatgaggatcgccgtgcagagtgggtcaccaacgaggcaggcttcagccatagccaccagcacggtttcggcctcctcaacgcctggaggctcgtgaatgcagccaagatctggacatctgtcccttacttagcatcctacgtcagtcccgtgttaaaagaaaacaaggcgattccgcagtccccccgttccctggaggtcctgtggaattcagcaggatggacctggagatgtcagggctgaagaccctggagcatgtggcagtgacagtctccatcactcacccacggcgcggcagcttggagctgaagctgttctgccccagtggcatgatgtccctcatcggcgccccgagcagggactcggatccgacggttcaatgatggacttctccactgtgcgatgtgggggaaagagccgaggaactacaggtgcaacaaggatgtcgggataagcatccaggcggatctcgcgaggagtgc

SEQ ID NO: 204277 - DNA, 413 bp, Homo sapiens
tacctgccaaaaaatggtgcttatatgtgtttgctaattgacagtaataccctagtaggagttgtaggcagtgaagaaatattaagcaacagccaatattataagaaattttcttggaccccttttggagtcaaagagaaccattacaatgtcttagtcttatgggagggccaagaggagtgtgtcagtctacaggcaggtgttgagcatagattcatggacctagcagagcactggctcctgtggggcaatcaaaagctgcagacaagcactgtggttgcagcagaaggccattatcctaaatggactaatgcaagaacagaaaaccaaatactgcatgttctcgcttataagtgagaactaaactttgggtactcatggacgtaaagatggcaacagcagaaactgaagac

SEQ ID NO: 204278 - DNA, 391 bp, Homo sapiens
acaactcaaaagaaccacatctaacattatataacctaaagtactatatctgctcaggaagtaacagtggcttcaccttatttattgtgtcaacttgaaattcttcagaccagcttttaaagttgttccccctccttcacataacatatatatcatcctgggaaaattacttaattattctgcgcctgaatttccttactggaaaatgggataacaaataaatggatgctggttcacatacaaagcaaaacacacacacacacacacacacacacacagcaaaggccaccactaactcctaaaatatagtgatctttaataccagtttatttgaatggggaaaatttgccacacattttctcgttttcttcttcttgtaatgttagagata

SEQ ID NO: 204279 - DNA, 514 bp, Homo sapiens
gaaagttaagaggcaagctgtcactgaaagatgaaagactgaaattaacattatgcagttattggtaatgataaggtcaagaatgtgattataggcatgagtggctgaaggagagtagagaacaagatcaccggagatgttaaagaaactaaaaggtcaacatgctggaacaatcatctatttaagtgttgaaatcaccaaaaattaaaatggggaatgctaaagagagtgaaagtgagccataagaaatgtgatggaatcacccagatgtaaatgacaatcatgagggaatgtgggaagtgtgtctgctaatatgaaactcaaaactgggggattgtctcaaggaagaatacctggaattggcaatgaggagcaaagagtatatactacagggaccaagaaatgtaaacgagtaaaatacacacccaaaaacaagctcagtctagcacaaaactaatgaccaacatatattactgtactataacacagtaacagcttactttcacagagaact

SEQ ID NO: 204280 - DNA, 572 bp, Homo sapiens
aagactgtataaatagtaaaaggttgagtggggtgactgtgagtcctaacactctcttctctattcatccatctcaggagactctaatcattccagtgagcccagacactcagcaatccaatggctgagggatctgaggcacaaacctggagctcaatggatccgggtcacctccaagtctttgaggggtgtcacaggacaaaggaaacagacatgatctgtggtgcccagtggctgagctaagacaaatcgatggaatggaactgcagcaggagacttgatctctcttcactgtaaaaagcaaattccaagagtcagagctacccaaataaaggatgagctaccttggatggtaatgagctgcttatcactagagatgtgcaagactgttttaaatagtaaaaggctgagtggggtgacctgtgagtcctaacactctcttctctattcatccatctcaggagactctaatcattccagtgagcccagacactcagcaatccaatggctgagggatctgaggcacaaacctggagctcaatggatccgggtcagctccttaaagataaacg

SEQ ID NO: 204281 - DNA, 410 bp, Homo sapiens
ggaaaacaggtataaatattgcaagaactgtccattgataaatgcacaggtgacacacaatttaaggatccatggctgttatagaagtcattcagttcaaacagttaacatttaaatttaaacatttcattttttgtttcttccctaaaacgctttcatccttctctacattaacagagcgtcaattttttagataaatcaaacatgagcgtaaaaacgtaatgaccacttttctccaaaccagaagacaatattacatctttggaattatacattactctcttattttcttattgaacaatcacaaattctcttcatggtaccacacaaaactgaatctgtaatgtcaggagatttagatgttccacataagataattaaaacaaatcttactccataagtgctaaaca

SEQ ID NO: 204282 - DNA, 593 bp, Homo sapiens
tggttttaagtgctggccccagcacttactggctaggtgatgttggcaaagttacctaccttctctgaggtacattttcttcatttgtacaggattatatgagtatgtctatgtaaatatttatgtgtataaaagatgtccccaagggacattttctatcccccagcctatcccaaggacacaaagacttacttcccacctatatggctccatgccatccatgaatggaacatagccttaaaatgtcgataacaacagtatcttcctaaaagagttatgaggattaaatgagatgattcacataaaccatttaacacaatggcacctaaatcctctaaatgttgtgccttgctgtattcctgtttgtactttgtaagtttgaaataattgaagtgcctaggggaagccagataaccaaacatattaaattaataacctttaatattttgtaggggcttaagtctctaagtaggttgggagggtttggggaggaacgattaaaagatttgtagagataaagacaaaaaaaggtagaatgcgatacatgctaaatgggtggtacaaagtagtatagaagtttacaggagaaagtg

SEQ ID NO: 204283 - DNA, 369 bp, Homo sapiens
ctattgtaagcccctgagttccagggtggtttgttacatagcactgttgtggccattactgactaatgcatcctgtcctttgtattaagagagtgtggctgcctccaccaacatggtgcattctcccatagtgatggtggtctgtgatgactcaagaactcctggatccatgggaagaatccattcagctgtggaccagagttaggggtgaggtttgagaagccgaaggggagtagaaagaacactgtactgggaatcaggagacccaagttgcagactcagacctgccatgaatactctaagtgacctttggctgataactttccctctctgggcctccgttccataacctatgaaacatggcagtca

SEQ ID NO: 204284 - DNA, 411 bp, Homo sapiens
tgctaggttgagttacttgaacagtttcacctcattaagtgtttgctgattgccagaaacctattagcgttgctcttatctctttattcaatatgacattattcgtaatgtccctttgacaacctatagataggccatttcaagttcttgtcagtcctcagttgtgctagtacaatagtagaaactagtggaatagcactaagcgcctttagatgttttaggcaggggctgtaacaaacaagtttgggaatatttgaataaatagttgaaatcagagtttgaaaacaaacttcgaaatcatatatagaatgttaaattaatagcattcaagccagaccatttaggcaactgaaataagtgtttgaatccctgctatgtactggacacagtgatgggcatttaaaatatcct

SEQ ID NO: 204285 - DNA, 1299 bp, Homo sapiens
aatacgcaggaagagataccccgtggacatgtttcccttggaaagtggagggaaccctctgagccgtgattccgcctgaattaagcagtggcgggcactggcctggcaggcggcttctactgccttggatttgcacctctaaggggtcacaggggccacccccgaaacaagacaaagtgtgatcatggacaggccctcggggggccggaagaaggaacggctccagtgatgaaagctgaacgccagctctctccccatcgttctcccggaccaggagagggctgctcggcagggctaggtttaaaaaccttccatgcaacttacgaaggcatccacagtgacttctgctgctgtggtacgttctgccctcccctcctccccgccccatcctgttctcggctacaagttatttatatgtacagtgtcatctgaacgtgcacgggcctatcccaggacatcacacacaaagaggcggcggtgaacccaagccgccgggccggcctgtggctcagtgtgtgtttcagaagtcccggccccaggcagctctcctgaacagagccactggaactcaggagggtcaggaccacagcccaaacaactgcgaccgaaaacaccctacagggcttgagaactaaaaaataaggagggatctgggcagccgagctgcctcctaaagaagccacgtcatagagaaaactgcttgctctatccatgagacggaggcggccggggtgtcctgccagcagacacgggtctgtccatcaccggccaccgcgctgcctctgtccttcactcccatttaagggaaaacgatatctcttcatctttctgccctggacattggaaatcagcggtgagaacagtgctcttgctacaaaatgctcaggttctagaatgctcccatctttccttccattccacatggagtttatccaaagcacaaaggccagtcacggcactgacatccgtggtgcccgctcaccggggagtgggaagcacaagcctgtcctcagaggaccgtgactgtgagcccgcagctgcttgtgggtggggccagcccgcagctcctcctggaggcctcgggcttcttgctgctgcatttctgtgacatgtggagggaggatcgttttgacacctgcctgggaagtttcaaaggagatggcctctgggcaggggttttaaactgaagggcaccacacagatccagatgtgaactgtggctgttgtttgcaattgaagcagagatgcagaggatggaacaggagtgctggccatgctgctctatggccttggcccagc

SEQ ID NO: 204286 - DNA, 391 bp, Homo sapiens
tggcttctggaaaagtctttcccaccctcaattgagtcctttcataggttggggcatttatatgttgtatgttccccaatcaaaaaagctcttcttacatttgaatattgacaacaggcatgtggaagctgaaaagaaaaggcagaaagccatcatgaaagtgctaccacagagagcgatgcccagacaccaatataaagagtgtgatgcaatttttacaagtcttaattgtgaaatgccaaacactcccaacacaaaggaaagtcaaatgtcacttattcccatgatgtgttgagaggtgcagtcccaaagcacacatttctaatgcttggccaagagctaggtaaataaatggtgagggcaaaatgccacaaccccccagcgaacgggc

SEQ ID NO: 204287 - DNA, 372 bp, Homo sapiens
ctggagaggccatagggatcccgagtgccaggactgggtacaggaggggcaggatggccgaggaggcagcctgagcaggaggggctcggcccccggcagtggccctgccacatggggtggcccaggcagcggcccagcgcccaggcctgggcctcgggagaatgtgatggggagagggaggaggaggaggttccgagggaggggcagaagcaatagaagcatggccgtgcccttgcagcctgcttagactccagtcagccacttgtacctgggaggccgggctgagtgcagaatcaggcccccccgccaccgcctccctgagaggccggggagcccacagctttgatctcaataaaagccaaggcctgcacg

SEQ ID NO: 204288 - DNA, 376 bp, Homo sapiens
tgagtgggtcatcactctcctaacaggtacacagatgccatctagtgatggagaacagaaatgcaagtttttcaagtaaaatgccggacgaaggcatggggttttttgttgtgtggtgtttagaaatatgtttcagtgtaggttacttaaggtgttgcacagagatacagttaatgcattattattgttagatcatatgcagttagaatggaattaagcaagttgttgacgagtacaactttaaaagattttggcattagagagtctcattttataggcctttgtcttgttctgagtctggtcattgaggataagaaacacctcattgtaaaaatgggatataattattaataacagattgaattaatttttgggt

SEQ ID NO: 204289 - DNA, 438 bp, Homo sapiens
  misc_feature (428)..(428): n is a, c, g, or t
aaatactgagttcggaaaataatattttaggcttttggttaacataaagcagtggtagtgacaactactaacaatcacactaataccttttattgataaagcaccatatatgtttgaaatgattatatgtgacagcaggacattttgttttgtttctactatatccccagtgctggacatacagtgactgctcaataaaaactcactcagtgaataaataaatgaatctgataaagcaggccttggagtttggtaaggctgtttgttcaaaagcaaagtaaaaaagtatttcaatcattctttgagaagcaggttaggctaatctacctttataaataggactgtacatcaagctccaattatctctctcccatagcttcttagctagtttctctttttctaacctcacctaccaactcagttgggtnccgagctcga

SEQ ID NO: 204290 - DNA, 363 bp, Homo sapiens
aatagtggtaatctatgggtaattactttctggatgatttcatttcctcattcatagttttctatggtgagcatgctttgttcttaaaatcagaagaaaaagaaacttaaagtgtatgtgtttgtaatactaaactatttattttcatcaaaataggtagaaagggagaaatcttagcctattccctaaatggcaagtttagttataatttttttttttttttttttgagacggagtcttgctctgtcgcccaggctggagtgcagtggtgagatctccactcactgcaacctccgcctcccggatccaagtgattctcttgcctcagcctaccaagtagctgggactacaggtgcccgccac

SEQ ID NO: 204291 - DNA, 868 bp, Homo sapiens
tggccaggctggtctcgaactcatgacctcgtgatctgcctgcctcggcctcccaaagtgctaggattacaggcaagagccactgcgctggcctcaagttcttttcaataaaagaaagaaatagagaagaccgaaaacctttccttatatgtcttagaatataaatagatgtttatttataatgattatttttagtagtggtgctttttgtgtcacttaatggaagactacttgtattcatttgaataggtaatttatgtgactgaaatttcctttcttttcttttttttttgagacggagttttgctcttgttgcccaggttggagtgcagtggcacgatcttggctcactgcaacctctgcttcctgggttcaagcgattctcctgcctctgcctcccgagtagttgggattccaggcgcctgccccaacacccagctgatttttgtatttttagtagagacgaggtttcaccatgtggcaggctagtctcgaactctgacctcaggtgatccgccgtctcgcctccaaagtgctgggatatagggtgtgagccaccgcgcccagctgtgacgaacttcccaaaggcatgcagtcagcaaatctcttccttcggtcattcccagacaccacgaacgaggccacaggtaccaagtcaatcaagtcacacgtattctccactgacacaatggggttaatacatcaccacagtgaggggggagcggcgggcggccaccacacaaggggccgcccgcaaacggcccctcgcggacacggggcaccacagatggaaaccgcccggcaaagcaacgccaggccgaacccacgcacacaccgcacacagggacaacggcgcacatacccaccc

SEQ ID NO: 204292 - DNA, 496 bp, Homo sapiens
atagatgtcaggtgactcccaagtgagttggtggagcagctaggaggatagtaatgtcttcactgagattagaaacaaaataagagaatatatgttagggaaggaagaagtctttgttttgaccatgtaaaatttgaagtgcatgtgagccaaccagtcatatatgtgtagtgtgcaattagatattcattcaacactgttggaagagcacctactctgtgcctggtactgttctacacactgaaataggtaaagcagcagcaaaacaaatggttcctactcctgttttttagagggaaacagcatataaacaagttttaaaaataagaggagagagaatatcccataaattcgtgaagaaggctgggtgcagtggctcatgccagtaatcccagcagtttgggaggccgaggtgggtggatctcctgagttcaggagttaaagagcagcctggccaacatggcaaaaccccgtctctactgaaaaaaattagctg

SEQ ID NO: 204293 - DNA, 1392 bp, Homo sapiens
ccatcttggaaaaagaaagaaaaaagaaaaacatgattgatctccatgcatcaatatcatgcctgcctcctaaggcagaggtaatgaagacttaattcccttctgtaggccttcccctcctccctaagccgttttctgagagaggtgcaggagcaggtgggttggggcaggctgcatacacagtgggggtgggttgtgctgctaagcagcagcaggtccacaatcccccctctgcatagctcctggggggaaaggatggaggagcgtgtgcacggctgcctgcctgttgaaggtggtggttctaattttataaacctcctctgcacagatgggtaggctagcacttgctgccactcctgagctgtgaagtcagcgattacctcactcagatagctggtcaggccctgcactgtaggtcctaataggccagtggacagattgaggaaaacaggagcttctgaagggcataacagagagcaaaaccactgaagctgagtggctgcagctgcagccagggaaagagccagtaggatgggggagaattccactgacctttatgtttacctagcctggtttctaggggtgtagattcctggctagggcccttattccttgtcttgactgtcttcatgacaccaatttggcatttcaggagagcggttaagaaaaggagttgtgtctgtccaaaagctggcaaggccagagctggattgtttggggtagagactggatggccgtcattctcttttgcctccatccctcctccccagagttggaggaaagcagtggattttgtggttagtcattctttggactcacactaaaagaaacattggtgccatgttcaaatatatcagaagacctaggaaataagaaatttgacctacttttctaaatgaaatcccagactgagcaaagagctcaccacatttgaaagcttgaacaaagggggcctaggctaagtccagaggcctagaacaaatgcttttttattttctacataacaaggggaaattccttgttatgtagaaaatagctggagacaaatggtgctatagagtgactcataacaaactacggtgatataggtctagggacaaaagcaggccactgataagtggcagatgcctgatccccctaggtagtggggagtgtgagactgggttataagaagccttcactatcttttaggaccctcccttgaggaggccagtctaccacaattgctttagaatgaaggtcttttggttgctcacaagactataatggtaatttttggctcatcatttttgtgtgtgtgggttttatcttaattcattgttaaagagatagtgggtttcccctgagctagtttcctatcatctgtgcctatgtttgcttcactgagctatg

SEQ ID NO: 204294 - DNA, 439 bp, Homo sapiens
agatatgtctttaaatgcattagctagaaagggctttggttatgctcaaaattgcccagtttaattttactaaatgtagtgtagtagatgtaactggaggtagtttcctggcttacagttctcccagcagccacattcatgctacacttttttctaataataggctcaattccaaatcatggaggtgggcaagtgacccaggtagatcaattataatgcctcattcctctagcctgtgattagtccacatagtggacacatgacccaagctgggcttgatcagcctttctccatggagggaagaataaagctaacaggaaaagagcagcagagataagagactgacagtttttaaattcctggctctagtcactccagcactttcatggtttgagaacatcagccaataaaggcctccttttttgcttaaattagttca

SEQ ID NO: 204295 - DNA, 258 bp, Homo sapiens
ttacattgggagtgtgtattagttataagtactgtgtttttcctatgttaatacttttcagaattttaatatgattacttacattaatggtatttttagtaatacattttttaaaagaaataatttaaaaaatagagatttgtccatttcatctgacaagtagttcataactggagaagtagtagataaagaggctaaaattgtaagtaggagacctggaataccaaccaggattatgtacctaattctataaagtgt

SEQ ID NO: 204296 - DNA, 449 bp, Homo sapiens
ttgggccaacgcaccgtcatggcttcccctggcagtctccaggaactggcaggcatgggtcgccccacactcagcactccgaaacttttttatttcccggcaagatagaggctttctggccccactgtggccccagccaagggcatcgcggagctgcccacaaaagcgaccagagtaaacggccccgttctctggctgtcagtggccagtggcttcccttatgcgtatctcaaaatggctgccggggcagctgcaccctgtgggctgactggtcttcgggatgcctggctgatctgtctcggggcctctagagtagctgcttctccaaggggtcccaatggcaggtccgctttgttctagggctctacgcccgggtcggggaaaccctggcttaggcagagtccaccccgccccgcccatcctcactcttctcggtgcctggcagaagg

SEQ ID NO: 204297 - DNA, 152 bp, Homo sapiens
tctcctcagcagggccacacgctctgtgaaggctgggtgacactgtatttatcttggtgtccccaaaagcctagaaacagtgtcttaggcatagtagacactactaaatgtctggtgaagtaaattatgggatgttggtggggtaccaaatt

SEQ ID NO: 204298 - DNA, 380 bp, Homo sapiens
tcatttaaaaagagaaaagaaattttagagagtttatcttgttggattatcggatgttatttttctctttttaatgccatatacttttcaaattttcagtgggctggtattacttttgtatttaaaaaagaaaaatataaggaaaaagaaacctgtcacacactttctagtggattttactgatcagtcatctctgtatttctggcatcagcaaactgagccagaaactcagtgcctcccatttctttctttttttttttttagacggagtcttgctctgttgcccaggctagagttcagtgagccactgcaaccaagtggcaaccgagatcgtgccactgcactccagcctgggcgatagagcaagagtacatctcaaa

SEQ ID NO: 204299 - DNA, 187 bp, Homo sapiens
tttacaaattctccaacactaacctagagtgttcaaaatgatgagtctgaccacggttaccaccgtcttcctacagacagacaatctctataagatgggtagatcaatagtcacataaactgttaaattttactatgctacaagactggctctctatttgcaaaattcatatgaataacataagagc

SEQ ID NO: 204300 - DNA, 324 bp, Homo sapiens
  misc_feature (6)..(6): n is a, c, g, or t
aatcgngctcggtaccgtatctctaacattataaacataaaacacaaggaactgagacaaactgatctaacatgattacctgttcctgtatgtaagttaaaaaattagacatctgtaattggaatatgggtatctaagtcactgcatacttgagatgcactaaaaatatttatactacatttagaaaaaaagtaagttaatttttctggatactttttaatgtttaatcgttcatgtttaatttaaaagtcttgagctacttaacctctctatgattcagttttatcatatctaaaatgagaataactgctaatgttagagata

SEQ ID NO: 204301 - DNA, 377 bp, Homo sapiens
cccgcctccccaccccatgaatgtgcacagcaccacctcgtgtcccagtagcgcagctttggggagtttggaaacactcctggtttgggattcactcagcaaatatttaatgtgtgtgtgctgtggccaggtaaaatgccaggtactatcttcctctacatggcagggacagacatgtgttcctcaagctcactggggatagcaccacctttctaaagttcctctcatctgttgcccggcctccaaacccggtggtcctttattaattcagctgtggcatgggcgttcatactctcagcttcctttactgcgtttcctactgtttctggcttcaagttgttgaagtcaaaataaaaaagtagagactgagctctaaa

SEQ ID NO: 204302 - DNA, 1619 bp, Homo sapiens
gccttcgccgcttctgcagccaccggcgggggggggaacgaggcagtactgccgcggacgctcaccaaccgcttcggcttttcccccctccgggtctcctcgacctttcctgagagccggaatccgactgtagggggaagaaagactcaagagcagatgcttgaactgaaataactttattttggggggttactttgctgacccttagcgcagggcttcctttcccttccccctccgccgccagtaccaatccaactccccatctttctctttgtttttcctctttttctttttctctccctgttgccgctgtctccgcgtccttcccctccgttgccgcccagggcgccgagccagactatgggtcccaggtgggggctgagcggcggcagcagcgcgggcggtccagtcacggtgcgcactgcagcggggatggaggggctcagttggctggtggttttctcttgacatggctcctgcccgtgctaccagcagcgcccccgccgccgccgcctcttccgccgccgccaccgctccgcccgcaggctgcggctagagggcccaaaccccgccctagagtcggtccgtgagtcccgggctccgcggggacagggaggggatttccccgtcacccaccccgccctagctgcctcaattccaccccctgcccctcgggaaacaactaacgaccccaccctaaacaatccaaactctggaaacatggtctgttcaacgtgagagagagctaatccgggaacttaattttttggggggagggtgggtgggcttactttagaagtaatattaacacaattattttctttttttcccccactgaaccttcccatttaccctctcccgcccactccacccgggcgggaattgtttccacgatgaaatgagtgaaaacctgagtgatcctgtgtctcccgtggtgcgagtgagtcgctgccgctgaaggcaaggggtgggggtgggacctgcgggggtggaaggcaggtggtctccgggcaccgcctgggatttgggagaagaacccgccacctttgcctcggcaatgctcacaagaagataaatcgcactccccaccattttgaacgggggcagatccacagggaagtctcccttggggaatgtaggactagttgcaggctgggggtgttgggaacccgggcattaatcaggtctaaccacagagccggaataattaataccgtattatataccccttttccttctgccgtcatgattctccttggcagcagcgttagcagccgcctgagggtgaaaatgtgggtgatggggaagttggtaatgactccgctgttttttctcatggctcctttgggccacagctgcccgcccccggtatacactgtagttgattgcagggaaaccctgtacctctccctttccttctctaccgattttgcacttttctctatgctcaccaccaagtgtaatcaataacaagcactgacaatacatagcaatagtgaaatctgaaataactaagaattaggtactacagccatggagctggctgggtaaaatctaattggatatttcagtttcattcacctaccctgttttggtgtttggttttggttttggttttg

SEQ ID NO: 204303 - DNA, 391 bp, Homo sapiens
tcagtcggtaccagtgatgcatgtagtcccagctacttgggaggctgaggcacaggaatcgcttgaacccgggaggcggaggttgtactgagctgagattgtaccactgcactccggcatgggcaatgcagcaggactgtttccaaaaaaaaaaaatcctaataaatccgcaatagtaagtgaattagattatgctgacactcctgggccctcgtctctatcccctccttaagggaggaagatgcttcgtagtggtgagaatggcgtttcctaatccccacctgatatggtttgaatatgtgtctccacccaaatctcatgttgaaatgtaatccctgatgctgaaggtgggtcctggtgggaggtgattggaccatgggggtagtttctc

SEQ ID NO: 204304 - DNA, 404 bp, Homo sapiens
ataattaaaccattttggttcagagcatgtagcctcccatttcacagaaggaacagtttgcagaatgcatggtatgctttggtcttagtaatgacactttaaatgtgattctccccaaactcctaagttttaaaagtatatatcaaaaggctttaagctgtactgatgacacatctcattggaaaatccctacgctgtaccccagctttcttacttcctggcattcactttccctgattcatttatgagatagtgcttgttgttaaagactactgtcaccgtgaaaaggttcagcctgtgtgacctggcattccctaatttctcattcatgacttcctgagtttttggggggatttgattgtggtattggtagggaataaaaatatggagagaacaagataagc

SEQ ID NO: 204305 - DNA, 350 bp, Homo sapiens
tgaaacaggccatagggatgcagcaatggcattgtggaaactaccatttctggcaaatgaagacttggaggttgggcgcagtggttcacaactgtaatcccagcactttgggaggccgaggcaggtggatcacctgaggttagcagttcaagaccagcctggccaacatgcgaaaccctgtctctactaaaaatacaaaaaattagccaggcatgttggcatgcacatgtagtcccagctacttgggaggccaaggcaggagaattgcttgaacccgggaggtggaggctgcagtgagccgagattacaccactgcactccaacctgggcaaaatagtgagactccatct

SEQ ID NO: 204306 - DNA, 696 bp, Homo sapiens
aataactatacaaagggctacagtaaccaaaacagcatggtactggtaccaaaacagagatatagatcgatggaacagaacagagccctcagaaataatgccacatatctacgactatctgatctttcacaaacctgagaaaaacaagcaatggggaaaggattccctatttaataaatggtgctgggaaaactggctagccatatgaagaaagctgaaactggatcccttccttacaccttatacaaaactcaattcaagatggattacagatttaaacgttaggccctctaacttttcactaggcatgaccactgctctattttagatagagattcagtggggcaaaacctgagaattatctgcccggctatcaagaagatagctccttgcatttttgcggggagagcacttttgcttcaagggagtgtttcttcctaggattataaatctttctgtaacctcaggaaacactgctgatgaaaaccaggcatggtggctctggcctgtaatcccagtgactcgggggctgaggcaggaggatcacttaagcccaggagttggaggctgcagtgagctatgatggcaccactgcactccagcctgggacacagagacagacgctgtctctgaaagaaaaagaaaaaagaaagaaaaacattgctgatgaaactgcggcctcttttgcagctcaat

SEQ ID NO: 204307 - DNA, 145 bp, Homo sapiens
attttagagtaaaaaactgcaaggcgtgatttgaataaggatataagaaattttacatcattttctttatattgtgttcacagtcaatagtttatgctgtaatagtttatgctgtaatagtttatgctgtaatagtttatgctgt

SEQ ID NO: 204308 - DNA, 347 bp, Homo sapiens
acgcatcctgccatctggggtgaggctagacccattttacagataagggggtccggagggttaattgacctgtccaaggtcagcaagtagggcccagctgagaactgaaggaagtgggcaacagttagaaggaggctttgttttcctctcctctcccaaacctacaccagggtcttcctgaaaggagggagggaattggtgtctcttgctggactgggccttctggtctggggaggaagaataaggatgaagtctcccttgtggtctgagatagttggaggaggttgcagtgagccgaggtctttgtgtaactgcactccagcctgggagagcgagactctgactca

SEQ ID NO: 204309 - DNA, 336 bp, Homo sapiens
gtaaaccagaagtatccaaatacgacatgaaatctctaaaacaacaacaaaaccaaaccaaaccgcagcactagcaaatcacagactgcctgatctacccactgtttacagaggcagcagctacttccagcactgtctctcatcagtgcccggggctgtgggtctcattctagattttgtctacatttttttacatggttctcctgattccctgctccccctccccaccaccgccccgcctggagatggagccttgctctgtctccagggaggttgcagtgagccgaggtctttgtgtaactgcactccagcctgggagagcgagactctgactca

SEQ ID NO: 204310 - DNA, 422 bp, Homo sapiens
gtaaaccagaagtatccaaatacgacatgaaatctctaaaacaacaacaaaaccaaaccaaaccgcagcactagcaaatcacagactgcctgatctacccactgtttacagaggcagcagctacttccagcactgtctctcatcagtgcccggggctgtgggtctcattctagattttgtctacatttttttacatggttctcctgattccctgctccccctccccaccaccgccccgcctggagatggagccttgctctgtctccaggctggagtacaatggtgccatctctgctcactgcaacctccacctcccgggttcaagcgattcttctgcctcagcctcctgagtagctagaattacaggcacatgccaccacgcccggctaatttttgtattcttagtagagatggggtttcac

SEQ ID NO: 204311 - DNA, 486 bp, Homo sapiens
atttgagagtgctgatgtgaggatttcatcttggttaactgaaggaaataataatttgtttaagatcatcaacatgtgatcaacttgaaataagagcttctcagtgttatgaaaattgtgagttgataatgtgtaacacaatcagactaaaataagccttattaaagcagatttctctaagggtacttctgcttcattttgccaattctggactctgcaatcttaatttcattggttagggaggatctactccctctaacacaatacatgcaaatcataaattagaattggttgcatataatgtaatagagaagctgtattcagcttactcaattagcagaaatgtatatgcaactggtataacacacattaacagattggagtgctaatatgaacatatctctcatttcaaaattaaaactggtagggaccccatttttcagattaggaggaagtccagcatctttctaaagaaatccctcactg

SEQ ID NO: 204312 - DNA, 509 bp, Homo sapiens
tccctctccaaactagccagccactgagaccttctgacaggacacccccaggatgtcacccaaaaaagttgggacagaacaagtcaactggcaagtccattgctcagcttgttgaaatactctgcacagaatgcaaggaaaaactgttttcatgaggtagcccatgaagcgatgaagcaaggcaaatttatctgcctggataacctcctgtatgctgttttcactccatggagagtcaacacaacagacttctgagttgtattatcgagctccttcaacagggcattgctgtaagatcctagatcccacactccatggtgtgatgttttagccaagtctggaagtagcacaggccctaaaatctcatgattgcaggttgtcaactctgctgtaggcttgccacttcaagggcaagtggttggttggggctgggatttgggcagagccatagaaagaaagggaacattcaagggaatttgatgatgtgcatgatgtctctgtctgataca

SEQ ID NO: 204313 - DNA, 118 bp, Homo sapiens
tgctgggattacagacgtgagccactgtgcctagccctagttttttttattgtctgtatagatggggtttccctgtcttgcccaggttggtctggaactcctggactcaagcgaacct

SEQ ID NO: 204314 - DNA, 300 bp, Homo sapiens
gatccccggtggtgtccctgcaggcaatctaagaaagaattccacctccttcccatgtgactttgggctgggctcacctatgttgcctaggctggtctcgaactcctggccccaagtgattctcctacctcagcctcccaaagtgttgagattacaggtgtgagctaccgtgcccagatgaggatgagctttattgaggagtgaggcaatgggctaggaacgcgtaaaatctgcctccagcagccacaaagcactgatgttccaagacccccattacaggagagaaaaattgaggtccag

SEQ ID NO: 204315 - DNA, 478 bp, Homo sapiens
gggatgggctggtcctgggggcatgctcaggcttctgctgcctaggaaatgtgcccactgggggcttagaggcctgagtgtgccactgcaggtggacccaggcagacatgcagccctggaaaagggcacaacggcagtcacaagaatcccggacgtggataccactcatagagctcactaacccgccacagcaccctgactgcagagtctttctttctacccatcttacagatgaggaaactgaggctcaaggaggtaaagtgactcgcccaggtacacagctggtgaggagaggagatgggcacagtctgccctgtctccgttacattataggaaagttagggatttgttatttggggggacgggtcagctgatgcctgtgggcatcgtggggactgctcagacatgcagccctggaaaagggcacaacggcagtcacaagaatcccggacgtggataccactcatagagctcacaa

SEQ ID NO: 204316 - DNA, 490 bp, Homo sapiens
aattaacttgcatgtagtagggtgagaagcatctgcttgtcaactgacatttaaatagcaattgccagtggaaagtaagcatatggttagttgaatgaagagccagaaagagacaaatacatccaataaaagattttagcactttctcaatttatatgttagtgtttgcaatctgcttctgcaagtcagctgagatgttgatctcactcactgaccttgtctgacccgaggcgtccaaatcagcaccaaccttggtttagtctttaacggctgagacagaattctcaaaggagtgttccctggaacagcagcatcagcgccacctgggaacttcttagacatgcaaattcttaggctccaacccagatctcctgaatcagagactctgagggtgtggcccacaatctggggttaacaagccctctgttgactctgctgctcacacaagttggagaacactggtctaagagaagcataaattgaggtggag

SEQ ID NO: 204317 - DNA, 657 bp, Homo sapiens
caataatccctacttttggggaattcttccttatccttctagttacccaagccaaatctagtacttattctataattcttcttctttcccacctatacatgaatctcttatcatgttttgtcggttctatctttgaaatctgtcttaaatctggcccttctccatttcttctgcctctgtcttatttcaggccctcattatttttgcctgagctccagtggcctcttacctaatcttcctgcctctagacagttctttcctattcattcctatttctggcaaagtgattccagagagatctttctaaaactcagtatgcccctgccattcttcttgggatactttaatgttccattattgtcagcataaagcccaaactccttggtatggtttgtaggtccccctatgaactttctcctctgtacctgttcagaattgtatgtcttgacattccctgacaggtgttctatgctccagtcatattgaactatctgtacatctctgggaccatgctgtttattgcttattatgcttttgcacattctgttcccttgaaatatattctgtcttgtttagttggttacttcctctgagatgctcagtcatttattcagtaagtatttttttaccactcactgtatgttaggtactgttcta

SEQ ID NO: 204318 - DNA, 777 bp, Homo sapiens
aggtgaggactgtgccacttgaccttgctgggttgcaggttttgctgatactggctgtggggcccttgagtgctcaaggagcatttattgagtgcctcctgtttgcagacactgggctctgtgagccacaggcatgcttacccacaccctccattaggtttggatcccgacaccacccctctgggagttccttagggcctcacttctaggggggtacccagccccctggccaagctgccccttcccatgccagaaagcatgtggggtgccaggagagactggtctcagcttcaggcttgtggttttttttttttgttttttttttttaagggaatgtctttcttgctaagcactttattattgctgacaagccactggcatgcagggcggagtcccacatcttgactccagccaagcatcactgcagcctgggtggagtgtgagaactgcgttcctgtcccactctgccactgccgcgctgtgtcaccttagacaagtcactggcggcgagcctcgcttcagtcatccatacggcgaggcggcaccttcgcagcttctccgcagggctgagggtctggagggggccctggcgtgcaagccctttgcaggtggtgacttgtggcgggaaccacttggagctgtgtggttcccatctggcctggagagaccaggggtggagtgagatcctggggatgggaggtgtgggccagggtgccccatggagcctgacagggtactgggcacccgcgagagaggtatcagtgcctgcccagtgcc

SEQ ID NO: 204319 - DNA, 1353 bp, Homo sapiens
cttcctcgccgccgacgtcggcccgccgccccttcttttcctttgccttccccccgcgccgcgcccggagaccccgcccagcacccagcggctcggctactcccggcgcgccccgagagctacggggatgagaggcggcgccggcgcccgggtgatacagccggcgttctgtacgtcagccaccgctctgaagagagaaaagcggcggtgtcctgcggagagagccgctccctccactgcccgaggggagcgcgtcgcctcagccgctcgaaagcaggaaatgggcggcaaaagcgcagtcagacaccaactggttctggactgcccccgagaggcagcgagcagcgctcccgcgcttcgcccgctaggagctgccgccacgtcccgagctgcgccgctcgcgcccctccctgctccgagtccccggtgggggctgggctgcggccgagtccggtacccgggcccccacccgcgccgcgctgtcgaacccgccgccggcccgctctcggcgccgataatcgccggcgggcatcccgcagaggctgccgccggctccgccaaacagcagccaaggcatagccgggaagtccccaggccacccgttccccagcacccttcggggaattcccgttcagctctacaggaggcgaaaacggaacaaacgaaaaccccttaacagtgaaaccgggcccggcgatggcccgggtggcgactgcgacgactcgacgcgtgcggacacaagacccgtctcgcgctccgctgctcctgtgcgtccggacgaaccttagagatcacttaaggaggctcgcgcgctactcctcaccacgtgaccgccccgccaggccgccccccgcgccgccatcttacatccgggacagaggcggcgtcccctttccctgccttggcaggcgtcagcgtgctaccagaaatcagccctgaaagaggggaccccgattccacgtcaccagagtgctgaggcagcgggcgatgccctccatcggctcagcgggggggagtggagtcccaaacttttttcggcctttgcccgcaaagaagatggcggcgcatatcgccgcctaagcggacacgttgtaccctggccgtggtttgaagtttccggcacctcctttcccaaccagcaaggacacaaccatacgagccccacccacgcggggtggctgccgtgctacattccgcagaaaacaggcgggaaagctgcggcacagcccgctttaaacgcaagcttttgggacttctggttttggctttttctttttaagccaagttagggagaaggctgactgccatggagccacttctgcttttggcccagacaacttacgggattttttt

SEQ ID NO: 204320 - DNA, 447 bp, Homo sapiens
ctagctatgcctgagtactatcagattacactatctgctccctgaagcatcatcccttcctttactgtcagtccccaggggtcatagagtaggtgtcacagatgcagaggttccctccaagaaacaggcagagactttaggagggcatctcagaaagtgggtgagaagctgggacagacatggaagatgcttccagagtatcacacttagtttcaacttggtcctctcaccctgttattccttgtccccctagcccaaaggcaggaagagagggaaacctaaaaaaaaagtcaggcctgggggcaacattcaggaatgttcctgtctaggaaggcgatggaaggggtccaaggacagatctccctcctgatctccctaaggctttcagagcttgttgagtcgacactttatcctggccctgatgaagaagcacccctcctgccccca

SEQ ID NO: 204321 - DNA, 471 bp, Homo sapiens
ggaaaaacaagagtgggattagctagtggctatgagggccaagctgaagttctgtaatgtgtacttgctgtgtgcccaagtccacatagttttctacagcccagaccccataccaaggtcacagacatatacacagactcacacacatgcgtacatgcacacacatgcacctgcagattcacatcctggaacacttaaacacatcaatctcgacaagggaattatttattgatctacggttttcatacagtgaagtatataggtctcaagtgttcagtttggttttgacaaattccacccttgtaacaaccacccaaaacaaactataaaacattgccattattccagaaagttctctcatgctcctttccattcatctgccaagacagctatttcctgatttctatgatcgtaaagttgctttgcctatttgtcatcggataggaaaatatacaaatacattgacagcct

SEQ ID NO: 204322 - DNA, 98 bp, Homo sapiens
tgtgagcaaaggactctgtgtcataaataagtttaaggaaaggtgctgtgcctggatgtgcacataggccagatttatgtttgactttacacaaacat

SEQ ID NO: 204323 - DNA, 482 bp, Homo sapiens
  misc_feature (5)..(5): n is a, c, g, or t
tcagnctagaggaccccaagcagttatacagactcacatttgaaatacgttagggagtagaatcttgggtaaaagcctctaaaaaggttgtgtatattagacattctcaaagtgcggcacccataccatagaattaaactccctgtttcagtcctgtgttttgaaacacatttttactatccctggaaacactttcacatttttgtcagacgttgagtgagcaacagggtaaataacttttcaaaagcatttttagagtagtaaaaccttaagttccttgctagaagggctgatccaaaataaattaaatgctggtatgactaagccaagtgtggcaaattctgatttgcagtgtggacacctccagttaatagatctattcagtgattcaacatgcacctccaagtcgtaagcctggcagcaaagtataaatttgagacttacaagcattctctgatctctgagtctgtattaactgcttg

SEQ ID NO: 204324 - DNA, 606 bp, Homo sapiens
tgtgagacagagttttgctcttgttgcacaggctggattgcaatggcaggatttcagctcacctcaatctctgcctcctgggttcaagtgattctcctgccttagcctcctgagtagctgggattacaggcctgcaccaccatgcctggctaattttgtatttttactacagatggggtttctccttgttggtcaggctggtctgaaactcccgacttcaggtgatccacccgcctgggcctcccaaagcgttgggatcacaggcgtgagccaacgcgcctggcctcactcactttattcatgtgtgtgcacatatccccctagctattcttttgtaatgttatgtagtcagatatatccaaacccagcaccatgctgctgtgggaccttgggcacattatttaatctctgtacaccttaatttccttatttgtaaaatggagataatgtaaatagcattaggcatagtggctggcacaaagtaagtaaataataaatgttagctgtgactcttattagtctatttatgtgacttttgtgttttgtgctctacttaagactttccttactccaaaatgtaaaatattcacctatctactaaactag

SEQ ID NO: 204325 - DNA, 717 bp, Homo sapiens
agctttgttggacaatgaggtggccaggaatgttatgctgcttggggcttccaggcactggtttcctctttgggaacagttcctcaataaaagaaattgaacgagtacattaagacctgttcagaaagcagctcaatggctaggtgtgatggcttatgcctgtaataccagcactttgtgaggctgaggcaggaggatcccttgaggccaggagttcaagattagcctggacaacaaagtgagacctcatctacaaaaaataaaaaaattagctgggcgtggtggctcacatctgtggtcccagctacatgggaggctgaggcaggaggattacttgaggttaggaggtcgaggctgcagtgagctctgattgtgccacggcactccagcctgcgtgacagagtgagaccttgtttcaggggaaaaaaaaaaaaagaagaaagcacctcaactaaatggagacctttggctgtgtccttgtgccctctgcctttgtgcgtggggagtaggtgtgggtgggccctccaggggacgctggttttgggtcactgtagcccgcatgatttggggatggcactaggctgtggcgggcgggaggcaggttcccgacaccattcatcatggatgaacaatgtcttggggtggttccgtgtcagtccagacctcattctgtttcatgactgtgcaatggctgctgtcatactgctgggggtcagg

SEQ ID NO: 204326 - DNA, 357 bp, Homo sapiens
ccctcctttctttttctttctctttctttctttctttctctctctctctctctttctttctttttctttctctttttctttctttcaagcagtctcacgcctgtaatcccagcactttgggaggccgaggcgggcggatcacgagatcaggagatcgagaccaccctggccaacatggtgaaaccccgtctctactaaaaatacaaaaattagctgggtgtgttggtgcgtgcctataatcccagctactcgggaggctgaggcaggagaatcgcttgaactcaggaggcggagattgcagtgagctgagactgcgccactgcaccccagcctggcgacagagcaagactccgtctc

SEQ ID NO: 204327 - DNA, 205 bp, Homo sapiens
aaagttattcggggtaatgattccagtgatccatctgcgctggaagtggggcagcttttcctcctttgcacgttaccgcccatattaaagtgtcatatgtaaatgattaagccgatgaacagttttatttcctccagcagctgacaattccacaaaatggagagattttaatttaaaggggcacaataaagaaaacccttctggg

SEQ ID NO: 204328 - DNA, 168 bp, Homo sapiens
cacagaataaataaataacactggtattacaacataattcaaaagacttaaagaatgcagtatttttgttttagaaatcatcaaaaaataaattcttagctccatttccccacttataaagcaatagatctaccagtgttttaatttcatatcatacaaaggtagaaa

SEQ ID NO: 204329 - DNA, 301 bp, Homo sapiens
tgccctgcctccccaagcgcctgaacacggcggcggcccgcagagcagaaacgcagcacatgaactccagcacctgcctgggctcagggaggacacagggcagcaagcccacgctaggtcctgccatgctgagctcttcccctgccccaggacggagacccgcctaggcccggggcggtgccctccttgtctgcctgtcccgccgggggcagcatcatttcaaacgctgaccctgccagccctcccctctccaggcagggtcaggtacacatctgttaaaaacttcgtagaaggaaaacat

SEQ ID NO: 204330 - DNA, 398 bp, Homo sapiens
cagcccagagtcaaggttgcccagagcttgccacctacacctttgtagccaaagtcagaccttcttattagctcctcaccccaaccgattcaacaagtatttgcctactgtgcactcaacactgatctaagcaagaatacgaccacacacaaaacccaaacctctctgctctcccggagcttatagtccagtgggtgccaatctgatcacactctttctccacctgaccaaagcaatctttaaggccagtccatacccaccttggcaatgagcccttccctcctgacccccagtttatcctggtttcccatccttggggctccagattcgttttatttccattcatcctgctggttacttaactaaagactgcagctgatcagtcagcccaattcatc

SEQ ID NO: 204331 - DNA, 333 bp, Homo sapiens
cgcgcgagtttcagggtttgatgaagggtttgatgacagggtttgatgacagggtttgatgatcatcgaaaccctgatctaagcaagaatacgaccacacacaaaacccaaacctctctgctctcccggagcttatagtccagtgggtgccaatctgatcacactctttctccacctgaccaaagcaatctttaaggccagtccatacccaccttagggtttgatgagtcatcaaaccctaatctctatgcgtcatcaaaccctcatcaaaccctaacctgcggaaagcaatataagaaggccccccaaataacgggtttagggtttcgatga

SEQ ID NO: 204332 - DNA, 538 bp, Homo sapiens
gtccacgttcagaaagctctcttccctcatttctctactcttgacatttattcagcttgtaaagaaaaggatcctttccaaaacacgtcttcagttttttaataaaccccgcaattcctttaatgatttcagattatcttaaatatttataaaaatcactctcagcaacacttctttaagcaaacctcctcatcaacttcgattatttatatatttatgaacacgatgttcaaggagcagatggcagctagtaagtcctccaaaagaaggaaaaaaaaaatcaatgggacagaatgtaagctccatgactcgtccatgtactcttctcgacaagctctggtacaattatctttccattcagcggaagcgccacacaaaagtccacaattggtttaaaatagcacacttggacttcataaagcttggaggctccaagtttaatccaggaatgacctgccagccaagggctctattcccaaaggaaactgaagctctgtcaggggagggtaagacattggatgcagggacagatgatggg

SEQ ID NO: 204333 - DNA, 1188 bp, Homo sapiens
aggagatgacggccagtgtcccatggtgagctggggctacagggcaagttaccccaaaaccagcagctgaaaacctgcatttatcaccttggatttctgtgtattgggcctcaggctcagctcagccaggctccctccttccgtctcagccgtgggccggggccgccgtctcatctgaggcctcatgggggctctgtctcagccgtgggctggggccaccgtctcatctgaggcctcacgggacaggatcctcccaggctccctccacgctgcaagggcctccccacgggctgctggcatccttagcacagggagctggtggtcagagagccacacccaggcagaagccgccctccgggagtcctggtgtgagggcagagccacgtgaggatgtgcacatccagaggggccttgtcagcatctttaaattgcgagtgaagtcggcccgggacggcttcgaaaactgcctctgaacttgtctgacaagtacatactgtctgtttcatgggaaccaacatctcagagatcccacacaacgcttcctctttagagaagaaaaacacagcaaaacaacacaggcagcctctgtttaaacgcacgtggcccccgcaccccgcctggaagcctctgcacgtggccttcatctggaagcctctgtatttaaacacatgtgggcctcctccatctggaagcctctgtatttaaacacacgtgggtccccatcccccgtccagaagtctctgcatttaaacacacatggccccccatcccccatccagaagcctgtgcatttaagcacacgtggtcccccgtctagaagcctgtgcatttaagcacacgtggtcccccgtccagaagcctctgcatttaagcacacgtggtcccccgtccagaagcctgtgcatttaaacacacgtggtcccccgtccagaagcctctgcatttaagcacacgtggtcccccgtccagaagcctgtgcatttaaacacacgtggtcccccgtctagaagcctctgcatttaagcacacgtggtcccccgtccagaagcctgtgcatttaaacacacgtggtcccccgtccagaagcctgtgcatttaaacacacgtggtcccccgtctagaagcctctgcatttaaaccaacgtggcccctcctctggaagcctctgtatttaaacacacgtggccc

SEQ ID NO: 204334 - DNA, 551 bp, Homo sapiens
  misc_feature (9)..(9): n is a, c, g, or t
  misc_feature (12)..(12): n is a, c, g, or t
cagctgtcnccnggagtaggatatgtcgaccaggcgtcgagctcccatctggaagcctctgtatttaaacacacgtgggtccccatcccccgtccagaagtctctgcatttaaacacacatggccccccatcccccatccagaagcctgtgcatttaagcacacgtggtcccccgtctagaagcctgtgcatttaagcacacgtggtcccccgtccagaagcctctgcatttaagcacacgtggtcccccgtccagaagcctgtgcatttaaacacacgtggtcccccgtccagaagcctctgcatttaagcacacgtggtcccccgtccagaagcctgtgcatttaaacacacgtggtcccccgtctagaagcctctgcatttaagcacacgtggtcccccgtccagaagcctgtgcatttaaacacacgtggtcccccgtccagaagcctgtgcatttaaacacacgtggtcccccgtctagaagcctctgcatttaaaccaacgtggcccctcctctggaagcctctgtatttaaacacacgtggccc

SEQ ID NO: 204335 - DNA, 422 bp, Homo sapiens
acgcccgcctaatttcattcatactttgggaggccaagacgggcggatcatgaggtcgggaaattgagaccatcctggctaacacggtgaaacccgtctgtactaaaaatacaaaaaattcgccgggcgtgttggcgggcgcttatagtcccagctactagggaggctgaggcgggagaatggagtgaacccgggaggcagagcttgcagtgagcggagatcgcgccactgcactccagcctgagggacagagtgagacctggtctcaaaaacactcctaatttcaacatcaatttccttgtgaatctatcttatttttgtgtgtcagaaacacttttggatttgaagataatttcaaaacaatactaactctgtatttttttaaggtattattgtttacttatgtgttatgtgtcaaaaaa

SEQ ID NO: 204336 - DNA, 461 bp, Homo sapiens
atgtccaacctgataattggttaagtcggcctcataagcttatattcttagcttctaggtcattccttgtttctattggaagccagaagacattctgttacagtcagggctttagagtaggagtggaccagattggattattctgtattccttccacttttagccttactattagtcaacatagggattgtggaccttcgtcctaggcagtgtaagtcttggaaagaacagatagggcctcctgcttctatttgtgaggtcttgagcatcacaatctggggcctgacaagggcatgttctttgctcagttgtaaagagggatgccttgggttgaaataaacatgcgtcacatgtatttatgtacgtgattattcacaatctaagttaaaagtgacacacagatcactttctttcattaccaagtataataaaactacccttagagaagccaattttgtctg

SEQ ID NO: 204337 - DNA, 247 bp, Homo sapiens
tatccccattaaaaaatggaaacagaaatatctattttttatgtataaagaaacatgtttgagacaaaaatagttgtatataaaaggatatttcataatctcagaatagtttatgctgtgggaggagctaattaaactcatttctgggcattttacagtctatgaggagcttagagttttctcctttctgctagctctcttagaacaatacagacagcttctgtctcctccctgcgccagttattat

SEQ ID NO: 204338 - DNA, 476 bp, Homo sapiens
catatttcagcacattcctcagtttataatgttaaggttttaagaaagcttaaagaaaccagcatcactggtagttaagcggtttatatttttactgtattttcttcagaagcttgttgccatgtagagtaaaagaaacctcatgttaatcttttcagaggacactgccagtaagagtgttgttattgttagataatcataatggtatgttctggagtctcttctcccctcactcgacacacccgattcactcccaccctgccagcggagccagagagagaagaataaagcaggatcttatttgctttcagaatttgattctgtattgctttggagacatgctgggatttgttcttaaactattattaaatttctaatgtccgtcaaggtttagattcctttgtaagagaaccaagaacgtaagtgaaactgtaaggcttcgctgtgcagacctttcttccagcaagcatcagctt

SEQ ID NO: 204339 - DNA, 225 bp, Homo sapiens
tatctgaggatcccttcgggcagtatgttgatctgtagttacatagtacaaaaacatttcaggcctgcttctctatattctacctttagtcttccaaagttaaacgttctgttttccttaaccattcctcatatgttatatttcccctcattttggtaaccctcttctgtgtgctgtctagtttgttaatatccttcaagtacagtgttcactgctagccccagc

SEQ ID NO: 204340 - DNA, 223 bp, Homo sapiens
actcctcattgtcacatggcagccgtgtgtaaaccaaggtccgtgtgcacaacctgctgtgggccgccgctgtgtgtcttctctgccttagggcaggggatggcgagctatggcctatgggccaagagtagttcttatttttgtttatttatttatttatttttattgatcattcttgggtgtttctcgcagagggggatttggcagggtcataggacaatag

SEQ ID NO: 204341 - DNA, 359 bp, Homo sapiens
aaattcctggttggatacttccgatatttctttcatatctgagtctggttctgatgcttgctctgtctcttcaaactgtggggtttcttgtcttttagtatgctttgtaattttttgtttgaggctgtatatgatgtactgggtgaaacgaactgagttaaataaggctttagtatgagattttgtgtttctctggctaggagttaggctttgtttactctttgctatatagtcatggatgtcagaggctaaaatttcctctagtgtccttgtgttgtctcccctgtcttctctggggagctccctaaaggcttctttgtaaagtagctctgagtcttgcagtgtctatccctaatcat

SEQ ID NO: 204342 - DNA, 352 bp, Homo sapiens
catcctacaacatgcagctggcctacatcttcacaatcggagcatgcttgaccacctgcttcttcagtttgctgttcaggtatggaagcatctacatttcctgattctgagggtcatgttagatttcagcaaaaatccaagaaattcaaaaattacccaggtaacagtttctctgcagtcctctcctctcctctcctctcttttcttttctttcttagatagagtctcgctctgtcacccatgctggagtacagtggcgcaatctgggctcactgcaacctccacctcccaggttcaagtgattctccttcctcagcctcccgagtagctaggattacaggcacctgccacc

SEQ ID NO: 204343 - DNA, 545 bp, Homo sapiens
tggggaggcagaaggcagactgatcacttgaggccaggagtttgagacctcatgtctaaaaaaaaaaaattctgtgaggtgagttttattgttattccctctctacagatatggaaactgaggctgagaatcagaaccattcacaagacaaaaatcccccagttggcagatccagggttgcaagccaggcctgtgcagccccaaaaccagtgcttgtttaaccactgtgtggtgaccacaccgctccaggccaacagcttggggctaagtcttcacgttgcctttcaccattaataatagggctgccctttgttgaagccctgcactcccagtgacggccataataaccttcaggtgttctgctttctgccttctctagcatggccaagtatttccggaacaacttcattaatccccacatttactccggagggatcaccaagctgatcttttgctgggacttcactgtcactcatgaaaaagctgtgaagctaaaacagaagaatcttagcactgagataagggtaaggcgagctcactttact

SEQ ID NO: 204344 - DNA, 412 bp, Homo sapiens
catcctacaacatgcagctggcctacatcttcacaatcggagcatgcttgaccacctgcttcttcagtttgctgttcagcatggccaagtatttccggaacaacttcattaatccccacatttactccggagggatcaccaagctgatcttttgctgggacttcactgtcactcatgaaaaagctgtgaagctaaaacagaagaatcttagcactgagataagggagaacctgtcagagctccgtcaggagaattccaagttgacgttcaatcagctgctgacccgcttctctgcctacatggtagcctgggttgtctctacaggagtggccatagcctgctgtgcagccgtttattacctggctgagtacaacttagaggtaaccaacaccagggtccagggcagagagaa

SEQ ID NO: 204345 - DNA, 414 bp, Homo sapiens
tctgttgggacctgacctctagtcattggttaccagtgtgtcaggcaatctggattttccagtgatgccgctgagatggcacctgtcaaaagagtagtggttccatttctagattgtggatattcagataaattctgccattttcatttcacttcatgaaagtcaggttcagcctgtgaaaagttgttaaacaacatgctaaatgtgaaatgtcaaccctcactctaaactttccctgttcagagcatcagatgaagacttcagtggctttctgatttttggtagtccattgaagaagggagtttgaaagttgttgtatactgttaacgattgtctgcccatgtcctgcctgaaatgccatgattgtttatggaacgtatctttaataaagctggatacagcttgaaaaaaaaa

SEQ ID NO: 204346 - DNA, 209 bp, Homo sapiens
tgatagatcagtaggtcaaaggtacacggaagaaaaaatattaaccagttaaagtggaatatatttgagggccaaatgaggacatgcaaatttgagaaattctgaacatttaaattcagaaatgtcatggatttgttctgtaacataccctatatctcacaaacaggagttaataacccaagagataccatatctcaagcatctacttt

SEQ ID NO: 204347 - DNA, 1234 bp, Homo sapiens
atggtgtcaaaagttacacggaagtagccaactttttactgtatggcaaacatacctgctagcaacagcttagcttgagcaacaccctgagagttaccctatggtttaagaggaatgcgtgttcagagttccaagctaaggaatccaggagtggccaaccagagattcattccttatctatgaggaacatctgagcccacggcctgtcccatggaatgtgggctgtcctggggagtcagaccctttgttttgggttaagtgaaggtttccaggtgaagggtaagtgaaaatggtacataaattgcatgctttctgaaggtggtctccgtgctcctgtccagcctgccaccactggaacactctgcatgtaagttcttctcaataaaccctatgtctcatttgctgactcttgagtctctccttcagcctcttgaacctggtgccatctctactgaagtgaataggggtctggtacgacaatattcaaatctagttctcactccaaagcatgtaattccaaagcccacactattcctacattatgatgcctatttcacttcatttgtctgactcataggaacctgtttaacctccttgttaaatagaacattataagaaatgctgccataccttaacacagcagagtactatataaattcagatggcattattgtaacatatctttcattcagttgtctgtgaagaacagatagtagtttatatatttgtgaaactcagcattaagattttgatattaaaaagacagggaaggatactctgtgataaatacgaattaggtcacatcattctatgcttggttatgctgaacaacacggcactgaaaaaacagagaatacctgtaagattatttcttctaaaggagaacctaaaggtaaacctagaacttggatgactctacaaataagggccctggaaatctacagggcgtcttccctttctaattttaaaaatataacaatcgtgtttactatatctattgtgaaatacaattacagggtactatgtaagatgctaaggggtggataaatctcagaataaataaataaaagtaactttccatggactgagggagacggtcaccatgcagtacgccacagttccagggcatgactgtagagcagggaaaagtactgcaaagacaccaatctttctttgatgtgtgtccctttcttccctttgagttgggttcctgctgatcctgagggaacccctc

SEQ ID NO: 204348 - DNA, 470 bp, Homo sapiens
taaacacatcatgctactgtgcaggtagttgaagcataaaaacatcgcactgtgtattagccatgcatatgggtgagaattaggctaataaaaattcactgaaagtgttttgccctgaagaaagcaaggtgcctgccatttcttggagtttatgtgttgacagtgttaaaaaaaaaactggagtgtacaaagaaagttgtcttgcttcctactttatagcctccatctggtcaggaaaggagtaaattgaccacatctgctgcaaatctgtagctgtactattggacctttcagctttgtcactaactctgtcttatccccaagatctgggatactatatcctgtacaggagtatgccaattttcacaacttttgtactcttctctagcattcttcaaattcatattcccttgggcatcctataggataagagttggaaaaatttttatttaaagcaacagataataaat

SEQ ID NO: 204349 - DNA, 492 bp, Homo sapiens
caagcagccactaataataatttggagtcaatacatcagatgaaatctttatcacccttggaaaatatatttttctgaatctcatctagtttttagcttctcgacttcatctacacatgaatggtgaggctgtagaagtctgtttcttgtgaatgacctacagataactggcaagcttggtaaaatctcatatcagagcaggttgaccaggtgatttgactagggaaggaaaggataagattagttagggttggccatttgccaggacaattgacctcaatatctctaagagctggaacacaaagttgatgtcttgctcatgaaataatccaagttgactccaggcttgggggatgggagtgtatgagttccattctgcacagtcattagggattaggaccaatagaggctctgtcttcttaaacacctgacttcccacatcactgtgggcatttgcatccacctggtggtaagggaaggagcatggaggaa

SEQ ID NO: 204350 - DNA, 175 bp, Homo sapiens
ttcactgaaacaggctcatgtctgactttggaactgacctctctgcctgtagatcatcatggcatgctctacaaaattgcttctgacaacggaattcactttacagtgaaagagggaaagcagtgggtgatacccttgtcaatggatcctgtcacccagaagcagtcatctgtat

SEQ ID NO: 204351 - DNA, 447 bp, Homo sapiens
agcttccaggtgctttcattttcagcatgatggctgccagctgtttaaaattcacgtaaaatcctcttcacctgttgactgaatgcatgttttcactctttggctgcctcagtcactgtgtaattcgtgtcttggtaaattttaccttgaagagaaagtcttaaaattatagaaatagaggacagattagttctcaccaggggccaagaagaggaaagaggggaaggggagtgggtgtagccataaaagggcaaagtgagagatccttggggtgacggaaattttctgtatcttgactgtatcaatgtcaatattttgattgtgataattttgtaatattctgtgatagtctgtaatattctgattctgtaagtaggatttctctgttatccttaaaactgcatgtgaatctacaattaccttgatttaacaaatggttttctgtaa

SEQ ID NO: 204352 - DNA, 621 bp, Homo sapiens
attgctgacaaaacacaatagctcaaagaagaaatcaaaaggaaaatagaaggtattttgaactgaagaaagatacaacatattaaaagtgtgagttactgctaatacagtacttaaatgggacatgttgtcactaaatcccacattataaaagaagaaagatcttaaatcaatattagcttccactctaagaaactaatgaaggaagagcaacagaagtccaaagtaagcagacaaagggaaataatagaaagtacagtggaaattaatgaaatagaaacagaaaatcagtagagaaagataaacaaaccttaatgctcattctttgagaatatcaatgaaactgataaaccttgaagtggaatgagagagagagagaatgagtgcaaattagcaatatcaagaatagcagtaatcactacagattctaaagatttgaagatcattaacaacttcatacctataaatttgacaactcagatgaaatggataaaatatgtgatagacacaagttataaggctaactcagaaaatttaggtagctttataaacatgtatctatatcaattttgaaaattgagttggtagttaaaacttcccttaaagaaaatgcaatgccca

SEQ ID NO: 204353 - DNA, 1388 bp, Homo sapiens
tctcattgagaatgtttcctgtgtacctatagaaaagcctctttggtagattttccggtttataattatttaaccagaagatacatgggaggttcttttgtatgtacctgtagaatacatcccagtaagggtcctatggagaaagacctgttgtcatcaataaccttcattattctaactgtgaaacgttcattaatgcgaataatatcctcaaagattttctacaatgagaatcatccagtaaagctttttaactgagaatttaaaagttgtaaaattgttagttaaatgtgtataattatcaaaagaggttgactttggaaaacaaacaatttgctaagggaaggaaaacttgaaaataatcaccttagatggggcatacaatttgacctaagcaattgtttcaaaactgtcttcagtttcttgaaaataattgttagggctgatatatagaaatacatatctaggccaggcacggtgactcatgcctgcaatcccagcactttgggaggctgaggtggatggatcacgaggtcaagagatcgagaccatcctggtcaacatggggaaaccccgtctatactaaaaatacaaaaattagctgggtgtagtggtgtgcgcctgtagtcccagctactcaggaggctgaggcaggagaatcacctgagccccggaggcagaggttgcagtgagccgagatcgtgccactgcactccagcctgggcaacagagcgagactccgtctcaaaaaaaagaaaaaaagaaatacatatctaatgttacagattgtggtttattggttaattactatgcatttttttcagtttaaaaaataatcttattttatatacttctctcggtataatttttcatgacatttcagcatgttgataatatgtgtgcatctatttcagtgccttaaagtattttgagagcaatcttttgctgacagttgaagaactgttaatgaaatactgttcattaaaaggatctgtgaaatcatttacccttgttataaaatagttatatgcaaatacacttgtcattttatttggcaaagtcattcagtttgataatcaacaaacatttattaggtgcttttgctttaaccaacattactttcatttaatactcagaaatgtaaagatgtgctatttttgaatactaactcaatgatatgtttaatttttcatttattctttgtgttatcagctgaactagcatgaagactctttagtagggtttactcctttgttcttttcctaagtacaaaccattttatgaaaaaattgctcattgcactaaaccttcagatggaaatggcttattcagtagaccagtatttggctttgtcatttgttttaatgtattttttgcacagataattt

SEQ ID NO: 204354 - DNA, 442 bp, Homo sapiens
aaggtcaaaagatgcctaatactaaatgaattaaaaatgtctcctaaatttcagctaccagtttgagctcaacctagaatagaatactacatatcaataagcagagttcagtcttaaatgattacatgacaaaggaaactgaatatgcaagccccagaggaagctcttttggctgtaagtactttaatcctgccagaaattttaagaattcacaagccatagagaatatttaaatcacagatggacggggttcaataaagctccagaactggcctttacagatatttaaacatcattctgaacttaaaaaaaattaaataacaaacgctattaattccacctttcaaaaactacagcaggctactccgaatgactaaagaaatacattcttttgcttgtagacaatctagaatcttaaaaacagaaatgaattacaaacaat

SEQ ID NO: 204355 - DNA, 366 bp, Homo sapiens
gatttgatatttttaaaatgccatcttaactgttttattttccatttcattgattgctggtgaagttgaaactctttgtttttcctcttttgtgaattgcctattcaaaacctcatttatatttttttcttttcatttccgtgtctaataagtcctttatgtatctaagatacttaattttgaagcagaaatgatgtggccaaatagtttctttattaatacccacctgactgtaaatgaaataacttggacaaatagatatatttacttactaatttattagtttagtcaccagtatctatcatataacttgctttttttatactaccttgctaaatgctttaataatgtggcaaaaaaaaaaaa

SEQ ID NO: 204356 - DNA, 447 bp, Homo sapiens
tgattcgtttcacatttttgagaaataggggctggaatggagtgagcaaagatctaagtggcagggcatgctatctgaacagtagcaaggggcaagatcatgcaggattttattctgaggtggaaagccattacagcattttcagaaaaagcatgatatggggccgggcatggtggctcacacctgtaatcccagcactttgggaggccgaggtgggtggatcacctcaggtcaggagttcaagaccagcctggccaacatggtgaaaccccatctctactaaaaatacaaaaattagccgggcgtggtggcggacgcctgtgatcacagctacttgggaggctgaggcaggagaatcgcttgaactgcagaggcggaggttgcagtgagctgagatcataccactgtactccatcctgggtgacagagtgagactctgtctcaaaa

SEQ ID NO: 204357 - DNA, 395 bp, Homo sapiens
tctcaaaaaaatttttttaaaaaatgccataagtttaaaaagaaaaaaatctgcttaaacttcacaaccttaaaaaaaaaaaatactggctgggtgtggtggcttacacctgtaatcccagccctttgggaggccaaggctgggggatagcttgaggctaggagtttgagagcagcctggcaacacagcagaaccctatctctataaaaatgcaagataaaaaaattacccggccatggtggcatgtgcctgtagtcctagctactcaggagacccaggtgggaggactgcttacacccaggagcccaggagttcaaggatgcagtgagctgtgattgtgccattgcactccagctgagcgacaaagcaagaacctgtctcttaggaaaacgaga

SEQ ID NO: 204358 - DNA, 407 bp, Homo sapiens
tcttctccagacaagcaaaagctgaggaaattcatcaccattagaccaccctacacgaaatgctcaagggaattctaaacctggaagcaaaaggatgacatttgccaccatgaaaacatacaaaagtacaaaactcactggagtaaagcaaatacacaaagtaagaagaaagagaaaggactcaaaccacccctacagaaaaccacaaaaccacaacgacaaaaagaaaggaaaagaaagaatatacaaaacaactagaaaacaataggacaaaaacaaaacctcacatatcaataataaccttaaatgtaatggattaaattctccacttacaagatatcaactaggtgaatgaattaaaaaacaaggtccaactacttattgcccacaaaaaacacacttcacct

SEQ ID NO: 204359 - DNA, 194 bp, Homo sapiens
aggcaaaaatcaaaaacaaccataaacaatgctacattgtctaaatgcatttattcttcaagaaatatttgttgaatgcttatcacaggctaagcacaaaaagtaaacgaaatagatctaatctctaccttaactaagagtttacagtctagcaaagaatatagacttaaatagacaatcagaataaattgtga

SEQ ID NO: 204360 - DNA, 191 bp, Homo sapiens
gctattttaaaaattacctctcattttacagtagttacatgtcttatcttgctaaaaactcaagaaagaaagaagataaaagagcacaatcgccaaacctcacacgctcagcacagttccctcctatgctttcaacgctgagcatcctgatggaactcactatccatctacatatacgtgtatctttcaag

SEQ ID NO: 204361 - DNA, 572 bp, Homo sapiens
taaagatacaaagagaacaaactgtctccgggcccaagtaagacaagctagtggtcaacacctggtcccctgcagactgggctggtttcaggacccttcccaaggatacatattctaagatcagtgccagctgggtgttcccttctggtcaagtggagacagtcctagaactggtcctctccatggagttcagcacgttcattgggctgttgggaaaccattggtttgggctccagcataagccagggcaaatcactttgcctctggacttttccacattgataaaatgaagtcgatagcaatacctgctttgtagttaccaaagtgctcttccatgcattttataataacttcccacaatcccacaacaattgtgaaaattaggaaagcacagatcagatctgcttagcatccaccgactgtgaggatgtgaagctgaacaccaaattacagggtttcaaacctcaagccttggtgacttatgtttgctaccttagttggaattaatgaaatcattacagaaattcctgcttcatttctggaagagccctcaggggaggttctaaaaatgg

SEQ ID NO: 204362 - DNA, 490 bp, Homo sapiens
cactcttggtgcaggcttctgcattttccactctgtgatggtgggtttcacaaggacaggtagaagagatggctaaggggaccaggcctgctcgcctgatcaatgggctccacaaatgaccccacagcaacagatactggatatgttgttgttgttttgagatggagtttcgctcttacataatgcccaggctggagtgcagtggtgcgatctcgactcactgcaacctccacctcctgggttcaaatgattctccttcctcaggctcctgagtagctgggattattggggcctgttaccacacccggttaatttttgtatttttagtagagatggtgtttcaccggttgcccaggatagtctcacttctggacccaaccaatattcccgccttggcctcccaaagtgctgggattacaggcatgagctagaatgccaaacgaattttttttcctaaactacaaccttttttacaacccagaataccttg

SEQ ID NO: 204363 - DNA, 370 bp, Homo sapiens
tacactattacagcataaactattgaggagtatcctgaggcatgggggtcaggggttgaggtcttggagagtgttttagtggggttagcgatggaggtaggattggtgctgtgacagcataaagaattgatgtttagtattttttcagatccttcttgtgactcatagctatgatcatattattttactcctttgatctaaggtaatatatattaataaacttccaaattagagccacgttagcaatcccaggatataccttatctagttgaattgttttctccctaccactcccaatgtttgctggtatttacggtttgtacttcaatgttcataagtgagatcagtttgatttttcttttttttggtc

SEQ ID NO: 204364 - DNA, 443 bp, Homo sapiens
tgctgggattacaggtgtgagccaccgcacccagcccctcttacctattcttttggaggagaaaaaatcaagaagccttcccaggttgtaatttcccaagctgttttttttgtccagctcctctgcatatctgacaaaatttcccatagcatctttcagtaacacttttatcttgctcatacttcccccatcatcacaattacacttatgttcacagggtctctggggcttgctgtcattccttcatctggccaaaaaatgcttcttcctgaaagccccgagtgaagcattctcctggttctaagtacagttcattagctccccggtttcccttttctcctccttcaagtacacagataactaatctaaaatagggccttcccagtccgaaccgttggtatcaagtacacaggagtgccatagccttgaatctaattacctag

SEQ ID NO: 204365 - DNA, 417 bp, Homo sapiens
taaggagccctgacactgagataaaccttgttagcatctgctgctcactctggatgcctgccctagtgggagagcccttatgactcccatcctactctgcttttctattgttctgcaacacattgaggaatccaaagagatcctagagataacccatcctcagtcaacacattttcctctctccttttcttctcttctcttctttctttctctctctctctctttctttctgacagggtctcactccgtcaccctggctaaagtgcagtggtacagacgattgggaggcaggaacactgaatgtcatcagagaaagtctcttttttggaaggaacttttaaatcaagacttaaagaaacagaaggagccaaccacacaaggatggtttggaattgagttccaggcagacggaacatc

SEQ ID NO: 204366 - DNA, 480 bp, Homo sapiens
gggttaaaataatctttttgtcctttcaaaatgatagttttattaccacagaagactacttatccttaatgtttgttatagttcatttttgttactaagtagtttgtgttaatctccagatagaatatttcctttcaaggtccaattctttggttcttgtgtaatagtcaattactgttgactatatatagccccctgaagctttcatgtatcacaggtagagtttttaactgcattctctgtgtatgtcgctataatttgtacatgtacataattttcttattttaagatgccaaactaagcacattgtagacattttggatgaaattagaacaaatgattgtgtgccattaataatagatgtggattggcattctgaccttaaaggataaaataagaggtgtggttagggctgggtgtggtggctgatgcttgtaatcccagcactttggggggctgaggtgggcggatcacttgagg

SEQ ID NO: 204367 - DNA, 518 bp, Homo sapiens
aattttctcaactaggtggttgcctttccaagcttttgtatacgtgactccatttaccaagaatcattcacataccatctttgtggtttttgccctggccatagatcccctgtattatttgctcacattttagttgactcacttttacatatagcaaaattgtttcacaaaaactacattgtcactattaaatacagaaagccagtgtcagttgcaaatagaaaaaacctcgagtcgtccaagaatccatcttactccccacagtaaaaaaacatcgcacctttcgggttcaaccttgaacaaccactttcatgaattaataagctgagggattgattacttctagaagttaagattcattatttgttctctctaccttggaaaagctggtagaaatgtctgcagctttggataccaaactaaccatgtagcacttagcagagctttgggataacagataagtgacatttagcctggggcttgttttgaacaggagaaactgggtaaattcaggaagc

SEQ ID NO: 204368 - DNA, 599 bp, Homo sapiens
aatttaaatgagtgtctgaatgctggtgaaggcagagcctgtctatctcctagcagccatctttgcctctgacagttcacatgtggcattgttgtgagaccattgcttctctctcccttagaggttttccaggtgctatagttcttgctgttgtgatttcaaagtagagacaaaataggtagggacaggaagattgttcttggatttcttctgaaaatgagagaggtgggagaagagaatttttaaaatatgtagtatcctgaacagaccaagcaacattccccagaaaacaagagataccactgtgctcaagaaactttctccctaaattgagttgattatgataatactagattaagtaacttgcccaggttcacagagctaactcttgattctgaaacctgtatacttaacttttactgcctccctggtacgtagtgtaggttgtcatatattttgtctgatttaggagcagtgtgataaagtacaggataaatggctgtccatcatagatttggactcctcgtggtagatggtgtaagacttgaagctaattactgtttcctctctaatctctctctagtcagcctctcctattt

SEQ ID NO: 204369 - DNA, 284 bp, Homo sapiens
ctagaaaataaattctgtatcttttagggaaggtcactgccctgaccctgtaatgcttctatccccgcaagtcccaggtaaccactaatctattttctatctttatagatttgcctattttggacatttcatataaatggaatcatagaatatgtggtcctttgaaactgtaagattttaaacagtttggttaatgctcatataacctttgttttttgaagtctatagacagctttgctgcagcacaaaatctattccacactatatcagcaaagtactgcatt

SEQ ID NO: 204370 - DNA, 367 bp, Homo sapiens
cgtctgggctctgtgcccgccgccctccccggccgttcgcccgcgagtccctttcgcttttaaccccagccgcgctgattgcctgcgattactcagaatcgcccccacttggctggctgagcgacaaaaatcagcagtagctgtccgaggaaagctcttcgcaaaccggcgcccccacccagcggaaacaccccaagccggatcccagaaatctcagtcttctcccaaccccggctctgcctctctctctcaatgggactcgtccgggtctcagtttgcccatctgtgcagacggtgtgaagaatttctgcacaatcgagaaaaaaaggtgtggaaacagccgaaaataattttgatccgaaataac

SEQ ID NO: 204371 - DNA, 242 bp, Homo sapiens
atggccttctaactttaaacagatccctccctctttcttcttctctggattttagtttgcccatctgtcaaaaatcgggttgaattaaattatcgttggagatattttagatctaagattagaatttgtctaaaggtctaaaagcctcggttaaaaaaaaatccccttcctaaaatgctactaaatgtcaagatgtgcttttcgtagcacaggtgttccagaggatttaggaaaccgaagca

SEQ ID NO: 204372 - DNA, 782 bp, Homo sapiens
acatggataagttcctggatgtatacaacctaccaagattgaatcagaaataaataggaaacctaatcagaccaataatgagtaacaatattgaatcagaaacttaaaagttttacaaaaaaggaaagtcccagaccaaatgacttcactgccaaaattttaccaaacttacaaagaagacctaacaccattctcctcaaactattcaaaaaaattgaagagtagataattcttcctttactcttctacaaggccagcattactctgatatcaaaaccaaagacacaaaaaaggaaaactacaagccaatatccctgataaacatagacacaaaaaatccccaaaataatcctagcaatctgaatccaacagcacatcaaaacaataatgcaccatgatcaagtgggatttcttccagggatgcaaggatagttcaacatatgcaaatcaataaatgtgatccatcacattaacagaattaaggactaaaaccttatggtcatttcaatagacacagaaaaagcatctgataaaattcaacatcacttcatgataaaacaaactcccaacaaaccagatgtagaaggaaaatacctcaacataatgcagaccaaatatgacagacccacagctaacatcatactgaatgggggaaggctgaaagtttttcctttaagaactggaacaagacaagaatgcccatcctattttcaccactcctattcgacatagtactggaagtatagccagagcaattagtcaagataaataaataaaaggca

SEQ ID NO: 204373 - DNA, 199 bp, Homo sapiens
aggctgtgcccagggccgcccccgcacctacctcgtgggagtagacgatggcgatgagaccgatgggaccacccagttgcaggaaaacaaactcagggctctcactgattctacatcaaggtgagttgtataattatttcattatatatgccaatgtaatcataacataaataaagtgcacaataaatgtaatacactt

SEQ ID NO: 204374 - DNA, 477 bp, Homo sapiens
gtgatatttagttaatgatttgttttggaaaacatgcagttaggagtatttttgtattttgtcagatgtttaggagacagactttcgggtcatgtttcttgtcttgttcccagatcttttcttaaaagaacagtgtgacaccagaagccaagagatggtttttactaacaacagctttgatgagttcctattaaggtcgtattgtgtattgtgccaaattttccacccagtataaatttagtaacccgctatgagcatatgtaggatattcaatttgcagatacttttgttggttatgttggtttataatagacaagttttatggtcatatgcaattattccattatctttttggacacagtgaatatgttttttagctaaaaatgtccttggaaacataaatgcctgccaataacatggaatattgaattcgggcaatgtgaattgattaattagaaaagggtcaaaagaaataca

SEQ ID NO: 204375 - DNA, 634 bp, Homo sapiens
gcaacaagtgctctacaacgtactcagagatcaacaatatctagctaaagctggtattgaattctgctttctcaacaactctatcatcaacatactgataagcaaagaaaagtcaccataggataggaagtcacgcagatgttggagatatactggcagagtgtggcatgatgagcacatcagattacataccaaacttagaaaaagatgtttgcttgcatccaacctttttattacagtaagacttggctcttatctctaaaacctgatttctttacctctcgtcagcaatactgaaagccaggctccacataaagcatcaagacagtccccaaaaaggttcatgtattacagcacgcctgttaactctgcagtcagagtcaccaattctgaactctactggtcagggcagatggacagtgggcaacagaaagattcctaagcagatactgaatggcaataaaaataaagtaaaaataaaactgcataactatcaaccttaaagaaatgacaagacattccacaaagacacagcaatcaaaaatagaaaaaggatatgaagtccttaagactaatggagccacaaacaatagcagaattcatcaaccagggatacataggatcaaccagcaga

SEQ ID NO: 204376 - DNA, 542 bp, Homo sapiens
tcaaatccagaccaggtttttgccaagggccagactggaatggggtggaatgggaacagctaaccggacatccgagtctcatcactctgagacagaaaatgggcaacccggcagtgaggacacctggatgactttgacccaatcctttcccatctttgtgcttccagtttcacagtctgaaaaacttctttgtatcacttattatgcttgtagttacacatctgtatgattatttaactaatatctatccactacacggtaggccccatacaacatgaactgtgccttgctcactataatcactcagtaactagcacaattaagctctcaatacatttatctgttaacaaaatgaacaaatgagggagactagaccccaagagatagttgtgaaaagaggagtgttccaaatctccttcctgactgctaccaagtttcacctcttggcttgaagtgctctatgtgagggaaaaaaggtgtcctagcagacggaaaaaccaataaactcaaagagctagttccttttgaggctagctcccaat

SEQ ID NO: 204377 - DNA, 464 bp, Homo sapiens
ggcaacataggaagactgtctcaaaaaaaaaaaaaaaaaaatatatatatatatatataattcatatattcatctttatgccaacccagtggtaagataataattttttaaaaaatttttaatggagaaagggtcctttgaaaacaaaagtgcctaggacccaagaaagtcattgtctgtgtgtgtgtgtgtgtgtgtgtgtgtgtgtgtgtgtgtgtagcagggaagggagagggtgctttcttcttccaacattgacagctcatgctagactcctaggcacctgcctggccaccaccccctttaaatgccgccccctctcccggggtacacctggcctccctgaatgggcccacctgccccgaggcctggcacgaagaagccaaacaaaagaacaaagattcctcaacaatcccagggtcagaagaatcttctgtaccaggcttggaaaatgcacctgcgga

SEQ ID NO: 204378 - DNA, 181 bp, Homo sapiens
tgctgcatctaaaattatttgcagttgagattattaaattgtttaaatccaaaaaaatacagttctaccactaataagtagcaacaacaactaatgtaattcttttgctgattaccaaccatttatttgccttggtgttcctttggaatgtaattatttctagctagttaaaattcttaaa

SEQ ID NO: 204379 - DNA, 621 bp, Homo sapiens
  misc_feature (608)..(608): n is a, c, g, or t
agtgggcagcgggacggcctgattgcgtgtgctgtcatagtttccagaagggtgagattgctggggactgtggaaagcatctcaggcaccagtccacactgctcactggggacaaagagcttcgcacagccctccacatcgggcagagttgtacgtgcctgatgcacttgtgcattctcaccttttacgtgatctctgtgaaagattcattctctgtggttttcttctgaagtaaagctgcttccttgaagatgtgtaaggcaacatgaatgggcagcgttcccattcatgtcccttcctgtgccccagtgggaggagctggttcctggggggcagaaactggcttgcagagctgctcaagcgttccactgtttggttttttttttttttttcccctaaaatggagtctcactctgtcacccaggctggagtgcaatggcgaaaccctgtctctactaaaaatacaaaaatgagctgggtgtggtggcacgtgcctgtagtcccagctactcgagaggctaaggcaggaaaatcgcttgaacccaggaggcagagattgcagtgagccaagattgcaccagtgcactccagctgggcgacagagcganactccatctcgga

SEQ ID NO: 204380 - DNA, 418 bp, Homo sapiens
agtgggcagcgggacggcctgattgcgtgtgctgtcatagtttccagaagggtgagattgctggggactgtggaaagcatctcaggcaccagtccacactgctcactggggacaaagagcttcgcacagccctccacatcgggcagagttgtacgtgcctgatgcacttgtgcattctcaccttttacgtgatctctgtgaaagattcattctctgtggttttcttctgaagtaaagctgcttccttgaagatgtgtaaggcaacatgaatgggcagcgttcccattcatgtcccttcctgtaatcccagctattcaggagactgaggcaggagatttgcttgaacctgggaggcggaggctgcagtgagtttgagattgcaccactgcctggccaataagagcgaaactccatctta

SEQ ID NO: 204381 - DNA, 489 bp, Homo sapiens
aggccccctcttggaaaggggctgttgaacgtcctttactcttcttaaaatttccatttgaaacctgttttgctgcatgtcaccccctgcagccaatattgatgttaatcttgggctgcatatgcaatgtgacctcggatgaaattgaacaactgggtaattatctgtggacctatttctaatgaaataattggaataattggaataggattagtagaactgcagagagacctgttgctcctagctgggctcttaatgccaaacaaaagaagcaacgtgtcagtaattcagttggtggatgccttggagccattcaagatgcattttgctcattagccaaatctcttcctgccctcatcctcccccaacatttgtttcagatgtgattttcatgaagcatgtccctgtgtcttgtttgtctttggcaaacacaagtaactattgtaaatatagcattggatctccctgctctttggggaccctgagatt

SEQ ID NO: 204382 - DNA, 475 bp, Homo sapiens
aaaggaacagcacattcacagttaaaagtgctttgtgatgtgacttgactctgtagagcacatcaagatgagcaccataggagcaagcttagaaagggagatttagaggcacattatggcttactttgaatgacaggctggaagttaaggcatgaaagcaggccttggtctggcccctttcattatctcatttaatgctcactcacactccatgaagtacctgctctaatgcccattttatagaaggagaaactgaggcatagagaggtgatataaatgtctaaggttacacatctgaactttaactcaggctgtaaattcccacatcaccatcagtgcaccagagcagaggttgaaaactggtggtctctgagctcagtatacctcagagttctgtcctgtttgatactgtatttaaaacattaaaaaaaaaaaacatggttgctaacatgtaaaaatgggggacattttcata

SEQ ID NO: 204383 - DNA, 313 bp, Homo sapiens
aattgagtgttttctattctggcagcatccgattgaaaatcatttcagaaattcttagtattgcatgcaatcattgtttagtagctagatctttttaactttatgatagaattgtgcatttcatttctgttttaagtcctatccatgtatttaagtagtgtaataaattattttcttgccagcagggtcttcttgtagccaccaagcttccttaaacaattattttgaattattctttaggtagttcatagatctctatttctttggggttaattactgaaaaattattgtgttccctttgcggtgtaatata

SEQ ID NO: 204384 - DNA, 311 bp, Homo sapiens
ttctgaaatccaactgtctactcatcatatccacgtaaatgtctaataggcacctcaacatagctgagaaaacatacttctcacctccaaacctgcagcaatcttccccatctgggttaatgacaactgcattcttgcagctgctcaaacacaagccccggagccatctttttctctctcacacttcacatcagcagatccaatcaactaccatcaaaatacatccagaattggtcacttctcaccacctcaatcactaccacaatgctccagcaatcaccaagtgaattactgccaatagtgtcctaaca

SEQ ID NO: 204385 - DNA, 531 bp, Homo sapiens
tctcccataccccaaagagagagacagggttaacattttgggagggagacagaagggaatcatgctataaacagctttctctgtcttttcagaatttatttatttatgtttaaacctctaaagaggtttaattctttcttgggtatcaattgcctgtgatcaaggagtaatcatattgttactaatacactcttgacagcttttggtcatgcagttctgagcagttggaagataaagttcttagttacagcttctaatactcataaatctcaccaacagtgtggggccccactggagttcccactctcatcttgaccaagatgatttactcagcttgcccacagtgctgcctcttgacattctgaagccctggggaattcctccacaccctctgacttcctgtaactgagcactgaggctcagtgcatctctatttagcactcctcttactgtctcatatttaactagtgtttccactggattgcagaagttttgaaggcagagcaggattacatttttctcctctttaaa

SEQ ID NO: 204386 - DNA, 355 bp, Homo sapiens
cgaagtatagcggaccaccgcattagcctcagccccccgaatagctgggaatacaggcacgtgcaccatgcccagctaatttgtgtatttttagtagagacagggcttcaccatgttggccaggctggtcttgaactcctgacctcatgatccacccgcctcggcttcccaaagtgctgggattacaggcgtgagccaccacgcccagccgcaagcttttgtttatgccccttcctccatcttcagagccaccatagcctcttcagatctctgactcttctttcttcccttccatttataaggacccttatgattacattgggcccacatgagtcatgtatacactgcaaaggcc

SEQ ID NO: 204387 - DNA, 492 bp, Homo sapiens
gtatttttagtagagatggggtttcaccatgttgtccaggctggtctcaaactcctgacctcaagtgatccacccactttggcctcccaaagtgctgggattacaggcatgagccactgagcccagccgggaacccacaggttttttggatggtctctgaatgtcatgtaactcttttattttttatcaaaaaaactttttttgacacagtatcttgctgtgttgcccagactggagtgcagtggcaagatcacggctcactgcagcttctaactcctgggctcaagtgatcttcctgtcacatgagtctcccaagtagttggaacacaggtgccagccaccacacctggctaatttggtttggttttgtttttttagagatgggctcttgctatgttgcctatactggtctcgaactgctggcctcaggcaatcttcctcccttggccacccaaagtgctgggattacaagcatgagccactgtgcacagc

SEQ ID NO: 204388 - DNA, 392 bp, Homo sapiens
gagagaggttacgtgactatagattctacagacattaaaaaaaggttaagaaatattatgaataggctgagtgcagtggctcatgcctgtaatcccagcactttgggaggctgaagcaggaggattgcttgagctcaggcatacaagaccagcctgggtaacataatgagaccttgtctctacaaatacaaaaattagctaagtgtggtggtgtgtgcctgtggtcccagctactcgggaggctaacgtgggagaatggctcagagtctgggtcgttaaggctgtagagagctgagattgtgccactgcactccagcctaggcaacagagtgagacccccatctcaaaaaatgtatatatattatgaacaacttcatgctcatacatttggc

SEQ ID NO: 204389 - DNA, 678 bp, Homo sapiens
acacctgtcctggagtgggaggctgagatgggaatatcacctgaggtcgtcgggagttcgaggccagctcagccaacatggtgaaaccctatctctactaaaaatataaacattagctgggtgtggtggtgcacgcctgcagtctcagctactcgggcacaagaattgcttgaacccagaaggtggaggttgcagtgagccaaaatcatgccactgcactccagtttgggcaacagagcaagactctgtctcaaaaaataaaacaagttatgggtatacagtatataaagatctaacttaagacattgataatataaattgcagtggagtagtaaagaagtagaggtttttgtatgcaactgaagttgttaaactagattgttataactttaagatatgttatgtgatctcattggtaacttcaagtaaggtatctatagaatatacccaaaaggaaatgggaaagaaatcaaagcatgtcactacaaaaaaaatcaatgaaaaatgaaggaaggcaaaggaaaggaggcctgaaaaggctacaagacatataggaaataattaatatggccatagtaattcttccctatcagtaattattttaaatgcaaatagattaaagtccccaattaaaagacagagattagctgaatggagtaaaaaccaggatccaactat

SEQ ID NO: 204390 - DNA, 790 bp, Homo sapiens
  misc_feature (462)..(462): n is a, c, g, or t
  misc_feature (468)..(468): n is a, c, g, or t
  misc_feature (473)..(473): n is a, c, g, or t
  misc_feature (480)..(480): n is a, c, g, or t
  misc_feature (497)..(497): n is a, c, g, or t
  misc_feature (499)..(500): n is a, c, g, or t
  misc_feature (502)..(504): n is a, c, g, or t
  misc_feature (526)..(526): n is a, c, g, or t
  misc_feature (553)..(553): n is a, c, g, or t
  misc_feature (555)..(555): n is a, c, g, or t
  misc_feature (564)..(564): n is a, c, g, or t
  misc_feature (568)..(568): n is a, c, g, or t
  misc_feature (576)..(576): n is a, c, g, or t
  misc_feature (579)..(579): n is a, c, g, or t
  misc_feature (582)..(582): n is a, c, g, or t
  misc_feature (584)..(585): n is a, c, g, or t
agcggaggcggattatgtggagtgaaagttacaccgtggcggattgacttctaaggactcttggtacatgaggaagaaacccggaaggggaagaggaaagcaaaggcgtcaggaatggttcttcctcagggtctattgacattcagggatgtggccatagaattctctcaggaggagtggaaatgcctggaccctgctcagaggactctatacagagatgtgatgttggagaattataggaacctggtctccctggcatggagtttctcgctcttgttgcccaggctggcagtgcagctggcacaatctcggctcaccaccacctccgcctcccgggttcaagcgattctcccgcctcagcctcagaagttgctggaattacaggtattttcttctaaatgtgacatcaaggaattaccaccaaacaaaggagagtaatacaggagaaactatccagacagnaatgtnggaangacatgnaaagccacgacatacangnntnnntgcttcagagaaacccagaaanaatgtacatgactctcagtgtcctgtngnaacatgatngaangacattantancgngnngcctgcgtgtgcacctactaacgcgcacacagtctcatctggtagcaacgagcacactgcatgggcgagaaccagcgcatgatggcaccaacaacgcagctctgattaaaagaatcagcttgcgatttacaccggcagttcacatctacccagaacttgcagctatttcacagctgaaaggggaaaactctttaaatattgaatc

SEQ ID NO: 204391 - DNA, 578 bp, Homo sapiens
ggcttcgcgccccgccgccacccggcccaggccccgcccaccacctcgcggggcccgccgaggcctggcttctgtcctgcgcgcgcagattctcgcaaatctggaagcggatcgcgtggagtgacggtcacaccgcggcgaattaatttccaaagactcatgttacatgagaaagccaccaagaagaccaaagaaaaggagacaaggatggctcttcctcagggatgtggctatagaattctctttggaggagtggaaatgcctgaaccctgcacagagggctttatacagggccgtgatgtggcagaactacaggaacctggagtctgtgggattgacttctaaggactcttggtacatgaggaagaaacccggaaggggaagaggaaagcaaaggcgtcaggaatggttcttcctcagggtctattgacattcagggatgtggccatagaattctctcaggaggagtggaaatgcctggaccctgctcagaggactctatacagagatgtgatgttggagaattataggaacctggtctccctgggtgaggactaacttccctccagaagctgggg

SEQ ID NO: 204392 - DNA, 662 bp, Homo sapiens
  misc_feature (334)..(334): n is a, c, g, or t
  misc_feature (340)..(340): n is a, c, g, or t
  misc_feature (345)..(345): n is a, c, g, or t
  misc_feature (352)..(352): n is a, c, g, or t
  misc_feature (369)..(369): n is a, c, g, or t
  misc_feature (371)..(372): n is a, c, g, or t
  misc_feature (374)..(376): n is a, c, g, or t
  misc_feature (398)..(398): n is a, c, g, or t
  misc_feature (425)..(425): n is a, c, g, or t
  misc_feature (427)..(427): n is a, c, g, or t
  misc_feature (436)..(436): n is a, c, g, or t
  misc_feature (440)..(440): n is a, c, g, or t
  misc_feature (448)..(448): n is a, c, g, or t
  misc_feature (451)..(451): n is a, c, g, or t
  misc_feature (454)..(454): n is a, c, g, or t
  misc_feature (456)..(457): n is a, c, g, or t
agcggaggcggattatgtggagtgaaagttacaccgtggcggattgacttctaaggactcttggtacatgaggaagaaacccggaaggggaagaggaaagcaaaggcgtcaggaatggttcttcctcagggtctattgacattcagggatgtggccatagaattctctcaggaggagtggaaatgcctggaccctgctcagaggactctatacagagatgtgatgttggagaattataggaacctggtctccctgggtattttcttctaaatgtgacatcaaggaattaccaccaaacaaaggagagtaatacaggagaaactatccagacagnaatgtnggaangacatgnaaagccacgacatacangnntnnntgcttcagagaaacccagaaanaatgtacatgactctcagtgtcctgtngnaacatgatngaangacattantancgngnngcctgcgtgtgcacctactaacgcgcacacagtctcatctggtagcaacgagcacactgcatgggcgagaaccagcgcatgatggcaccaacaacgcagctctgattaaaagaatcagcttgcgatttacaccggcagttcacatctacccagaacttgcagctatttcacagctgaaaggggaaaactctttaaatattgaatc

SEQ ID NO: 204393 - DNA, 379 bp, Homo sapiens
ttttcacggagctccttctgaagaggagagaggtggtgcaccaccccttccctggtgttcagagaaggaccatgccaatagaaaaaaagtgcaagcaactttgctactccttgagcttggcctttgtgtttctcaagccttgaatcacctgagtttcaacctgggcttgtaagtttcaaaaatcaccaggacagaatgatggtgtgaacctcttagccagactgccatggaaacacttcctcatagaagtttatgaaaaattcaacaatttttagggaaagttaacatagaaagcattatggattccacatcctggaagaaaagacttttcttcagaagtttgagggctatcaactttgtgccttgtgctattctaggt

SEQ ID NO: 204394 - DNA, 174 bp, Homo sapiens
tctccccagttgatttgttaatttcttgcatcattcaaatgccagatgattggactctacacaattgaccgaaggaacagaatttccaagagtgtcagttgcctttctgagtaaaataatcagacacttcactcacattctatgaataaataacacctccagtgtaaaatggat

SEQ ID NO: 204395 - DNA, 705 bp, Homo sapiens
ttagatttcagaagttgattgcaaagatgcactggaaatgatctgtaacttagaatctgagggtgatgaaaaaagcgctcttgttttatgtactgcgtttttgtcacgtcagctccaacaaggagatatgtactgcgcttgggaacttactctcttttggagtaaattacaacaaagagtagaaccatctatacaagtgtaccttgagaggtgtcgtcaactttctttgttaacgaaaacagtatatcacattttcttcctgattaaagttattaattcagagagatggggtctcactatattgcccagatttatctccaactcctgggctcaagtaattctccgtgccttggccttccaaagtggtgggattacaggtatgagccaccacacatgaccttcgcagcagccttcttgacagggatagtatgcaccatgactgaaggggctggacttgctacctgtatagaactgtgtgtaaaggctcttcgcttggagtctacagaaaatactgaagtgaaaatatctatttgcaagaccatttcatgtttgttgcctgatgatctggaagttaaacgtgcttgtcaactgagtgaatttcttattgagcctacagtagatgcgtattatgctgtggaaatgttgtataatcagccagaccagaaatatgatgaagagaatcttccaataccaaattctttacgc

SEQ ID NO: 204396 - DNA, 385 bp, Homo sapiens
gatgatgatgatgatgacaaccaaatgttttaatctggtagaaaagaaatagaagaaattaggccaggtgggaagaaaggaaagtaatctttcatgtctagccaaagacaacacttacaaagcatattttatttctgtttaaatcccagccagagattgcacaataccaaactgccaaatttcaaagacatttattcaaaatcaggagaaaggagattttacttagcaggtatagtctcttggattttgcaaagttaatcagcgggacttggaacttgtagggctctcttctatccaggagcctggctctcttaaatctttcagctgtcagagtaattatagagtcatgcataggtttgtactcagcatgtactagccttgaata

SEQ ID NO: 204397 - DNA, 408 bp, Homo sapiens
gcaattaggtaaatgtgtgacagttcgaaaatacattcaagtatagaccagtggaccaatgttatctcaggatgaaatcatagatcatacttcaacaaaggtgtcacaggctaaagtgggagagcgtattttagttttcatccatttccaacagtgagaggtgtgaatgcttatgcaatatagaaaaaagtccgcaaagaactgccagaaccaggcctgtgaccaagtttacagtcatctaatttctctccattggtccgagagaaattggagttaattattatttatcatccaagctcctttccctctgccctcttattttccaacacagtgtcttgaattttatcactttatcgtttagttattaagggtgatttggtgaaatgtagaacagactatatgaattac

SEQ ID NO: 204398 - DNA, 561 bp, Homo sapiens
ctatagactaatattataaccaagaaagtaaaacaggacacaggaaatggatacttttaagtgtgcccatgcctttcctaacactcagcccttcacaaaattcgtctgccaaattttatcacatttggttcttttagttcctacttaggccttgcaacaattcacaagctcaattccaagtggaacaaaagctgatgacccattcaaccttcttctcatgctgattaataatgataatattactttactccctaaactatagacccctgtaggaaaaaatacaagtaggcacttaatcaataggactccagcaaatttttttcatataacatactcgctttggttgttgttgttgttgttgttgttgttgagatggagtcttgatctgtcgcccaggctgggaatgcagtggtatgatcactgctcactgcatcctcaaactctcagactcaggcaaccctcccacctcagccatagttttatttttaaatgtctttataggccgggcacagtggctcacgcctataatcccagcactttgggaggccaaggtgggcggat

SEQ ID NO: 204399 - DNA, 645 bp, Homo sapiens
ctgcacacccgcgggccacgggccctagcacacccgtcacctgcccaggccagagaccgctctccgcgctagaagccacagcaaccccggctttcctcgcatggagcacagcagagctgctctggaaatgtggggtcacaccttcactgtcttctcgggagcagctaggctgggctggggaatgacctgggaacacagataatcagggaatcaacacagctggaggcagcattggaacccagcatactggaggcggtgtcggcccagaggttttttcctagcccaagagtttttttccagccggcgttgttggaaggcctgccctgctttaagcataaacagaggaagagactaaggcagccgagggcactgggccgggggcatagggaaacggggcaatgtggtggtctgggctggatcctggaaccgaaagaagacattcacggaaaaactggtgagagccaaataaagtctggagcttaatcgcattgtaccaatgtcagtttcttagctttgacaaatgtatgaaaggaatgtaaaaggttaacaaaggaagctgcgtgggggtaaatggatctctctgttctatattcgaaacttttctgtaaagcaaattattctaaattaaaagtttattaaaatatt

SEQ ID NO: 204400 - DNA, 990 bp, Homo sapiens
  misc_feature (768)..(768): n is a, c, g, or t
  misc_feature (783)..(783): n is a, c, g, or t
  misc_feature (829)..(829): n is a, c, g, or t
  misc_feature (869)..(869): n is a, c, g, or t
  misc_feature (899)..(899): n is a, c, g, or t
gaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaaacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcncagagttcatcagcntccagcggcactgcagcactgtgggtggcactacatggtagtactngcagtggcacttctgggcagagtactacgtgggccaaatntggtgctggagtaggagctagtatgttcanaacacaggaatgcagagcttgttggaacaaataactgaaaaccaaaaatgatgcaaaacatgttggttggcccctaaaattggaagttgtg

SEQ ID NO: 204401 - DNA, 796 bp, Homo sapiens
aactgagttggtaatctagagaaatctgcccctctactttattctctcctgctattgacttgttgcagaaaccaagtttggtgtcctgtgttctttcctacatttggaatgcatttgtttgcttccttttggtgtctttcagtgtgttactctatccacagtatttcttgtaagtggaagcaccagatgcttgaatagattcatatttcatagatggttatacaagaatacttcatagaggaaaagatttaaagatttttgcatgtgtttattcatttataaatttggtttcttaatattttggggctgtccttgtatctgcatcctatgacaatcgctgcctaggattcccacaagggatccatccagctacaagggtggtggagaaatgagtgttttgttttcccaggctctatagctgaggcagagaagggagaatgaggagtaggctgtgtgaacctctattcctaactccttcttcctacattggaacacccctagtaagcttcagtgtatctgtatttcctgaatgattatctccaattcaattttgttgcctcccacagaagaaggcatacagtagtgttactgagagagtggtgctattaggacaaccgtgctgactcccctagattttgtttttaatcattgtcagattttggtaattggacaattgttagtaacatgttcttgtgaagtcctttgtaactgcttacaacttttgtttgaaacctctgctttatttagagatgcagagtctattgagagaacatatctgtaaataccaactcagtgc

SEQ ID NO: 204402 - DNA, 275 bp, Homo sapiens
tttttggttcttctccttctgtaaaagcttatagtgccaacataaatactctgcatatttataactatttctttttctaccttctatgttatagttctagggaatgcctgatgcacagaaccctaatctttgcaaaatacgtaccacaaataagatatcagaataattgttatctcttttgctcagtgtagtagtgggaagagtttatatagagtgctctagctttagaacgggaagagaacgatgtgctgtctgttaactaaatttctctacgc

SEQ ID NO: 204403 - DNA, 705 bp, Homo sapiens
ctattttgataatcccatggtttagaggccctgacaccatggccacttccaccttttactctgattaagcgctcatgttgctattctgtgaaccagtgccagagaggaaggttggctctctgtttggaagtggcccaagcttctattataaccactttgggaaaaaaggcaaaagagcagctgtcctacacagtgtctttctcctcctcctgctcacccagtctgagctcagacttaccatgattccctcatttgacctcgagcatatcaccatcaggggtttgcaattcaaagtacagcatcacagcagacagaacaatggcttggccaaagatgtccatgtccttatcctcagaatatgtgaacaggttaggttgcatgatgttttgactgcattgtgttttcccagaactcatatgttgaagcctaacccccaatgtgtctgtatttggagatagggcctttagggaagtaattaaggttaaatgaggttgtaaggatgctgtttgtattagtccattttcacactgctgataaagacatacccaagactgggaagaaaagaggtttaatggacttacagatgcacatggctggggaggcctcgcaatcatggaggaaggcaaggagtagcaagtcacatcttatgtggatggcagcaggcagacagagggagcttgtgcagggaactcctctttttaaaac

SEQ ID NO: 204404 - DNA, 631 bp, Homo sapiens
ccacaattcttatttccttggggaagaatacttactctaatattttccaggattataacgactcaaataggctcaaattaatctctgcctggcaaaagctgattcatccagaaacaaccatctaaatagaactgtcttactgaaatcaaagttgatagggatgaagaatccactcattcccaaaagtcaagggggctaaggtgcctcacagagtccttcacagaatgtcaagaaaatggtgagaagggcaccctgactcaatatcctccttgactccttgcccatgaaataacattgcagacagacaaattcaaaccagtgctagaacaggagtacatcacaaactttctaccagtgctttcaaacttttttgaccatgatggataggagaagatacagcttacgctacaacccagaaaatacaggtttctaactaaaacaagttgcgaaaaacaatacttatctttcttaagtatgatacactgataatttcttttttttattttttattttatttatttattttcaatgtcttatttcccataggtttttggggaacaggtgctatttggttacatgagtaagttctttggtggtgatttgtgagattttggtgcaccaatcaccgagc

SEQ ID NO: 204405 - DNA, 712 bp, Homo sapiens
ccacaattcttatttccttggggaagaatacttactctaatattttccaggattataacgactcaaataggctcaaattaatctctgcctggcaaaagctgattcatccagaaacaaccatctaaatagaactgtcttactgaaatcaaagttgatagggatgaagaatccactcattcccaaaagtcaagggggctaaggtgcctcacagagtccttcacagaatgtcaagaaaatggtgagaagggcaccctgactcaatatcctccttgactccttgcccatgaaataacattgcagacagacaaattcaaaccagtgctagaacaggagtacatcacaaactttctaccagtgctttcaaacttttttgaccatgatggataggagaagatacagcttacgctacaacccagaaaatacaggtttctaactaaaacaagttgcgaaaaacaatacttatctttcttaagtatgatacactgataatttcttttttttattttttattttatttatttatttttttgagacagtcttgctctgtcgcccaggctgcagtgcagtggcgcgacttcggctcactgcaacctctgcctcctgggttcaagcaattctcctgcctcagcctcctgagtagctggcacgtgccaccatgcctggctaagttttgtatttttagtagagacaaggtttcaccatgttggccaag

SEQ ID NO: 204406 - DNA, 634 bp, Homo sapiens
atagaggagaagagtggatatgtggtgaccaatattaattaatttatatatatatatatatatgacattttcttgcacaatagactgggaaggagctactgtagtggacttaatgaagtataattttggggtaaacctcaattttaattccagtctgtcacttactagctgtctgacttcaacaaaatgagtcaccttctgatccttagtttcctcatctgtaacatgggattatattaggtaacatacataagacacctgtaacacaatcagtgcttgagaagaatgatgacttttcttacttatccccatgttcacagtgcctgacacatcatagggttcaatgagcatttgctgcataaacttgacactgcctttgtcagatgcctcacctggttaatttcattttttatacaattattttgttttggaagagcttctccaaatatacagttgtataaatctaaaccagaaaatgatggtgttctcaaacagtacgagagctgagtgttgagctgtgtgatgttcaagggctcttttgacttatctttaatttttctggcaaggctatgatgtagggaagtacttctgtgcatggacaggagaaaaaagagtgtgcttatttctcattcaa

SEQ ID NO: 204407 - DNA, 405 bp, Homo sapiens
gcctgttttactcttgtcttgagctggctttatgcccaggaagtgggtggcaacatctcctcttactccccagattgtggggagaactctaagagctgtagttccactggatgatgagttaaatcactctggaggccttagctggctggtgagctctttttctgtggggaaaatgccacttgtgaattgaacagccatcctttaagtgaatattcggcagtcagtcttcattataggcagtggccaaccagattggtgcttttcagcctttgttccctggagtcccaggacccgcgagagaagttcctggctcctctacttgcagtcaccctccacagcttcatctttctttttatttgaggttttctcctgaattgtgtttgaaaaatatattgctgctaaaaa

SEQ ID NO: 204408 - DNA, 544 bp, Homo sapiens
tttggtaggctgaggtgggcggattgcctgaggtcaggagttcgacaccagcctggccatcatggtgaaatcccatctctactaaaaatgcaaaaattagctcggcatggtggtgggtgcctgtagtcccagctacttgggaggctgaggcaggagaattgcttgaacctgggagacagaggttgcagtgagccaagatcacactactgtactccagcctgggtgacagagtgagactccgttaaaaaaaaaaatgtagttgtttatctgtttttctggctttctttgtgaggggagcaagcactaggggcttctagtcagccatcttgctgacatcacttcctctggacctcccattaaccaccaaccctgaaaatgtacaacattaattgtaaagaggagctgatataagaacatggataaatgagtcagacaataatttcaagccatgaatctgaaacaggttcgtatatgtgggacatataaagctataagatacagagctgtatggtaaggtacatctggggcaatcaagcttgggtac

SEQ ID NO: 204409 - DNA, 408 bp, Homo sapiens
tatttcaaacctgacaggactatatgctgcttgggtgaaacaaaagcagtctgcaattgtatttactggtgatcaaggttccaaattgtttggctgtcgtggaataaaacaattgaacataaaacccaactgttatattggaacataatattgtcttcaagataggccagtgctctgacttaatatgagcttatctgcaaaaatgccctttggcagagacatttctgaaaagggactgtttctgttgctggggccagaaatggctcacacactcctcactggcatgtactgatgggaaagcagaatagtagatattgccatcatcatgaactttgagttaatcattgtttgtagtgaaactgtataaaaataatgataatgatgtcaccaagcattctctatatgccc

SEQ ID NO: 204410 - DNA, 496 bp, Homo sapiens
ggtctgaatcctcacctgtccgctggctaagagccttaagccaggctcagcccgcacaatgtgtgcgatgacctccaccacggccaccacttgtcactgtgtcccctttcccacacgtcttcccagcacagtcctattaatttaatgagttgagcatttgagacacccacctgtagccagtgtaagttcttttagacaggggttggtcctgcttcaggtaacacccgtctccttctgttttgtgagctataccctctgacttcaagataccacccagaatgagtcccagagtttcatggaaagctagagttcaaaatgaataagctagagcaggcttgtctaacctgcagcccatgggccacatgcggcccaggacggctttgaatgtggcccaacacatattcgtaaactttcttaaaacattgagtattttgcaattttttttttccagttcatcagctatcgttagtgtattttatgtgtggcccaagacaat

SEQ ID NO: 204411 - DNA, 125 bp, Homo sapiens
tgctgagatttacaagcatgagccactgtgccagcctctgctccccatttcctactcttatttatctttttgccagattttctaacttggctttttgttttgttttgtttttttagacttgttaa

SEQ ID NO: 204412 - DNA, 428 bp, Homo sapiens
aacataggcatggttcccatgcttaaggtccaaagggtgcatagtggaatgtagatcttcctcacacctggtccctacctacccagccccctctccacaggcagcccctatttccagaaacatccatctccattccttcttccttcatctagctgccaagttctgccaccctttcttttgcaggctctgacacctcattccttttctgtttattcctatagaagcttagtggaaaatagacccctctccctctgtcttagaaaatagagacctctccctctgtcttagtagaaaatagacacctctccctctaagtagaacatagagacctctccctctgtatcctaaccactgctactcttattccctttggccctctctcttccagcccagacctccttctgcttctcagacaaggtagagccgag

SEQ ID NO: 204413 - DNA, 476 bp, Homo sapiens
gagaaactggaaatttggattttgacatgaaacctctggaatttaaaatactagtttaaaatgcacagtgcctaccaaaccaaacctatctgcaggccacccctaactcacagattgccagtaaagacctctaaatcagatgaacattaataccctctaggtctattactctgtggcagtgcagtgctgcatgactaaaaatcttcactgaatgaatgtgtttctttaccactaaacaggcagcgtgtttttactcaaccttgacatatgacttttttttttcattatgaatactcatgaatcttaagacctgagatctgcacagagtctttactcgaagaagtactgtcataaacagagataggttctgccgaacatggccggaccgaaaaatcagggagcaattttcacaggtacacaatcgagtaagaactgccatcaatctgtcttttcagacatattaatccacaaagata

SEQ ID NO: 204414 - DNA, 194 bp, Homo sapiens
tgtgccattacgcccggctaattctgtatttttagtagtgtccagatccagtgcctactaatgctaaataaatatatgttgaatgaatgaattctaataaggctaagtaaaatattcactataccagccctgtaaggaaactgtgcttacaaataacacagtcctttgaattaaaataacttattttaaagatc

SEQ ID NO: 204415 - DNA, 639 bp, Homo sapiens
tgagagacccatagatggttcacatcacaggactctgcagataacctccagtaccagcctggaactgggaagattcgctgggtggctagacccagaagagagacaacaatcactgcaagtttggctcataggaagccacatccataggaaaaggggcagagtactacatgaagagaacaccccatgggacaaaagaatctgaacagccttcagccctagaccttccctctgacagagcctacccaaatgaacaaaccctggtaatatgacaaaacaagacgcttcaacaccccccaaaaaacatactagttcactggcaatggatccaaaccaagaagaaatacctgatttacctgaaaaagaattcaggaggttagttattaatcagggaaggaccagagaaaggtgaagcccaatgtaaggaaatccaaaaaatgatacaagaagtgaagggagaaatcactcagggaaatagatagcttaaagaaaaaacaatcaaaaattcaggaaactttggacacatttttagaaatgcaaaatgctctggaaagtctcagcaatagaattcaacaagtagaataaagaaattcagagctcgaagacaaggtcttcaaattaacccaatccaacaaagacaaa

SEQ ID NO: 204416 - DNA, 376 bp, Homo sapiens
acacatgaaacactccacaggcaaagacattatccatcagtgcactacacacttctgtaaattatcaggactcctcaattgaggtgagtctacagagatttcaaaggctatttgagtgctaagctatctaactactggttggacactatttaaataatgcgttaaacacaactcttgaggctctgaagaatttctatgctttccaatgaaccaggagttacaaggtcctgaaaaccacaagtgtgttacatcctttaatagataaagcaaagctgatattaatgtgaatatactttatatttacttctattcgtgttaatttttctttgcctgtaatatacattttcatataacggggaataagaaacatcttagg

SEQ ID NO: 204417 - DNA, 162 bp, Homo sapiens
tagctcactacagcagcaacacctatgcaaggagactagatgtaggctgccagtgaaaaccaacgtgtaatttctgggcagcaaatttaagagctaatgtatgattcacgatgctcttttccctctgctatgacaacccttaatgttccaatgttccatcag

SEQ ID NO: 204418 - DNA, 487 bp, Homo sapiens
agcccatgggcttgagaatcatgcagacctagctctaggttattaatctattattttaaccttatttcaattatttacccttctaattccaattatttaccttataagtgtttataagaatttaatgaaatgatacaatgaattgtacctggcacataggttatctacaaattgtagttacctggttaaaacaaataatatagcatatgaaatatacaagaattctgtctcttaaccacatccagagattcttcatggcataaaaaataaaataccaatctcttcagcttagtattctggactgtctatgaactcaactcaacctttccagttttataattttttttgacagtttattctacaagcttatcaaattatttctggggtatttctatttactgtattccatagctttgcttacaaagttccctctatacaggatgtattattttaaaattatattaaaattctaactgttattccaagt

SEQ ID NO: 204419 - DNA, 210 bp, Homo sapiens
gcctctgccaaggtgagaggacttcatgaagctgtttctgcaaccagtgaatgcatctctggtaggggctggggcaacagggtctctgtgtctgcatcttccaatggtcagctccacccaaggttgaaatccaaagcatccagaggtttgaatggagctcatggctccataaaggttaaggaataaccattgtcctggcagcgtggaaac

SEQ ID NO: 204420 - DNA, 320 bp, Homo sapiens
aagggaggctgctctcagggatatttgtcaggtaggaatgggtggagtggaactacagggccaccatgtttcccatgggtcacccatggtggccttgtcatgtttatccgtgatcctcagtgttctctgtggtcctcccgtcacccctttcagactgtcctttcagttctccactgtccctgcatcacctctgcccctgtcccgtttgtctgtgttcagtccatgttcccaggtcttgaggtggcccctggttctatgccccttacctaagaccctgtgcagggaatctgtgaaaacacagaggaaataaaaagtgagga

SEQ ID NO: 204421 - DNA, 532 bp, Homo sapiens
accttaggagcacctggtacattaggcacctggtgcattgttgaaatgctggtatggcccttagttcaggattacctgcacagtagctccttcatgccattcattttagaccaactcaaagcaaagaagcttattctgtcatagtctgatgggatattgtcagcctgcatgtcaaatactttgtgatagttaaataagactacaggactgttagaaattcttgtctgttagtctgcatgccataggctgtcatgaaaattaaacagagactataggattattatcagtttttgccctctggtttgtaatgcaagttgggctcaagtttgtttgtttttttttccccattgctgttttactgattagccagtagagtgaaatattaaagtttgtggattactttttatttctatatttatcagaccccagtattagaccaatgctgagctaaacattgagagagcaagacattttttagcatgagttcatctagtcccctccatgtaagctggtggcaggggtcttggtactg

SEQ ID NO: 204422 - DNA, 796 bp, Homo sapiens
atttctcggaggtggctcatcacacggctggtggcagtcttggtgccgcagtgattccttaatatttgatttctctcttgatttgccactattctgtattggcactttcagtgtagatattctagtttggggatgtcctcacaatgtgtaatagagattggtctattagcatgcttaatttctgctaatcagagttttgcatggcccaaacaacagttgaccatttttatggtatgggaaagtgtagttcacaactgtctttgtcacgaaagccgtttttcctcacattttccagtaggcagataacattacttaaattattaatatataacactcttggaactattgataggaaataatgtatttaaaataattttttgcattttcagagaccttgatgttatagggtagataagctatggcactataaaatcaaaaacactaattctgtggaaggatatctagttggtatttttatctttagctttctcatttctgagacagcatagtcatccagcttgatggtaatgtagtatattactttgttcagtgggcttataagtgactctgaattatgtttgtgatgagctatacactttttttctgttccccaaataccatgaaggacaaggtcactctttctctctctttttttgagtgtagattattttaaagcactaattgcattacattggtaactgcaatataaaatagccattattgttttgtgaagcatggttgaaattagctagtggtcccttttgaatttcatgagcctctcaaaaaagaaaaactt

SEQ ID NO: 204423 - DNA, 385 bp, Homo sapiens
attacatacagaaggatggtgataaaaaccacagaaaacgtataccagaagagagagtatctttaaaacacagaaagggaggaaaaaaccccctcaatccagaaatctatatgcagcaaaaatacctttcataaataaaggtgaaataagattttcccaaacatactaaagctgaaaaaaattcatcatcggcagacctgtacaagacatgctaaaggaatgtccaggcagaaggaaagtccagattgacataaaggaatgagaaggactgtaaatggcaaatactgaataaatataaaacatgtttttcttatttttaatctctttttaaaagtgacttgtttaaagcaaacgtaacaacgatgtattgtgaggcttatgactg

SEQ ID NO: 204424 - DNA, 900 bp, Homo sapiens
  misc_feature (17)..(17): n is a, c, g, or t
tcctacttttcacaggntacttttctacaggctacttttccacagcggtacttccacagggggggaaaggatttgatgacctggaaggtctttacacgttaaagttcaatgattctagctccagtttcatggatttaataagacagcctctcttcctagctccttttagaaatggatctttgaaagccttttgttttatgttctatttaaaatagcaattagctttgcatcgcaggtactttacagtgcaccatgtgtattattcttgtggaatattagttcaccagatgatagcccacaattctagttacatatgaagtggtggtgtggtgaaataacattgcagctcctcactaaaccaaaaactgcagcaagcttgtcgcagagagaccctcattttcccagctgtcaacctgactgatattttaatttttttgccctgtagaaaacttcagtctcttatccaatagataaatgagtgaacccccaggaaatgcagcagaatgtttctgtttgccaatgcaatgaatgcagaagctaataaatgtctacttctatcaggaggaggcgtgtaatgagtaaatgatgagagaaagaattcagggaaacaaatgatcaattcagtctaagatgacaaacaatttcctaataacttggcctctagttggagagagggcttcaccaggcaaagagaatgcctgttgaaactaagcctagcacaaggccatttacattcagctgctgatggatttggtctggttacatttgggtcacactgagcaataaggcgacgttcagacacagcgtggttattgcagacttttctttgccctgtaatgtctatgagtgtgtactaggaaaaggaatcatttcagagcctaattcacattattcaccccg

SEQ ID NO: 204425 - DNA, 206 bp, Homo sapiens
caatcacttgtcggggatactgtaaagaagattcttgggaaaggatttgatgacctggaaggtctttacacgttaaagttcaatgattctagctccagtttcatggatttaataagacagcctctcttcctagctccttttagaaatggatctttgaaagccttttgttttatgttctatttaaaatagcaattagctttgcatcg

SEQ ID NO: 204426 - DNA, 575 bp, Homo sapiens
ggctatttcaactccgtattatttatagcttaataaaatattttaaagatagttggccagtcagcactgatactcctgtctacctgtgttacatctcagaagaggcttagcctatctgtgctgacacttactgaagtataagttatatataaaacacacccactttaagtgtacaggttgctggtttttggtgaatgtgtacacgggcataaccatcatcacattcagggtgcagaactttgccgtcaccctctcatgccccgtgcagtcagctgctctctccctgacccagccccagagaaccactggtctactttctgcccctatgagtaagttttgctttttgtagaaatggaatttcacagaaattgaatcatatagtatgtattctcttgtgtctggcttctctggtttaacataattttgagattcatccattgcttgcaggtaacagcagttcctctttgttgctagtattctgttacatgggtaaaccacactttattcttccacccattgatggacatttggatgtttctatcttatgcctattatgaataaagctgatatgcaca

SEQ ID NO: 204427 - DNA, 2233 bp, Homo sapiens
tttttcaaaaaaaaaagtcccacatgtggtcatcgtcgcttctttatgttgtaaggtgaattgtaactatgcattctgcaaagggggtggggaggagagggcagaaaggggaagggagtagcgttgcatccttgttcttcagtttctgtgtccatggtgtccccgtgtcctggaggggaaggggagtgagagacgaatgtggtaaggtcagcacagtgagatagagacctctgagtcctcttgccactgttgctggcaggtctgatggccaggtaaattccagggggcctgcagttcctgtcaaccaatgtggttcaggattcttgatcctagccgtgcagtgttaatccagtgcagcaatggaactccacaggctccagtgttctctggaaaaagtactcatcctttcctgaattcagagcccttcaagctcaggaaaccacgcttcactcgtgctgacctgaaagttaatctttaggtcgattttgaaaaactccgcctcctctctcctttttaatatttctttcttcctttttaatcatgtttaagtgaacttactcttagttataaggaactgtcctgctttgtggggaagagggctgttgcttgtcaggcaaaaaagttttctcttcctacccaccatccctctctctgcttcccttgcatttggcaggctgtatgaagccaatgagctgcgaggtgttttgacaggggaggtctgcatgcagcctcttctttgtcctaacaattcctttgttgatcttgcctgtgatgaatcatagcgcctgcattgctctggtctaggcattatttgcaacacacagtatcgtaagcgagagattgttctgcctatattcagtgttttccatgcagcaattcttcttgttgacgttcacagtactgtaacgagtaacagacttgatcacagtctcctcgtgcctgtgcagggctgcacaggcatgatcttatcagggttccaatctgttagattgcctttaaacaaaaaaaacaacaaaaaaataaaatcctgacgtttcaactgtctcacacaaaataatacctcgaggtacatttccccctgcaatgtaaacccttaactcctctctcctttctgacatcagtggattatcctttttaaaatatgaacatgtaaatagcaggataactttaaaaaacattttctttgctgtgaaagtaaccctaaaatatgttttcttcttttgtatttttttggtttttgtttttaagccatcagaagtttcagatctttactctttcatgtttaagaagaaagagcagaggaggtcgggggagccggtttgcatttgtgttggaggggtgttatctccattgcctcccacacagtgacagcagaccagtatgtaaaccctgtcttggctgggcgcggtggctcacaccagtaatcccagcactttgggaggctgaggcaggcagatcatctgaggtcaggagtttaagaccagcctggccaacatggtgaaaccccgtctctactaaaaaattagccggacgcagtggcgcgcgcctgtggtcccagctgctcgggaggctaaggcaggagaattgcttgaacccgggagacggaggttgcggtgagccgagattgcaccactgcactccagtgtgggcaacagagcaagacttcgactcaaaaacataaaataaacaaaagacacacacacacacaaaaaccctgtcttaaatagctgccatctcttccagcaatctagtgccagggtaagaagtgtctgaatttctctcttccagcagatccatcccctgcagggactccagaatgttctccacacaatacctggagctctcaacctttcttggttcagacacacacatacacaccccttgagtaactcagtatcattttgtagttcacagaaggatgtagtccctggcattttggtttgcactgtagaatccatagccttgtcactttgttatgctctggaaatgtactgatttcttacttgggaggaaacttgtgtaaggagatgtgcaaaccaccctgaaagccatgtgcatcctcacctcttccattaccccctccatgagctcgaagcgacattaagtagagggaaatgcttttaacaaatgctgctcatgtggatctgtcagctattgcttgcctagatttgggcacccatgaagcagggttggaatggatcattttgaattgcttctttgcagacaccccctt

SEQ ID NO: 204428 - DNA, 1853 bp, Homo sapiens
tttttcaaaaaaaaaagtcccacatgtggtcatcgtcgcttctttatgttgtaaggtgaattgtaactatgcattctgcaaagggggtggggaggagagggcagaaaggggaagggagtagcgttgcatccttgttcttcagtttctgtgtccatggtgtccccgtgtcctggaggggaaggggagtgagagacgaatgtggtaaggtcagcacagtgagatagagacctctgagtcctcttgccactgttgctggcaggtctgatggccaggtaaattccagggggcctgcagttcctgtcaaccaatgtggttcaggattcttgatcctagccgtgcagtgttaatccagtgcagcaatggaactccacaggctccagtgttctctggaaaaagtactcatcctttcctgaattcagagcccttcaagctcaggaaaccacgcttcactcgtgctgacctgaaagttaatctttaggtcgattttgaaaaactccgcctcctctctcctttttaatatttctttcttcctttttaatcatgtttaagtgaacttactcttagttataaggaactgtcctgctttgtggggaagagggctgttgcttgtcaggcaaaaaagttttctcttcctacccaccatccctctctctgcttcccttgcatttggcaggctgtatgaagccaatgagctgcgaggtgttttgacaggggaggtctgcatgcagcctcttctttgtcctaacaattcctttgttgatcttgcctgtgatgaatcatagcgcctgcattgctctggtctaggcattatttgcaacacacagtatcgtaagcgagagattgttctgcctatattcagtgttttccatgcagcaattcttcttgttgacgttcacagtactgtaacgagtaacagacttgatcacagtctcctcgtgcctgtgcagggctgcacaggcatgatcttatcagggttccaatctgttagattgcctttaaacaaaaaaaacaacaaaaaaataaaatcctgacgtttcaactgtctcacacaaaataatacctcgaggtacatttccccctgcaatgtaaacccttaactcctctctcctttctgacatcagtggattatcctttttaaaatatgaacatgtaaatagcaggataactttaaaaaacattttctttgctgtgaaagtaaccctaaaatatgttttcttcttttgtatttttttggtttttgtttttaagccatcagaagtttcagatctttactctttcatgtttaagaagaaagagcagaggaggtcgggggagccggtttgcatttgtgttggaggggtgttatctccattgcctcccacacagtgacagcagaccagtatgtaaaccctgtcttggctgggcgcggtggctcacaccagtaatcccagcactttgggaggctgaggcaggcagatcatctgaggtcaggagtttaagaccagcctggccaacatggtgaaaccccgtctctactaaaaaattagccggacgcagtggcgcgcgcctgtggtcccagctgctcgggaggctaaggcaggagaattgcttgaacccgggagacggaggttgcggtgagccgagattgcaccactgcactccagtgtgggcaacagagcaagacttcgacatcggttcaacaaagcacaaaaatccgagggggccgtaccattcgccaaagagtgatataacaggggcgcctacacgcgagggaacgtgtacctaagggtgaaccccagacggcaaaaaagccagatccaaggcacaacagaaagaaattaacaaattaactacaaggaacaacggcgccccct

SEQ ID NO: 204429 - DNA, 1836 bp, Homo sapiens
tttttcaaaaaaaaaagtcccacatgtggtcatcgtcgcttctttatgttgtaaggtgaattgtaactatgcattctgcaaagggggtggggaggagagggcagaaaggggaagggagtagcgttgcatccttgttcttcagtttctgtgtccatggtgtccccgtgtcctggaggggaaggggagtgagagacgaatgtggtaaggtcagcacagtgagatagagacctctgagtcctcttgccactgttgctggcaggtctgatggccaggtaaattccagggggcctgcagttcctgtcaaccaatgtggttcaggattcttgatcctagccgtgcagtgttaatccagtgcagcaatggaactccacaggctccagtgttctctggaaaaagtactcatcctttcctgaattcagagcccttcaagctcaggaaaccacgcttcactcgtgctgacctgaaagttaatctttaggtcgattttgaaaaactccgcctcctctctcctttttaatatttctttcttcctttttaatcatgtttaagtgaacttactcttagttataaggaactgtcctgctttgtggggaagagggctgttgcttgtcaggcaaaaaagttttctcttcctacccaccatccctctctctgcttcccttgcatttggcaggctgtatgaagccaatgagctgcgaggtgttttgacaggggaggtctgcatgcagcctcttctttgtcctaacaattcctttgttgatcttgcctgtgatgaatcatagcgcctgcattgctctggtctaggcattatttgcaacacacagtatcgtaagcgagagattgttctgcctatattcagtgttttccatgcagcaattcttcttgttgacgttcacagtactgtaacgagtaacagacttgatcacagtctcctcgtgcctgtgcagggctgcacaggcatgatcttatcagggttccaatctgttagattgcctttaaacaaaaaaaacaacaaaaaaataaaatcctgacgtttcaactgtctcacacaaaataatacctcgaggtacatttccccctgcaatgtaaacccttaactcctctctcctttctgacatcagtggattatcctttttaaaatatgaacatgtaaatagcaggataactttaaaaaacattttctttgctgtgaaagtaaccctaaaatatgttttcttcttttgtatttttttggtttttgtttttaagccatcagaagtttcagatctttactctttcatgtttaagaagaaagagcagaggaggtcgggggagccggtttgcatttgtgttggaggggtgttatctccattgcctcccacacagtgacagcagaccagtatgtaaaccctgtcttggctgggcgcggtggctcacaccagtaatcccagcactttgggaggctgaggcaggcagatcatctgaggtcaggagtttaagaccagcctggccaacatggtgaaaccccgtctctactaaaaaattagccggacgcagtggcgcgcgcctgtggtcccagctgctcgggaggctaaggcaggagaattgcttgaacccgggagacggaggttgcggtgagccgagattgcaccactgcactccagtgtgggcaacagagcaagacttcgacaacacaaaaaccagggggccgggccaatgcccaatgaccgctaaaccgccgcgtcacccgtagagaaacccttccaacacgcgcgagacctcgccagaagcaagccccggtacacaccgaccgaccgcgtacagtccagactacacacgcgatcaccacgggcacgc

SEQ ID NO: 204430 - DNA, 2179 bp, Homo sapiens
tttttcaaaaaaaaaagtcccacatgtggtcatcgtcgcttctttatgttgtaaggtgaattgtaactatgcattctgcaaagggggtggggaggagagggcagaaaggggaagggagtagcgttgcatccttgttcttcagtttctgtgtccatggtgtccccgtgtcctggaggggaaggggagtgagagacgaatgtggtaaggtcagcacagtgagatagagacctctgagtcctcttgccactgttgctggcaggtctgatggccaggtaaattccagggggcctgcagttcctgtcaaccaatgtggttcaggattcttgatcctagccgtgcagtgttaatccagtgcagcaatggaactccacaggctccagtgttctctggaaaaagtactcatcctttcctgaattcagagcccttcaagctcaggaaaccacgcttcactcgtgctgacctgaaagttaatctttaggtcgattttgaaaaactccgcctcctctctcctttttaatatttctttcttcctttttaatcatgtttaagtgaacttactcttagttataaggaactgtcctgctttgtggggaagagggctgttgcttgtcaggcaaaggctgtatgaagccaatgagctgcgaggtgttttgacaggggaggtctgcatgcagcctcttctttgtcctaacaattcctttgttgatcttgcctgtgatgaatcatagcgcctgcattgctctggtctaggcattatttgcaacacacagtatcgtaagcgagagattgttctgcctatattcagtgttttccatgcagcaattcttcttgttgacgttcacagtactgtaacgagtaacagacttgatcacagtctcctcgtgcctgtgcagggctgcacaggcatgatcttatcagggttccaatctgttagattgcctttaaacaaaaaaaacaacaaaaaaataaaatcctgacgtttcaactgtctcacacaaaataatacctcgaggtacatttccccctgcaatgtaaacccttaactcctctctcctttctgacatcagtggattatcctttttaaaatatgaacatgtaaatagcaggataactttaaaaaacattttctttgctgtgaaagtaaccctaaaatatgttttcttcttttgtatttttttggtttttgtttttaagccatcagaagtttcagatctttactctttcatgtttaagaagaaagagcagaggaggtcgggggagccggtttgcatttgtgttggaggggtgttatctccattgcctcccacacagtgacagcagaccagtatgtaaaccctgtcttggctgggcgcggtggctcacaccagtaatcccagcactttgggaggctgaggcaggcagatcatctgaggtcaggagtttaagaccagcctggccaacatggtgaaaccccgtctctactaaaaaattagccggacgcagtggcgcgcgcctgtggtcccagctgctcgggaggctaaggcaggagaattgcttgaacccgggagacggaggttgcggtgagccgagattgcaccactgcactccagtgtgggcaacagagcaagacttcgactcaaaaacataaaataaacaaaagacacacacacacacaaaaaccctgtcttaaatagctgccatctcttccagcaatctagtgccagggtaagaagtgtctgaatttctctcttccagcagatccatcccctgcagggactccagaatgttctccacacaatacctggagctctcaacctttcttggttcagacacacacatacacaccccttgagtaactcagtatcattttgtagttcacagaaggatgtagtccctggcattttggtttgcactgtagaatccatagccttgtcactttgttatgctctggaaatgtactgatttcttacttgggaggaaacttgtgtaaggagatgtgcaaaccaccctgaaagccatgtgcatcctcacctcttccattaccccctccatgagctcgaagcgacattaagtagagggaaatgcttttaacaaatgctgctcatgtggatctgtcagctattgcttgcctagatttgggcacccatgaagcagggttggaatggatcattttgaattgcttctttgcagacaccccctt

SEQ ID NO: 204431 - DNA, 250 bp, Homo sapiens
cattgtggatctggcactgtttctaaagaaaaactccattatcccaagcaaaaagcacagaaggtggagtttggcttcaagagatgttaactcaaaatcttaggcctagcagagaatcaccaaatttatggagagttaacaggggtttaacaggaaggaagtgcctttaataagttctcaagccagaggctggagacagcagctaaagaggatgaggacagtccagagcagccagaaccaccagagctca

SEQ ID NO: 204432 - DNA, 358 bp, Homo sapiens
gcacagacaacttttgttctctgagtaattctggtcaacacttaagaaaatacctagacactaatgtgaggggttgtttgaagaacaatccctaccagatacaccccacagtgaagcccaattttgacacggaccacccacttgaagtttccaattgttttttatagtattccactcttaaaagcgcaaacagccaaggattaccagacagctgaagaaagtaactatatgcaacagactataatcatctccagagaacaaaaaagagcttttggaaatttaaaaacatacaaacacaaacaacaacaacaacaaaaacccagaaaacaaaaaccaaaagaaatataaaaacattgtg

SEQ ID NO: 204433 - DNA, 133 bp, Homo sapiens
ttttggttacatagatgagttctttaatggtgaattctgagattttagtgtacctgtcacctgagcagtatatactgtaccctcactcctttcccaactccacaacaatatttccatctttagaaaccaggtc

SEQ ID NO: 204434 - DNA, 450 bp, Homo sapiens
gtccaattggatatgagatgagaataaactgataattattccatcttcttcttccttggttgactggaagaatgatggtggcatgtcatagggcacaaagagccacccaggggaaattaatgtttgcttctgaaaatgctgagtttaaggtgatggaagtacaaggaatagacactcaaaaactgctgtgtaacacctaagaacagaaacaaaactggactcatagatgctaaaatcaacatccaataggtgacttttgaagccatggaattggatgaggttgcccaatgagggagactacaaagttagaaggaaaaaaagctggccgggtgcggtggctcatgccagtaatcccagcactttgggaggccgaggtgggtggattacctgaggttgggggttcaagaccatcctgaccaacatggagaaatcctgtctctactaaaaata

SEQ ID NO: 204435 - DNA, 438 bp, Homo sapiens
gccaggtatggtgactcacgcctgtaatcccagcactttgggaggctgaagtgggtggatcacctgaggtcaggagttcgagaccagcctggccaacatagcgaagcactgtctctactaaaaatacaaaaattagctgggcatggtggcgggtgcatgtaatcctagctactcaggaggctgaggcagaagaatcacttgaacccaggaggcagagtttgcagtgagctgagattgcgctactgtactccagcctgggtgacagaatgagactgtataaaacaaaacaaaacaaaaaaacaaaaaacaaaaaaaacaaaacacacacacacacacacacacaaaactgaatggaaactgagaacttactgttctatttatgatgaaagaaaactggtaggctttagaaagtacaccctatgtgatatgaaaagtgaa

SEQ ID NO: 204436 - DNA, 115 bp, Homo sapiens
caccaaattcctttcatgagattaatcttccacaacttctacacttccttaaatctttgattttgtcctatacttctttttttatattagcaatctactttaggacagaaattta

SEQ ID NO: 204437 - DNA, 306 bp, Homo sapiens
cagggctgtggatatgagccaccgtggcagggatgcatctgagatggcccccagggcagcctggcttttcaggggtgcagcctgatgacagagtgttctcacagtgaacgtgccattccagaaagcactgttttcttcatcacgcattgcttcaccaagcacttcagaactttaccctctgttcggtgctggggaaacgaaggggaagagaagggtccgtatgccagcgggcagacagacacattgagaacgctgcagtaacacggaaaacgatggtggcattgttgaggtccagaggagcagccc

SEQ ID NO: 204438 - DNA, 538 bp, Homo sapiens
tctcactagagtgtaagttccataaggacagagattgctgtctattttgttcactgctgtatcaccagtctctagaatagtggctattgcatagtaggtgctcaacaagtatttgctgagtgaataatctcactgaagaacctggagtaagtattatcataatagtgtgcgctccatttgcacctggcttttcacttacactcatgtcctgcccatcttccatgttaccacagagtcttcataatcatgatttctcatggctatggaatcttctgcccagtgtatatgctttacctgaccattcctatatcattggatcccataagttattactagttctcgacactataaataacacgacaatgaacatttttttggttgtagtatttccaatatatgatttatttttagggtgaattccctaaatcactaactaaccatttttaaagtaagaaaatacaattttgaattgctattttaatgaatgtattcaagaggggggaatcaatttttaaaaccagtgagcagtcaggtgcag

SEQ ID NO: 204439 - DNA, 463 bp, Homo sapiens
ctcaatcaagtagcctattaaaaggattatacactattaccaagtgggatttaccccaggaatgcaagggtgattcaacataagaaaatcaaccagcataatgtaccatattaacagaatgaaacaaaccacatggtaatctctactaatgtaaaaaagcatcacatagctgggcgcggtggctcacgccagcactttgagtggctgaggcaggtggatcacttgaggtcagtagtttgagaccagcctggccaacatggtgaaacctcgtctctaccaacaatataaaaaactagccaggtatggtggcgcacacctgtaatctcagctacttgggaggctgaggcaggtggatcatttgagagggcatatgaggttgggggctgtgctgctagaaacacagagttctgtctgccctttagtcagttttaaagagataatgttttgaggtaatccgtgaggg

SEQ ID NO: 204440 - DNA, 302 bp, Homo sapiens
gttttgtttttagtttaacaattttttatttaaaacctattttacaaataacaggaaacacatattttagcaaaatggttattctactattttagtaaaaatctgagatataaaggaagctttccaactagcaaaacctattttcaagtttagaaaatattctgctattaaaagaaaaattctctccttgttaaatttagttcaggggtcagcaaactttttctgcaaaggagcaaatcataaatattttaggctttgtggctcatgtgatctgtatgtatctactcagctctgccactaca

SEQ ID NO: 204441 - DNA, 368 bp, Homo sapiens
atgtaacagaggaaggaatcaatcaactagaagatgaaacaaaggacattacccaatcttaacagagacaaaatatactggaaaagaagtgaacagagcctcaaagaccttgtgaaatgataataaaagataaaatgtagatgtcatagaattatggcagatttccgtcagaaaccatggaggtcagaaggaagtggcatggcatttttcaggtgctgaaagaaagaaaactgtctacctagaatcctatttctaggaaaatatcctgcaagaatgaagagaaaattaatacactctcagatgaagacaaactaagagaatttgtctcactagacttaccttaaaagaatggctaaataaagttcttg

SEQ ID NO: 204442 - DNA, 477 bp, Homo sapiens
tttctataaatctgaaactgttctaaaaatataaagcctattaatttaaaaagtggcatatggtataatcttaatgttttgcaaataaaaaaaagatagggttcaattcattcattaacctgatctttactgagtccttcctttgtgccagtcaggcactgtgataaataacagaacattaacaatggccatctctgggtagtgaattgctgccattttcatcatcttctttatattctctatatttctaaatgttctaaatatatgtgttttggaatcagaaaaaaataagtaaaataatcattatgcaagcatgaggtaatattactcacaaattggatagactttaatttttggtcctcatcttcatttcactcagtagtagtgcgatcagctcaagtcgttgtgaaaaaggaaaggaagccccctggtcagagatcaaatggggaataaagaagatcctacaggaggtggagt

SEQ ID NO: 204443 - DNA, 478 bp, Homo sapiens
caccagcctgggtgatagagcgagactccatctccaaaaaaaaaaaaagtacttgggtacagtggctcacacctgtaatcctagcatttggggagaccaaggtgggaggatcacttgagcctgggaggtcaaggctgcagtgagacatgtttgagcactgcattccaacctgggtgacagagagcctatcttattgttgtataaaggtttgaaataggtacaaggtttggtcattcagtttcaaattcatttctcaaatatccttgtatctcactaacatcatctgtctaccagtaacatttccaaatctaatagtacttggcaagagatggggagggggttaaattgcacaatttaaaattttcataattgttatgcatcacagttattgtgatcacgtgataatgttatgcatgtcttttgttgtgtgtcagccccaacttttgtctcagcatttgaaccatgcatacatcttatc

SEQ ID NO: 204444 - DNA, 421 bp, Homo sapiens
tagactttcaagacagcaacagcagaaaattaaaccccaagtatgggaccctccttagcacagtgccgtatgcaactgcactggtcacacaacttgaagctggctctgcctttagattacaagaaatttgggcagggtgtggcagttcatgcctgtaatcccagcactttgggaggacaaagccagaggatagcttgaggccaggaatttgagaccagactggtcaacctagagagactctgtttctacaaaatctaaaaaaaaaattagctgggcatggtggtgcatgcctgcagtctcagctacttgggaggctgaggtgggaggatcgcttgatctcaggagtttgaggctgcagtgacacgtgattgtaccactgcactccagcctgggtgacagagcaagatcctgtctcagaaaa

SEQ ID NO: 204445 - DNA, 188 bp, Homo sapiens
tcaaactcttaggctcaatcaagtgatcctcttgcctcagccccctgagtaatgaggactataggcgtgtgccaccatcctcagctaattgtttttattttttgtagagacaggggtctcactctgttgcccaggctggtctagaactgctggcctgaagcaatcctcctgccttggcctcctaaaac

SEQ ID NO: 204446 - DNA, 512 bp, Homo sapiens
ggcctgcataaggaacaagacaatggtcaagattttctaagtatccagagcgagtatttctaggagagcaagattctcagaactgctctaaaaggtcagggttcatttcataccctcctctagactcccactatacttggttctacacttctaaacacagcactcctcctttgcctgttgttaacaatctctggactccttccattgctgagtgtctgtaattcttagtacagtacaatgcttgatacacaacaggcatctataatcattaaccgaattaaaagaaatgtaccggctggggcgcggtggctcacacctgtaatcccagcactttgggaggccaaggtgggcaggagatcgagactatcctggccaacatggtgaaaccctgtttctactatggtgaaaccctgtctctactaaagatttaaagatttactctagctaaatctaaaaactggttgggcgtggtggcgcgctcctgtagtctcagctactcagcgaggctgaga

SEQ ID NO: 204447 - DNA, 490 bp, Homo sapiens
ggcctgcataaggaacaagacaatggtcaagattttctaagtatccagagcgagtatttctaggagagcaagattctcagaactgctctaaaaggtcagggttcatttcataccctcctctagactcccactatacttggttctacacttctaaacacagcactcctcctttgcctgttgttaacaatctctggactccttccattgctgagtgtctgtaattcttagtacagtacaatgcttgatacacaacaggcatctataatcattaaccgaattaaaagaaatgtaccggctggggcgcggtggctcacacctgtaatcccagcactttgggaggccaaggtgggcagatcacctgaggtcgggagttctagactagcctggccagcatggcaaaacctcgtctctactaaaaatacaaaaattagctgggtgtggtggcgcacatctgtaattccagctactcgggtggctgagatacaagaat

SEQ ID NO: 204448 - DNA, 436 bp, Homo sapiens
ggcctgcataaggaacaagacaatggtcaagattttctaagtatccagagcgagtatttctaggagagcaagattctcagaactgctctaaaaggtcagggttcatttcataccctcctctagactcccactatacttggttctacacttctaaacacagcactcctcctttgcctgttgttaacaatctctggactccttccattgctgagtgtctgtaattcttagtacagtacaatgcttgatacacaacaggcatctataatcattaaccgaattaaaagaaatgtaccggctggggcgcggtggctcacacctgtaatcccagcactttgggaggccaaggtgagaggattgcttgagccctagtgagagcttgtctctacagaaaatttaacaattagctgaccatggcggcacacaaccatagtcccaa

SEQ ID NO: 204449 - DNA, 272 bp, Homo sapiens
gcttcctattttgttgatactcataatgttcacttagacattttaagaatttgtctcaaacaacttagaagaaacctttcttttctcttaaatgtcagattttagcagctctgaaactagcctaaacattcaggattgcctaattacaggattctaatgctggtgagcaaaatgaaccagatttgttcacctagatgcaagtgaagcttcaggccactctgttcccgctgagatttagaaacaagaaatgtctctgtgctgtgtatattgaa

SEQ ID NO: 204450 - DNA, 440 bp, Homo sapiens
tggagccaaggatgggggcttcctagtggagaacaaggcttcctagtggagaaagctgctgtgtgggaagatcagtagagctttctttgttattttttcctcttggtctggtttctgagagcaaatctaaaggtctcctggataccttaaaagtaccacctggagtcaggtagactctacatggttctgaggagaagagttccactaaaggcatctctgtaagtgggactgacttgaggcagcagcagctttcgtcaggccagcatgggtgtgcagcctggagggttgggggaagagggatgcccttcagcctttgcactcccatctactcactgtcagtgcttgctgtaccgccaggagaatggggaaccagaggtttcctgacaacttggagagaagtcacagttctctttaaagtaattaaaattatactcacatca

SEQ ID NO: 204451 - DNA, 777 bp, Homo sapiens
atggaaaaatacaggctaaaggggaagagcattgaggctacagtcagaaaggcttaacatacttttggagttctggaagattagaagagagaatgtagggaagaagtaatgttgctgagacctttccaaaaataataaaatgtatcaatccatacattcgagaaaccaacaaacctcagacaagataactgaaaacaaattaacatataaatgctacaggaaaccaaagaccaatagaaaatttgaaaagtagcctgagaaaaaagatagattatgttgaaaggatcaactgtttgaatgacaagtgattttcagcagaaagcatggaagctagaattcaatgtaatatattttcagtgtgtttcaaaggagtagcagacatttcataaacagaaattcaaaaggatacattttcagatagaaaaaagttactgaaaatacaaagttgaagatgcaagaaggaatgaaaataaaggcaatggcaaatgtgcgtaactaaaaggactattgactgtatagaacaataatatcttgtgttaaaagaggtaatgaataaaatgtatgccaataacatatagactggggtgaaggtgaaaagattaaatttagtttaattattatttaaccttttcattgtctgtgaagagagtctgagtatcaaattcaatgcatatactctagctatatatacaagagaagtgcattaaatgacatgtaaaataatgcccatggtagtattatttgtaattgttctaaaaagaaacagctcaaatacct

SEQ ID NO: 204452 - DNA, 516 bp, Homo sapiens
atgaaatttgtctatacaaaaaaaaaggatgtgaacaaatgttaacaatacaaatttaaacaggatacaggatttaattttgaaattctataattgcactttggaatatttcaacttgaagagtcttttgatggagctcctacgtttattcagataaattggcattctgttccagaatagaatggaatagagttgagaagtctacattttcacaaaacctaaatttggtgaaatgctccaaacagtcataaagacaacgtttttcttccttttatttttttttcttttttgattaaacatgtctttattatcagtatgcctgattctgtggaaagccgactggaaccctggtcattctgactctcggggcctcatgttccaaggttggctgctgcaactctctcttgagctctacctgtgtgtacatcttggtgatgtcattgtacctgcctttggggggctggtagttagagacccatagtgtataatctggaccttcccattcaaaggggaaca

SEQ ID NO: 204453 - DNA, 213 bp, Homo sapiens
cgcccagatgggctgacctaggagcagtataggctctacacaccattctgctgtcaagtggtcaaaatgaacgcatcagaaggtcaaattctggctcggcctccaagtgcagagacagcattaacttcgagagtattgctggcaaccattataaccctctaattgcctatgcaatgcacaagattttaaaatatatgtattgcacaaacaata

SEQ ID NO: 204454 - DNA, 539 bp, Homo sapiens
cacagtaaactcatggcagttcttctaagggcaggaaaagttatataaaatgtaggcctttaaatactggatttgcaaagttccattatgtgtggtaagaatggaaaagcgtatacctactatgtcccaaataggaaattacctataagcatcataatttaactcaccatacatactttgactcaagtaactgatttaaaaaaaaatccatgtggttggtgcatgtggttcgttatgttgtgttcataaatatgatcatcaaccgatttgcaaaacagtaaaatataataattctatgaactcaattccaaaaataatttacacctggatgaatctttttggaaaattttaccaaacagcatcatcttcagtgcttttctaaaccaaggatagaaaaatgcataaaccattggattaaatgtagagttcaagtagccaaaccaaatcaatacatcattcaaagtaggtggaataatgtagtgaagaaaagggtccatgactgtacagataaagaaagggcaccagcatattaggaaaac

SEQ ID NO: 204455 - DNA, 331 bp, Homo sapiens
ccacccccacgacaacatacatatcccaaaaccctgaattctgagtcccgcccttgggtctttgcccagtaattggccaccacagattctagcagcatttactgagcatctaatctgggccagccctcctctgggtgccatgacacacacatgaacaagacccagccccagaccaggccctagcagttcatagtctgatacggtggttctcagccaggggtgattttgatccccaggtaatatttaacaatgtctggagatgcttctggctgtcgcacttgtgggggctgggaggtatgctattatcatctagcgggtagtggccacggat

SEQ ID NO: 204456 - DNA, 365 bp, Homo sapiens
ggtcggccccatgtagactaacataggtatctaacagtggatagggaaccagtatgagtgttcgagacatgttacaaatataggagctattttacaatgaatccattgaataatactgctagatgctgtgagagacagggactccccggcccagcacacacgcttgagcagggatggagacatgggcatgggtaggcaggctggtggtcagcagataccctttctgtccctcctctgtgacaatcacccccaagtaatttttgggattcagaatgttaggtctacctggccaggtagacctaacatagctgaaaccaggggttgttaattcatttttaaacaataatactagtttactaaaccca

SEQ ID NO: 204457 - DNA, 449 bp, Homo sapiens
caggtggatgcggagggcagcgctggatttcccgggggagcattccaggtttagtccctacctggccggagtctaattcctggccttaatcctgtctgtcatgttccctagctgactacctgtcttcaagcgacctcttgggattgacataggcggaaacagtgccttcaactcagagaaagcccctttgtggactgaccattcccactcttactgcgcttgaatccttgggaagtgagtttggcagaagatacgatctaaaagagaagtctcccccttttctttttgaagtcattggaaactgtgtggagacagtatagtatggtggtgagggcactggcttgagagcccgagcacatgtttctgtctcagctctgccaactctagagccctgggcagattttctaacctcttgtgtacctcggtttcttcatccttttagcaaaaac

SEQ ID NO: 204458 - DNA, 694 bp, Homo sapiens
  misc_feature (388)..(388): n is a, c, g, or t
  misc_feature (394)..(394): n is a, c, g, or t
  misc_feature (405)..(405): n is a, c, g, or t
  misc_feature (412)..(413): n is a, c, g, or t
  misc_feature (417)..(417): n is a, c, g, or t
  misc_feature (420)..(420): n is a, c, g, or t
  misc_feature (600)..(600): n is a, c, g, or t
  misc_feature (611)..(611): n is a, c, g, or t
ctggcacccaaagagtgaccataacatgcagcaagaggggaaggggtgggctctgatttaggtgtataatttcctcagttgactggacaggtctcctctaagaggttctattactcaaccaatccgtgagctccttataaatgcatccaccgattgcagcagtgaaatgattggttttcctagaatcccctgagcaaacgtccaaccaataaaaaggtctgtgcatttcaccattgcttattccacaagatagttctgtcagtggtcacctagggctaccacttaaggagaaagcagagagaccaagcacagaggagacagaggggcaagaggaaagggaagaaacaggatgggcaatgcccacccagtcattgccaacagagaggtnctcacnctgagagatgngagtatnntggntcntggcagcccgacagtgaccatagcatgcagcaagaggggaaggggtgggctctgatttaggtgtataatttcctcacttgactggacaggtctcctctaagaggttctattactcaaccaatccgtgagctcctttaaatgcatccacgattgcagcaggaaagattggtttcctagatnccctgacaaantcaacaataaaaaggtctgtgcatttcaccattgcttattcacaagatagtctgtcagtgtcactagggtacacttaggaaaa

SEQ ID NO: 204459 - DNA, 121 bp, Homo sapiens
tttttggttgtcacaatgtggcagggaagagggtgccactggcatctagtggatggagagaactgccaaacaccctgtgatgtacaggacagcccctacaacaaagaattgtcttactaaa

SEQ ID NO: 204460 - DNA, 264 bp, Homo sapiens
ccattagcatgtttacacaaatgtgcatccagtcccattctttcctcaaagccagttttgattggaggagaaggaagttttttaaaaaatcacctatatacaaaagagaggtgaggatcagaagatatatcttcctgggcattaatcctattctctcgcccattcccagctaagtgcaagccctcgttgacttcaaatagcaccggtagcccaccagttttccatgtcatctgtggattatctgaagtgacattaatctgaact

SEQ ID NO: 204461 - DNA, 411 bp, Homo sapiens
cagtactagaaatagttatcttccctcctagtccctcaagtacggtcatctttgaatatattaattctagaatgcctattttgctcttctttttctcatttaaatttctaatattaaagctgaaattgagggccaggcgcggtggctcatgcctgtaatcccagcactttgggaggccaaggcgggcggattacgaggtaaggagattgataccatcctggtaacacggtgaaacgctgtctctactaaaaatacaaaaattagccgggcgtggtggcgggcgtctgtagtcccagctactcaggaggctgaggcaggagaatggcatgaacccgggaggcggagcttgcagtgagccaagatcgtgccactgcgctctagcctgggcgacagagcaagactccctctcaa

SEQ ID NO: 204462 - DNA, 444 bp, Homo sapiens
acatcacagtcatttctgtgtgtccagggctgtgaacacggagctgccgcggtcagcattccctgtacatggatgtagggtcaggaccactgtaccctgtgggggcctaggtcacagagaaatcccaggccttgttcagagatggtgaagggtgcccggtggcaacagcagggtgtcctctgagccccggcacttctgagctcagggctgagtgaccacacaggtagctgctatgggcccagcccttttgcatcgtgctggggggatgcgggggctctgttgccttctcgggtcccagggagatgtgccttctgtgcccacgtctcagcggctcccacggcgcatccagtgaactgggaagtgtgaatgagcacctgctcgggccagtgattcatccgagtgtcgttagctgctaattataattaaacctttgatgagttgtgt

SEQ ID NO: 204463 - DNA, 464 bp, Homo sapiens
gatttgaccctcaagctatagtttgccaactcctgctccatcctatgctatcttgccttacatctacatgaaagatgtaacatgtcagacagagtgtgcctgaacagtgaccagcgcagactaagtggtcagtaagtgttcattctcgttcccttccctaatctcgttcttcttcttcctccccacaaccagatcagatatctcattctgtgcccagcacaagagaggaagacgagggctttcgcaaggtctaatcagcaggcagagcctgagaaattatcccttcggaggagagaggctgtcattggagcaccataaacagcccctccaggtcccagcatgttccaatggagagtcagaagttcaaatcccagtgctaccactgacaagctctatgatcgtgggcaaaactgcttaacctaacaggccctaaatttcctgtacattaaaatgaatataatgat

SEQ ID NO: 204464 - DNA, 441 bp, Homo sapiens
aggatcagaatttgaactcacgctgtgtgactccagagcctacatgtttaaccacacttagggttgccagataaaatatagttacactggatttttgggtaaacaaatcctaaatatttcatggaacatatttttactaaaagcacattttttgtttatctaaattcaaattcaactggggatcctctatttttatttgctaaatctagcaaccctaaccacactattctgccttctgtaaattcagatatccatatatttgggttgtttaatttgcagtttacacgtgcttgagttttttttttttttttacagaataaatgatgttaattcacatctacaaaactaggcttctggatttctctttccctccatttattgaagggcgggttggtctgatgccagtcttctccctgatagtgaagctaagtgcaagctttt

SEQ ID NO: 204465 - DNA, 405 bp, Homo sapiens
aggtggctatacttcagttgtggataaagaggtgaagaaggacatctatggtgatgctcagtaatatctgcgaagaactgtggagacagacaaatagtcaaaggagaatacagatgactttcagaagaagtgtgaacatcaagctgaggagcttttttgaagagcaggatctttctatcaacatgggatagtggaagattaaagtagtgatgactacatatagaaatacaaagttgaagtgagagacgcaagtctgatactgcaaaagaaaaatgacacaacaagaagatggttgtctacaagccaggaagagaaccttcacaaggaaccaaatcagcgggcaccgtgatcacgagactcccagcctccagaactgtgagaaataaatgtctgctgttgaagcca

SEQ ID NO: 204466 - DNA, 517 bp, Homo sapiens
aggtaattaataatttgcatgtttgtatatgatatgatgcatattgtttgtaaattcactcatagccacctgacagaaagagtcccttttctagtagtgtatggatgtcactcctattttgttttttaaataagtggttttcccccatccagcaacctttttagcaagttagagtctttagtccataacctgacaatccatgttcttaaaaatttgttatgaaagacctggatcagaacaacgtaggtaatattagaaatgttcattccatctagtcctctagaagcctgcatacatcatcaagcacgtaacagtgcctgactctcaaaaatgcagtttatgtcaagagactgttacctattatatgttcccaaaatttgcttttaaaaaagcaaactaggctgggcacagtggttcacgccctaatcctagcactttgggaggccgaggcaggcagatcacctgaggtcaggagttcaagaccaacctggccaacatggtgaaatcctgtctctac

SEQ ID NO: 204467 - DNA, 315 bp, Homo sapiens
caggaagcttccaattatagtggaatgcaaagggggagcaaggcgtctcacctggtgggagcaggagcaagagagagaagcaggaaggtgctacacacttttcaccaaccagatgtcacaagaactcagagtcacaaggacagtgtgggcatgggggtggggggtggactggtggtaaatcattcatggaggatccaccccatgaaccagtcaccatccaccaggccccgcctccaacattggggattataattggtcctgaaatttgggtagggacacagatccaaaccatatcaagtggtaatatcgtatgtt

SEQ ID NO: 204468 - DNA, 329 bp, Homo sapiens
caatggttcttaaccaaattgaaatgacttaaatgaaagccataaagttcagaatctggatggcaaggaagctgatcaagatacaggtaaaagttgaaacccaatccaaggtatccagtaaaactatccaaaagtagaaagaagacaaaatagccactttaagaaagaacaaatggaacttctggaattgaaaaaattactacaaaaattacctaatacattttgaagcattaacaacagaatagtccaagccaaggaaagaatcttggagcttgaagacagaatcttataatcaacttagacaaagggaaacaccgggagatcctcta

SEQ ID NO: 204469 - DNA, 420 bp, Homo sapiens
gcatgcacggaggaaaggccacgtgaagaggcagtaagaaggtggccatctgcaagctgaggggaaaggcctcaggggaaatctcaccatgcacagaggaaaggccttgggaaatctcgccggcactttgagcttggactttcagcctccagaacactgagaaattaaatttgctgtctaagccaaccaataaatctgcagtttttgttatggcagccctagccaactaatacagagctttaaaaaacattactatgtacactgtagaatttaatactctaaaaagttttattccatcgtctccactgacagaatttctaaattaataagagaaaagttacactaggtaacatgattagtacataaatgccttacgggcagatttcctttgtttactgctatatacctagtgcacaggtg

SEQ ID NO: 204470 - DNA, 481 bp, Homo sapiens
atcatttaggtgggagagaggatgttagtaaattaaaagaaaaaggttattcattaaatgctaaatagtataggatgtacaggccagaaaagaaaaaggaagtccacgagtgaggaaaggttggaaaacaatagtagaattaggaaagctattcaaaatgctctcttatgtaaaaaagagctttgcttaggaatatgttagaattttttttgcctgttttttaacgactaagacttgagagttctttctacatgttctagatactagtgttctgttggacatatggtttgcaaattttttctcccagtctttagcctgtatattcatcctcttaactgtaaaaagttttaaattgtttgtaaaagtaaaatccagcccccagatcccagtctcagcaacattttgagttctgtttgagacggtgtccgggtggcttttatagtgtgagggctaagacagcttgtcttgcaggacagtaggt

SEQ ID NO: 204471 - DNA, 442 bp, Homo sapiens
tttttattttagccgttctgatagtgtgtactaggattaattcgcatttttctcatggttaatgatactgaacaaatttcgatgtgtttttttgtcatatggacgttctcttcagcagaaactgtttatgtcttttgcccattttcttattgggttgtttggttaaatgtttgtctgttttttaacgactaagacttgagagttctttctacatgttctagatactagtgttctgttggacatatggtttgcaaattttttctcccagtctttagcctgtatattcatcctcttaactgtaaaaagttttaaattgtttgtaaaagtaaaatccagcccccagatcccagtctcagcaacattttgagttctgtttgagacggtgtccgggtggcttttatagtgtgagggctaagacagcttgtcttgcaggacagtaggt

SEQ ID NO: 204472 - DNA, 495 bp, Homo sapiens
cggcgggggcgggagctgtcagtgggccccgaccctacagcccggggctggcgggtggggcaggaggactggggcggagcgcagaaaaacagggcgacgccctgtgagggaagggtcccgcggtttggctgtttgggcctgtggctgttaggggtggcaggatagtgacccggggacaggacttgggggcactgtgggggtagaatttggagacagagtgtcccagggtaggattgccgagacacgatggccgagggatacgatttttttttttttttttcctgcaccttcagctacctaaagtcttatcctcaagatacaatctttggcctagtcatgtctacaaatgctgcctattttaccatgttgcagcgctgtcagattttgctatcactcctattaagaattccaagctacagatcttgtcctaacttctcatcagagcttctagccaacacatccagctgtgtagggggcctgtttgtagggtggaaa

SEQ ID NO: 204473 - DNA, 490 bp, Homo sapiens
ttcccaggtgcaactgaaggactatggctatggtagctgcccaggaagactggccatccgattcatgcttgtgcagtccttggacttttagatctaccaggatcatcacattttggagttctcagtcccatgtacaaagtccaactatctgaggccaccatgcacttaggatgtccaggccacctggagaggctaccagatatgtgtatgaagaagttgtcttgaaagtggatcttccagcccatgttattctagctacagctgtttgagtctccttgtgcaagccccagacatcatggaatggagaagagctgagccacggtgtcctctccaaattctcaatccacaaaactcatgaaaataataaaatgattgtgtctttgtgctactaaatttagggaaatttgttattcagcaaagatgattagaacaagagaccacaatttgactatcatatttcagaaatgacacagatccagagaggttaaat

SEQ ID NO: 204474 - DNA, 779 bp, Homo sapiens
tcaatgcttgaacaagaatagtttcatgttatcctcttactgtgttacatgtataaaaagcccacatcctgtgtttctcaaattgccttctggagagcagaggagatgttttaattgaatatctactgggaatctaagtaaggcatagaatcagatttttagagctagaagggaaagcagggatgtgttgaattttccagatggccaccacgataactcccatccttcgtgctttcctacgatgtcaggaacctgatcggaaagtgaagtcaaattcttctcccttgaatctgactgaacttgtaaatgctttaaccagtagagtggagggcatactatatgctttccaaggttatagaatgccgtgttctttctgtcctgtcaaacaggatcatcacattttggagttctcagtcccatgtacaaagtccaactatctgaggccaccatgcacttaggatgtccaggccacctggagaggctaccagatatgtgtatgaagaagttgtcttgaaagtggatcttccagcccatgttattctagctacagctgtttgagtctccttgtgcaagccccagacatcatggaatggagaagagctgagccacggtgtcctctccaaattctcaatccacaaaactcatgaaaataataaaatgattgtgtctttgtgctactaaatttagggaaatttgttattcagcaaagatgattagaacaagagaccacaatttgactatcatatttcagaaatgacacagatccagagaggttaaat

SEQ ID NO: 204475 - DNA, 496 bp, Homo sapiens
gcctctgtctctgcaccaataaaaaaattttaaattatgtcactactccttcccacccatttcaggctcctggtgctttcctcttctgtctttgtctccttatcagatcaatgactgaatcaataattatttactctcataactgttacttatgttcatcttctattgaatgatagaaataattaacatctaattgtgacaattttataagaccaggactattccaaaagaaaaaagatactatacattttcttttctttttttttgagatggagtctcgctgtgtcgcctagactggagtacagtggcaagatctcagttcataacaacctccgcctcccgggttcaagcgattctcctgcctcagcctcctgagtagctaagactactggcacccagcaccacacccggctaatctttgtatttttagtatagacagggtttcaccatgttgcccaggctggtctcaaactcctgacctcaggtgatccgcctg

SEQ ID NO: 204476 - DNA, 538 bp, Homo sapiens
gctgacaataggcagtctaataggagtgtgatgagtaaaaggaaattgcataaaatcagggtggaaagagctcaggggtcagattgtcccaggcctgggagtctgtgtatgtgggctgggtttcatcctctgtaaagcaggacactattaaatggttctaagcaaggaagtgcttttgacttacattagtcaaagatctctctggctgctgtatggagaacagattggaagagggcaagagtggaagaagcaagaccagttagaggctagtgcagtcattggagcaggagaagatgggtgctgggatggaggggtcacggagaggcaggagcggtcagattagaaatagagttagaaggtagagcaaccggggctgcccccctgtgttcttgggattcaccagaacccagtctgtatgttccgctctctgccctccacacccctcacagtgaccaccactgcttattgcaattacttcccatgcttcctcagcattcttcataataaaaggaaatcaaatatttgtgttttaccatta

SEQ ID NO: 204477 - DNA, 442 bp, Homo sapiens
tctggtttctggcctttctgaagagcattgtggtgagagtttctgtttcattctaaggagagtatctgctctgggatatctattgtacttggacatccatatcttagcatttgctgcaactctgacagttggggtctgccagaagtgttcaagacatatattacagaagagcttctcaaggtacactggatgcctgttgcttctttctccaaggacttctgccctctgaagagcaccggtggaggccttctggaccggggagtctctgctgtttgtcttcccgcttacttctaaggggcgtgcatgattcactggtgtgaaaagaaagttctcctacagttgatgccttctccatcaaagctgctaccttgttgtagaactttttacctggacatcagactccacagaaaagactatcacaccgccagaaccacaaatatcg

SEQ ID NO: 204478 - DNA, 523 bp, Homo sapiens
gaatattattcaatgttaaaaacaaatgagccaccgcaccatgaaaagacatggagaaatattaaatccgtattactaagcaaaagaagctaatatgaaaaagttacataccatatgacattctggaaaaggctaaactatggagaagtcgaaaagatcagtggttacctgaggttagggggaaggagggatgaacaggcagagcacagaggattttcagggcagtgaaactactctgtatggtctaatagtggatacatctcattatgtatttgtccaaacccacagaatgcacataaagagtgaaccctaatgtaaactttggatgacaatgatgtgtcagtgtgggttcatcattgtaacgaatgtaccactctggtgggggatgtggataattcaggaggctatgactttatgaaggaagtgggtacataggaaatctctgtatcttcctctcaattttgctgtgaacctaaaactgctctaaaaaataaagttgttgttgttgttgtttttaaaaaaa

SEQ ID NO: 204479 - DNA, 440 bp, Homo sapiens
ttgtggttctggcgctgctaaatgctgggaataaaaccagacgcagagccacttgctgtcttgtaggagcccagcacctggtgggaggtgcttggagaacagaggtaagatctgggtgtaggaagaagggaagggcaaagttgttctgagaagggcttggagatgtggccctaaagccccgatggatgaggaggttcatatttgtcatctgccttagttcagagaagactgaagcagctcagaggacaagcagaggttcagagaagtgtgtgcacgggtggggaaagtgtgctcccatgtggtttggaagagttaggggctccctgagctctattgtgaactatacgggtttcatccaaggaatggtatgatgtgggcataaaaccattcttcagacaactgaagatggtccccttctgtagccagaaccacaaatatcg

SEQ ID NO: 204480 - DNA, 599 bp, Homo sapiens
ttgtggttctggcgctgctaaatgctgggaataaaaccagacgcagagccacttgctgtcttgtaggagcccagcacctggtgggaggtgcttggagaacagaggtaagatctgggtgtaggaagaagggaagggcaaagttgttctgagaagggcttggagatgtggccctaaagccccgatggatgaggaggttcatatttgtcatctgccttagttcagagaagactgaagcagctcagaggacaagcagaggttcagagaagtgtgtgcacgggtggggaaagtgtggtgtgtgtgtgtgtatttaactccccaaaaggaaacagcatgagacaggcccaataacaggccaaggaatcctatagcagcagaccagatattgtgctcctcgacccaaccagtaaatgttgtaaatgcttatctttggggagagaaggggaagggcccacccagcttctgttcttctttcccttggtaacttaccatctatgagttagtgagatggagacatcctaaccattaatccagggaaagggaggaatctaagccatcagcaagggagttagtgcttttcatcaaatttgagacacctgtga

SEQ ID NO: 204481 - DNA, 448 bp, Homo sapiens
  misc_feature (121)..(121): n is a, c, g, or t
  misc_feature (257)..(257): n is a, c, g, or t
agtaattgacatgtgttgcttaggagcaggtaaaacacaaacagcaaagaagcacagctctaccttactctttgctagtggttcttacatttattcaagtgcagaaccagcctgggcaacntggtgaaaccctatctctacaaaaaatacaaaaattagccaggtatggtggtgcatacctgtagtcctagctattcaggaggctgaggtgggatgatcgcttgagcccaggaggtcgaggctgcagtgggttgtgntcgtgcccctgcactccagtttgggcaacagagagagactcggtctcaaaaaaaaaaaaaaaaaagtaaaaccttgggcttaaattgggcgggattgcctttttttttaacttctaaattttttaaattgtatggtacggtatggacgtgtcctccagatattttcccgtgaacctttttttctctcaaat

SEQ ID NO: 204482 - DNA, 401 bp, Homo sapiens
ctgaggattcctgacatctagacgaggcagttacagccaagaacaagtccactgaggctaagctgtgctcctctggagggctgtgtttagagtccagccttctaggggaagcaaattaaacccaaactatagaacagcccagggaaatactcacaaagggaaatgctgacagtcagactcctgaagcttcctgatgcttctcgagttttggtaaagaacctcagtgctgtttgtttgtttgttttttaatgttttctggttttttgtttgttttgagacagtctcttattctgttgcccagtctggagtgtagtagtacaatcatggctcactgtagcctccacctcccagattcaagtaatccttctgccacagcctcctcagtagctgagactacagat

SEQ ID NO: 204483 - DNA, 511 bp, Homo sapiens
tggagtgatggcctgcgggccgcttgaccctttgggaaggggtgcgaacggagaagttgtcccccagtgcgctcgaatcagagcaggctgggctgtgcgtgcccggcgccgcggagcccagagcccgcgggatccccaggctcctggtaccctcggcaatgcccccaaccgtcctggctccgaggggcgcggacaggactcggccgccaggcttgctttcgactgcgttcgaccctgttcaccacccactttgcgccccttcagtccagacccgcggcttcttagtcttccaccctcttctggaggcgagaggatcctcgcgccccgggagaaaagtatgggatttgttttttctttcctgcttttcggaggcctggggaggggcgggaacccgtgcgggaggaaagctccagggcttggcgctctcgccgcgacctgcttaattggggcgccgagcagccacagcgggaaggcaggttcggtctggtttttgtttttctttctttcttta

SEQ ID NO: 204484 - DNA, 536 bp, Homo sapiens
agatggagtcacttatgtcaagggtgtgctatacatatagtatcttttaaagagctgcatctttagaagcacattgctggttatgtaagatgttctatctgaggaagtgtgctgaagtgtgactactactaataataagcagaaagcacgtggtgttgatggggatgttgtcaatgctgatggcagcagcgggcacttgctgggcatcaaaccctgttctgagtccttggaatgactttccataaacaaacccatctcccatgtcaccacatgcccctcagccctgggcagtgacttctgttagggtgatcatctcatccaggtttgtctgtgactttcccacttgtagcactggaagtcccaagacccaggaaacccctcaatcccaggcaaatcaggagagttggtcactctactccatatccacaatccattttatctatttatttgttatttttgcctttaaatttatatcctagaaaaatactttaaaagctgctagacatgtccagctgaaagaacattcttcaaagatt

SEQ ID NO: 204485 - DNA, 1103 bp, Homo sapiens
ccaaagttctctcatgtgtctcccttttctgaagtactcttcctcacaagtctcacctccttggccatacgaacttcatgtatctctgacttctcaatttggcgatgtctcgggattgtgtttctgttctctgttcctgtgctgcaacctggaaactttctccagacagtaagctgggacatagatcctaagggctttacctcttttgttttcttatatagatgatcacagaaaatgcctgataaatgttgtttgataaaatttttctgatttactagttttttttaacactggtcaagtggttcatatagcatttctcccccatgggcagatgttactgaatttttaaatcagtatagtgtaaggggagtctatcttgaacttcaggcaaatggatttatttaaggacctcatcaacaagtgatcttgtcagtaacttggtcatgtggcatgatgtttgaattcttcaagtgttcttatgtaaacttaaaacatgttagctttaggacttttttcatatttagatataattttatggttttgtttagttgagtggttctcttagaagtaaatgtcagtaccttattgggtatgtctctcacagtatctatcattattttagtatttcccaaccctagactggagctattggctacaaattcactgcagaattaatttaccttcagaaatgctattttttccagttaagtctgatataataatttacaaactgatgtgtattttttgttaaatgtaattatgcattaggttcagggatcaataaactatagcccacacaccaaacctgaatgaaacaattactgataaatgtaatactcccaggtagtagcttaagaagctgaacgtgagggggtgtggagaggagtataaaggggaatctccaaaactcctgtttttactaatgactaagcatgaggaagactgaacgtggaacaaaattatattgaccatattgacaaaattatctttatattgccatgttttgctttggtttccttttttaaatggaaggtagactatgaagacattcttgctgtgaaagttcaaacaatacagaatttgaagtaaaaagtggggagtgt

SEQ ID NO: 204486 - DNA, 486 bp, Homo sapiens
caattcaagacccagcttgactttactgtctccattgtggtggttaatggagacaaattcaattcaaatatgtgcacgtggatttctttgtttctctgaggtttgacttatctgccaaaagagagaaacacagaaagaggggagaaacaggagaggggaaagagagaggagagagaaaccaaggaaatgtgacatataataattttttaaagaatattttttcatttttttattgaggtataaaatacatgtagtaaggtatgtcaataactcaaatcttatgtgatttttttatgtacatgtatacctgtgtacacctgtgtaaccactacctaagtcaagatagagaacattttaatcatcttaaaagatttcctgtgtctcttcccaccaatacctgctgatgagcccactctccttacagctatcagcagagttgttttacctgtccttgaacttaatataaatgtaattatactgtatatg

SEQ ID NO: 204487 - DNA, 450 bp, Homo sapiens
tcattgttctatgtatccagagacattttaccacaaatacctagttaaatcttgtattgtcagagattactaagtaactgataatttttcctttctgaatctttttctagtcagtctggtaacctgtttctttagtcctcttaaaaggtactgcatgcatttgaggagagaccatttcaggacctatcccattttaaatatgtaacaggttgtgcttttctaggaatttgtgaagtttgttgtaaaatactttatataaagttccaggtatatgaaggttgacaatgctttattctgattgttgtaaatttttgtatttatacattttcagagggtttcacttggtagaacctgatttaatttagatgtgaagtaactgattccttccacaacccttctttgtcttcagtttatgtgcatcactaactgaaataaatttttgtcttacga

SEQ ID NO: 204488 - DNA, 591 bp, Homo sapiens
aatgtctattatggtaaagttgtatcagtcttctagttataacacactggaagtaagaattaatatgatagattggctgtcagacattggaagccttatatagtcctgttttaaattattcctgtgtgttttagaggtgaacatgccaccttttcctttatccatcatagatgcatagaatagagcaaaggagaaaaaaaaattcctgtgtatacgatttgattaaacctttgaaaagctagaagtcaggcttaacctttgtatcaaagctttaattagatcatttttattttttctcctaggtagagtttaatttttcacataggcataaggactattaggaaaaacttatgttgaagtaaacttccaccactcagaaaattcttgattagaaactgtatagagatagcaggggtttttttttggttggtttggtttggtttggtttttcgagacagagtctcgctctgtcacccagggtggagtacagtggcacggtctcggctcactgcaacctccacctcccaggagagtcgcttgaacctgggaagcggaggttgtggtgagccgggatcgcgcattgcatccatc

SEQ ID NO: 204489 - DNA, 372 bp, Homo sapiens
accgcttgatcaaaggttagctgacttctagctttcaaaggtttaatcaaatcgtatacacaggaatttattttttctcctaggtagagtttaatttttcacataggcataaggactattaggaaaaacttatgttgaagtaaacttccaccactcagaaaattcttgattagaaactgtatagagatagcaggggtttttttttggttggtttggtttggtttggtttttcgagacagagtctcgctctgtcacccagggtggagtacagtggcacggtctcggctcactgcaacctccacctcccaggagagtcgcttgaacctgggaagcggaggttgtggtgagccgggatcgcgcattgcatccatc

SEQ ID NO: 204490 - DNA, 503 bp, Homo sapiens
acatgtaattcatccaatgatgatgcagtacaagccatctgaaagtgggggaatggacaaggcggcttccctgcaggaagaattgggcaaggctcatcaggaggggcccccaaaccatgccttacaagaagctctagagtttaccagatggagaagtagctgaatggtcactcctggccagaagggcaccagtgcagagggggaacttcttggtgcatcgagaagcttccatgattggggtgggctacctcattgggtgtgatgtggactctctggctcaggtattactcactcaacacccttcagcaccgatacttccaggacagttccctgacattcagtgggagaggacgcataaagggtgtgcccagggacctcagaccactttaaaactggagtccagcttgtcaaagtaacaacaacaacaacatacacaaactacttgcttattttttaaaaaaataatagttttgttgaaatataattcacatgacatcataaca

SEQ ID NO: 204491 - DNA, 158 bp, Homo sapiens
aggtgatctagaggatcccgttcatatctacacaaaaacttgtaaacaaatgcttgtaacataattcaaaatagccccaaagtagaaagaactcaaatggttcatcaactgacaaataagctaactgtggtatatccatacagtggaatattgttcat

SEQ ID NO: 204492 - DNA, 455 bp, Homo sapiens
atgaggataccccccccatggaatccagtccaaaaatgtgtttaaaatacaccacagttgtaattcttgaattctctgtcaaaatctaaatttaggggatttcagatttctctggaagaaaatgggaaaacttagaccttcatcctttaaacagcaggaattaggaaacggagctgagtgccgctgcccctttcagatagggtgttcaatgggccaatgggacatgcctgtggtcacacacgtcactcattcacccacctgcctggcccctgctggctctgaagctggacatcctgatgaacaggatgctatgtgtcctttcaatatcatgtggccacacacacacacatatgaaagaaaccagccagacacaagagatggtctactctataattctgttttttggtttttgatttgcatttgcctagtgattagtgatgtttagctttttaaat

SEQ ID NO: 204493 - DNA, 567 bp, Homo sapiens
acttactgcactgatctgaaaaaggtaaaagacatttaaaaaaaaaaagcttccctcaatggtgtattctgaggaaatgattaactctccagacaaaataaacagaccttcccatcaaagattgctataaaaccagaaagactgacaatagaaagtagttattttaaagctggccatttggacgtatagaaaaccaaaattcaaagccaggaaggatctattgctttgttcaatatctcccagtatgttgtgagaatgttaacaggtgttgagtgaaaaataaatgcaaggaaatgcatgaagtcggctttttaacttttaagatgtctcagagcctttaaatgccagtgggtacgaggatactcgtgaggggtctagggtttatttcccatccgctgcttgccttcatagtgccttctctcttagagcaagtcctgaattgagcatgctgaggacagcactttgggagatgctcatctaggccatccaaatcccctcattttcagaggaggaaactgaagccaggctcaaagtcatcattcatagccagacaggggcagcatcaga

SEQ ID NO: 204494 - DNA, 581 bp, Homo sapiens
cggggtttcaccgttttagccgggatggtctcgatctcctgacctcgtgatccgcccgcctcggcctcccaaagtgctgggattacaggcgtgagccaccgcgcccggccattttttgtattttttgtagaatagggcttttgtcatgttgcccaggctggacttgaactcctgagctcaagtgatctgcctgccttggcctctgaaagtgctgggattacagtgtgagccatcatgcctggcagcatcatttgtttttttggtgtggtatccttgccagaaatgcatacttgactccagtattaagaaagcaccagacaaacccaaatggagggacattcaacaaaataactgattggaaaaaactctttaaaagcatcaagatcgtgttagacaaggaaaaaacaagaactattacagactggaggagacaaaggaaaatatacaaatgcaatgtgggatcctggatgggctcctggaatagagaaaggattttaatagaacactaggaaacttaaataatatgtgtagtatcgttaataacattgtatcaatattaatttcctgttcttgatcattat

SEQ ID NO: 204495 - DNA, 428 bp, Homo sapiens
aataactctacaatggccactaagtgtttgaacgagagaaaagtccaatgtctctcactataaatcaaaaactagacatgattaagcttagtaaaaaaggcatgttgaaagctgagataggccaagagctagacttcttgcaccaaacagctcagttgtaaatacaaaagttattgaaggaaattaaaagtgctactcttttgaacacacaaataataagaaagcacaacaaccatattgctgatatggggaaacttttagcagttcagacagaaaatgaaaccagccacagcacattgttaagccaaagtctaatccagagcaaagccctaactcatgtcaattctatgaagactgagagaggtaaagaggctgcagaagagaagtttgaagctagcagagatttgttcatgagacttatagaaaga

SEQ ID NO: 204496 - DNA, 362 bp, Homo sapiens
ggttcatttcctgtttattattaaagtgattttcacaaatgtttcattacatgcatatgggggacatgatggataaaacaaaactgaatatttgtggcaactaaaaggaagatgtggttatgttggtatttgccacttgcaggcagagtcgttgccaagcgtctggacaatacagtgccctcacaggagccagaagtgaagtctgcgggccgctagcacagcgccctggtgtcctgttccccgagcaatgtggcctgcgtctgctcggcatgttggaggttctgatctcagcggagtaagacacccggcatcggtcagctccctcttcctcctcctgctttctgccacccatctgccgaggg

SEQ ID NO: 204497 - DNA, 412 bp, Homo sapiens
ttatggcattgctgtctcactcatgggccttcacatgcttctctgtgcccagaatccttatcatcttcctctgtacttagctgaggcatccttctggtctcagctagataccactttctaatgaaagcattccttggccaggcatggtggctcatgcctataatcccagtgctttgggaggtggaggctggaggattgcttgaggccaggagttcaagactaacctggacaacaaagtgagacctcatctttacaaaaagtaaaaagaaaattagctaggtgagtggcacatgcctatagtgccagctgctcagaaggctgaggcaggaggattgcttgagcccaggagttcaaagctacagtgagctatgattgtgtgactcccggggcaacagagtgagaacctgtgtca

SEQ ID NO: 204498 - DNA, 293 bp, Homo sapiens
ggaagtgaagagccccagaacagtcatgggcctctagcacaccacagctgttgtatggaaaagcagccagactgtcttccttgtgggtccctgtctctgctactcctcactgggcagggcctcctgacctgggcccccagcacatccaccctgcccccacctgattacttcagtcagtggaggctctgtgtttctctgggatggaattcccagaaacacctgacaggctctctaccattgctgctgcagcagtaccaacccttgctaccctcaggcgggggaacaaagaccct

SEQ ID NO: 204499 - DNA, 739 bp, Homo sapiens
gctaccacctcctctttccccttttaccgttaagcctggaaaatcagcttacaagtggcaggtcctcagttcaacctcacttctcagggagatagaagctccacatccccattttccagatggagaaagatgatcagataagcctcgaggccgccttctctaatgcccagaattcattcaaaactcctgcccttctcaccccaccactcctgggcacatcaaaacctcgggatataaagtcagggggtgagggtctagtggcccctgaacccactgccctgcccctgccctaccacctccttcccttgaatcatgttcccctctttctggacagcttcagaagggagccctggtctgcgtagggctggctcactgcttgttgaagcccccgcttgctctcaggaaatctggggaaatcttggggatctcaatgtggctgagttcctggtggaaaccctgcactctcccctgagcacccacagagaaatgtgagttccccactcatctccctggaaagcaattagaggcataattaaaatgtcactcaggtccctccctctgtccctagacaggctcattcgtgtgggagttatgagcggggacttctggctgccccaagggaagaagagagagggaggagagctggggcccattgggagacgggtccctaggggctacagtctagctcagggatgactggggagaggaaggtactgttcaggcgaggaccaggcagatg

SEQ ID NO: 204500 - DNA, 350 bp, Homo sapiens
ggcttggtgcgtcacactggtaatcccagcactttgggaggccagggcaggagatcgcttgagcccaggtattcgagaccagactaggggctggactgtaggagctgtatcttactccatatcatacccttatccccagcaatgcctgatgatgggttggtgttcaacaatgtggactgaatgaatgagacagccggctactgaagaagtcagggcaacctgcagtgctgttagggaagtgtccctttctagcaccttctcagagggtcctcctgtataccatatgcgaaattctgacttaagatttggagcagctagtgctttttcattgtttgacttaacatgatcat

SEQ ID NO: 204501 - DNA, 534 bp, Homo sapiens
cagttggaatccttttctcacatatgctaagttacaatgtaaggatagatgtctttctaaactcttcatctggtccatttatttatttgtacatttctatgccaatgttagattgttttaattactaaagctttatacttaggataattggtaaggcaagtctccatgtacttattcaacttttttcaaaattatcttgggtatatttatagagtaaaacttcagtattcattttagaataaatctgtcaggttctgtcaaatactgttaatttaaattgggaatgcattgaaattaaaggaaaattagaggtgtattttcatagctcctgcattgatcattcccaccaattaactggtatatttatacatttattcagatcttgttgcatgtatatcaatgaagcttcagatttgcatcaaaaagataatgaatctgttttcttagataaaaccttaggaactttataattttttgagtgtactgtacatggaaatttttttctattaagttttcttattatttattgatctt

SEQ ID NO: 204502 - DNA, 468 bp, Homo sapiens
tgtatttatatcaagtaactatgactattttacatgggattccttgttattttaacaaaactttaatttttatctaggtttcagatatgtagagtcatttgggcagggaagttctacctgaacactgccattatctgatggcagctatgtaaatcacaggctggaagattaaaatgaaaaagagcccctgaagcctggccctgccaccctgaggtctataatgtaatgggaaatgtcacggaatcagttacaagactagaaaattcacaactcagaagagtttgggtacccaagcagagaacatagtataaagtttaggtaaatttcaaggcttatgatgtggattagataatccaccctgttttagctgaaaacactcaaattgcaggccagcttttggagaggtgaaactatgctaatgtaaaggcataaagataaaacagtgcagcaatgcctaattaattttta

SEQ ID NO: 204503 - DNA, 214 bp, Homo sapiens
cacttagaggatcccctccttgtaatccaagcagtcgtatgtggaactatgactgtgcagagaccctgggaggtggtctgacccaactctgccacatgcggggggctctatttcaccactgctgcctccttggcactgctttttgaggcacattgataatttagctactctgtgttaaagatagcgatgtagactgactgattgcctgatgtaa

SEQ ID NO: 204504 - DNA, 536 bp, Homo sapiens
tcacatcctgacaagctgtctcttcaggaatagacattctcaagcaagcaagaactcaaggaatacaggcaaccatgagccacctttggggaaaagcaaaacaataaagccaacaacaaaatgaattaaagaaagaactcaaatgaaaaaaacatgtacctcagaaacaaaaatagaaggactggtaaaattttaaggaataactccttttgtaataaagaaagatttaaatgaagttaaaagtgcaattctttcaggtttactttgatttcttttcagataatttcaagaaaattaaactctggcaaataaaaactgcatgtacagtatgatctcatttttgtttgactattcatccatcttgctttgctctctacataaatggagagattatgatgttttatcaatacctgttttggggtggtggaattttaggtaatgttttactttcttcctcatgttcttttctgtattggtgtaagtttttttgggggtgggacagagtctcgctctgttgcccaggctggagtgcagtg

SEQ ID NO: 204505 - DNA, 516 bp, Homo sapiens
gccaagcccaccacaatgcaaaagcagcagctgctggcgctcacattttcagaactctttcatgtacattatgccatttgatcctttaccggaaccccaggagagagatgggcagacatcttagactgttttcacagataaacaaagaaaagttaattaagtctgtctaaggtcagacaggttagtagtgtgagacgagacgaaaacctgtgcatctgtgagtccaattcccagctcagggctctcttctaatgcacaagggcccgtgatttctcttgtctactcgattcttagtgagcaccttctgtgtgtctgagactgtagtgggctgaggggattgagagctcgctaagataaaagttggaccctggaaggagatgtgtgaccatgtcattagagactacacatgctgtgcttgtgaaagcttcaaaactggaaaagaaaaatcgccatccttgggattctacaataactatagttaatgacatacaaattgccaatactccctaccaccca

SEQ ID NO: 204506 - DNA, 487 bp, Homo sapiens
tgctggagagacccttgcccatgatgctgatgggtgtgaagcagaaatacagtggaagagctaccctggaggaatcatgctgccaagtcagacaactggaacgtgtctcactaccgggagtagtttcactgaggttgtgaaagggtgggattcaatggggaaaaggaaagcttgctccctttattataaaaagtgtttaccaggcacagtggctcacacccgtcatcccagcactttgggaggctgaggtgggtgggtcacctgaggtcgggagttcaagaccaagcctggccaacatggtgaaaccctgtctctactaaaaatacaaaagaaattagccgggcctgatggcgggcacatgtaatcccagctattagggaggctgaggcaagagaatccaggaggtggaggttgcagtgagccgagatcgcgccactacactccagcccaggcaacaagagcaaaactccatctcaaaaaaaaaaaa

SEQ ID NO: 204507 - DNA, 130 bp, Homo sapiens
agtaggagaacctatcctagagtagaggtcagtgaagatcttaccagagtgaaatttaatgtcagaagaatggggtcactttagtcagggcaaaagggagttaggaaagaatattccaggcaaggggaac

SEQ ID NO: 204508 - DNA, 539 bp, Homo sapiens
ggggcctgccaaaggctccaaacagcatctccatctgcctctgacacctcgagcaccatggggtctgctgggtcatatggcccgaaggggagagcagcttgcacagcagcctggacctgttgcagagccttcccttgttctgggcaccactcaaaactagcagctttttggatcactaaattaatgagccggagtcacacacccaaatgttaggggctgcctcccacaaaatcatatattgaagtcctaacccgcagcctctcagaatgtgactgcatttggagattggggatttaaagggtaattaggataaaatgagattaggatggaccctaatccagtatgcctgttgtccttataagaagaggagattaggacacagacaggcacggaggtaagaccatgtgaagacccagggagaggacgccatccgcaagccagggaaagagacctcagaagagactaactctgctgacaccctggccttgaacttctaagctccaaaattgtgagaaaataaatttctgttgtttaagcca

SEQ ID NO: 204509 - DNA, 405 bp, Homo sapiens
gcccacctcagcctcccaaggtgctgggattacaggcgtgagccaccacacccagccctattactgctgttttctgttttctgaccatttcgtttctgttaattctttcatgctgtcttccctggtgttttcttgaatttttgttttgtttttgttgttttatgccttctttttttgtatttacccactacaatttttttttgtaatttccaagaaacttatgtaaaacatctcatagttataaaatcaagcttcagatagcaatttaactgtttgttttgtacagatagggtcttgcgttgttacccaggccagacagggtcttgctttgttacccaggttgtagtgcagtggtgcattcatagctcagtacagactcaacttccccaggctcaagcaatcctc

SEQ ID NO: 204510 - DNA, 224 bp, Homo sapiens
acaaaatctgcttctcctgctgtctatctcatcttagcaaatggcaactccattcttccagttgcccaggccaaaaatctggagtcatccttgacttatccttttctcttatacccaacaatcccatcccttggcaaatcctgtggccaccagcttcagaatttacaacaaacacaaccacttttcctcgtctctatacctaccactcttttccaaaccaccat

SEQ ID NO: 204511 - DNA, 720 bp, Homo sapiens
ttttaaacttcctcattataacacaaattttgggataagaaaacgtgtgtaaaaggccatttgggctggatgcagtggctcactttgggaagccaagctggtaggattgcttgaggccaggagttagagattagcctgggcaacatagcaagacctcatacaaaaaagttttggtctttttttttggagacggagtctcactctgttgcccaggctggagtgcagtggtgtgatctccgctcactgcaagctccacctcccaggttcacgccattctcctgtctcagcctcccgagtagctgggactacaggtacctgccaccatgcctggctaattttttgtatttttagtagagacggggtttcaccgtgttagccaggatgttctcaatctcctgacctcgtgagacctcatacaaaaaatttacaaattagtaggtagggccaggcacagtggctcatgcctgtaatcccagcacttagggaggccaaggcagggggattgcttgaccaggagtttaagaccagcttgagaaacacagggataccctgtctctacaaaaataaaaaaaaaattggctagatgtggtggcacgtgcctgtggtcccagctacttgggaggctgaggtgggaggatctcgggcccaggaggtcgaggctgcagtgagtcgtggtcatgctgccgcactccagcctgcacaacagagtgagaccctatc

SEQ ID NO: 204512 - DNA, 492 bp, Homo sapiens
ccctcttaattaaatgcagtgagagaaatgggatatcaatccaatacattgagctcagcttgtcctgagagtcagggtgcctagagaatatttgatatgccatgagttgcacagtgttataatgggccctgagttagtgttttgtgtatagtattcgtggtagagtcctgtctcttcccagataagtgtgtgttatataggatataacagtaagtagacataagtgcttgtttttattattagaaggctgataaggagcagagaacttgtggtcttagcagcccacattaaggaatgcaggttctatttaagtgcaatgataaatcaatgatggatttccaaacccggatgtacttttttttttttttgaggaaaagaaaaacctttgttgatgcataaggaaaggctgggtagaagaacagagttaagggtgggaggccagttaggagactgttgaagtaacgcaagtgaggcattatagtggaatggact

SEQ ID NO: 204513 - DNA, 432 bp, Homo sapiens
atatatttttgtctttgttttagttattattttcattaatatctctgaatattctttaaagtccttttcagatctcaagtatggaaatctttgtttgatggctctatgcactatttttattggctttaggattttgttttgttgtgattcattgtgagaccccttctagggactgatcttccatggtagtcctgtatgtttcctatgtggggtgtgtttgtgtgtgtgtgttatgatagactctgcctggttccaatagaatttaccagttctgaaccagtgtaaattcaatttcttggcttagggttcccttttatgaggataatgtgaacttgggccttgtatctgcttgagccatagagaagtgtaggcttgaggatttgtcttttattttttaatttattttttatttttatttgagacatagtctca

SEQ ID NO: 204514 - DNA, 261 bp, Homo sapiens
gtgcggtccgtatctctaacattaggacaacttctttctctggtacaatcactttttttttaaagttaaaactcattttctcttctgtattccccttcccctgggaaggaaaagaatacatgcacaaagaagaaaaaatgtaaaacacaaccctgccatttaggactttttccaggcttatatgttgctattattctttaaggatactatatgcttcctaatgtgatttttttttcactaatcaatataatgttagagata

SEQ ID NO: 204515 - DNA, 215 bp, Homo sapiens
agtactcagtaggtgttccatatgtatttattgagtttttggaagattccagtacacagtaggcattccatatgtatttattggttgagtttggggaagattccggtgcacagtaggcattccatatgtctttactggttgagtttggggaagattccagtgcacagtaggcattccatatatatttattggttgagtttggggaaagctgtcta

SEQ ID NO: 204516 - DNA, 525 bp, Homo sapiens
atatcaaaggccatactttacgtgtttatagtcattttgattttgaggttatacttggagcaattccttttcatgtacacaactgtggtgtattgctgtgtgtttgtttttgggaggggtggggggatgggggacagattttcactcttgtcacccaggccagagtgcaatggtgtgatcctggctcactgcaacctccgcctctcgggttcaacccattctcctgtagtcccagctacttgggaggctgaggcgggagaattgcttgaacccgggaggcagaggctgcagtgagctgagatcatgccactgcactccagcctggacaacagaacaagactccatctggggggaaaaaaaaaaaaaaggaaaattttgtgtatttgagtgtttgtacattttattgtatgcatggaagaaatcctggtagaagataaaccaaaatatggttgtaagtataattaattaaagttggggaaatggaaaaattaaaacaggaaggaatacttatgaaatattttgttt

SEQ ID NO: 204517 - DNA, 370 bp, Homo sapiens
caggagtgaggaagctgggccagaggtccactaactcccattacccttgattaagtgcacattctagggatgtctttgctgccccacatgagaaccaagcacattcctgtgcccagaggcaacccttgaatgggggatttcactcacatgcagtaaaaatgtctgtagagtgcatggggcagtgagtgctcaggggacacaggagggtgtgtcagcataggcttgaggaaccctgactcattcctactctctatactccctgatgtagccatttttattttttcttgttctttattatgttgtatgtaggtaagtatgcaggtgtacatgtgtatatgtttgtgtatgtgtgtgtgtctgtatttatgta

SEQ ID NO: 204518 - DNA, 695 bp, Homo sapiens
agcacctggtattgacagactttatttcatttagtctcaaccacaggtaaacacagtatctccattttatagatgtggagactgaggcatggggcagtacgtacattattttgagttcatacatgtatagtgatgatcaggtgggacaaggtggtctgagggaagttcttttctactccacatactacgatggaaagaaaactggacttggcctggcacagtggctcacgcctataatcccagcactttgggaggccgaggcaggcagatcacttgaggtcaagagttcgagaccagcctggccagcatgttgagacccccgtctctactaaaaatacaaaaattagccaggcgtggcagtgcacacctgtaatcccagctacttgggaggttgaggcaagagaatcacttgacctcgggagacagaggttgcagtgaaccaagattgtgccactgcactccagcctgggcaacagagtaagacttcatctaaaagagagagagagacagacaaagagagagaaggaaggaagagagggagggagggagaagaaagaaagaaagagagagagaaagagaaagagagaaaggagaggagaggagaggagaaagactaaatgtagggaaggggaaagggagctggtctaagttttagacccagctgtactactggttgactgtgtggccttaggaaa

SEQ ID NO: 204519 - DNA, 242 bp, Homo sapiens
tgagatggagtttagctcttgttgcccagacttcatctaaaagagagagagagacagacaaagagagagaaggaaggaagagagggagggagggagaagaaagaaagaaagagagagagaaagagaaagagagaaaggagaggagaggagaggagaaagactaaatgtagggaaggggaaagggagctggtctaagttttagacccagctgtactactggttgactgtgtggccttaggaaa

SEQ ID NO: 204520 - DNA, 243 bp, Homo sapiens
actagttattatattttagggtggtaggattaaaactttttccttagcttgtatatactttctgatgttctacattaaatacagtttgtgtgtgtgcataaaagagaataatttcagttaaagggtaagaaatgtagaccccatattttaattcagtagcaccagttcaaatccagttattcagaattaacaaagcaactgttgctcaaaaaaatgccaataaactcccgagccaactgagat

SEQ ID NO: 204521 - DNA, 777 bp, Homo sapiens
gttgtggaaaagaataggaaatcttcaggcgaagtcattaaactctgaagctcccaggggatcagctttagcgccctctgtaaagtatctgggagggagaatatgcaaacaataagaaaaataattaaacttcagtacagtactttagtttcaaagtactgttctacatatttcaggtccataaaacattatgtaaacaaattgtttgggtaccacccacctcccttctcggtaccctttcaacaaaccccaccctctccccaaagtcttcctcctgttcagaggcgttcttgacagtcagataaatgagtgatcctgaaatcggattcatattttaggaaactgatctcagctcagtattctctcctatcacacgtgtggtttgctgctgtccattttacctcttccacccgacacctcccagatggggtcttgctccgtctccaaggctggagtgcagtggcgggatctcgactcactgcaatctctgcctcctaggttcaagcaattctcctgcctcagcctcctgagtagctgggattacaggcactagccaccacgcctggcttttgtgtgtgtgtgtgtgtgtgtatttttagtagagacagggtttcaccatgttggccaggctggtcttgatctcctgacctcgtgatttgcccgcctcagcctcccaaagtgctgggattacaggcgtgagccaccacgcccagccccattctacctctatgagagcctagtcttgcttttaggcagcaactgaactaacaaagaaaa

SEQ ID NO: 204522 - DNA, 676 bp, Homo sapiens
cacgagtaaatcactttaaaagccttttttataattttgctttaaaaaaaaaatgaaatccccagacctgtcaaaagctgaatctatgccagaaggagaccagattttgccaagaatatggtgaacagggacttccttcagtcccctggccacaagtggcctcactcaccaccagatgggctgcgtgtccttccacctggtctcgcagtcaaccaacccagagataagcaggccagcttatcctccaaacatcgcccacaacaggcctgagcttcaaccctacaaacgcaggtggggcagcccctatcacggaaagtcaaattcccattttcagtttccaatgagatgtcaagaaccaagcaacaggctcaggaagagccaagaaaattgactttctcaactaaaaaaaggccagaacacatgaactccttgtgtttgtcatgtggactccagttactcacacctgaatctctgaggccctgaacatctgtgttcccccttccttccatatctaattgttgtttttttttgtttgtttgtttgtttttgagatggagtttcactcttgttgcccaggatggagtgcaatggcaccatctcggctcaccgcaacctccgcttcccaggttcaagcaattctcctgcctcagcctcccgagtagctgggattacaggc

SEQ ID NO: 204523 - DNA, 369 bp, Homo sapiens
acactctacgatctccctttctcatcctgcaaaatgtcgtgagtgggatgacactctgagctgtgccattatgtgcatcttgatagtatcaaatgataatttcagtatttgaacccattttggaaactgttaagtctgttgacattttcaaaatcgtgaaagtttctttggcaaacaaaacttcagttgttgacatatactcttagacacaggtgatatttcacctgtcatatttcactcatttcagtcaacaaatatttattgagtatatgcagtttgtcatgcactatcttcagtattgtgaatgtagccgtgaacaaaagcagtcaaatttttcccatgatggaggttacatgtcataattatcaa

SEQ ID NO: 204524 - DNA, 882 bp, Homo sapiens
tcggtaccccacccacctgagtccagaaaacttattctagcctccctcccctagccctcattccttttattatttattttctttagaaaacaaattagggaatgaaatatttagaaacaaagatccaggtgctagctgtgggcattgctactgttactctactaaaaaaaaaaaaaaaaaaaaaaacttcacatttccaaataaatagtaacactttttaatgtgttcttaacgttttatttggcattaatctaaattcccctctagcacaatgaaaacagaaagagaaagttaaaatttcaagtaaactgaaaacaacaatagtgctcagaggatttttttttaagtgaaaagggatagtgcttaattatgacaaataaaagctaacttgagatgcacatatacagatgcagccacttattttggcgggggacacttcaggaattaaaatttaaatagcgagagatcaaatagatacttggtaaatgtgtctgaattggatgttcccagacacaaaaataaaatgagttattgacagctcttgggagacaacattataaagactagacacgttatttattttaactctatgttctaaattaccattgagtaattgacattcgtatttgactatggtttgtggttaagttcttaattgcaataatgttaaataaaatgtgaagcccaaagcaaacaacaacaaaaattatagcaatacttcaacagaggtaataataatatgctgcatcaatggttcagaatccagcatctacataaaacaagcaacagggtaatgaaattattttcttttcaaatattctggcagagctactttagttttcttaagttatagattgtggtcttaactgcaacttttcgctc

SEQ ID NO: 204525 - DNA, 1165 bp, Homo sapiens
atctatggataatctttcctcaaattaattatttcaatgatgattgtaaagttctgtttttcaaatttcgccgttccttctacatgttagtaggcattgttctttaaagaggagctcagtcttcttcctatttagaatcacttcgtaaccatagattctttttttattcaattgttatcaataactaccgttattcttcttgatgctcaaacaatcccaaatctagtcagtggaactcctccaagccagcttctattcttttcacatgtctctaccattctttgagtgcttaattgctttttgcaacagaaaacttattctagcctccctcccctagccctcattccttttattatttattttctttagaaaacaaattagggaatgaaatatttagaaacaaagatccaggtgctagctgtgggcattgctactgttactctactaaaaaaaaaaaaaaaaaaaaaaacttcacatttccaaataaatagtaacactttttaatgtgttcttaacgttttatttggcattaatctaaattcccctctagcacaatgaaaacagaaagagaaagttaaaatttcaagtaaactgaaaacaacaatagtgctcagaggatttttttttaagtgaaaagggatagtgcttaattatgacaaataaaagctaacttgagatgcacatatacagatgcagccacttattttggcgggggacacttcaggaattaaaatttaaatagcgagagatcaaatagatacttggtaaatgtgtctgaattggatgttcccagacacaaaaataaaatgagttattgacagctcttgggagacaacattataaagactagacacgttatttattttaactctatgttctaaattaccattgagtaattgacattcgtatttgactatggtttgtggttaagttcttaattgcaataatgttaaataaaatgtgaagcccaaagcaaacaacaacaaaaattatagcaatacttcaacagaggtaataataatatgctgcatcaatggttcagaatccagcatctacataaaacaagcaacagggtaatgaaattattttcttttcaaatattctggcagagctactttagttttcttaagttatagattgtggtcttaactgcaacttttcgctc

SEQ ID NO: 204526 - DNA, 199 bp, Homo sapiens
tgctgggattacaggcgtagccactatgcccggcttggctctcactttcgtgttctttccatgtaatcacacatgaatggttgtcacaagatctcacagggaaataatttagcaagtgaatctcagttttaaaaaggaaggtgtttgtgttttatcagcatctgtaattgatcagaccatatagttaaacccctaagaa

SEQ ID NO: 204527 - DNA, 527 bp, Homo sapiens
tggcacctaatgggcatgtgagcatttcttgttgagtgacattatgaatgtttttgtaagtgaggcaacttgaattaacaagtatcttatttaatagaaactataatatttctacttgtaaatgactatagacaagaagaaatatttatattcagttgtgaaagttttttattcatgaaataaaatctgctatgagattaaacatgccacagcagcacatatttgtaaaagcatttttcttcaggacataattttaaggtgctaatgcctggtatgaatgggtgagagagaagcagaaacatgttccccttccccttctgcttcatacctgggccagctggggagaaagcccacgtgctccttctccctctcccctcctatctagaatgtcccctgcttctagcctcaccagatcccccgttctcccccttcctcctgcctctctgccttttactgctatgcccttcttctcctcctttatccttctttctgttttccacatctccactctctcttcaagcaaagtc

SEQ ID NO: 204528 - DNA, 698 bp, Homo sapiens
tggcacctaatgggcatgtgagcatttcttgttgagtgacattatgaatgtttttgtaagtgaggcaacttgaattaacaagtatcttatttaatagaaactataatatttctacttgtaaatgactatagacaagaagaaatatttatattcagttgtgaaagttttttattcatgaaataaaatctgctatgagattaaacatgccacagcagcacatatttgtaaaagcatttttcttcaggacataattttaaggtgctaatgcctggtatgaatgggtgagagagaagcagaaacatgttccccttccccttctgcttcatacctgggccagctggggagaaagcccacgtgctccttcccttggtgctaatggggagttcagcccacacaagtcttggccaatgaacaagaacccttacccagctccagctcccaaccacagcaggccccaagcctgtatccctgctttcaagccattttcagacacactcggagctagccctcctctgcgtagaaagcctcactctgagtaataaaccggtttatgtcctcttggtgcgtgtgtcatcagagttgacatctgaatgaaattttgggtgggagatccatctcactctcatggaatacccatcacaaacatgttgttacattttctttttctcctcctccacctcctcctccttttcttattc

SEQ ID NO: 204529 - DNA, 547 bp, Homo sapiens
ttaaaaaaagctgagatataagcaccagagacaaagggaaacaccggtgtttccctttgtctgttttcgagacggagtttcactctttcacccaggctggagtacagtggcgtgatcttggctcactgcaacctctgcctcccaagttcaagcgattctcctgcctcagcctcccaagtagctgggattacagacatacaccaccacacccagctaatttttgtatttttagtagagacagggttttgccacattggtcaggctggtcttgaactcccaacttcagtgatcctcctgccttggcctctcaaagtgctgagattacaagcatgagccaccatacccagccctgaaatgtttaaaatatggaatgcttcacaaatttgcatgtcatccttgctcagaggccatgctaatcttctctgaatcattccaactttagtatatgtgctgctgaagtgagcattaaacaacacacttaaacaccaaatgaataaaaagaggaaatcattagggagataagaaaatatattgagacaaattaaaa

SEQ ID NO: 204530 - DNA, 1204 bp, Homo sapiens
gatctgctgagcctcatttaaaccaaattgtctcaaattctttatttcagaagtctttaagctcagataatcttctcactattgttatctcacaatttactctgtgctactgctgctttgttgtttaagaacactgaattctgtcagtgctgttctcccattattactgctatcttcagcattgtctgtttcattgtatcttgtgtgtgccacacagccacctagatattgcgtttgagaaaggtttcgaaatttttttctattgtattcttctgcctttgttgcagtgataatctctactggcctttcaaggtaggggaggatatgttcctaagcagaaaattttgaggcctgtgtccttgaagagtttgtgaacatcaagatttcagtagttaagcactgaccccaggcctggtattgatacttaggatttccctaacctgcagaaccatgggaatagtatccatagtggtagagctgtggtaagcaaatcagcttttacgttagaaaagtcacacctggtgtgattgtctaacaagcaagcatgcttgcaggtctgtactgtttctcttctttatgtcttttacatctctctggttcctcagagtgctttgtatatagtggctactcaattatttgttgagccaagtacagagtgctctctgtatagtaagtcatctatttcttgagccgaattgaatttaattgtcagagttaacagtagttcttgggtctcttccagtagttctttcacctccagctcacttgagggtatggttggactgaagattacttcaagattattttccccagtgccttgctgttaccaactggggaagctgtggaaaagaatattttaggagagttgaacgatgatttaatatacctatcatttaatatagcttcccactttaattgaatttttccttccaaaattgacattcagtggacttataggctctttttgaatatgcgtcttaaaggggggtgaatacactttggggtagctcaggttttttccataatgtttatttatattcagctgaaatgaatatatttttggcttattcccattgtgattatataggaagaatgagaatttttgttttacccaagaaccttctgtataccttagtaaaagcattgtttctgtccaggcttctcttggtcttgaaccattcttgtaaaatatggttttgaagct

SEQ ID NO: 204531 - DNA, 847 bp, Homo sapiens
tcagccgcgtatctgccagaggatttcatccgggtggggcagctgacaaagcgagtggacatcttcagctgtggaatagtaagagtgtcctgctctgcgtagagtggggcccaccttgatttgtccttcccacggctcctttgtaatcacaggatacggtagaggcacacagacaggttccatcaaagtacaacaggggctgacaaactgtggcccacaggccactttggcctgtggcgtattttgtatggtctgtgagctaagggtagttttacatttataaaggattatatttttaaacacaaagaatatgtgatagagactgaacatgctccccaaaagctcacatatttactgtgtggcgtgttacagaagaaatttgccagcccttgaaggaaaaccactcatgagtgtccaggttctagtaggctccagatatcctctcctgacttccgtaattcccatccagccatccacttgtccatccagttgtctatttgtccttatttgttcatcgctgtccgatcatccatctaccctttagctgcccatccattcagcgaccactgacccacccagcatcccaccctaccaccaccaccatccttgtctgccattatgtcgtgccaggcactaggaatatgaatgtaacaaaaacacagtccctcccctcaggagctcatggtctgcatgtagcagtctccaaagtatatttctgtagaactccagttccttcggacctctaggattgatgtgttaaaagggtttgtgccctgacaggcttggaaatattgcattaggcaaagtcaagcaggtttctttaccacaagattaattcaagctggtt

SEQ ID NO: 204532 - DNA, 212 bp, Homo sapiens
tatctgaatttggactagccacatttcaagtgcccagtggacacatcttggacagcacagataagtgacaaatattcctaagtgtacataaggatttaataaggtagctgcaggtcacttttctttttctgtctttctttctattttttttttttggagagggagtctcgctctgttacccaggctggagtgcagtggtgcaatcttggctc

SEQ ID NO: 204533 - DNA, 275 bp, Homo sapiens
gcattaaagagaatagtatcatatgttcttttgggaatgtccccaaaaaggtttatgtaaagtctaaagtctaaaacagtatataggactgcatgtgaatgtgaatgtgtagtgggaaggaagagacagagtaacagagaaaaggaatcccaggcattagacagagttgaaccaggtggctagatcccaacaccgtagcagcttcctagactatacctaaagcagccgcaatgagaccagtcccttgcatgatcttcccaaaagtggaggagtca

SEQ ID NO: 204534 - DNA, 210 bp, Homo sapiens
tactattttgcaatgacaacatgttatataaagatgtattcaccaaataacattctagtttcatagcctttataatgatgacctatttttgctatgagtgatatgcaatctgcacattgtttcctgtatccattatgtatgcttaggaaaaactatatccattaatatgcttaggatttgcttcatagtgcacagacattcattttagta

SEQ ID NO: 204535 - DNA, 442 bp, Homo sapiens
ctcagcttcaacacattcacacccatagattcagccccaagttgtccacatctttgtcactgagggaaccaggtaagggaatgtggatgggcaggtatcatgtatcaacaaatatttattgtgcccctattgagcttgcacatggttacaaagacatggtgcatgcaccagtatttgaagatgataatccccattggatgacccctgagatgactttattcatctacaatttcttattggacacctactactttccaggcactgagagggtgctgggaataaatattatacaccagtaagtgaatatgaaagattgcatcctaatgtaaagagtgccataaaaggatttgttagaaacaatatgggagagaataacaggaagagggtgttttgttttatgtgtcagtaggcaaaatcctccctgagactttaaatggaaaaa

SEQ ID NO: 204536 - DNA, 252 bp, Homo sapiens
cttgttcctgaccccctttaccccaacttgtgctcaccctttcagaattaacttgggaaatgcctctctaaggaagccttcctggctggaccctcccctcggcagccctcagaccctgcactcacttgtgtccttgcctcatcgcacaatggtgtaattatctgtacatatgttggtggcatcctagaaaacagagactgtatcttattcatctctttatccccagtatctagcacagacagggcctagcat

SEQ ID NO: 204537 - DNA, 419 bp, Homo sapiens
taagactgttaaaattgttttccagagtggctgtatcattttatatttccagcaatgtaagaatggtgcaatttctcagaatttttgcgaacatttggtgttttcactatttttttaaaattttagtcatttgataggtgtgtagtgatttgtcattgtgatttttatttgcattttttatgttgagcattttttcatgtgcttatttgccatctctgtaacctgtttggtaaactgtctcaatatttttattcattttcttactaaattttttaactgttgagttttaaaagctttaaatcatattttgtatactagttcattgctgattatgtgatttgcaaatattttctctcattccataccttgacttcattttcttcacatgtgattttatgtattaaaagttcttaaaaata

SEQ ID NO: 204538 - DNA, 516 bp, Homo sapiens
aatgtgactttgctcttacgctgaggttggaaaaaaagcttaagttgaaaccatgcttgtgattattatactatttccccttttgtttcctttcatcagcccatctgagtttttattagtgacttaagagcattaaagatggaaagtgaccactggagacagaaaacctaagcaggtttataatttagttgggaagaaaagatagaaaaggaaaaggagggcaaggtagcttatactgattacttgtaggcagtaagtacggtaggactgggagacttagggagaccgtacagcagagttgtgaatccagctagatactatacttagactaagacatcaatatttttgtgggaaaagtatcctaatgacttttttttttcttttaagagatagggcctcactctccgatgcaatggtgtgatcatggcacactgcagtctcagcctcctgggctcaaggaatcctcctgccttagacttccaaagtgctgggactacaggcatgcacccggcaaat

SEQ ID NO: 204539 - DNA, 694 bp, Homo sapiens
agatggcaaagaagaggagaaaaagaaaatttctaccctgattatcaaagataccaagaatgtcatctcctttaatccctgtaccaactcagcaagttaggtttcattattatttccattttacataaggaaactgaggttcacagacattaaactgctcaagctgtgatgtagacccactggttgcacagcatccatctggccttttccatattgctgctttgagacttgggaggcaagaaaaaccaatgcaaacaggaatctcatgttgcttgctacactgtaaatagtaatgtcctttgcctttgagccaggagttttgtgtctttagctaatatttgtgaaacttggcaggttaatgtgtttgctcagaagtagcataaaatctctgattcttcacagttctagataaaaaacaggcctcaaaaggatcaaactgataacaggtaactgtgttccataaaaagagatggcaatttttatttatttatttatttatttttagagacacagttttactcttgttgcccagactggagtgcaatggtgcgatctcagctcactgcaacctccatctcccaggttcaagtgattctcctgcctcagcctcctgagtagctggggttacaggcacccaccaccatgctcagctaatttttgtatttttttttttttagtagagacagagtttcac

SEQ ID NO: 204540 - DNA, 524 bp, Homo sapiens
cctaggaacaggaattagccattatccacacatttgtatttagtatcatctgtctcctagccctttgctactggaggaattgtggaatggagaggttatggctaagtactattttatgatgttattctctgggaattggcttagattagaatcacctggagtagttttataattattaatggccacatcacaaggattcaggttcttcaggttctgttgatctgcggtggggttgggcatcagtagtttataaaggtctccagttaattccaacgtgcatcaagacggaaaaccaccgtgtaactccttgcttctcaaaatgtcccaggacaaaggccccaggtaaattgtttgtatattcaagcctgagaaacctacaggttcctttctagttaaaagcccattgttctagttggcctagagagctgttgactccgcaatgaaggaaagtgttgtatatttctggaggcagagagaggtctgcaatgcaaaaatagtttacagagaaagcggtattgttacca

SEQ ID NO: 204541 - DNA, 395 bp, Homo sapiens
caatcccacctcgttagtgtataggagagatagatggagtgaatattctaaactatatacctggtaggaacttatcccctataggcaagacaacaaatagaaaagtggaaaagaggccgggtgcggtggctcacgcctgtaatcccagcactttgggaggccgaggctggcagatcataaagtcaggagttcgagaccagcctggccaacatagtgaaaccttggctctgccaaaaatacaaaaattagctggacgtggtggtgggcgcctgtaatcccagctactctggaggctgaggcaggagaatcgcttgaacccggaaggctgaggttgcagtgagctgagatcgcgccattacacaccagcctgggcaacaaggcaagactctgtctca

SEQ ID NO: 204542 - DNA, 281 bp, Homo sapiens
gccattgttagttcatgatatagttctcacctaaaaccttgtcatagttttagaatatttttcttcacttgagattctagacaacgataggttggtagtgtatactgaacaaacaagattcttcctaacgtgttctgtagtcacttgctcagcatttgggccatatatatatttttttttccagaagtaaaaaggacagtgtggctaagtgtctagattagtccccaaaagcccgtttaacccctgcagttcagaaaagaagactagatgttaggggcaat

SEQ ID NO: 204543 - DNA, 722 bp, Homo sapiens
gagttctggagctataatcctcctgcttgttctatctgctgactctcgtttgtggtacaaagccatttcctcatgtgtcatttttaatcataaattcatcttcagttgggcttatttcttctgtaagaatcccttgaggtctaaggtatggacgtacctctcagagtcttttcctgtttcactagcttgaagcctgtttgtatattaatttctgagccatataatataaacccagttcccaaatgtaagcaaagtatagatcttgtgcttcaatttctcaggcaaacttttttcattttctctttgcatagagctcaagcaaatcaagacaagatttcttgtcgtctccttgtgtaatagggaagattttctttttctagcccaccctttcacctagagtgcagcacatcaaaaatctcaactttatgcagaaatcttagttctgattcctttttgcatatggtaaaactcaacctgctaggaagagaacacctgaaataacccatctctacactcctcactctgctccagggcaatacagcataggttcaagggcttacagttttggtcggtagttccatttttgtttttggaaacgagattttcctatctttcctgtatattcaagaatgcatttaaaagaactgtcattctttattatgcagcttttgggcttacagttttggtttgtagttccatttttgtttttggaaactggagat

SEQ ID NO: 204544 - DNA, 512 bp, Homo sapiens
tccccagtccctgcaccccaccccagcatcctctccattagctccctgaaggagtcatactgttttcttgttccctgagagctttctattgataaaagttctgtctgtcttcaactacaggaagaactgtgggtctctctggattctacaggcacctggcaggcatgagagcactctcagagacagggctttggtgggctatgaatggaatgccctctgagttcccctgaaaggaggatgggaaactctagatccctaactgccctcagggtacccaggactggctgaaatgatccaaactcagaagttgagtgctcacgcatagggccataggggcctgaggtaaaacagggtgagtctagccatcctgataaggtctgaggggaatttaagagcataaaaattagcccagtcagtgaaagaaaaaatcagattaatagtgactaattgtttggtcctgcacttgctctacagaaatataatgcaagttacatatgtaattttgaatgttc

SEQ ID NO: 204545 - DNA, 458 bp, Homo sapiens
agtggtaatactaggttttatttgcttactgtccattggtatattagggttctccagagaaacccaaccaactggatagatagatagatagaccatagagagaaggaaagcaccacagtcactgaagtaagggccctcatggaagaggtgtgacaggaaaggtctgctgtcccagggccaccatatataggagtgactcccatcctgggcaggacctttctttcttttgtattcacagtagttctgaaattgcaggatgctgaaacccagcactggccagttatactgtttctttctttaccattaaatgctgtgccaaagagcaccttaatacatttctttcctcttcctggagagaggcaaaatgatagtagatatgttgaaacacacaaatgtactttaagcacgtgctttcaggaaaagctactagaagattagttgcaccaaaatgagggggg

SEQ ID NO: 204546 - DNA, 372 bp, Homo sapiens
gtgccagatactcaaccaactctcatggagctcacaagttggtagtggaaggatatgcatcaaccaacatttcaataggagacaaggagctggaagggctgccggtaccagaaagggtggggaagcacttcacactgactgggctggaggactgcttctcacaagtgccttggaggtgagtctggatggttgcttaggagttcaccaggggtcaaggaagaagtcaggcaaggatgttccagacagaagctgtgtggcgcaagctagcttggtgcactcaggatggctggtgcattggatgcatgagggtggaaagtggacagcggctgaatccttcaaggcctggtgggacatggcgtgccaagagtatgg

SEQ ID NO: 204547 - DNA, 350 bp, Homo sapiens
gtaggaaggaaggtagattgaaaatagtttatttcctaaatattcgtggtgaaaattggtaaaaataaaatacatagctttaccatttggggaaaacaggacagaaaggagaacaaaaagcatcgaaaaaactctgtaaagagaaaacacaaagattgtagaaataaaagacctatgtatcagtaatcataatataggtaagcatatttcaatatggagttgaaagtaaagaggtcaggcatggtggctcatgcttgtaatcctagcattttggcaggccaacatgggagggatctcttgaggccaggaattcaaggccagcctgagcaactaaatcttgtctctacaaa

SEQ ID NO: 204548 - DNA, 308 bp, Homo sapiens
gaagtgataaacatacgtctaatagaataaggtggtgagataataacacctgctgtggcatagtaccaccaccgatggaaaaatggagccaagagctggctgagaccatgatactgggcagacctttggagaatcatacacacagcaaggagctgatgatgtctggggcgcctttggaatctttgcccatgagaactctgaggcctcctcctagcatgacaattgccgcccagcggctctccaggagaggaacagccactcctcacttactagcatccaagggacttccaacccacttgagggtccat

SEQ ID NO: 204549 - DNA, 379 bp, Homo sapiens
gcccgcggacagttgccctccctggtggccccgggcaggagcgtgacgtcgaggggctgcagcggaggctggaactcaccctcccgctgcggcgcctctcggcctgccgaggagcagtccggtgcttttgccggctgagaggaagcgagagttattttaagaattcaggggttgcctttccttcgccttgggggaagggcgtaagagtcagttcccactttcctgcattctctgggcccatggtggcatcttttgcttgcggtgcattcgtaactttccaacagcctgcctgtcatgtggattagcggttgtgtttttgtatatccgagtgtgttaattatcccaaattcgcccttcttcgccagctcagaatctaggc

SEQ ID NO: 204550 - DNA, 535 bp, Homo sapiens
tgacactgatgtttctaaaggttacaggacagatgttttgcagaatgcccctcgatttggattttgatcacttcctcatgcgtcagtgcaggctaaaattctggggaggaatatgattaccttagtgtcccctgcttttcccagtcgctctttctttgagcctacagcagtacttgctgcagtctaacggcccctgcacttgttacctgggcaaagtgcttaacttgctctgcctcactctactaatctgttcaatggaccaatgacagtcacctcccataggctgttgtgaggatgaaatgagattatgccgtaaagtcggtggaatggggcctggcgcatggtgagcgctcagcagcggtgagcgattcgtgttgtcttttctgtgtgtgtcagattacctgccaggtagacgtgtcagacacacatctgctctgtgtcctctgagtctagcacaagtctgaagaatcacatgggtgaagctactgcctggcctctgttttctgtagtgaaattataccccattcccatgaac

SEQ ID NO: 204551 - DNA, 643 bp, Homo sapiens
aagcagatactacagactcagcctcctgagtcgctgggattacaggcacctgcatcatgcccaactaatttttgtttttttagtagagtcacggtttcaccacattggccaggctggtcttgaaatcctgacttaaagtgatccgcctacctcagactcccaaagagccgggattacaggtgtgagccaccgagcccagcctgtattttctctcttaatgtaagcattatggtatacactttacccatcctgctcttgattagagaattaggccgtctctcattctccatgcagtgaacatcttacatggaattgcatttgtatttatctctgataggtttgagtcaaacagaatttctaggtcagagggtatgattattttaaggctctccagaaagatttattattttcattcccatcaacctggaaagtttttaccgtgccctcaacagcatggataagaactccttaaaatttactaacttgagaggaagagtaaatattaaatacttaacattttaccaatattaaatgcgtctattccaagacaagtactagggtaaatggtagggttaagccagcattttgtctactgtaggaacaatgaaagatctcagtgagcacagcgtattgggaaatttgt

SEQ ID NO: 204552 - DNA, 332 bp, Homo sapiens
caagcagttcatacagactcagcctcccaaagtgcggggattacagtgcatgaggcaccacgcctggccaagaaaaaattttaaaaactttctagcttctttatgatgacatcagaggattggaattagaagggggaagggtgacctaagaagaataactgaagtggagaatctgaaaggaggccagactattggagagggagttccactgggctgcaggaaagcataagattgccttggtaaagtgagctccaatcatggtgtaccttaagttctagaacgaggaataaggaattgattagtgagtctgtattaactgcttgggttaccga

SEQ ID NO: 204553 - DNA, 221 bp, Homo sapiens
tatactgtattatcccatatttataagtatgtatacgcacatctaaaagaattgatagaagactacaatcaagaagttaaaagctgttatcacaaggtaaaggttgcttgcttatattttccaaactgtctgcagtaatcatgtttttttaattattgctgaagaattatgataatttcttatactacaaatgagagtagatatagaagagtgcacttttg

SEQ ID NO: 204554 - DNA, 455 bp, Homo sapiens
caggttgtagcctaggagtaacaggctatactctacagcctaggtgtggagtagactataccacctgggtttgtgtaagtacaatttattatgctggcccaacaagtgcttaatgaagcatttctcaggaagtatcttcatcattaaatgacacatgactgtacagactctgcatccaaagctagcgtgttttaaactgagtttttttcctactgttcaaacaggctattttaaaaatccctttaaaaattttcatttatagttttgttttgatctagactactactgccgacttaaggaaaatatcgctagagaacatgacagcaatgacagagaaacataaaattaacagaaattttgaaagtatctattgaacgttaactacttaagttacttttgccaattttgtcctattttcaatttgtccctatgtggattagtttaacagcaacaaa

SEQ ID NO: 204555 - DNA, 395 bp, Homo sapiens
tctgcctccctcggcctcccaaagtgctgggattacaggcgtgagccaccgcaccccagcccatttcctgaatttcagggggagtgaattaattctaatatagagagtgggtaaaaggaccaattttttcattactatttgacttcatatcatcttgctttgcaatgccctggtttttacatctataaatcagaaatgataagcaacctgctttataggaatgcaatgaagataaggagatacaatataaaaatatacattgagtcagaaagacagataacactatttaaaccagtgtattcttataatcctcattattactaagaatgatgttaacagttatgataaaaagtcaacatgcagaaagaagagaataaagtaatttctagtttggg

SEQ ID NO: 204556 - DNA, 296 bp, Homo sapiens
gtgtttgcagtaaggacagccttgttgagggtccatgacctttaacctgtgggtctggtgctgactccaggtgattaatattagaattgtattacagtataccagttggtatcagaagacttgctcagaaagttcaaactcaactggggagaagataatgataaaaccaataccaaaaatatagaaattatctggaattgcactaggaggtatttgagatactcagaagatttcctgaaataaaacactgtattagtttgcagagcttctaaaacaaaataccacagactgggtag

SEQ ID NO: 204557 - DNA, 539 bp, Homo sapiens
ctcacctgcttcaaactcagattcttgtcaagactaacatgattgaattcatttaatgtgaataaataagtgatgttagcttaaaacagcatctatcactagcacattcttttctactgatttcgaccagacgttcattctctagataaaaaatatttatgttgtgaattcactgaattaacatcggtcactaatcacccagttaagttacaatcgtatatattctggctggtgttgcaatttaaattgccaaaaaaataggctaatcattagctaatgaactatattagacatggtttgtctgttaatgacattatctttatcctttaatgacattatttacaagagattcagtgtttgtgaaagcaaaaagctctattcactcattgtgacaagaaattttgacacgtaaatatgtatgtcatgttttaaagatatacatactactttttaaaagacaggagagtctttcaggcaccaaacttgcaaaaaatctcacagttttttttaacagcataattcaagtatatgagtaaata

SEQ ID NO: 204558 - DNA, 478 bp, Homo sapiens
ccctaaagttgttataatttagaaatagtttattctaatttctgaaataggactagaccacatcaaattgaaatgtgggcaatagataagcacatcctccttactgccatattacagcaattccagaaagcttgaagagttggatagttactcttcaaaactttaagcatgtagattgttgaacaataatatcaaccagcttaacttatttaacattaatagaacactatttccagtaacaacacattcttttgaagtacatatagaacattaacaaaactatattatattctgactataaaataattccgaaaagtttaaaagattcaagtcctataaattatgttttctgagcacaatagaattaaattagaagccaatacaaaaggatctctgaaaatctacaaatacttggaaatatatggcacatgcctacctaacccactagtcaaaggagaaattaaagaaaaatcatgaa

SEQ ID NO: 204559 - DNA, 337 bp, Homo sapiens
ggcgtggtggcaggcacctgtaatcccagcaactcgggaggctgaggcaggagaatcgcttgaacccaggaggtggaggttgcagtgagccgagatcgcaccattgcactccagcccgggcaacaagagcgaaactctgtctaaaaaacaaaacaaaacaaaaaagaatgtacacactctggagtcaggctgcctggatggagcctcacctctactgttacccactgtgtgaccttgagtaagtgactctgagcctcatgttctcccctgtaatataggggtaataataacacaaccttcttccaaggatggttgtgagtattcatcaagattgtgc

SEQ ID NO: 204560 - DNA, 499 bp, Homo sapiens
aagtacctcactttccattccttatacatactgtaatttattttagttaaaatgttagtaagaagcccaggcacctgctgattaagcatacatggcacataataccatagctctcatgatcacagccccaaaaaagtaaatctcaagaaacaactgcattagcagccatgccaaagatttagaaaggttattatcctgtgaacaattatggttcttgtttgattgaaaaattcataataaaaacataacacttttggggatacaatgttcattatacaccattgtagtcagtggctactttagttttcatttttgttaagattccaaataataaaactatttgcaaactgttgatttccttgtaaattcccctttctttggctaaatcaatatatgtaaatatctttgttcatatattagttaagctttaaaatgaggttgtttatgttcttgcattcttataaataacccacaaatatgtaatccctctaattctctt

SEQ ID NO: 204561 - DNA, 924 bp, Homo sapiens
ctgtccaactgcacattaacacaggcctgccagtcctgtcgggcttgcttttaggctgagccaactgttaatgtcttagctgcattgttcccctctctggaatgtgccccctcctccctggtcaactccagtccactccagagatggctgaattgaatccattaattagtcccaggtacagacttgctgctggacttgaacaccctgtctgttagatacttgttttctttctcgtttgctgcttggctcaagggaagcacagagtatacagaatggaagagcggagttaagaaacagatgatcttggttaaacctctcaaaagcaagatcacaaaggtcacccgaaggcccagtcccacatgtactgctagagcttgataaactctgggtagctcatgtggcgtatctcacctgcaccctctggaacctttgtcctggagagcatccaaggtactttctaatataggacaaggagttttctctgaagtcgttgttagacattaacaatacagatgtaggaaatatcagccctttcctcaaacttgaacttctgcctaagagcagtgtcggggaaattggttgcatgtagacagcaaattgaatgttaaacacaataagtctttgatgattaaaggccatagctggcaggcagttataagtttaaagtaaatagtgatttaatgcacctttagtcttattctgggaatctgtcaacatcccactcttcaaagcccattttgtaacttgtgtatttaggcatttcatccaaggaatttagtatttaagagtaaaaaaaagtttgttgtcttcctctctataattcatatttctttggaattctataaaattttatttccaaaaggaatgaattataagctcttagataaaaaaactcaaaataaaatttatatactagttgtcaaa

SEQ ID NO: 204562 - DNA, 465 bp, Homo sapiens
aaggtgtgcgttgcacagaggatttgctggctgggtcccatgagcttgcagagctgagcttggctggagagtaattggaataccaaaaatgctcgacctcggactgcagcttccgtatcaccagggccagctgggctgtggtcccagcttccaactcagagacctgggttcttccactgagtcccaactggttgagcacttctgggatgagttctggtgcagcgtggtgctccagtatccagcatgggccctgacactcaggaggccctcgtatatggctattgagagattgagctacctgtgccatcttggaggtggccatgtccctcaggcctcagtctcctggtaacaaaaagggatcctttctcgttccagaggacaggacttaaaacccttaggggtgagcgctccttgagcacttactgtatgccatgccctgttctaacacttcacatgtgcaaactc

SEQ ID NO: 204563 - DNA, 467 bp, Homo sapiens
cagtaagactatgtgtcaaaacaaaaccaaaaaggaaaaaaaaaacaaaaagaaattcaatgaattatacatatttgtaaaatctctttcacaatcactgtccaaatactaccaaatcagatactgagtagttgtgtgataactgcttgtcaagtgaatgaaatgtacggcatttatacacatattttttcaccatagtcttgtactaaatgagtaaagaagtgattaagtatacatttttttttttttacttacttattggctctctgataacaagtgcctctgatgtctcaacaaatggacccatgccaatactattttcagccgcaattcggaaaaagtaggcttttccttgaatgagaccctggacagtagcattttgtcgggtaactgtatatgtcactggggtccatgctctgcggtcagattcacgcttttcaatgacataattggtgattggagagcct

SEQ ID NO: 204564 - DNA, 530 bp, Homo sapiens
gcccctgtttttcgagcatgtatgggtacggggcagaatgatggtcagtcttagtttcaacaatcgttgagatgcccctagctaccggtatctcatcatgtatcacctgacttaatcagcctctaacagtgtctaatctgctaaacctgttgtcatttgttactcatgtggaacatctcaggccgaatgagccgacttattaggatatcggtaatcatttctagcgccccatcatatttctcgacgatcccaatgtcagattcactggatgtcgagtgactgcttggactcccaggtctgcacgacgctctggtacggttattggctctctgataacaagtgcctctgatgtctcaacaaatggacccatgccaatactattttcagccgcaattcggaaaaagtaggcttttccttgaatgagaccctggacagtagcattttgtcgggtaactgtatatgtcactggggtccatgctctgcggtcagattcacgcttttcaatgacataattggtgattggagagcct

SEQ ID NO: 204565 - DNA, 405 bp, Homo sapiens
aagtggacaggaccgagcgagaaggaaatggtgtgctgagttcacctgaaagcctcagttcccaagctatttctttgctaaactgtgtttttccaaagttgtatctacaccttctctggtttgcaaagagggctcaatcccaaagcagcagcaggctccggtccaaagtgcaaaccaaaagaagcagcaggaggggtagaacagagtcattaccaaagactgagtacagaataaagtgatttatgaaaaccagcatggaagggcatgctacaggctaaagccggactcaggaaggcctgttgtgagggagaggggaaatccacagcccggcatgggagaagagaaccatgggcacagagtaagtgggaagacggaatagtgagtgacccacggccatactctacc

SEQ ID NO: 204566 - DNA, 370 bp, Homo sapiens
tttatatgaattatttctaatgactaacgtaaaatatcagaaatgcccacagagctatgcctgcttttgcctcagacttttttatactgacttataattgtcaggatagggacccatcccactccagcagcctcacaccaatttctcgtggctgaacacagagaaaagaacacagcaaagatatttcttcaaaacacatctaatgagagtcattcattttacactttgaatgaaaaaaacaaattcataaggaaatcagtagcttttaaagaaaaacatattaatgattttaaatgtgtttgtaaacatgaaaccaaaatatatagaaaatattgaaactaaaattttattctcaagaaaaaaaatgggt

SEQ ID NO: 204567 - DNA, 481 bp, Homo sapiens
aaagaggccgagggccgggcgtgatggctcacagaggtaatcccagtgatttgggaggctgaggagggaggatcacctgagactaggagttcgagaccagctgggcaacatagtgagactgcgtatctataaaaagttaaaaaattatctgttgtggtggcatgcatgcctgtggttctagctactcaggaggttgaggcaggagaatctcttgagcctgggagttcaaggttactgtgatcatgccactgcccaccagcctgggtgacagtgagaccctctctcaaaaaaaggaaaaaaccctgctaccttttgtgtagcaacacaaagtcctagagcggtctcctctaagagacagagttttgctttgtcatccaggctggagtgtagttgtgtagtcatggctcactgcagacttgaactcccaggcacaagcaatgctcttacctcagcctcctgaggagctggaactacaggcaca

SEQ ID NO: 204568 - DNA, 329 bp, Homo sapiens
agtttccttaggtttttaccatgcaagaaggattgtgaaatgacagcttaggtgggaacaagaatttccttgtgtccctggagttttgtctgaacataggtgatgtctgggtctattttgcattctaaaggacaataagagaaacaagtatgtgtgaaatacataagtgggcaaaaaaacagtatcaaaatgacctaatcatgtatcctacagtaaagttattgtgtaattttaaaattcagatagataccttattttgcatatgtttgaagacaaaatcagtagttgtcatttatatgcactaaataaacagctaaaagaaaaacata

SEQ ID NO: 204569 - DNA, 218 bp, Homo sapiens
gggccttgcctgctccttcagtggggagtccttgtgaagggcttgtgctgtggaaaaccagtctctctagcttttgtaattttctcaagcaacgaaaaagcaaacaaacgcaaaaagcttattctgctttaatacccatttccgtcaaaggagtgtatgtgtgtgttaggagagtgctccggctcatactggaaagttaggtgttggtgaggactgct

SEQ ID NO: 204570 - DNA, 509 bp, Homo sapiens
taagagcatgatgctaacctattcatgggaaatctgccccatgatccatcacctcccacaaggccccactgccaacactggggattacagtttgacatgagatttgggtgaggacccagatccaaaccctgtcacctgttctcaggtattctgttatggtaacacaaatcagaagaagatagtggcttttggagcacgaaagttttaaattatggtgatgtttaatgtagtttgtgcttcctatgccttatttttaaaatccttgcttttcctgaggttgcaaagtttttctctatgttttcttctacaagttttatagttgtggctattattgttaaacctattatcctttttgagttagttttttaaatggtattggtttaggtccaggtttatttatttttagtatagatgtccaagtgttctctcaccatttgttgaaaaatgtatccacttcccatatggaattaccttggcatcttgttgaaaataaatttcacatatatgca

SEQ ID NO: 204571 - DNA, 244 bp, Homo sapiens
tctaaatctagaatgattccattttagggcttcctacatctaaaaatatgctcaggagtagggcaacttagatctgaacattataacttgataaatgaggcataaataagctttaataagtggtaaataattctacattaggtatttgttgaataaaactgacaagctaagagtaggggatttgacatctcacagccttgtgttgaatgaatatatatcctatgctctggttgcttaatttacc

SEQ ID NO: 204572 - DNA, 591 bp, Homo sapiens
tagaggatccccacgcgcacgcgcgtttcaaaaaatcataagttgaaccatcatgaattcgggatcacctgtattcagtaccatgcaataaagtaatctgactaaaaagtctaaccaactatttgcagaacatacaagaaataaaggagcttgttaaataaccacagggatgcaatcagcaaaaccttgaatgtgggaaattccaaagaacaaatgatctgatttcctcaataaataaatggcaaggaagagctaaacaaaaaatattaccaattgaaaggagagttaaaaatagcaaccaaatgctatggaccttgttttgaatctttagtaaaaaaacaaaccatgtttttaagggaaaaaaagatacaatcacagaaatgtgaatactgactggatctgatgttacagaattctttaatttttaaaaggcggaatcatggtgctgtatttgtatttctttgtcttatgcatccttatcttttagaaacaaatagtattttccaaaaacatcatatgatgtctgaaatttgctttaaaaatatttgaaccgcggtgcgcgtggggtacgagctcgattcgtaacagcag

SEQ ID NO: 204573 - DNA, 401 bp, Homo sapiens
gctgggcgtgcctcagagggcgccccatgccagcttaaaggcagctgggaatgcagcaattgatcagtgggtgctgggcagctcacacccccgtgcggacagtcttctccatgggccgagaagtgtgtcacatgcatgcaggtgcatatgcatggggacatgggggcccaggagtcttcctactgcagagttcaaagatgcgggctgaaggcagtttggagagcgtcccctgcctgtgcttctcttttaactccaggacctgagcctctgctgggtggcgggtggacgctgctcccagtctcccatgcaaggggccccagagggaggaaaatggcaggatgggacagagggaccacgtgagagcagctttgggataaagctgccagatacacaaagcaata

SEQ ID NO: 204574 - DNA, 382 bp, Homo sapiens
agaagaaacaactagatgcttcagtcagtttctcagagttttctaagaactgctcagagaggtggaagaccatgtctgttaaagagaaaggaaaatttgaagacatggcaaaggcagacaaggcctgttatgaaagagaaatgaaaatatatccctacttaaaggggagacaaaaaagaagttcaaggatctcaatgcacctaagatgcctccttcggccttttttctgttctgttctgagtatcacccaaaaaccaaaggagaacatcctgtccagtccactagtgatattgtaaagaaactgggaggaatgtggaataacactgctgcagatgaaaagcagcctcatgaaaagaaggctgtgaagctgaaggaaaaatac

SEQ ID NO: 204575 - DNA, 728 bp, Homo sapiens
attttaactcacattttccataatcgctggaattgccccaaacgaagagctcttcataaatctgtttctaatggttggcctcacccaggagtgggaaactacagaatggggcagaatttccatgcaagtgtcttagcttcatacaatttgaattatttgttgaaaagccaacttattttccagttacgatgactgttcagaatagcacatctgcaaaccagtaagacccaggtgaagtgattcccacagcgtctcctgtcaacagccctctccccgctctccttctgtaaggagctgtgtttatgagcttcctcactgaactcaaatttcaacttaaattctatgccacaaatatatttcttccccacccttttctactgctgttatagttcatcaaaaatgctgtatgaaaggaagtgctattttccccatggcttagcgtggcaaggtggcttctgacatcagggaagggccacatttaaattaaactcttgacactctgcttgcgagaggtgatagataggctcccaggagctgcctcctctggaaaccaaatctgaccgggagccagaaggaagtgaatgatgcttctgcacaacatgaagtgaatccagtttcctcctgaccttgtcccactgtatattttctttctcttgttttatttatatttctttattaccagaagattttcttttagacagcggagttctaagttaaccacccgtcta

SEQ ID NO: 204576 - DNA, 490 bp, Homo sapiens
ccgttcaataaggagaatttggaaaaaagtggaagaaggaagcgctgcagccacatccccgccctgaaggctgcgtccctccagtgcctcgcagattagtcaggatgcccacttagcactggccacggggccttgctctgtcccgggtccactctcatccccgtgtggtgatggacctctgtggacaaatgctttttgttttatttgttttttgggatggagtttgtctctcgtcgcccgggctggagtgcagtggcgcggtcttggctcgctgcggcctctgtctcccgggttcgggcgattctcctgcctcagcctcctgagtagctgggacaataggcacgccaccatacctggctgttgctaaggactctgcatctgtgttcatgaagacattggtttggagctttcatttcttgtaatgtatttgtctggttttggtatcaaggtcatgcttgcattaaattagctgaaaagttgccagcctctt

SEQ ID NO: 204577 - DNA, 559 bp, Homo sapiens
cttctccctgacagtcctccaaatataaagacagctatctccttcccttggacgtactcttacgtttttaacttatctagaataattttatatttaacatacattttttcaggcttatcaataacttctgttacaattttattctctatcctattaagccacaaaaaagccatgttaaataaatttcaacatagaagggatccttggtttccccagtgaatctttgttttgtgtctccttattttgttttctggtttttcaagccagagagactatgagtgtctacaagaatcttagctgccttgcatggttctgactggggcctgccctcaggctacaagctacacaaatgacacttagcaagtgctaccctctgcttccaggtttgactctcccctggtcattctctactgccttcatataattgttttattatatttttgtttacagtttttaatctgtgggagagttgatctgataggagctactcagtaaaagcagaggtggcatctccctctaagggcttttttttttttttttttttttgagacagagtctt

SEQ ID NO: 204578 - DNA, 180 bp, Homo sapiens
gggacctaagtatcctgtgaagctaatgattcatcttattcacactacagcaatacaacaatcatttagtacaatccagcttctcaaacaagcgataaaaagacaattttaaaaggataccaaaagggaaaacatactcttcgtagtttaaatttcaagattggattcttgggttttaag

SEQ ID NO: 204579 - DNA, 349 bp, Homo sapiens
tctagaggatcccgttcattttctacactatagtttcatctgccccaaattcaatgtgcttttttagaggtactgatgtcactgttgttgaacattcaaaagcagctggtaaattgcttatcagggaagttttaggaagagacctgatatgtagttttttccaatactatgtgccaagactatttcaatatacctatgcagaagccatgctgagttttagtttgattaactattcttataagaggtttcgataaaataagatttctgtttactacaatcaataatgacaaatgttccgtaaagtgaacacttagtacacaagtcttgttttcatattgtgcagatgcca

SEQ ID NO: 204580 - DNA, 461 bp, Homo sapiens
tagcttcagctgaaattatacaaaaaaaaaaaaaaccctcctctcaactccaaaaggaagaaggaagtaagaacctatgccatcatatggtagcataactgtgctttcattgttctcctgtggtgcccttatgctatgtacctgccattcaactgcatgtgcttactcatagcattgttcctcctctcaggggccatcgtctctccttccatactccagggacacacataaacactcacatcagtgcacatccacaaacttacaaaaatcacttattcatctacactcacaatctcactcctttgcacaaacatacacacaaatacattcatacacaaatacactcacacagagattttatcttgttctgcttcactagtcctgtatgctgcttttaatgtcaaatactctctctaactcacctggttgaatttcattgcattcctagtaaagcttgaatt

SEQ ID NO: 204581 - DNA, 401 bp, Homo sapiens
cccaactccaagttgtagctttcagttgaagaaaaagttctctacactgttttaagcaaaaggagtggggataaaacactggaacattattagaagtaagaattttcttagtcttgaagtttatgttttagagtaatttaaaacactttttctgtgtagttttatataggaaaccttgaaggatgccttcactaatttgggagatacagaactgttagctctttagttgacactggttaaacattggtagttggatacttgacaatatggtttgaagacaaaccaatatggtttgaagcagaactagagtactgcttagtaaatgcccaattttcctaagaattttaagatctaaacatatgcttttctgttttaaaaagttacttctaatgtagatactc

SEQ ID NO: 204582 - DNA, 530 bp, Homo sapiens
gcaccccggctgacattttgtgagatgggtgactccaaggtgtagatcttcaaactgcgtcagctatccacaggttgtgatgaaacagttctacagatttcttctaagaaggaaaaaaaaatgaaatttgagtctttccattatgccaagcttctcctcaacaccagaccaagtaatgggatgaattctgtgccttaagaatatgagaaaacagaggcttggaaatggaaggtgccatgaggcagtcaaaagacctgagatcacatctaccacattcaacccatgtgacatgaggcagattatctgacttcaatgtcacttgatgtcctaattttcaatgcagggctgggaagcacacattattgaggagaaatcagggaacacatgatatagagcccaatttatttcaacaaaccctgagaccccattgtgtgccagtgttggagagtgcaaaacggctgtcagggggagaagatcttctcccctgacatctgtcgttagtaaaaattttgcctaactcaatataccta

SEQ ID NO: 204583 - DNA, 233 bp, Homo sapiens
tcttttctcctcctctgcttccttcccctgctcctccttcttcttctctgtttttcttacaagggttaaacaagggtctattttgagcttagcacaaagtctgttcccactttctccaagtgtcccacctaagtgctgaagctcagtaaataagcccaattggaagtggatacatgattagttaattgttcagtggcaaagttcttacagttgattttctctgcaatcactct

SEQ ID NO: 204584 - DNA, 480 bp, Homo sapiens
caaggatgggtgtggaggtggcagtggcaatggggagaaggggaactctgtagaatgtatgtgagaaataaaacaacaacaacaacaactgtatattagggcttggtgatggggtcactgtaaggggtgcaacagcaaagtgagggtgagggaggcttcctgagtattctccagtattaggacgcgaatactttagtcatcctcttcatccatatcttctatttatacctgggcaaatagtcccagagagaaaggagaaaagggtttgggagctacaaaaatggggaattcgatgaatgcaaaggcttccatgtgtggatatgaccctgaaatgacaggcagaaggtgagtagttgactagttaaagataacagtttgtgcaaaggtcctggggcagggttggtgggggagagcttgaaacactcaggactgcctttcacatagtagatgctcaataaacaatggctgcaggaatgaata

SEQ ID NO: 204585 - DNA, 226 bp, Homo sapiens
tcaaaaggtgcaatgtcagccttaggaggcttaggaatctttccagatgagggtttaagaaatgaagctccgtttttctggtgagaaaattcctaaaattagatctagttttcacaaaactcctcttaacagaacagaatctctaagatgtgtgttctgaactaaatagctcatcttgcccttcattattgcagccctagcagcactccacctcctatgataaacg

SEQ ID NO: 204586 - DNA, 592 bp, Homo sapiens
agatgtgacctgtttagccacggtgaactggaaatcctctcaccagcacaacaccttccagtagatgagaaagaagataaacaaggatataatctcattgaatctatcagtggaaaccaagattattcttactctcatttgcttctttgatttgtttttaataggcaaactcctagtctgtctgaaggcagcaactttcagactgcaaggtgattatagattgttttttgtttataaaaatgctttcacaatgggcacactagaccaacagtgggaagtctttttcctttagggttcctgatcctcaaaatttgtgagattaagaaacattataggcggggcgcagtggctcacgcctgtaatcccagcactttgggaggccgaggagggcggatcacgaggtcaggagatcgagaccatcctggctaacatggtgaaaccccgtctctactaaaaatacaaaaaaattagccaggcgtggtggcaggcgcctgtagtcccagctactcaggaggctgaggcaggagaatcacttggactcgggaggcagagcttgcagtgagctgagattgcgccactgcactctagcctg

SEQ ID NO: 204587 - DNA, 723 bp, Homo sapiens
gagacttacaaattatggccttaaaccaacagctacggagattacattcatataaattgagaatattagggaggctgtgggagtaaagaaaaggggatcctttgaatagtcttaggagaaaatttatccatataaaaattagaaaagctctatacccttatctatccaactggtaaagtctgttttaaatatattctttgaatatagaatcatgctctcaagattaaaacatattatgacagtatagccagaaagcctgggtgtgagagggaggtctctgctcctgtgtaataggggcaggatgtcaggtgggggcagctcagctcatcctgcacatccttccccgcctctgacctctgatgccactatgttgaggactgcctgttcctggttattttgggttttccagtttttggtacacacatgcatctcacaatgtcctaggggtattcactggaagacaaagaatagtattaggggagaagattttagagatggacagaaatggcttctaacaaggtcatcatctgatatctcactaatctaaaatgcagtgctgaacctataccatctgaaaactgacggcatgctgtgtttatgctgtgtttaaagatccttatgttttacttattttagtgcatcacagtctaagtatgttatcacttttgtctgaactaagccagttggaaagtaaaagagaagaacatttgatagaaagaaggc

SEQ ID NO: 204588 - DNA, 392 bp, Homo sapiens
ttttggacggagtctcgctctgttgcctaggctggagtgcagtggcgcggtctcggctcactgcaacctccgcctcctgggttcaagcgattctcctgcctcagcctccggagtagttgggactacaggcgctcgccaccacgctcagctaatttttgtatttttagtagagacggagtttctactaaacatgttggtcaggctggtctcgaactcctgacctcgtgatccacctacctcggcctcccaaagtgctgagattacaggcttgagccaccgcggccggcttacacgtgcccattcttacagcatcctgtatcccttggatgtgcaaacaatagttatgaagagtccatgactcaggtgcatagctacaatccttcccttaaatg

SEQ ID NO: 204589 - DNA, 611 bp, Homo sapiens
tataagataggtactactaatattcacatttcatagatgagaacgctgaggcatgcagtattagacagccgtgagtgtggagacagattcacacggagcccactgagagtctggccttttatgaggaagcttcctccctctcttcaacaagaagtccgggtctgcatcgccctgctgaggatgctactatgcaaacgcagggagtctacagattacaagtgtaataacataatggaatattttatataaaatcttgaaacagacagatttcacatcaggaactgttagcatgatgtcatgtgattctaatgcctattaaattttaaagatcaatcaataaattataaataaacaaatagtgacctacaaatgtctaagtgaaggtgggggctccggggagggggagagaatttgaaaagtctgctcgaccccttggcagcgattccaaggctaagggaagctccctctcaggtgcctgacagcaggagcagccggattttggaaagggaggaggccgggacgcatgcagcttggtgggggctgtgtccgaggtccgcagggagaagctgagcgacagccccagcagggacctactgctggcgcccactccc

SEQ ID NO: 204590 - DNA, 612 bp, Homo sapiens
gtgagttatggtggtgccactgcaatccagcctgggcaacagagtgagaccccatctcaaaaaataaacccacacccaaagtgttggtttacagaggctttccaatgcaataggaagcttctggaaactttagggaaagaggaggattaagcaatggagtctagagaaccctcagtggcttgccactgcctttcatttccagtctagttcccctgggaggcagacaggccgagccctctgacattgctgctggaggctgtctctcctggcaaaggcccagggaaactatcctgctgaggcccatctggagctggcagggagctgacattcacggccacatcttagtcataactcctcccctcccctgacacagccacttcctctttctgctgagaaaagaagttgaatgaaggacaagctctcagaaagttgcaacccctaagaacttgagtacaaggaagagacggatgtttattgcaagaaccgttccccggtgtctcctggctcatagagcagctccaacaacacgtgcttggatgccaagtgtgccatggagaccaatccttgctataatcctgatggaaagaacttccccatctgaaaagaggatgg

SEQ ID NO: 204591 - DNA, 291 bp, Homo sapiens
agggcccctcgctggatgtttcagccactccctcacaggttctcgtgtctgcttggtacagttgagatctgcaagagctgattcatcggcctgattgagattcctttgtaaaaccagatattcaagaatactagtggcaagaatgctttggtgagcgtaagatagcggctcccactggatcacatggctggtcggtgtcagggagatcactgtgggaggtagcaggagtcagtctttaaaaaaattattgggccgggcatggtggctcacacctgtaatctcagcactttg

SEQ ID NO: 204592 - DNA, 389 bp, Homo sapiens
taactggcggtgttaagtgaaacacactctgtcgccgcaaccaaggcctatagcttgcaccctctgaggcagtgacccaagctgtacctgtacatctttcagccaaggtcggagcaggagctggggctgctgggatgcaggcagcagtgtcctgaggctacacacagcagcagggccatggggctggcccaggaaaccattcttctctcctaggtcccaaggcccgtgacagcaagggctgctgcaaacatctctgaaatgcctccaagccttttccccacaattgtcttggctattagcactggcctccactttatgcaaatttctggagacttcatgaattttccccctgaaaatcagcttttctctttgaccatctggccaggctg

SEQ ID NO: 204593 - DNA, 351 bp, Homo sapiens
cagcaagacaaaactgactcatatacatgatacaaaaataatttcctctgactttccatcaaaaataatagaggccagagggcacagggatggcgtatttgaagtactgaaagaaaactctgtcaatcaagaattctatatcccaggtagggccgggcacagtggctcacgcctgtaatcccagtactttgggaggccaaggcgtgtggatcacctgaggccaggagtttgagaccagcctgaactacatgacgaaaccctgtctctactaaaaagacaaaattagccgggcgtggtggtgcacacctgtagtcccaactacttgggaggctgaggcaggagaattgcttg

SEQ ID NO: 204594 - DNA, 527 bp, Homo sapiens
catacattcttacatgaaatccttaccatcagagtattgtttaatgtcttctcattttatgataagcttttattcttcagtattaaattggtctatataatcatttcaggtcagatatttgagcaacatcattacagagaaactttgattttccacaattttcaaaatagagcctggttccagagctcacagagaatgagggttcctaggagttcagccctgagttgctaatttctattttgacattaaacctgggaaatgctttttagactgtcttgagaagatttcgaggaaggagaagaaagagaattcaatcttttattaagccgttaagctggtttgtgaattctaaacatgtggtaggaaaggaatgaagaaagttagtgcttctgaccttcttatccctaaaaatagttattatgtgaataaaaagtttaccatcctgaaaataaatatttcaaagggaagaaaatgtcagaagatttcgagactatgaaaattagttatgtgaatactaacattagaac

SEQ ID NO: 204595 - DNA, 412 bp, Homo sapiens
agtgtggaagagttaagcactagtaatagatgatgaacgaatacttcttaatgtaaggaaaatataaaataggactggaatgctcgtatcagtgagctttagccaggacaaaactccagatctcactggatgtaaattcaaaaagaggtcacaaccacttcctttcctagctctcactctccactccttctcataggtttaaaatcatatcctaggaaggattcattgtcacttgaatattttaaactgatagttcccattttaaaaataaagagggctttcattgtcaagagaattcaaaaataaaaactcaagggtgaaaacgaatctgcatgttaatcagacagaggttttgaggagtgcacaatatgaataaagcacaaacaaagagatgtgcttccaaagtactgtg

SEQ ID NO: 204596 - DNA, 517 bp, Homo sapiens
acccctacccttccgccacctctggtgtgctctccaacctgggatgagaagctgtctgtctagccccaagcccatggaatctgatcaaacaaggatggaaaacgctgccagggaaaggagactcacaacgacacttggcagctcacctcttacatgtggaatgcgtttctgggtttgagcatgctacttcaaacctcagtctctagaaatagatcccaaaataaaccaaccctaagcttgctcccacaggcagacctagtctgaccaaaaaatcagaaggccctgaagttgctgtggtggaccagtgtgggcatcaggcagtggagttcagtcccccaggagccccccacactaaagggctcgctcaaaaggcatcccatctaacatcatgcactgcaaagactgagtgatgcttcctctgctccctacaagttccactggccagaagagaggatatctcccttgaggtatccaggcaggatataagtataactaagcacacactcaacttcgaaac

SEQ ID NO: 204597 - DNA, 502 bp, Homo sapiens
caacacttgtaaatttgtgaaaatgaattttatctttccttaaaaaagaaatgttttaatccatcacatttttcttccctaccctttagtttttgataaatgataaaaatgagccagttatcaaagaagaactagtttttacttcaaaagaaaaataaacataaaaaataagttgccggttcctaacaggaaaaaaattagtaattgtgctgagggaaactgcttacatagacattgcagatcaaatatttggagttaaaatgttagtctacatagatggatgattgtaactttactgccattaaaaagatttcagattgcattcatgcttctgtgtacacataatgaaaaatggacaaataatgaagatctctccttcagtctgctctgtttaattctgctgtctgctcttctctaatgctgcatccctaattgtacacagtttagtgatatctaggagtataaagttgtcacccatcaataaaaatcacaaagctggttt

SEQ ID NO: 204598 - DNA, 405 bp, Homo sapiens
gaaaacaaaagctgccagacttcagttttcatttaattggtcagacctatacaacatatctagcttctccctaactgcagggaaggctctgaaaatcagtgtttaactttttcattgtggctgcttcaggtgagaaggagactgggaatataactcttgtgtcacctagccagtgggttctgctgctgtgcctgagctcccaccactattaagtggcaaagctggaattctaactcagatgtctcttcctccaaagtcctaattctccagttctgcctctcaaagaataaaggctcccgtattataaagatttgaatgaacattatccagcatctacagataggtacagtttttttcttgaaatttttcccttttcaaaataaaaaattttatttacctttttag

SEQ ID NO: 204599 - DNA, 211 bp, Homo sapiens
ataacaaatgacagggcaagtgatttctaacttagttgagttttgcaacagtacctgtgttgttatttcagaaaatattatttctctctttttaactactctttttttttattttagacagagtcgcttgaacccaggaggtggaggttgcagtgagccgagattgtgcccctgcactccaacctgggtgacggagtgagattccatttga

SEQ ID NO: 204600 - DNA, 789 bp, Homo sapiens
attgttcatatgttaggcatgactatggcattatgggtatatgtgtatgagtccttaagtgttagagattcatactgaggtatttaaggctgaaatgttatgcctgtgatttacttttaaatacttaaaaacaaaaggtgggagggatagatgaaacaagattagcaaaatgttggtaaatgtttaatctggatcattaggtacacagggttcattgtgccgttcttactatctttacatatattttaaattttccataataaagttttttaaagtagaaaatcaaaaaaaaaaaaaaaaaaaaaaaaaaaaaaaaaaaaaaaaaaaaaaaaaagacaaaagaaaagaaagaggagaagaagaaaagaaaataaaagagacggagtgcagagacaggagcaagacaccaaaactccatagcacagacgacgacgggctcacccacagcaacgcacgaccgcaccattggccagggccgaaggctgagtgcatccagagggcgcacgcaggaccagcacagcagcgcccccacagacgccaccacctctatcacaagacagacggaggaaccatagcgcgggccgaaccagagctcgcatacatctttcgcccaaacgagcacgtacgccacaagcacgcaaggcggcggatagatccagaccaacacagaccgcacaacgcgcgtcgcgtgacacaaacttatacaattgacccgaggcaggcagatgcgcgcacgatggaacacggaacaatgatcaggtaacaaacgcggaaattgaaacaccgagc

SEQ ID NO: 204601 - DNA, 303 bp, Homo sapiens
tgtatctccaacttagacctccctgctgacctccagactcatacgaccaactacccacttgccattaccacctggatgtccagtaagacatctcaaccttaacatgtccaaaatggaattcccatctctccctcaaaagctgctcatctcagctaatggcaactctcattgttctttttacttggaccgaaaaacctggggtcatcccgaatcctctttcactttttttttttaatttaatttttttattttttagagacagtgtcttagcctgttgcctagactggagtgcagtggcacaat

SEQ ID NO: 204602 - DNA, 543 bp, Homo sapiens
tacaagatgaccacctactcctagactttcaaagactttacagaaattttggtataacttttaaattcatcccacccccagtaggatgatctgactatctacatacagcagaaaggtaaggctggtactactgtgttttgagaacatgtaggaaagtaagatggggatgtgagataatgcctttctaggagttattttcttggcagtatgatactttacaatatgatatacaacagtaccactgcttaaaccacacacgtgcataatgaaaattcaactggcgactttgacttgtgctgtaatggctgtgacactaacctaaacaacaacaacaaccagtctttagtcaatatccacccttcctcattgcactcaccatcacacgcactgagtccggtcagaagggccttgtttacagagtatcatctttggtcatgtcacatgagtgtgagcacatagcgcgtcctcactccaacctggaacatgtagtggagatcctggagagcagcactcgtgtcacaggtgcctggctggtgacccaag

SEQ ID NO: 204603 - DNA, 465 bp, Homo sapiens
caattgaggacaatcaagaggatgaaagaagattaaaatgaataaaagaacaaccaacctcagctataattcagaagaatacttcaaagtgtaattagtattttatttaaaatttaagaatacgtaatgtttaatcatagttgcatttaaaagggggcatagaactagaaaaggttttgaaaattataaaaattttaattgaagagataaaatttcagcatgaatcaagactcaattgttgattttggaattaagaggaggaactgtctgcatatgtaaatcaaaagagaaaataatctggaaaaacttgagggaaaattaaagaagcatggaaaatatatcacagtttttcacatccataagtatgagttctcagagcaagagatttaggaaccatgggaaggatagaataatgaaagaaataattgaagaaaatttcctgagctgtagtaactgtaatgaatt

SEQ ID NO: 204604 - DNA, 305 bp, Homo sapiens
ctggagcttctagtggaccagatactcttgagagtgcttgacgtggtttatctcatcaagccctcacaaccacttacgttacaggcatgatcatcatctctgttttacaggtaagaaacatagcacagagaggtcaagcaacttgcccaaggtcacacagccaggatgagcagtgctgggattccagcccaggtgtcccagggctctaactcccttgggatagcctgtctttccctaaactgcaattagacagtggcctcagcccaatgtgttgcgaggaatgagggctctgcatggactttttg

SEQ ID NO: 204605 - DNA, 209 bp, Homo sapiens
cttcgcaaatataactatccacgtaattatcaccaagataaatgacattttcatcacccgcaaaatgcccccagtcattcctactttctgccactatagataagtttcgtcttttctaggatttcacctaagtggaatcatacagtatattgtgctttgtttggcttttttttttttttttttttttttactcagcataattgtattga

SEQ ID NO: 204606 - DNA, 146 bp, Homo sapiens
agcgcccccagcccaccattcttttccctcaacaggaggcaaatgagaacttctctgggatttttatatttgcagtttctgtcctataccctgggtcgtcaaagagtgcaaagtgaacacatatgaggtgggggaagcttgggagc

SEQ ID NO: 204607 - DNA, 668 bp, Homo sapiens
ccaggcatggtggttcacacctgtaatctgagcactttgagagacccaagcgggtggatcacctaaggtcaggagtttaaaaccagcctggccaagatggtgaaaccccatctctaataaaaatacaaaaattagccaggcatgatggcggtcacctgtaatctgagctactaaggaggctgaggcatgagaatcaattgaacctaggaggtggaggttgcactgagctgagatggtgccactgcacttcagcctgggtgacagagcaagactccacctcaaaaaagaaaaaaaacaagaaaaaagtggtagtcagtatgtattaagatttagctttgcaagataaaaacattctagcaatatgttgcatgacaatgtcaagataattagtgtgacttaactgaatatttaaaaatattttgtggtaaatttgttatttttttgacaagtaaaaataataatacccaaaagagatacagagttatgggagttttaaattatattcaaatccaaaagtgtttctcccacacaaaaatcatatagattcataaataggatgttgaaattacaagaattttataactactcatctacaaaggattagaaaaccattcacaacaaacctatacaacaaatatacaaaaaacaaacaaaaaaaaaccaagggt

SEQ ID NO: 204608 - DNA, 664 bp, Homo sapiens
tactggtcaccagcattaatttcccctcataactacaagaactcaatcaacagaagctactgtgttgaacttgacaaagaaccaaaaaagaactgagcacaatgtattactataaaccactgcttcaagagaaaataaatagctggtgctcaagatctagtataaaatatcattaaatgtccctaaaagtgatcaacagcaatactaaaccagtatgaactacagcctaatagcagcaaaaagatatgcctatttcatacttcgggtcatggctgagggctgggagggataacaaatttttcatttaaaaagattatttggtagtaaataagcataatttagagtctttattattcattaaaagcttatatagaggccaagcgcagtggctcacgcctgcaatcccaagactttgggaagccaaggcaggtggatcacatgaggtcaggagttcgagaccagcctggccaacatggcgaaaccccgtctccactaaaaatacaaaaattagccgggcagcagtggcgcatgcctgtaatcccagctacttgggaggctgaggtagaagaactgcttgaacccgggaggcgaaggttgcagtgagccaagatcacgccactgcactccagtgtgggcgacagagcaagactccgtctcaaaaaaa

SEQ ID NO: 204609 - DNA, 639 bp, Homo sapiens
ggtatggctgctgccataggtagcaattcctctgatggccctgagcaaagtcagtgaaaaactttccggaaaggactcaccattctagatgccattaagaacattcatgaatcatgggaggaggtcagaatatcagcattaacaagagtttggaaaaagttgaatttcaaccctcatggatgactttgagggattcaagacttcaaagaagaaagtaactgcagatgtggtagaaatagcaagagaactagaattagcagtggagcctgaagatggaactgaattgttgcagtattatgataaaacattaatggatgaggagttgctgttttttatctgtttattaaaaagatttttttaaagacaaagtctcattctgttaggctggagcagaatacagtggcacgatcctagctcactgcagccttgaactccctggctaaagcgatcctcccttctcagccttctaagtagctaggaccacagtcacacaccactgtgcctggctaattttttaaaaaaattatcttttgtacagacagggtcttgctttcttgcccaggctgttttcgaactcctcgcttcaggcgatcctcctgctttggcctcccagagtgctgggaatacaggtgtgagcta

SEQ ID NO: 204610 - DNA, 757 bp, Homo sapiens
ggtctggggaaaggttttatacagaaatctgtactatttcaatcttcagagttagggaagttggctctgaaagcagaatgggaaacacagtaccttagaagatctcatactttccaaaaaaacaaaaaaccattctagttgattaaaagaagtagaacttttcctcacattgatgtctgaagggaatttctccaggaagctttagtagatggtggacaattaagctgaagatgattctaaaacacagttcagttagagcagcttcctaaggcttggggcaaaaccaattgatcttaaattcagagctgatggtggtttgggtcttgaaaaattctcgtgtcagactccgctagagagcatcttttcaatgatgtgttttcacttaagagtttagtaagtgaagggcattttggattgcgctgttgtgacctccagcttaccttccactagggatgcagcttatgggtagaatatgaatcttcagatggcaaaacagcttttatagctaataacctcagaacagaagcaaagagagcacacttagactcttcgctgtgctttcactggcacatcagtaatttccatccttctacaaaggggatgctaatttttctcttaaaaagtccttgctttataaatgaaaaacagtgaccagtgacaaattcaggaattaagtaggttaatttgatagggcagcttctcaggtgctgaccctttaaaaaaaaattcaccctttttttcccgctacaggtgattg

SEQ ID NO: 204611 - DNA, 219 bp, Homo sapiens
tgtccctttgtctgcacagcagacagtcgagatgcactgaaactgtccagatgcgactcctgattttcattccatcctccatctctgggactgttacgatagctgtttccctgaagtttctctttctacccgctccatgtcttcctctgcccgaaatccttctgtagcttcctattaaatagcattcccatggttcatttatttagacaaagggaaaca

SEQ ID NO: 204612 - DNA, 366 bp, Homo sapiens
aagcagttaatacagactcagatcaaatgacaaaccaaatggggtaaaatgttaacatcagacaaatcatatatggatgggcctcggactatttttatatttacaacttcttgtaagcttgaaattgtttccaaataagtttattttaaaactccacaaaccgatcaaggcttggatatataattctgcttcctactatccccaggaaaggaggaacctgaaagaatccaagagaggaaagagaaaaagagcacaaggctgggaagagaaaagcagacaaggaggggaagggggagagggacacggagggaacagaagtccaggcctcagtcaccccaccagacttgagtctgtattaactgcttg

SEQ ID NO: 204613 - DNA, 187 bp, Homo sapiens
aggtaacctcattgtttctgcttttcatgatggtctcatcaaggaaggggtaggaataatcatagcctgttgcaaagatgacagagtcgatagcctcaaacatggtcccatcctcaaacacagctgaggtttccgtgaactccttcacactgggcttgatggacagagtgccacacaggatgcggga

SEQ ID NO: 204614 - DNA, 567 bp, Homo sapiens
attatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttagga

SEQ ID NO: 204615 - DNA, 508 bp, Homo sapiens
caaacaactccagacgcgctgcctttaagagctgtaacactcactgcgaaggtctgcggcttcactcctgaagtcagagaaaccacgaacccagcagaaggaagaaaatccaggcacaccatctttaagaactgtagcactcaccaccagggtctgtggattcattcttgaagtcagcgagaccaagaacccaccaattccggacacagtttgtctgtgtccccacccaaaatctcatcttgaattgtaataatacctgtgtatcaaggacgggaccaggtggagataattgaatcatgagggcggtttccctcaaactgttctcctgatagtaagtgagctctcacaagatctgacggctttatatggggctttccccttcacccagctctcattttctctcctgccaccctgtgaagaggtgccttctgtcatgattgtaagtttcttgaggcctccccagacatgctgaactgtgagtcaattaaagctttttcctttataaatt

SEQ ID NO: 204616 - DNA, 471 bp, Homo sapiens
tgcgagcagtaaagttgatttaactgttgaggtttagggctaagcatagtggggtatctaatcccagtttgggtcttagctattgtgtgttcagatatgttaaagccactttcgtagtctattttgtgtcaactggagttttttacaactcaggtgagttttagctttattggggagggggtgatctaaaacaccctttacgccggcttctattgacttgggtggagataatggggttttctagatatagtatcatgtcatctgcaaacagacagttttacttcctcttttcctatttgaataccccttatttgtttctcttgcctgattttcttggccagaaccacaaatatcgcgatatttatgttctggccaataagatgtatttggggtttttttatttttgtagttgttgtttgtttgcttggtttttttttcaagacagagtctcactctattgcctaggctgga

SEQ ID NO: 204617 - DNA, 282 bp, Homo sapiens
tgaatgaatgaatgaaatttgtctgagagaaccattcattctaaccaacatttatggagtaactactttgaaaagaaccattctgtctttactatcaagccaagatactcaaggaaggcagcagaagtggaagctccatgtgggcagaggagcctagtcttgagatgtgatttagctggtatttgggtgaaacaaataaaccagcctcaaaataacacaaggggccgggtgcagtggctcacgccctggcggtttttaatcaagtagaaaagctgcattata

SEQ ID NO: 204618 - DNA, 223 bp, Homo sapiens
gagagcgagctctctggtgtctcttcttatgaggatggtaattccaccatgtgggccccaccctcctgaccttgtccaaccctaatcacctcccaaaggccccacctcctaatgccattacaatgggagctggggcttcaacatatgaaattagaggagacagagacacaattcagtccatagtacccagaaactgaagatattcagtgttcatcccctggtg

SEQ ID NO: 204619 - DNA, 707 bp, Homo sapiens
agaattgcttgaaccgaggaggcggaggttgcagtgagcagagatcatgccattgcactacagcctgggcgtcaagagcgaaactccatctcaaaaaaacaaaaaacaaaaaccttcactgtgtctttatgtcctccttgatcagctggaatgcctagtctatagtaagggctcactcaatatcatgttaatgacttctgactatctgacttcatgggggaccttaaagaccctccccccactgcccactgcacctgactgctcgtggtgtcctcatgcagacgctctgttatggccaagcaaatatgctgttgtctcttctctcccactcctacccctttgtgactttcttggcctgtcatatgcccttttcctccctgcctcctggcgttaacaatccctttttgttgtccatacctccaagattgcctccagtattctcaactgcctgcaactaatactcctaggcttgcggtactcgctcgtccttactgacttctgttattcacttggccatcagcatttttgaccttttttgtccttactgacttgtgttattcacttggccatcagcgtcttgtaatatgcaaggcaccatgcctcacctgtcaaatgaagtcaagttccccttcacttactgcattgtacaagtcacttggaaactactctcagctcttgcttgtaaaataaaaacacttctcaattgc

SEQ ID NO: 204620 - DNA, 365 bp, Homo sapiens
ggagaataagcttgattgccaagtatcattcttactgggatgaagaaacagaggtcaaagtacaagactaccaaagcagctctaagttgagggagaaaatctcagaaagaagcatgccacagaagagggagccccaagttctctttgcagttttccaaattgtgtacagacagacagtgcttccagaaagcagcatcaggtactaaagaactaagcagagatttcagcagctgcctggtgctgagttttgcatgtaaatgttgctatgttacagggattgataaatacctcaaattttgtgttgaaactgcagaagagctatggttgaggactaagggatttcccaggactaagggcaataagca

SEQ ID NO: 204621 - DNA, 336 bp, Homo sapiens
aaaatagaactgaaaagtaaaaagctaaaacctagcacagctgcaaggctcaatacacgatgatacattgtattcccacacaccagccacaaaaaaagtagaaattataattataataccaaaaaacatgaaatagggataaatttaacaaaatatgtgcaagaactgtaaatgaagcttcagtgaaagaagttaaagacataaatagagaaatatctcatgttcatggaccgaaaaactcactatcgtaaacacggcaaattttccctaagtactccctccacttgtggccagtagccacataagtcaaaaaccggaaacaaaccaaatgtccat

SEQ ID NO: 204622 - DNA, 529 bp, Homo sapiens
gttttctgttcttgtgttagtttgctgagatggtttccagcttcatccatgtccctgcaaaggacatgaactcatccttttttatggctgcatagtattccatggtgtatatgtgccacattttctttatccagtctatcattaatgggcatttgggttggttcccagtctttgttattgtgaatagtactgcagtaaacatacgtgtgcatgtgtctttatagtagaatgatttataatcctttgggtatatacccagtaatgggattgaacttctggttctagatccttgaggaatcgccacactgtcttccacaatggtttgttctcattctttttccttttaaaataaatactgtctaaattgaagtaatagtgcagcatgattcttacaacaagtaatttgtaaagatgtttgttttatttattccctatgaggaaagcagcaatgcgatcatttatttataactagtgactgtacacatggcgacctttattttatataagttgaagccacaacttttctatt

SEQ ID NO: 204623 - DNA, 432 bp, Homo sapiens
gagatcaatgataaggggccctaaatcaaggtgagcttcccccacctccgtgcacttgcattctgtgtgggcaggaggccctgccctgaaagggggctccgtcctgtcaagagcctatggtttcaagacttaaacatctttgttggaacttgcttggaagaggggcctgtgttgccaccttggaaagaaagtttctctgtcctttcagctgggggtggagggagggctgtggaagggggcttgctggcagttgagttccaccaatgttttctcaagccgacactgagccccattcatcctcctgcccatgtgtggctccggcacccctagacggggccagcccagcagcctgaagtccgcatttagaacttgatcccctcttataacgattaaattttagtaagtaaaataaaaatgcttcaaaagaaaaaa

SEQ ID NO: 204624 - DNA, 556 bp, Homo sapiens
cagccctctggacccacccccagcactctggacgtggggggttactatctccaggtcctcgatcaacactcggacccgagctttccgcctcgctcctcgcggagccgggtgaaagaaaacctggcccgagatgcaggtccgcgctgagccttcatccgccgcaacacgagtctctttcctgccggcccgcgcgacccttcttccctctcctcctctcaaatgaggccaaatgggtgcacgtggcgtagaaattctacagcgcccagagcactgtgaggaaagattcgccttttcctccccgtggctgctggaggctgtgcggacttgccctgagccttctccgccactctcggccgtgacgaggcccttcctccactaacccttgccctcgtcttcccttgggaaaagatgtctacaaaccgtcgatgtaccacgaaaatctcagcgcccacagactggcgttcaagagtcatggacatgagacaagagagtaatggaaaatacaaattcttggccatatttctaaaatcatccagccttttttaaaacttgtatt

SEQ ID NO: 204625 - DNA, 550 bp, Homo sapiens
cctcataagatggactaattttatcattgagcagccctttgcctatagccataggactgaatgcatcatgtaccagaacaggatgcattaatttgttaaactttaacaaattaattgaaatgcagaaatacagaaaaccaaaggaacaaacactgccccttcctcaaagtggaatgcagttttggaatggtatttgattatttgagacagggtttaaaaacatgcctctgtttagctgttagatgaaaatactcccattctcctttattttctggactgaggacactcccctgccacctgtggccaaaccactttggctctgtggggtagcatagttaatcacctcagtcacttctgccctctggcagttgcttggggatgagaaatccatttgcacttttatgactttcttaatactccttagaatttatccctgagcctgaacttccaatatcttcaaacttttccacagtcctgtttgaagaatgatctggttcatgtaatggtgcctcctgggggaaagagaggaggtggagttgagggttggaag

SEQ ID NO: 204626 - DNA, 531 bp, Homo sapiens
agccatgcagctatttcactgaagagtattttaggtaaactaaacaacaagactatccatgaaactcaaaagcagaatgagtggtttcgtgcatggccaatatgattgtggctcccagcaactgcggcacagctactctcccatctggcagtctgatccatcctccttttattatttgcctcccgtctgcatggaagaagtctttttcttctttagaatagatttgaaataaaacctccctattttcacaaaacatctgctgaaagagagagacagagaaagagatggaaattataacatctcatgctctaatgaagtagtaatcatagagggggaagcataatacttcattaccatgtctgtagaggaatggaagagcatattatgcaaataagaaatacaaggcattccttgaaccatagtcatccttcagagaagtggaatgtgtctcaagttctgttttatgaagatatcaacatttttgaaaaatatggagatgaaaaatagcaacataaaaataaatctcagacc

SEQ ID NO: 204627 - DNA, 525 bp, Homo sapiens
ctaatataacctatacttcagaaaagaatatatgcaaatgggccactaagcacatgaaaagatgtttaaaagcactgatcagcaagtaaatgtgaattaaaaccacaatgagataccactatgcacttaccagaatgattaaaatgaaaaagattgacaataccagtgctgataaggatctggaactctcaaatattgttgataggaatgtaaaatggtacaaccacttgaaaaacaggttggcagtttcttaagaagttaaacatacatttaccccatatgatgcagttattctacttctaggtatttccttaaaggaaaaggagatacagtcatgcactgcataataatcttttggtcaacaatggactgaatatatgatggtggtcccataaaattatagtggagctgaaaaagtcacagtaatgtgaataatgcacaattcattattcatgtgtttgtagtgatgctggtataaacgaatctactatactgccatataaaagtatagcatacactatgtac

SEQ ID NO: 204628 - DNA, 744 bp, Homo sapiens
tatcgagccggtaccgttgatgtggcttctgagaggcctaaggagtaactcgtaacctttggacatttttctagacctcaagacttcataaataaagctccaagaatgataccaactctgctgatggaggtggagatgaaacagggagagagaccagaggaatgtgagaggatgttagggacgcacctgggtttgtgggatggatgcctaacattttaaaaaattgttaaaattgatagacaaaaataaaattcattacttgggccagaaggaaattcagtcaggaaaaggggagaaaaagaaaatatcacccttgcttcttggccttttggctgagatcaagtatagtgtttgttcttatcagaaatatggtaaataggaaaaatgaaataaaagcataaataagccctaatataccagtagttaaaataaatgtaaatgaccaaaacacactaatcaaaaagagttaaggtccgtgagcaaatagaaaacctaacaatatataaaattacaaatcatgcaccatgtagtatatgtataatatataactctgtgtgcgtgtgtatgatgattgacagtaccatgaggagaaacaaaataccaaaaagtgtggcttgaaatttgaatgcacccctctcgggaatggacaggtcaggtgtgtgaaaaaggagcgaataactagaagactggaatgccacagctctctacctgggcccagagagagcactagacccaacaggcaaa

SEQ ID NO: 204629 - DNA, 323 bp, Homo sapiens
aagaataatacctaaaatcatgttaatatctataaactagagtttccacttaatacaacagtctgccttgtctattttatatcccagtctactatataattagataacatctgatatggtttagctgtgccccacccaaatctcatcttgaattgtagttcttgaatgtaattgaatcatgggggttccccccatcttgttctcatgatagtgagttagttatcataagatgtgatggtttaaaaaggggctttccccttcactgggctctcattctctctcctgctctcctgtgaagaggtgccttctgtcatgattgtaag

SEQ ID NO: 204630 - DNA, 112 bp, Homo sapiens
gtgaggcaattctgctctcgtattttcctcagagatggatgttcacttggatgtcaaaaaatccagggaaataaaatcttaaggtcactgttttgttcactatttatgtcat

SEQ ID NO: 204631 - DNA, 458 bp, Homo sapiens
actgggcaacagggcaaggctctgtctccaaaaaaatgataaaaaataataatttctttaaaaaaagcacccatgcttatttatttatgtgtttctttggctgttctcgtgctacaatggcagagctgagtagctgcaataaaacatacagctctcaaagccaaaaatatttactctctgtccctctgcagagaatttgcgaaccacggtctagaatataaatatagcaactatttagaataaaagactaatacatgaatgttttcttgtcttaaaccatggttcacttgacggatttttagatagttttacacaagtaattgtctaaatttgcaaacattaaaaactctgtttaagggaactccttccgtactcccatcctcatatcctacaatttcaattacctgagaagctacaaataaaatcaccttaaagattgctgcttttaaattctaacc

SEQ ID NO: 204632 - DNA, 443 bp, Homo sapiens
cctgtcacctccactgaagaacaacttcagcttaatgccccgttgtgttcaaaacagtaatgtctctgctgagacatccactccattcctgagagatgagatagtctccatatctctctgacctgtgcatggctgcagacactgaccctcggctcttgttctgggggcttacagggtttccgtgaagctctaaaggcttttgaaatttatcacacatacctggggatactgtcaaacaattatctgaaacagcagagtaatgtagtttagcacatgggatctagagtctattcctggatttaaacactagctctgtcatttaatcttgctgtgccagttttgttatttgtaaaatgggttattctggtaattaacctcagaaagatgttctgcagattaaataacataacatatgcaaagtactgagaacagtgtctagagca

SEQ ID NO: 204633 - DNA, 430 bp, Homo sapiens
ccaaaccctcgggtctctggaacactcgggatggagcagccccaaagggccaatgtctcatcaccaccagctctcaggaagtccttctcactcagctaagagccagggcacgctgctgggaggtttaggttttaatttaaactgtgaggttatcagggtcaaaattaccttgattccacagaactcctcgcaggtgagggccgcaaagaggatggattccaggacgtatgtttgttttaacttgatcggtaacttggctgggtgagctattcaagtcacttgtcccacaattaaaaataacccaaatagcggccaggtgcggtggcttacacctgtaatcccagcactttgcgaggttaaggcaggcagatcacctgaggccagaagttcaagaccagcttggccaacatagcgaaaccccatctctact

SEQ ID NO: 204634 - DNA, 473 bp, Homo sapiens
ccgagtatgtcaattggcaatatcagtccacatatgagctttcaaatgctctctttctaagcccaggcagctgagtgatttgtgtgatatttgatttttagtttttcagcagcccgttttgatttagtgctttctgcatttttatagacatcagcaatcctgtagcaggtcctgtttggctgatacattttacaagttgataatagtaaagggtgtgtagagatagaacctgatatagatgtgttcttttgaagcatcatcattactgagagataagtctacatagaaacaaaacacaaaacagctagcagctatattttaaatttttgattcaaccaaaaaattagatatattgtactaccttgatgtttatccccttttctacatatttgtgatgttttgaatattgaataggaattcatgaagatatttccaaataaaaacaaaaatgatattggaaatttttataaaaa

SEQ ID NO: 204635 - DNA, 382 bp, Homo sapiens
ttctctctcttatcacatccttcttttcctttgacccgctctactaaacgactggtcatttgctcacactaagatgtctccctctcccagaaatctctttttcctcccaggcttttcattgacattggcctgcagtctcttgccacctggcctccacctcacaactcaaatataccatcagggggcatctgggctcccagaagcccacagcccctactggaacagcctttggaaatcttctaatgctggaagggtccttctcctctgatcactgtttgccatctgctgctgcagaaagggtttgagattttgttgcagtttttgctttgcttttctcccaatatcatgaatgagttgactcttagctttcctggtgtatgtg

SEQ ID NO: 204636 - DNA, 1622 bp, Homo sapiens
tcttccttctctgggcttgtcatgtgggggtctcgtgcgcttgcccctcgtggcctggcttgtggaggatcccgggatgggccttcctgcccagggcgggctgcacttcccctcccacccttctcgtcacctgatgaggagtgtgtgccttgccccatagcccatggtccctggtccccgatagagccttcaagccagggggagccgtccttgcctcactgggcgattccaagggctcactttgggtagggaaggtgatgaagcacgaaggccagagctggagtccagaggccctaagaacccccgtgcctgtccagccaccgggctctgttgggctctcacctctgcttccccagcgagtccaacagtggtcagtgggcatgaagcagatggcagtgctgggggctcaggcagggtacagtaagtccacagctgagaagggctgggcactgacaccccctaagtagctgaggctgccactttactttcctggggtcagggagggtaacaagactgtccgccctaatagaaggcaaaaatgcacccgttatgtgatagacaggacgtgggaggagccccaggaggagcagggctgggctgtcccgcccagtcccggcagggacttctctgcttggcctggggcctctgcctggccgggtcacctttgtaatctgccaagcctgctgtgaaagccagggctgctgggactggagtggcttggcctgcactcctgaggctctgcacccaggcacatcaagcctgtataggcggccaggggagaaatagacccatccagccgggccacacattctgatggcagagcagctggggacgtagggatcgcagtttccggcctgtgcccgtaggacaccctggccacctgactcccctccctgccccatgcctgtgtctgctggtcttgctcttgtctccgtgaggtgccacgctcccctcaccttatggctcctcccaagccctgcccatcttgcccattcctagtgtgagctgcctggggtgaaccactgggcctgctgcctccaggtacccgccgggcaccaggttgcccttgcctgcgccctgccagcttgggctttgtgtgtgtctgttgcagtgtgctcttgcctcccctccctttggtgtattcatttggtttcttttctttgaatagcatagcatatcgtcgggtcattcgtgtctatcagtatgaagttggggatgatctgtctggaaggtttttctccttatttctcttcttacctcactgtggctttactgatgcactcttgacatccccaggcggtccaccctgactaacctgccgccctcggctgcttgggaaggaggggtctgtcctcccactgcaccggcacccagcctcctgcccccaggtcctggggggcattttccccggggggacatggcgtgactgtgagtctgacctgctggggtaggaggaagcctggtgccttgccttgctagagcactttgaacctggggagattgcagagctaaccctggctcgccgggttttaaaagggtaggttggggtgaatgtgggtacaggggagcctgggctaaaaccccaccaaggccacacgcaccgtgtgattcgtccctgcacg

SEQ ID NO: 204637 - DNA, 423 bp, Homo sapiens
ttaaagatcatgtgcatttcacaaagaattacaataaatgacagctaacggaagaccaattagagtcttaaattactgttagtcagtcagtaggaaaatatgattcagttcctctgtgttgtaaggggaggtcacgctaccctaaaatgtcacaaaacacaaatagttttatttcttccaaaagtacaagtaatcctggtatccagataaagaagttttaatttgtttttattggtttaccttgcctcagagttctgagtgttggattttcactgtgacaacaaaaataaaatatttcctgcttattgtaaagcggtcaaagagctgaaaagcaataccatcttttagaatgcatttcttacccttctttgatcaacattaagatgcgttgccactctggggtatgattctggtttgatcgag

SEQ ID NO: 204638 - DNA, 674 bp, Homo sapiens
atcacttcataaagaacagttctttgagaaaagaataaaggaatgtattcatttccagaaaaagagggttggggaaagtttgccatgtaggttagtcagaagaaagcaattctattatgcataaaaataaccttaaatatgtaagagagtatctcctctacttaaaagttattatagtagtcacaggcatacagaccacaggaattctatggtcttaacatattttaaaattacatttattttaatgttcttaaagtttatgaagaggagtttaaagcaattcccataattaaatatttactcggcaactaaaaactatttaacacttgtggttaattatacacataaacaaatggcgacagagtagcctcactaccacaattacttcatggttacacctttgctttctaataataggggctccagttgctaaatatatttgtttacttacagtttaagttgagctgattgttgaattctgttattgttcctgaattcaatgagtatataatttgtagagatgttgaatagtttggatcttagtttttaaggctgaaaaatctggctggatttagtttttaaaaatttgcatcatcaagaatattgcagttaatgttcctttttttttttttttaaagacagagtctcactctgtcacccaggctggagtgtac

SEQ ID NO: 204639 - DNA, 398 bp, Homo sapiens
gggttgcatcaggggaattggcagacctgtgtgagcgttagaccctgccgggcgggagagcgggcccggatagcaggaaggaacgcgcctggaaggtgaaaatggggtgcgagaaggtgttgccttgttgtggtctagggctttgttttccctgagcccgcctttatctcactggtggagagaactcccacatatggaagcctggggaatgggatgcttcatttagttgatgggtggtatccctgcattctagcatctctgaactgcttaggtaccagcaggaataactgctatatcggagtccagccctggcattccctttcccgtgaaataggatagtattctggcagtattactccctagtcccaatcacccccaggtcatcatcgcctttaaat

SEQ ID NO: 204640 - DNA, 399 bp, Homo sapiens
atgttgtaattcagtctgagtccgaaggccagagaaactggggccattggtgtaatcttggagtctgaaagctcaatgaagtcacgagaagatggatgtcccagccccaagagggagagaatttgcccttctctttttattctattggaacccttaacagattggatgatgcctgtccatattgatgagggtggttcttctgtactcagtttactgcttcaaatgctagtctcttctgaaaattctctcacagacccacccagaaatgttttaccagctatctggctatcccttaacccagtcaagttgacacataaaattaaccatcacagaatgttatttggattcagattttaatcaacaaagtgtgaaaaaataataagattattggagaaaatt

SEQ ID NO: 204641 - DNA, 412 bp, Homo sapiens
gcagctgggagatggaggttgccgtgagctgagctcacaccattacactctagcctgggcaacagagtgaaagtgagactccgtctcaaaaaaaaaaaaaaaaaatcagtgttgaaatgtgacatttttttccctgtagtggctgtcaaataattcatatttaaaattatttttgctttctcccattttgaagatggagttttatgttataattgttgatattacaacagacatcttacaaatgctaaatctaaatgccaaatatatgatattattgtattcaggagaccaaatctatcaataccactttgtggttaatttatttttaaaaataaacactcttacctcagcaatttaatatgagattaatgataataaattttataggcctttaaaaattagtaggctctgt

SEQ ID NO: 204642 - DNA, 638 bp, Homo sapiens
caaaactctaattagtagctaagccaatattaggacctatctcttctgtctgtagttttgtagggatgctctttccactacacaggggaaagtttacctttgaaaaacatcccaatacaaagaaccttccatgtttctttcaaatatgcttagaagtggctgtatccaaaaactatcatcaggatgaacagaaaacctacagaatgtgagaaaatatttgcaatctatccatctgaaaaatgactaatatccagagtctggaaggaacttaagcatatttacaaaaaaaaactaaccccattaaaaagtgggcaaaggacatgaacagatacttctcaaaagaagacatacatgggccaagaaataggaaaaaaagctcctggggcagtggctcatgcctgtaatcccagcactttggggggctaaggcaggcggattacttcaggtcaggagttcaagaccagcctggccaacacagtgaaacccgatctttacaaaaatacaaaaatttgctaggcatggtggcatgcacctgtaatctcagcttcttggaaggctgaggcaggagaatcacttgaacccaggaggtggaggttgcactgagctgaggtcacaccactgcactccagcctgggcag

SEQ ID NO: 204643 - DNA, 381 bp, Homo sapiens
tttctcatgataagagaccaaccactgtgaactggctctggcctgtttacagaaatggtgcattgtgtgccttcgtgttactgcttcaccttttcatgtatagggcctaactgtaatacatttaaatgttaagcctccaccccaaggtgtaacatgcatgcatcaggactgccttcatgaatattcatgaatccacctgtagcctgttgaatatgtatacttggccaacccattcaatttaaatttctgtcttactcttccttccctagaagtgcctgcctccggtctttgctggaggttacgctttctagcctgcagaatgaccaccttgtaggctgtaaccctttgtaagaaataaagtatcctttccaaatgcatgaa

SEQ ID NO: 204644 - DNA, 268 bp, Homo sapiens
tgcctgtggagctcagtcaggggacctgccttctataggtatatcagctctgggcgaaagggacagaactaagggtttgaatttgtagaaatggattctagatcttaaggcatggtgagcccaatcagatgcagcctttctgtgggtcttgttcaggaaacctgagggcctccctgaaggacacctctattacgaagctctttacctgcagcacactgcaaacaatcattcagggaataatgacataaccacataccctcatcttcaa

SEQ ID NO: 204645 - DNA, 500 bp, Homo sapiens
tttatttcaaggcaaaagctacgcaaaaaaggggagagagtggcaacacaaaattataaaataaaaggagatatagcaacaaatagaggtggccttttttgaaaaagaaaactgctacacatatgccaatgtgttccaaagtgtgcttccacagaaagttaatacatgctccactaaaaaaagcactcagtgtctaagtttgggaaatgctggactaaacaaagtgagcaagctatttctagcactctaggactttacctagtctttaacatgcttataagtgtattgttaatctccaaaagatatatcatttgaccacagaatcatttcatagaatatactcttcaaaaatatttcaatatggaaaaatgcacaaaatgtatttacaaagctagcctaacaccaatgtcaaaaaatttctaacaagtagcacaacaacaaaaaatcaatgcaaaactaccatagtagcctgtagaggctaattaaacaattatgtataa

SEQ ID NO: 204646 - DNA, 441 bp, Homo sapiens
ttcttaagtactgaaaacacatcctttttgaaaactctaaatgctgaaacagtggttatgagcatggacttgggaatccaatgcctgagtttgaatcctggatcaagtaactacctgcaaactagttactttacctccgtgggaagttactttgcttctctttgtcacagtcctcacttgtgaaatgaccataattgtaatgcgtgtttgtagggttgtaaagattaaatgaatgaatccttgtaaagtgcttggaacaatccccagcacagcccatgcacttattgttaccattgtgatttttaaattatttttcaattatgttgagaaagagttaattaagggctatttgaaactaaatatgattatggtgggtaataaaactggataatatcatttttcataaactaaaaacatcagtaaaagtgagatatgactata

SEQ ID NO: 204647 - DNA, 254 bp, Homo sapiens
ctcccagaagcatttaaaaatccacaaaccatggataacttcctgtgaaatggcttagtgggcaaaaattcagaataaggggagtgtgagtccatgtctcctttccagagatgaagaagtttctcttttctgtgcatgaagaagacaatgggatatggatgacactaaacctttgaaagttcctgctaacctccaagtggaaggaaagggcccacggtgatcaataaatgtgtttgctattttttgggtgaaag

SEQ ID NO: 204648 - DNA, 647 bp, Homo sapiens
ttttattgaattgtcagataatcatttcaactttatattgcctattgatcccttaattcatattttcttatttattcattcattgaattatttttcaaaagtaaatgtctgaaatatagcaaacttatgtttactatgttttagaaactgtgataggggttaataatagaacaaagaataaaacagatatggtgttccccataacaaaggctagattctgcctgtagagagacagtaaagaagtgatgacataaaaatcataaaattataattgttagaaatgtcataatgaaagcaatcgttgtatgctgttaaactatattatagggaaaaccaaatgtaaattaagtctggtaaattgggcagttttgagtcaaaactgtgatgggtgatgagacatttctgagatgaaggatcttagtcaatctagtgtagtataacagagaataaaattattaaaatattgggtaaaaagaattagggtagtgttaagtgtatgatcaggtggacagtcatatgaagaatacctgactgaaatattagattgatgcaaaagtaattgcagtttttgccatcaaaagagaaagaaatattaatagattccttgcagtcatcctaaatgaagagcagaatttagttatgtgaag

SEQ ID NO: 204649 - DNA, 334 bp, Homo sapiens
tacacctacaccatctacacctacaccatctgcacctatatccactgcacctacaccttctgcacctgcatcctctgcacctacaccatctgcacctacatccactgcacctataccctctgcacctacacaatctgcacctagatccactgcacctacaccctctgcacctacaccatctgcacctacatccactgcacctacaccttctgcacctacatcatctgcacctacatccactgcacctccaccttctgcacctacatccactgcacctacatcctctgcacctacaccatctgcacctacaccatctgcacctacatccactgca

SEQ ID NO: 204650 - DNA, 401 bp, Homo sapiens
tcagcctagaaatcacctttgaatcctctctgtgcttcagacttcacagagctctacccgcatgatatggtcagaatcatccacaactttccatctccactgctactgccctggtcccagtaaccttcacagcctgcctgaatctctgatatcccccaatcggtctttttgcttctcttgccaccctaccatctactctccatatggcagccagagccaccttttcaaaatatcaagagaccatgcataaaacactacaatggtttcccacacgtttggaataaaatggtcaccatatctcacttaatcttgcccctgcccacctctccaacctcatctccccttcactttctacctgacaatcacagcggcctcctcattcccactgcagggcttctccg

SEQ ID NO: 204651 - DNA, 3677 bp, Homo sapiens
tgaaaagccagtaaagaggccataatacaggccagaataatagtggtttggggcagggtggtggcctcgcaggcatcacgcatgctcagaggtgcaagtcagctccagggggactcacatgcacataggcccacacacacacgtggacaggcaggcgggtgctctcacacccacagcagcacagaaacaaggcacactcaggcagacccacccgtccacaccctctgagtcactccaggactgggaggaagatgtgtgagttaaggcctgaacaaagcacatctttccaccacaaggccctggcaactagtgtggctgggggtggctgggcttccccaggcccagcacagggagcagggagttttctctagatattccctggatctagtgtcctcccaggagtcagatcataaggctccatgcaccccccacctgaactggtctcccctcttcaccacccagcagctgtgagaccttgagctggttatttctcctctctgagcctcagtttccctgctgtagaatgggactcataactgcaacttcacagtatagtagtgaggcatccacaaagtaaacgtttcaagaatctggtctagggcaggagtccagcggagaagggaagaggaggtggtggagagcacaggctctggtacccaacagcctggccttgaatccacctcttgttttaagtgagtgacttgacctctctaaatttcacagtaatgagtagccagcatttatggggcacttactatgtactacttgctttgcaatcgttcaatgatcagtttcatctgtaagtgaggagcactgtaataactaccttatggggtcattctaagagattaaatgaggttctgctcataaagtgtttaacttcatgcctgactctgagtaaacactcaataaatggtgattgttattatcagccaaagcatatttgcttccttccagcatactagctctgttgcctttggttaagttatataaccttgctgtgcctcagtttcctatctgcagcttgggaggaataacagttctgaactcagagggtcgttgtgagtattgaacaagtcagaactcagaacactgcctggtacatagtaaatgctcaataaagtcacctattcattcatacgatggtttttcctctaattctcgcaggtaggcacggcccccaccaggcgccatggactggaagacactccaggccctactgagcggtgtgaacaagtactccacagcgttcgggcgcatctggctgtccgtggtgttcgtcttccgggtgctggtatacgtggtggctgcagagcgcgtgtggggggatgagcagaaggactttgactgcaacaccaagcagcccggctgcaccaacgtctgctacgacaactacttccccatctccaacatccgcctctgggccctgcagctcatcttcgtcacatgcccctcgctgctggtcatcctgcacgtggcctaccgtgaggagcgggagcgccggcaccgccagaaacacggggaccagtgcgccaagctgtacgacaacgcaggcaagaagcacggaggcctgtggtggacctacctgttcagcctcatcttcaagctcatcattgagttcctcttcctctacctgctgcacactctctggcatggcttcaatatgccgcgcctggtgcagtgtgccaacgtggccccctgccccaacatcgtggactgctacattgcccgacctaccgagaagaaaatcttcacctacttcatggtgggcgcctccgccgtctgcatcgtactcaccatctgtgagctctgctacctcatctgccacagggtcctgcgaggcctgcacaaggacaagcctcgagggggttgcagcccctcgtcctccgccagccgagcttccacctgccgctgccaccacaagctggtggaggctggggaggtggatccagacccaggcaataacaagctgcaggcttcagcacccaacctgacccccatctgaccacagggcaggggtggggcaacatgcgggctgccaatgggacatgcagggcggtgtggcaggtggagaggtcctacaggggctgagtgaccccactctgagttcactaagttatgcaactttcgttttggcagatattttttgacactgggaactgggctgtctagccgggtataggtaacccacaggcccagtgccagccctcaaaggacatagactttgaaacaagcgaattaactatctacgctgcctgcaaggggccacttagggcactgctagcagggcttcaaccaggaagggatcaacccaggaagggatgatcaggagaggcttccctgaggacataatgtgtaagagaggtgagaagtgctcccaagcagacacaacagcagcacagaggtctggaggccacacaaaaagtgatgctcgccctgggctagcctcagcagacctaaggcatctctactccctccagaggagccgcccagattcctgcagtggagaggaggtcttccagcagcagcaggtctggagggctgagaatgaacctgactagaggttctggagatacccagaggtcccccaggtcatcacttggctcagtggaagccctctttccccaaatcctactccctcagcctcaggcagtggtgctcccatcttcctccccacaactgtgctcaggctggtgccagcctttcagaccctgctcccagggacttgggtggatgcgctgatagaacatcctcaagacagtttccttgaaatcaataaatactgtgttttatacaggttggctctgtctctggttctcccacactcccacccactgacagaaccctgaaggtagggaaaggtaagccctcagaaagggaaagagttccatggctcggggtggagctagggtgggggctgtggctgtggctgcagctggggcttgagctggagctcggttaggctggggctgatgttgacagccgggagctgggtttgtaccagaggaggaggctggggtggaacctattgatacatatgttgggattctagctgtggccacaagagtgcgctgtgctccctctgcaacggtgcttccagccttcgtaattagacttcaccctgagtacacacacaatcactgccactctcactatagacaaaccacactccctcctctgtcacccagtcactgccatctcaacacacatccccaccctgtgtacacacaatctctgttattcatactctcactccttatgcgcactctcaacagggcatgtagtctgcactcaagcatgccatcccagcctcaccctgcattttattcggctcatcccattttccctgaacattttcgctgaactagggccctggcaggatgctgggactgtgcaaggaggtaggacctatgcccacggagctaagagacaggaacacaggctcatctcccgcactaaccaacccctgggatggctcacagcctgctcccagtgctgtgtcatgacctgaaatttaggggacaccaacacccaaggccagacccaaatggaaagcaaaagaggatgcaaggctatattaacccagtggaacacttagtgactatcacagccgaggccgggagtcagaaattcaggagccagtgagccaagcgccacagccagcaaagacaggtggg

SEQ ID NO: 204652 - DNA, 2218 bp, Homo sapiens
gaacttctttcctggcacaggactcactgtgccccttcccgctgtgggtacaaggtctgccccccaccccagctctccaaagcccaccggcctccctggaggccgaggtcgacggcccgtcgcaccgggagggggggctcccaggggtgccccacgcacggtcaaggtcccgcgccaagcggggaccgggctgggccggaagcgggcacggtactcgcggcaaactagcgtgggcgagtcctgattgcagtcggacctgccgccgcggcacttaacagtttgcagagtgcttcccgcccctgatctcattggagccttcggacagcccagcccatggccaccgatgcccccatttcacgcctgaggaagcggaggctcagacgggccaccagcccctccggaggctggcccgggagcgcctggcagcgtcgggtctaggagccggctccctcctgctccctcctccgcgccgcccggggtgtgcccgccgtctgtgtgcaccactgctgagcccagctccggcgccctcgcctctgctgtgggccccggggacgcggggtcaggccaccgcgttggccaggccgctgcaggtaggcacggcccccaccaggcgccatggactggaagacactccaggccctactgagcggtgtgaacaagtactccacagcgttcgggcgcatctggctgtccgtggtgttcgtcttccgggtgctggtatacgtggtggctgcagagcgcgtgtggggggatgagcagaaggactttgactgcaacaccaagcagcccggctgcaccaacgtctgctacgacaactacttccccatctccaacatccgcctctgggccctgcagctcatcttcgtcacatgcccctcgctgctggtcatcctgcacgtggcctaccgtgaggagcgggagcgccggcaccgccagaaacacggggaccagtgcgccaagctgtacgacaacgcaggcaagaagcacggaggcctgtggtggacctacctgttcagcctcatcttcaagctcatcattgagttcctcttcctctacctgctgcacactctctggcatggcttcaatatgccgcgcctggtgcagtgtgccaacgtggccccctgccccaacatcgtggactgctacattgcccgacctaccgagaagaaaatcttcacctacttcatggtgggcgcctccgccgtctgcatcgtactcaccatctgtgagctctgctacctcatctgccacagggtcctgcgaggcctgcacaaggacaagcctcgagggggttgcagcccctcgtcctccgccagccgagcttccacctgccgctgccaccacaagctggtggaggctggggaggtggatccagacccaggcaataacaagctgcaggcttcagcacccaacctgacccccatctgaccacagggcaggggtggggcaacatgcgggctgccaatgggacatgcagggcggtgtggcaggtggagaggtcctacaggggctgagtgaccccactctgagttcactaagttatgcaactttcgttttggcagatattttttgacactgggaactgggctgtctagccgggtataggtaacccacaggcccagtgccagccctcaaaggacatagactttgaaacaagcgaattaactatctacgctgcctgcaaggggccacttagggcactgctagcagggcttcaaccaggaagggatcaacccaggaagggatgatcaggagaggcttccctgaggacataatgtgtaagagaggtgagaagtgctcccaagcagacacaacagcagcacagaggtctggaggccacacaaaaagtgatgctcgccctgggctagcctcagcagacctaaggcatctctactccctccagaggagccgcccagattcctgcagtggagaggaggtcttccagcagcagcaggtctggagggctgagaatgaacctgactagaggttctggagatacccagaggtcccccaggtcatcacttggctcagtggaagccctctttccccaaatcctactccctcagcctcaggcagtggtgctcccatcttcctccccacaactgtgctcaggctggtgccagcctttcagaccctgctcccagggacttgggtggatgcgctgatagaacatcctcaagacagtttccttgaaatcaataaatactgtgttttatac

SEQ ID NO: 204653 - DNA, 1750 bp, Homo sapiens
gcaccctggtgggcagccatgggagtgtgtcaggtggaagcagccgtcagggtccctctctgctctctgtccggacagacagggctccaaccttcacttcagttcttgtgaactcccaccaggtaggcacggcccccaccaggcgccatggactggaagacactccaggccctactgagcggtgtgaacaagtactccacagcgttcgggcgcatctggctgtccgtggtgttcgtcttccgggtgctggtatacgtggtggctgcagagcgcgtgtggggggatgagcagaaggactttgactgcaacaccaagcagcccggctgcaccaacgtctgctacgacaactacttccccatctccaacatccgcctctgggccctgcagctcatcttcgtcacatgcccctcgctgctggtcatcctgcacgtggcctaccgtgaggagcgggagcgccggcaccgccagaaacacggggaccagtgcgccaagctgtacgacaacgcaggcaagaagcacggaggcctgtggtggacctacctgttcagcctcatcttcaagctcatcattgagttcctcttcctctacctgctgcacactctctggcatggcttcaatatgccgcgcctggtgcagtgtgccaacgtggccccctgccccaacatcgtggactgctacattgcccgacctaccgagaagaaaatcttcacctacttcatggtgggcgcctccgccgtctgcatcgtactcaccatctgtgagctctgctacctcatctgccacagggtcctgcgaggcctgcacaaggacaagcctcgagggggttgcagcccctcgtcctccgccagccgagcttccacctgccgctgccaccacaagctggtggaggctggggaggtggatccagacccaggcaataacaagctgcaggcttcagcacccaacctgacccccatctgaccacagggcaggggtggggcaacatgcgggctgccaatgggacatgcagggcggtgtggcaggtggagaggtcctacaggggctgagtgaccccactctgagttcactaagttatgcaactttcgttttggcagatattttttgacactgggaactgggctgtctagccgggtataggtaacccacaggcccagtgccagccctcaaaggacatagactttgaaacaagcgaattaactatctacgctgcctgcaaggggccacttagggcactgctagcagggcttcaaccaggaagggatcaacccaggaagggatgatcaggagaggcttccctgaggacataatgtgtaagagaggtgagaagtgctcccaagcagacacaacagcagcacagaggtctggaggccacacaaaaagtgatgctcgccctgggctagcctcagcagacctaaggcatctctactccctccagaggagccgcccagattcctgcagtggagaggaggtcttccagcagcagcaggtctggagggctgagaatgaacctgactagaggttctggagatacccagaggtcccccaggtcatcacttggctcagtggaagccctctttccccaaatcctactccctcagcctcaggcagtggtgctcccatcttcctccccacaactgtgctcaggctggtgccagcctttcagaccctgctcccagggacttgggtggatgcgctgatagaacatcctcaagacagtttccttgaaatcaataaatactgtgttttatac

SEQ ID NO: 204654 - DNA, 1466 bp, Homo sapiens
atcattttcttcttccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctctcctcatgctgccacccccagactgtcacgtgcaccgacgcggccctcgaggacctgctcttctgttcagcctcatcttcaagctcatcattgagttcctcttcctctacctgctgcacactctctggcatggcttcaatatgccgcgcctggtgcagtgtgccaacgtggccccctgccccaacatcgtggactgctacattgcccgacctaccgagaagaaaatcttcacctacttcatggtgggcgcctccgccgtctgcatcgtactcaccatctgtgagctctgctacctcatctgccacagggtcctgcgaggcctgcacaaggacaagcctcgagggggttgcagcccctcgtcctccgccagccgagcttccacctgccgctgccaccacaagctggtggaggctggggaggtggatccagacccaggcaataacaagctgcaggcttcagcacccaacctgacccccatctgaccacagggcaggggtggggcaacatgcgggctgccaatgggacatgcagggcggtgtggcaggtggagaggtcctacaggggctgagtgaccccactctgagttcactaagttatgcaactttcgttttggcagatattttttgacactgggaactgggctgtctagccgggtataggtaacccacaggcccagtgccagccctcaaaggacatagactttgaaacaagcgaattaactatctacgctgcctgcaaggggccacttagggcactgctagcagggcttcaaccaggaagggatcaacccaggaagggatgatcaggagaggcttccctgaggacataatgtgtaagagaggtgagaagtgctcccaagcagacacaacagcagcacagaggtctggaggccacacaaaaagtgatgctcgccctgggctagcctcagcagacctaaggcatctctactccctccagaggagccgcccagattcctgcagtggagaggaggtcttccagcagcagcaggtctggagggctgagaatgaacctgactagaggttctggagatacccagaggtcccccaggtcatcacttggctcagtggaagccctctttccccaaatcctactccctcagcctcaggcagtggtgctcccatcttcctccccacaactgtgctcaggctggtgccagcctttcagaccctgctcccagggacttgggtggatgcgctgatagaacatcctcaagacagtttccttgaaatcaataaatactgtgttttatac

SEQ ID NO: 204655 - DNA, 3045 bp, Homo sapiens
gaacttctttcctggcacaggactcactgtgccccttcccgctgtgggtacaaggtctgccccccaccccagctctccaaagcccaccggcctccctggaggccgaggtcgacggcccgtcgcaccgggagggggggctcccaggggtgccccacgcacggtcaaggtcccgcgccaagcggggaccgggctgggccggaagcgggcacggtactcgcggcaaactagcgtgggcgagtcctgattgcagtcggacctgccgccgcggcacttaacagtttgcagagtgcttcccgcccctgatctcattggagccttcggacagcccagcccatggccaccgatgcccccatttcacgcctgaggaagcggaggctcagacgggccaccagcccctccggaggctggcccgggagcgcctggcagcgtcgggtctaggagccggctccctcctgctccctcctccgcgccgcccggggtgtgcccgccgtctgtgtgcaccactgctgagcccagctccggcgccctcgcctctgctgtgggccccggggacgcggggtcaggccaccgcgttggccaggccgctgcaggtaggcacggcccccaccaggcgccatggactggaagacactccaggccctactgagcggtgtgaacaagtactccacagcgttcgggcgcatctggctgtccgtggtgttcgtcttccgggtgctggtatacgtggtggctgcagagcgcgtgtggggggatgagcagaaggactttgactgcaacaccaagcagcccggctgcaccaacgtctgctacgacaactacttccccatctccaacatccgcctctgggccctgcagctcatcttcgtcacatgcccctcgctgctggtcatcctgcacgtggcctaccgtgaggagcgggagcgccggcaccgccagaaacacggggaccagtgcgccaagctgtacgacaacgcaggcaagaagcacggaggcctgtggtggacctacctgttcagcctcatcttcaagctcatcattgagttcctcttcctctacctgctgcacactctctggcatggcttcaatatgccgcgcctggtgcagtgtgccaacgtggccccctgccccaacatcgtggactgctacattgcccgacctaccgagaagaaaatcttcacctacttcatggtgggcgcctccgccgtctgcatcgtactcaccatctgtgagctctgctacctcatctgccacagggtcctgcgaggcctgcacaaggacaagcctcgagggggttgcagcccctcgtcctccgccagccgagcttccacctgccgctgccaccacaagctggtggaggctggggaggtggatccagacccaggcaataacaagctgcaggcttcagcacccaacctgacccccatctgaccacagggcaggggtggggcaacatgcgggctgccaatgggacatgcagggcggtgtggcaggtggagaggtcctacaggggctgagtgaccccactctgagttcactaagttatgcaactttcgttttggcagatattttttgacactgggaactgggctgtctagccgggtataggtaacccacaggcccagtgccagccctcaaaggacatagactttgaaacaagcgaattaactatctacgctgcctgcaaggggccacttagggcactgctagcagggcttcaaccaggaagggatcaacccaggaagggatgatcaggagaggcttccctgaggacataatgtgtaagagaggtgagaagtgctcccaagcagacacaacagcacagacctaaggcatctctactccctccagaggagccgcccagattcctgcagtggagaggaggtcttccagcagcagcaggtctggagggctgagaatgaacctgactagaggttctggagatacccagaggtcccccaggtcatcacttggctcagtggaagccctctttccccaaatcctactccctcagcctcaggcagtggtgctcccatcttcctccccacaactgtgctcaggctggtgccagcctttcagaccctgctcccagggacttgggtggatgcgctgatagaacatcctcaagacagtttccttgaaatcaataaatactgtgttttatacaggttggctctgtctctggttctcccacactcccacccactgacagaaccctgaaggtagggaaaggtaagccctcagaaagggaaagagttccatggctcggggtggagctagggtgggggctgtggctgtggctgcagctggggcttgagctggagctcggttaggctggggctgatgttgacagccgggagctgggtttgtaccagaggaggaggctggggtggaacctattgatacatatgttgggattctagctgtggccacaagagtgcgctgtgctccctctgcaacggtgcttccagccttcgtaattagacttcaccctgagtacacacacaatcactgccactctcactatagacaaaccacactccctcctctgtcacccagtcactgccatctcaacacacatccccaccctgtgtacacacaatctctgttattcatactctcactccttatgcgcactctcaacagggcatgtagtctgcactcaagcatgccatcccagcctcaccctgcattttattcggctcatcccattttccctgaacattttcgctgaactagggccctggcaggatgctgggactgtgcaaggaggtaggacctatgcccacggagctaagagacaggaacacaggctcatctcccgcactaaccaacccctgggatggctcacagcctgctcccagtgctgtgtcatgacctgaaatttaggggacaccaacacccaaggccagacccaaatggaaagcaaaagaggatgcaaggctatattaacccagtggaacacttagtgactatcacagccgaggccgggagtcagaaattcaggagccagtgagccaagcgccacagccagcaaagacaggtggg

SEQ ID NO: 204656 - DNA, 1059 bp, Homo sapiens
gaacttctttcctggcacaggactcactgtgccccttcccgctgtgggtacaaggtctgccccccaccccagctctccaaagcccaccggcctccctggaggccgaggtcgacggcccgtcgcaccgggagggggggctcccaggggtgccccacgcacggtcaaggtcccgcgccaagcggggaccgggctgggccggaagcgggcacggtactcgcggcaaactagcgtgggcgagtcctgattgcagtcggacctgccgccgcggcacttaacagtttgcagagtgcttcccgcccctgatctcattggagccttcggacagcccagcccatggccaccgatgcccccatttcacgcctgaggaagcggaggctcagacgggccaccagcccctccggaggctggcccgggagcgcctggcagcgtcgggtctaggagccggctccctcctgctccctcctccgcgccgcccggggtgtgcccgccgtctgtgtgcaccactgctgagcccagctccggcgccctcgcctctgctgtgggccccggggacgcggggtcaggccaccgcgttggccaggccgctgcaggtaggcacggcccccaccaggcgccatggactggaagacactccaggccctactgagcggtgtgaacaagtactccacagcgttcgggcgcatctggctgtccgtggtgttcgtcttccgggtgctggtatacgtggtggctgcagagcgcgtgtggggggatgagcagaaggactttgactgcaacaccaagcagcccggctgcaccaacgtctgctacgacaactacttccccatctccaacatccgcctctgggccctgcagctcatcttcgtcacatgcccctcgctgctggtcatcctgcacgtggcctcagcctcaggcagtggtgctcccatcttcctccccacaactgtgctcaggctggtgccagcctttcagaccctgctcccagggacttgggtggatgcgctgatagaacatcctcaagacagtttccttgaaatcaataaatactgtgttttatac

SEQ ID NO: 204657 - DNA, 469 bp, Homo sapiens
ggtttctgtcaaataataaccactggcgtatttcctgctccttcctatagtctttagaagacccaacttacaactatgtctatgaggaactctggtaggactatacataataggaaaacataacatttttttcttgataacaggaacatctggctatgctgaacataagagattcaaaacagaggagatttgcaaattatagcttcccttagggcttagaagtgcttagataaaatttgattattccatactggcctgcaatttgactccaagatcccaggatcacatgccccaggcaaaagatttctaattcttctatgtaagacctatacttgctctatccattccgtatgtatccatccacccgtccatgcatgcacatgttaagcttgcattcaacagacatctttttttttttttttttgagatggagtctcgctctgtcacccaggctggagtgcagtggtgt

SEQ ID NO: 204658 - DNA, 481 bp, Homo sapiens
actgaggtcatgaactgaggagtgattcaaatagggtgaggcaggaaggcgctccgtcctgagcactaggctggcttctgccaggaaccagggtgagaaggagggtacagctcccagagccatgcttgcagcctgaccacccaccaaccaggcgagcgccaggggtggtgggaagcaggtgtgtcagagccagttataaccacaaccacagcaacagcggcggcggacatttattgggtggccactgcaggcctgttctgttttacatgcatttaaataatcacaacagcctcttaacccactctcttcacccttcggtgtctgtatgaccttgcgtgggtggctgagctgatgccttcctgggtgactgtgaagtgggtatgtgcacatgtgaaagtgatgggacatattcgtgtgtgagtccagtgcccagtagagtccgtggcacatagtacatcgtattaaatctttgaggaataag

SEQ ID NO: 204659 - DNA, 2089 bp, Homo sapiens
ctttcagctacagcacattctaattttttattttgtttagttcttttgtattcacttctggtctctttaagactgttttaaaagaaatcaatttagggaaccccagttatataatataaactttgtaatctgagagaaaaaatgtatagtaaatctaagtcttgatttttaactttctattgtaaaaaataataatatacagagtttaatagaaggtgatgttttggttttgttttcccagaggctgccatatggtctttgagtacggggatgtcccaaactggcccaccaatgagcatggcggctccggccaggaatgccagagttagcctcccaggcttgcgggtggacatgcctgctccctgccagcctccagtggcctggccaggccctcccgagcctgtctgccctccccaggggtggaggagtctctgggccccaggaggattccctcccggagactcgcacggtgctccctgctcacgcgttgtcacagttagtccggaaatgactgaaaccaggcattctcccggacctcagcgtgggggagcctccaggcagacgctgggtatggagctgtggtgtggtctgtcctgtatggtggccagtgctttctgccagcatttctggatggatatagggactatcattagtatcctaatacacggtgattttaaaacaaccataaaattgattcagagtccactgacccttacagatgtaggtatacccttactggagagggaactctgatgaggagatgctggtaaattatcattttttaaattgctggtgagtctgacacttggtgagttttcagccagtttgttaaacttttaattaagttttgtttataataaaaatataaatggatttgaaagtttccattttttaaagttaccctcgttttcaaaggtattttctaaacagatctttaatggactatttaaaccgaatttaaggaattcacacacgacagttgacaggtcttcacgcaggctggttggtaacgtgctgccagcacagggctgggtgatacgtacaccctaagccgggggtgcctggggctggggggcgctccttgcaatgcccctccagccacagggcagtgaggtgctgcctgtgtgagccgtcgggggagcggccggctgtgggggcagcgcagcaggagcatcgtggggcctttccttctcggctggttctctgtgacggtggcgtcggctcgcctctgctcctttcatctagaaagaagccactgaccctgacagcccacggcgggtacactgagcagctgcattggtgctgtcacttttttaaggctttctgtccagacttcaacactggtttcttttcagagtttcgaaggattaatgacttcctcagcgcccttgctggcgggctgagggtgacagtcacgtccgtttcttctgtattagaaggctgcggtgattcaattagattgtcccactgctgagacctgtagggcagcttctaacatgcttttttcaaggggagaggagtagtgacaagtcgtgtgtcggaattggatttgagaacactctgaatgacccctggaggccgagggggcaggcttcgggcgtgaactgaactccagacccctctttgtgttgggcagtgtcatcttgcttacaaactgtaagacacatttttttgtgtgtttgtttttgttgttgttcttttgcagcactcacgcctctgacagtcttttgggaaagagtaacacccacatacagaatttgtcacatccagagtagcactgttccttaatactggcataatgcttccaggaagtttttcttttttatatttaaaatgttacttttctgtatgatgtgcatgcaagtttaccgtaacttttcttaaactttttagtgccgtttctagtatattcctgtaaatgtcagttactgaaaatgagtccaatgtaagtagtttagcttgtttattgcaatgctggcctcaacacaacagaataaaaatggtagaaagtactctttgatgtttctggtaatcatggacccttctcctggggcatttgttttgttttcataataaaaagcaaaaaaaa

SEQ ID NO: 204660 - DNA, 1864 bp, Homo sapiens
ctttcagctacagcacattctaattttttattttgtttagttcttttgtattcacttctggtctctttaagactgttttaaaagaaatcaatttagggaaccccagttatataatataaactttgtaatctgagagaaaaaatgtatagtaaatctaagtcttgatttttaactttctattgtaaaaaataataatatacagagtttaatagaaggtgatgttttggttttgttttcccagaggctgccatatggtctttgagtacggggatgtcccaaactggcccaccaatgagcatggcggctccggccaggaatgccagagttagcctcccaggcttgcgggtggacatgcctgctccctgccagcctccagtggcctggccaggccctcccgagcctgtctgccctccccaggggtggaggagtctctgggccccaggaggattccctcccggagactcgcacggtgctccctgctcacgcgttgtcacagttagtccggaaatgactgaaaccaggcattctcccggacctcagcgtgggggagcctccaggcagacgctgggtatggagctgtggtgtggtctgtcctgtatggtggccagtgctttctgccagcatttctggatggatatagggactatcattagtatcctaatacacggtgattttaaaacaaccataaaattgattcagagtccactgacccttacagatgtaggtatacccttactggagagggaactctgatgaggagatgctggtaaattatcattttttaaattgctggtgagtctgacacttggtgagttttcagccagtttgttaaacttttaattaagttttgtttataataaaaatataaatggatttgaaagtttccattttttaaagttaccctcgttttcaaaggtattttctaaacagatctttaatggactatttaaaccgaatttaaggaattcacacacgacagttgacaggtcttcacgcaggctggttggtaacgtgctgccagcacagggctgggtgatacgtacaccctaagccgggggtgcctggggctggggggcgctccttgcaatgcccctccagccacagggcagtgaggtgctgcctgtgtgagccgtcgggggagcggccggctgtgggggcagcgcagcaggagcatcgtggggcctttccttctcggctggttctctgtgacggtggcgtcggctcgcctctgctcctttcatctagaaagaagccactgaccctgacagcccacggcgggtacactgagcagctgcattggtgctgtcacttttttaaggctttctgtccagacttcaacactggtttcttttcagagtttcgaaggattaatgacttcctcagcgcccttgctggcgggctgagggtgacagtcacgtccgtttcttctgtattagaaggctgcggtgattcaattagattgtcccactgctgagacctgtagggcagcttctaacatgcttttttcaaggggagaggagtagtgacaagtcgtgtgtcggaattggatttgagaacactctgaatgacccctggaggccgagggggcaggcttcgggcgtgaactgaactccagacccctctttgtgttgggcagtgtcatcttgcttacaaactgtaagacacattttggtgttggtttgggtggtctttgagattcagcttgaggttgggaagaagaaacactttagaatggaatccagtcgtctaaatgatagaccgaaggtttttttaaaggatcgaaggggagcgaattaaaagggagaatgaaggagaagagaagttatgcgaaagtttttcgggttagagaggagggtgtatttga

SEQ ID NO: 204661 - DNA, 437 bp, Homo sapiens
tctttggggttctgcagttcctgcatctccaagtttctgggcgccactgcattccctgatacccacagtggaagctgtttgcagtcggccttgtccagctgcagcctcacagggagctggcacctgtgccggtgcctggagctgcccaccccactgcagctggcatgcttgactgtgtgcagtggccagatcccatgcttgcttgctcacacacccttcactgctctgtacccagctcacccttggcaagtgtgggatccaaaccactagcatgagccgagtggacagaacgaacccagtgggcccgagcaaaacacaggtaaaggcaccaccagccagaggtttcaggcagaaaagtgatgtctcaggattctgtaacacttgtgccctttgacctctcagagcagctggggatcatgataaattctctctcggat

SEQ ID NO: 204662 - DNA, 521 bp, Homo sapiens
tggaagaacattctatgctcatacgtcagaagaattaatatcattaaaatgaccatattacacaaagaaatctacagattcagtgcaattcctatcaaaataccaacatcattttcacagtattataaaaaattaaaatttatatggaaccaaaaaagaaccctaataactaaagtgttcctgagcaaaaataaaaaagctagaatagtgcattacctcacttcggtaatattatgaggcgacagtaagcaaaacaacatggttctggtaaaaaaacagatgcataggtcaatggtacagaatagagaacccagaaataaagccacataaatacagccaagtgatctttgacaaaggcagcaataatatacattgtggaagtgaatcacttttcaataaatggtgctgggaaaattggatagtcatatataaaagaatgaaactagactactttattttgtcatatacaaaaatcaactgagaattaattaaaaacctaaacagaagaccccaaattatta

SEQ ID NO: 204663 - DNA, 519 bp, Homo sapiens
gaactgacacagaatatatttcaattggaaaactctctactttgagaattatatgaggaatcaatttcctgctttaaaaatgctgcaaattctgcattaagtaattaacagttaagagtcacacagctagtaaatgagagacacaggattcagacctaagcctgttctactcagaaatcaatgtactttccacacagaaaaatgtgtcttaggtgttttccaactgctggttttggcctatgaaatcaatttaatagactgcaagcagaatgttttaataaaacaaagctgaattgagaagatcccctacacacaaaggtaagcaaaataacaaattcatataaaaaagcctaaaagaaatgagcaaaaacatagaaaaattcaaattaaaaggaaagcaagggtctttattgcaaggagagcaatatttacattttaaatctctgaaaagcaagattcaaaaagaagagtgctttttaagagtcagggttccactttgtcacccaggctgaagtacag

SEQ ID NO: 204664 - DNA, 485 bp, Homo sapiens
tcttatattctgtcccctaagagacgaatagaaatataggtcaaactaggggaatacaagcccaaatgtctctctaaataaacttttctttgacttctctgagaaaagttgatttggagggatattctcctctttgacactgttttctccaacactctaattaagtaaggtcaaaaactgtctcttattggtcccttaattccaagttcccagtacagtggtttgtacagtgagtacagaatcttttaagtagtgcacatgtaagatgtgatgtggattaaaactctgatgctctaccacatgattcttaaaacccaaaagttctcaacttagcagaaagccagatataggacaatataatattttctaagctttttagtgtttaaagtatttacaactcatttacctcaaattacattcagtggagattccccagaccaaattttagagggtcagggtcagatgggaaggggacagatagattt

SEQ ID NO: 204665 - DNA, 359 bp, Homo sapiens
cagcttctcagtcagtatcagttgggtggtcaactccaggggacactattcatgttatatttaactggaagaatttgccattcacagaaaaggcaatgtgaatgctgctccccagagcaccattcacagaaaatgcaatgtgaatggtgcctcctggagattttgccttgcttagcaaggtgctagagctaaggactcagaaatgtttgttaagtgagtgaatggaatcccaggctacttcttactcattccaacccccaggacgaaaaagaaaagttgacaaggggtgaggagagtgggggaggagaaagggtgatccttagctacaaggcttctatgagattgggtgtgggtcggtg

SEQ ID NO: 204666 - DNA, 594 bp, Homo sapiens
attatacaagtagtaaggataattaaaggtggaagagccttttcagttatggtattgacaaaggcttagtcaaagaaggatgaataggattttgaaactgaaattattctagttagagggggaaagtgtggaagttgaaatgccaagattagttgaggaagcaatctagatctggcgggattatccatatttagtaagggaggaggggtgtctagttgaagacagacgaagatgttaatacagtcacactgtaggtactttcgatgccaagaggctttggtgtttttcctttatgcagtggggttttgaacagggaaaataatgtagtaataaccttgaaaccttaatctagtttcagtatgcaggatggatctgaggaggaaatgtgcgtggcaaccggctccgggatggctggctggggggcctagtcttctgcccgccgatctccctcgggaagtcccggatcagagcagcaggcccatcccccaactgttacaccctgctggcagcagcagaggcacagggatgagttaggaaacagatacagaggtcaagaggtgatgtttattaagttatatatttttttcttgtttt

SEQ ID NO: 204667 - DNA, 421 bp, Homo sapiens
agcagcaaagctgagaaaatggtttcctttggatgactgatcagagtttctacagctaatagcaagagctgtctgaactggactgaataagcagccatgggagtttttgggaacatctggagagagaatgctaatcctagttaatgtttgtgcagcaatttactcctctaagggctttacttatgttaacttgtgttatcattagaataccagaaacaagagtagggaatgttttccattttatagaagagaacccaaaatacagaaacttgtgacttgcccaaagtcctctacctagtaaggggcagaagtccgatttaaacccacgtagtctggctctagaatctgcattcttaactcactgtgctatggtgcctctccaatgtgagagatgggggcttggaaatatattaacttaaat

SEQ ID NO: 204668 - DNA, 413 bp, Homo sapiens
tctctgctgcaagttcaccatgaacatacttgtggaagggctgagaatactgttagcttggcacaagctttcaccaggctttcagctttttggtaggctgcccattaggctgtgcagatgcccaggggagtgctgtggaggggtgtgtggtagaagcaggccctgtgtttgcctggaggaagagtgagataatgggtagaaatgctagaactgaagctctgtggctctgggctgagtccaggcctaaggcccgaggccagtacggtgtctgtatcgggtggccccttctcactgggagagccctagactctggttccttgcttgttgatggaggcacagcaagaataatcaaacacctgagaaacttggaagatgattattgaaaccagaattttttttcagaattctctgga

SEQ ID NO: 204669 - DNA, 402 bp, Homo sapiens
attgttttacttcttcaccaacacttgatatttgacagactttttaatgtttaacaatctggtatataaaatctattgtggttttactttgcatttccttgaaaattaatgacattgaggcatatgttcatatgtttattagtcatttgggtttattattgtgtgatatgcccattcaagactttcgcttatttctctagttgttttggggtccccaagaccactctcatgtttagaaattcactagaaggacttacaagacttagcaaataagtgtactcacagctaagatttattacagtgacatagtaagggcatagctggatcacaagggacaaagatagagagggagtctccaggaacctatatacaggcttccttatgctctctccctcctatcag

SEQ ID NO: 204670 - DNA, 477 bp, Homo sapiens
gtaccaagatttaatttagatttaatgtaagattagatttagatttacattttaaaatctcatttagatttaatgtaatcctattaaggtaggagtattatctaccattttacagaggaagaactgaaggattcgttatttaacttgtccactgttaatcagataatcaacagtgatttctggaatcaaacccatttctgtctagctttaaaacagagacctttaaccaccctgctaatttgtagttattccacttatggaggtttccatgtccagcttgctttaaaagcaccaaaggacttttcacactgcatgccctggccagggttggtgagcttgttgaaggccttaccagcctcctgagaccctcacactcacttttcagtgtctctggagccttgccgtggaggtagtgttcgtcttggcctttgactacctgggagaaaaaataaattatttccataaatacagtgatca

SEQ ID NO: 204671 - DNA, 398 bp, Homo sapiens
cacacacacacgtatttgtgtcatacagagactccgccttcggtaacatcccattctccatcactggcccagtgacaggagcagccattgattatagaaacaagtttctatacacttccacaaaaactgatttcatttctccccagcagccagcaaaggatgctggcggtgttgggtaggtgtggggtgtggggctgggctgcagccctcccctctgctgcaggacgctggagaacttgcccaggctctccagtccttctgcgtaaagccatggctgttgttttatcttcacatatttatgtctttttttttttaaccagaagaaaatgaagtaaggaaaatgcttattttaaaattgctggcattcgtggaagtgtatagaaacttgtttctataat

SEQ ID NO: 204672 - DNA, 195 bp, Homo sapiens
tctgacctctaacccactggagcctcaaggctcagccctcagaccctgcctctatctccctaactgcccgtgtacttaaataccatcaatatgctgcagatggtatttgtatatcaagcctgaacttccccagtcttcccctttactaggaacccagttgaattcccaggaaccctatccctgtgagttccctgg

SEQ ID NO: 204673 - DNA, 232 bp, Homo sapiens
atttctgttctgacatcctggacaaagtctctcattaataagtagatgcctacacacttacgtagtaaaagtataaaagcatgcatgggaaaaacacacaccaactgtaaaacagtggttagcttggtgagagatgagagagagagatgggttggtagtgttttgctgttttatttcttttagggtgatggatcaaatacccgcagatctgaatggtgggtacatgggtgtc

SEQ ID NO: 204674 - DNA, 125 bp, Homo sapiens
tttatttgccatttaatatcttcttgggcatggatgggattttcctttcaaatatctatcagacacttagctagctgggacatactgcagacgattctgtgaaagtcacatataaaatacaaaat

SEQ ID NO: 204675 - DNA, 489 bp, Homo sapiens
gccgtagagagcaaccagaatgggcagagcagagacttagagcccagaggactggaagacgctgccacagccgcacgcactctagcctgatgctacaggcagaacacgtgtgatggacttctcagagaaagccgaaatcagtattcacagcttctaacagtaaattgaacatgaaaaaactccactaactactgatcattggacctgattgcttgtggttctgggagagagaagagacatctgcacaggaattggagccaggccctgccgcatgcagccatcagcctcaatgtgacactatgagctttggctgggaataagacactacatcttggcttggggacacaaacctggagtactaccagagtaaggcaaccaacccaaaagctacttgacagggagaggagtctaccaaaaagaaacaaaacaaacaaattccctcccaaacaagacatcttctgtaaccagaagcactccaagaacaacact

SEQ ID NO: 204676 - DNA, 1170 bp, Homo sapiens
ccaggacccgatggcccccggcgccgtggccgcaagcccacgaaggcgaaacgtgatgggccaccccggccacgggggaggccccggatccgccccctggaggtcccgaccactgcggggcccgcctcggcctccacgcccaccgatggcgccaagaaaccccggggccggggccgaggccggggtcgaaaggctgaggaggcagggggcacccggttggagcccctgaagccacttaagatcaagctgtctgtgcccaaggctggcgagggtctgggaacctcatcgggtgatgccatatcaggcactgaccacaacagcctggactcgagcctgactcgggagaagatcgaggccaagattaaggaggtggaggagaagcagccggagatgaagtcgggtttcatggcctccttcttggacttcctcaagtcaggcaagcgccacccaccactctaccaggcgggcctgacgcctccgctcagccctcccaagagtgtgccaccctctgtgccagcccgaggcctgcagccccagccccctgccacccctgctgtgccacatcccccaccttccggagcctttgggcttgggggcgccctggaggctgcagagagtgagggtctggggcttggctgcccttcaccctgcaagcggcttgatgaggagctgaagcggaacctcgagacgctgccctccttctcctcggatgaggaagactctgtcgccaagaaccgagacctgcaggagagcatctcctccgccatctctgccctcgatgacccaccccttgctgggccaaaagacacttccaccccagatgggccgcccttggcccccgcggctgcagttccagggccaccccctcttccggggctccccagtgccaacagcaatggcactcccggtgagctctgggcaggtggtctgggagtagagcttaaaggttattatgatcactaggtaacagttgtgcaggttacgcactgtttaagagacaccattcacatacatggtgtaagcttgcgtgtttatgaagggactttcctgattacacaagcattttgaggaaggtctatctttttctaattcactcagaggtgctaagtggactaggaggggccccaaggcagacactggagaatgcagggagacagggcaggtgataag

SEQ ID NO: 204677 - DNA, 1127 bp, Homo sapiens
ccaggacccgatggcccccggcgccgtggccgcaagcccacgaaggcgaaacgtgatgggccaccccggccacgggggaggccccggatccgccccctggaggtcccgaccactgcggggcccgcctcggcctccacgcccaccgatggcgccaagaaaccccggggccggggccgaggccggggtcgaaaggctgaggaggcagggggcacccggttggagcccctgaagccacttaagatcaagctgtctgtgcccaaggctggcgagggtctgggaacctcatcgggtgatgccatatcaggcactgaccacaacagcctggactcgagcctgactcgggagaagatcgaggccaagattaaggaggtggaggagaagcagccggagatgaagtcgggtttcatggcctccttcttggacttcctcaagtcaggcaagcgccacccaccactctaccaggcgggcctgacgcctccgctcagccctcccaagagtgtgccaccctctgtgccagcccgaggcctgcagccccagccccctgccacccctgctgtgccacatcccccaccttccggagcctttgggcttgggggcgccctggaggctgcagagagtgagggtctggggcttggctgcccttcaccctgcaagcggcttgatgaggagctgaagcggaacctcgagacgctgccctccttctcctcggatgaggaagactctgtcgccaagaaccgagacctgcaggagagcatctcctccgccatctctgccctcgatgacccaccccttgctgggccaaaagacacttccaccccagatgggccgcccttggcccccgcggctgcagttccagggccaccccctcttccggggctccccagtgccaagccaggccagtggctaactcccgagccccccgctgctggaggagaaaggcgcgcacagcagttgcacgtcctgaccagcgaatccctcgtgtcatcagaggtaacgcgtgatcgcccgataccgcacaacgcaggagaaccaccggactcacacaaggcaagaaaagcaaacccggcacggacccgggcagcggcagctaaaaaaggcggaaggaacagggaacagcggaaacagaa

SEQ ID NO: 204678 - DNA, 203 bp, Homo sapiens
gtagttcctctcttgaagcagtggagctgatgagacaatcataatctaggtgttattaatgtggagtcctttgtttaaaagttttgcagatgtcatagatttgtaaataaaacagcttgtgaatgtgtgtatatctttactgtttgaagatgaaaggttcataacttgaataagatctacagagagattttattaaaaattat

SEQ ID NO: 204679 - DNA, 245 bp, Homo sapiens
tttatttataatatatatattctaatatttggaaacaacttgaatgtctatgttaggttatgtaaatgctgatatgtgatataggacaatgggatattattcatgcaatagaaaaataagtataaaactttttaatggcataggaaaatgtatgttttatgctaaaggaaagaggctgtatataaatctaatggagtactttaaaaaataaaataaaaatatgtactaaaatggtaattgttatc

SEQ ID NO: 204680 - DNA, 544 bp, Homo sapiens
gggactcagatatcttgacacctatgtctgaagcagttttattcacagtagccaaaaggcggagccatcccaggtgctcatccatgaataaacggatgaacacagcgtggtccctgcaggctggaatacaatccattcttaaaaaggaaggaaatcctgatgatgcacgcagctgaaggacattatgctaagtgaaataaactgtcaccaaaggacaagtacggcatgcttccacttggatgaggtgtcttagagtagtcaaaagcagagagacagaaggcagaatggtgggtgccgaggacggggctggggaagtgtggagttgccgctccatggggacagtttgtctgggaagatgaaaaggttcttcacgtggatggtggaggaggctgcacggcgatatggaggtgctgagtccccgtgagccgtacagtcaacagtgggtaaaatggtagcttttatgtttatttttaccatgataacaaaactaaattgccacttcacatattccaatcagaagatgacctcttacaagaggaaatga

SEQ ID NO: 204681 - DNA, 197 bp, Homo sapiens
tgactttttcttgacccctcaatcatctgccctgacaaactccagtcctattattaccttcacttccacactttgctgatgaggccctctgtaaattcattttacagaagtcttgctcttgttcagcaatcctttcatctacatattgttgcctctctgtggaattcgctaatgtaggtattctacaaccattcttc

SEQ ID NO: 204682 - DNA, 940 bp, Homo sapiens
  misc_feature (15)..(15): n is a, c, g, or t
  misc_feature (28)..(29): n is a, c, g, or t
  misc_feature (34)..(34): n is a, c, g, or t
  misc_feature (46)..(46): n is a, c, g, or t
gatctacgaccgaanacagtggtggcannatctnaaggccagcaanagcagcaccagagaaagctcaaagtaaaaaaatccctgggagggatttttccttcccttaggaagtagctgacctgaagcgttaacctcagttccagattggagcagggcccttccaggctgtcagatgcccgtccagctccttggctctggaagaccacatgggacagacagggccctgcacagaaggggaaggtcacctctccaagggaggcagagaaaatagtacccgaagacagtggtggccaaaatctgaaggccagcaacaagcagcaccagagaaagctcaaagtaaaaaaatccctgggagggatttttccttcccttaggaagtagctgacctgaagcgttaacctcagttccagattggagcagggcccttccaggctgtcagatgcccgtccagctccttggctctgaaagaatgggaaatggcaggcgctggctcctgactgacttttctcctggaaaatatttagccgggccccagccccagaggcatctgtgggagtcaggagcctagactgggcacatgggcagttcctggttgcttttataagcatgctaccgccagaggagccactgtgataacaattccaaacaagaggatattttaacaatcaacatcactgagcaatgtgttaatatctccaagggacatgcaatagaattattttcaggatcttccagtttggctctgatgtcagaggagaaaatgcatggtgtccagttctgtgcttcctttgtccatccctcccaccagactgtaagctccatgaaggcagaaaccatgtctaactagtcaccctcatgaccgcagcacctgctgtcacaccagacacttagtcagtgtgcaataaatacacagaggaaagaggaagtggggaaggggcaa

SEQ ID NO: 204683 - DNA, 529 bp, Homo sapiens
  misc_feature (15)..(15): n is a, c, g, or t
  misc_feature (28)..(29): n is a, c, g, or t
  misc_feature (34)..(34): n is a, c, g, or t
  misc_feature (46)..(46): n is a, c, g, or t
  misc_feature (458)..(458): n is a, c, g, or t
  misc_feature (483)..(484): n is a, c, g, or t
  misc_feature (492)..(492): n is a, c, g, or t
gatctacgaccgaanacagtggtggcannatctnaaggccagcaanagcagcaccagagaaagctcaaagtaaaaaaatccctgggagggatttttccttcccttaggaagtagctgacctgaagcgttaacctcagttccagattggagcagggcccttccaggctgtcagatgcccgtccagctccttggctctggaagaccacatgggacagacagggccctgcacagaaggggaaggtcacctctccaagggaggcagagaaaatagtacccgaagacagtggtggccaaaatctgaaggccagcaacaagcagcaccagagaaagctcaaagtaaaaaaatccctgggagggatttttccttcccttaggaagtagctgacctgaagcgttaacctcagttccagattggagcagggcccttccaggctgtcagatgcggtcttcgggtcgtntaaacgacccgaagacatttatttnnaaaatcanttctcaatggaggagagattgtatccatagaacgtca

SEQ ID NO: 204684 - DNA, 393 bp, Homo sapiens
gagtaaagagacgagagagatgaatagtaaacttaaaggagttctgacatacaaaacttaaacctttgcaaagttcactccttcaataactactttttaaatacatacgacatttcacacactgtgcttaggccctgatttttcagagtttgaataaagcacatatgagccctcacctcacagaactgaaatctaccggaaaacacagtaaatagcacaaaaagtgtacggaaagttgcaataaataagtactagaggaaaagacacatatctccaagggaacacgaacttaggagggaccacagatggaacggtcatgaaagtctccaaggcatgacatcaaagctgacgacagaaggaagaactcgcaccttggccaggcacagtggctca

SEQ ID NO: 204685 - DNA, 374 bp, Homo sapiens
tgctttggcacagtctgaacttgacctcagagaacaatgtcagaggcctcttaccctccacccctgatctcttacttccccatgtccctttaagttttccgtagatcttgccttcctcctgcatcctagcttgctactgccttgctatatggcctgctgctcagtgatggcccacctatacaccctaacgtctgcaggggccaatttcagcagacatcatgtgcctgcattgtaaactgcactgctgatggtccctactgaaatttctcctaaaaactagccacactcatgaaagctgcaaaatatatgacagtttccatttggaatttctaaggaacttggaaaaccaagatttcttcaagacaaaggatcca

SEQ ID NO: 204686 - DNA, 367 bp, Homo sapiens
caaaaaacaaaacaaaattgtaaaaagccccactacacatagactgtaagatacttaaactccgtataaaggctgagaaaagcaacacttttaagtttgtccaggccgatttcaaaaattcttcagcgccaacaatatatagacaggtattccctccttaagtatcaagaacaaaatcaagaacttttaaccatcaacatgaaaggtagagtcagacagaccatctgcctaattttaaggaatgtagttatcacttaaataacatacaaagccaaatcagttcatgccattgcttctcagacctgtaatagctcatacaccaaaaacttgtacttcttgctcataagctttaaagtagaaagaattt

SEQ ID NO: 204687 - DNA, 449 bp, Homo sapiens
cacctccttataaaatgatctatatattggttccctagcatcctacaaaggtaatatatgagcccatgggttggatttgtttaaatctattacagtatctttccccctctttggtcagagtaagcccctctgggtcagcttctgtgtccctctgacaggaccctcattggtttctctggtaattttttttatagatatttgtaggcaataactccattgtctttgatagctgccttgctttctgataagaaaaaagtgtttcaggcttacatcatttgtttcctgccccagacatagagtcagctatttctctaaggagccatatttcattttagtgggaaataatatttagaaataacaatctgagtggtaaggatgttcattgctactgcattgaccgttgtttgtagtcttattcctcggagacagctgaaacctttcctcccctt

SEQ ID NO: 204688 - DNA, 705 bp, Homo sapiens
ggcctgggtgtgggctgggcattcccctggggtaggatgcagggctccagaaagagagggtgagtggagggtaagaggtgactgggaaggaccgggaggaacaggaggaagtgagatgtggcagggccaggcctctgctggtcaagacagccttgaagccacggtgctacaactctggcagggtcagccctctggctatcccagaagagggcaggttgccacagagcctgggcaaatacccagctgccctctgaaccaggtgttccagggacacctccgaatactgcttacactgagacaatgagacaaaaagtgccagcagcttcctggctgggacacaccttcaggagtattagcctggagcagaggctgaacccatcctaacagcttgcccatgtccccagccccgggctaccgggcaagtgctcacatcccctggggacaggtggatggcacacagggtcatggcggagggctgctcactgggtccagagccagggtctgggaagagggagggagatgcaggaatctgacaggcttgagcctcacagggcccagggctctggcttctctcagatccagctctgggcaatgtttcagttcaacactctccctgggaggctgtgtagcctggggctcagggctttggtggcgtcctgtctgcagaaaagccccactccccactaagagacaactccccatacc

SEQ ID NO: 204689 - DNA, 382 bp, Homo sapiens
tctgccctggccaagacttctgtggcaatgtcagatgccagtggaggctgctggcaggcgtggacgtctcagatgtctgatccttcaggagccccctccacggggccctggctaggcagtgaccaggatgtttctgaatccccttaagttaatggtggccacttaggcagcggaagtgtcatgaaagactcttctgtccccatggctgggccaaaccagggaagacgctgacatcaagcacaattgagaacaagcagcagtaggcaatgttctggggctattaattcatcctgggggaaaaaacctcacagtggattaaattggtttatgtaaagtgctgagaagagcccagcctgggcaacatgatgaaatcttgtatcta

SEQ ID NO: 204690 - DNA, 565 bp, Homo sapiens
agtgccttgagccttattgtggaaaaggaaatatcttcacataaaaactaagcagaagcattctgacaaacttctttgagttgtatgcattcatctcacggagttgcacatttctttagattgagcagctttgatacactctttttggagaatctgtcagtggacatttggagcactttgaaggctatagaagaaaagaaaatatcttcacataaaaacgagacagaagcattctgacaaacttctttgtgatgtgtgcattaatctcacagagttgaaccttacttttcattgatcagttttgaaacactgtttttgtagaatctgtaagcggacatttggagcaattggaggcctatggtggaaaaggaaatatcttcatataaaaagtagacaaaaggcacagcaccgccgcaggcaccgggaggtgcagagcaccgccccaggcgctgggaggcacacagcaccaccacaggcccagtctccactccccagctgtgaaaggatcactgactgaacccccaaggtagcccaccaggcctccatagagctgcccagcatggcc

SEQ ID NO: 204691 - DNA, 381 bp, Homo sapiens
aaatgaacaaatctgtagctagaccaaagatgaaaaacagagaaaacacatataaaatcagaataaaaaagacattatcaccaatgttataggaaaataaaagaattagaaaggaataccatcaaaagcagtatgccaattagataccttatacaaaatgtttgtttttaggaagacacaaacaaccaaatctgacacaagaaaaaaaacctgaatacttacaaaaacagaattgaaggccgagcacggtgcctcgagcctgtaatcccagccaacaatgggaaatattttcaaactgctaaagtaaaaagaatgccaactgcatattctgtatctagcaaaactatccttcacaaacaaaagagaaattatggcatttgc

SEQ ID NO: 204692 - DNA, 281 bp, Homo sapiens
gagctatgaagccaggtacagaatgcaatgcagatttcgatttctagggtaaagaataggagagatgcactgaacgcttactgcgtgccagcactgggccacgtgctgcacatgtgtctcttgccttctcattctcatgaaataagcagcactacaaccgcttaattgcaggtgaggaatgtgagacaccaagcggccaggatcctcatttcatttcagttggattagaaatatttatggagtacctactatgtgccatgctctgttgtaggcccttggaa

SEQ ID NO: 204693 - DNA, 296 bp, Homo sapiens
tataaaagttaggttgacaccgtactgtagtctattaggtgtggaatagcattatgtctaaaagacaatgtacataacttcattaaacatagtttattgctattatatgctgcataattttattacaacatattttatggctaaaaatgcttatgatcatctgattatctattatgaccttcagcaagtcataatcttaaactttttgctggtgaagggtcttgcttcaatgttgaggctgctggctgctaagtaagggtagtggttgctaaaggttgaggtggctatggtaattt

SEQ ID NO: 204694 - DNA, 270 bp, Homo sapiens
aggaaggttgtcgttataagaataatgggtctgaagtggtactccagctagtgtcttagcaaaaggaggggtgcttagggcagtctgaaatttatgagtgcttttgtatagctttcaaagctgagcttttcctgtgtacattagggtttatgaaatatcgtgggtcagagcatccgttacaggcgctgtgggagctgtcatagatacctggctctttccgtgggtgtaaaataggtttagtccttaggatgtctgtgtagggaatgtgct

SEQ ID NO: 204695 - DNA, 262 bp, Homo sapiens
taatttgttggcctaagattacacagctactaaatggcagagccaggatccggtttttcctttgtaccatgcttcctctagtaatattattaatatgtagcattaatatttattcatcatatattatgttaagaagttgtaaagcagacttgagtgtaattgttcaaatattcccatctagtccagttatcagtcttactctctgataaatacatatacagttactaaacttctgagatttatgtacatatgagtagcctaa

SEQ ID NO: 204696 - DNA, 581 bp, Homo sapiens
gaaagggttaatgagacaagcatctgcttctgcttcctgggagaatgatcccacttggtaaggtggcgttcccagggctacctggtgcccaccccatctggctgctcaggtctctttgtggtggccgtttcatcatggtgcagagaagctctcacccagggccctgttgtgttgtcagaagcttccggggtctgtctgttgatggttagcgcctgcgtggtgccagccgtgctggcccactgaggccattctcgctctctgtgggtctctgggatattttctgccacagccctgggcgctcctggaactgcgtgttgaacaccatgtccttactctgtgaggggcaggcctaggtgaggacagggtaggtgagaatccctgtgaggtgggaaaacagtaaagaacattttgaaaatagaattttccaggcaaggattgtaacaaaaagacctaagaaacgtagtatttgtcctcctgtgtttatcaccctttcggggccaattttaataacttcttgtttaatgttgcaaaactagatttcctaggaagattgttctgatgtatgagtgtggagcgttgct

SEQ ID NO: 204697 - DNA, 566 bp, Homo sapiens
cctaccctaactaatccatccaccactgtgacatgttcctgccctaccctaactaatccatccaccttgtgatatgttccttccctaccctaagtaatccatccaccttgtgatatgttcctgcccttccccaactaatccatccaccttgtgatatgttcctgcccttccccaactaatccatccaccttgtgacatgttcctgccctaccctaactaatccatccaccactgtgacatgttcctgccctaccctaactaatccatccgccttgtgatatgttccttccctaccctaattaatccatccaccttgtgatatgttcctgcccttccccaactaatccatccaccttgtgatatcgtgccttatgacttcccccaccttgtgactatgcaccttgtaacattcttcccctgcccaaaaaaactgcccctaactgtaactttccactacctaccccaaacctatagaaccagttccactcccaccacccttcgctgactcctttctctgactcagcccacttgcacccaagtgaataaacagccttgttgctccacta

SEQ ID NO: 204698 - DNA, 733 bp, Homo sapiens
gtgtttagatgcaggtcagtgggagttgggggaggaatctacttgctggagtagcatgcctagatttgctctccaaaggaacaaacaagatcccagtggaagaagaacaactaggggtaaaaaggctctaaacctgacatccttgggataaaagctaatggctggggagcttggcctggagaagagatgacttggaggtaggccaggttactgccttcaaagctgaggggctacgggggcaagcgaggaagcagatgtgctctgcgtgctccagagagcagtgctagaacaagtgggtgtgactggctgacctggaatctcagctctgcaactacctgtgtaaaactggcaaatctcttaaccttactgagcctcagtttctccatttatgcaattagaactgtaatactgacctcagcacattgctgtaaggatttaatgtgaagatgtacatcaagtgcctagcacatgtttggcacatgggagatgctcatgttaggctctttatgactctaaaatgaatactgagatgggtgagaaacataccggcaggggtagcttggagggaggagggaaacaagaataatttcagcttcgaacacaaacacaattctcttcgcttcctattttgggaattgctgcggaggccaggagggagggaaagattccgattttagcgcaacccgccttctcactgggtctgtgacttccaatactccaaccagcctctgga

SEQ ID NO: 204699 - DNA, 511 bp, Homo sapiens
atatttagttataagaaataactgcgtcccagggacagtgcaaggacagggcaggcagtgaggatatccaaaaactgtttgtgtctgtgaagatcatccatccaggctcctccttgtggctttgcaggttaaattcatgaatgttcaggcttattttcatcctgaaatgtaggtcctagagctcctgtgttggctggaacctcatttaagaccagtacagttggccgggcgcagtggctcatgcctgtaatcccagcactttgggaggctgaacaggtggatcatgaggtcaggagttcaagaccagcctgaccaacatggtaaaaccatgtgtctactaaaaatacaaaaattagctgggtgtggtggtgggcgcctgtaatcccggctcctcaggagcctgaggcaggagaatcgcttgaaccctggaggcggaggttgcagtgagccaagatcacaccactgtactccagcctgggtgacagagcgagactccgtctcaaagaaaaag

SEQ ID NO: 204700 - DNA, 1326 bp, Homo sapiens
cacctccaacacgagtcatttatttatgaaaagtgaataggatacaaattaaaagcttgggcgcaggagccagactgctgtgacttgaatcctggctcctccatttccaacttcccccagcctcagttgtctatctgtaaaatgggtctcatagtaggatctgccacacaggattgtgtattaaaagagataatcaatatcgagtatttggcacagtgcctggcacatggggctcccaacacatggtgttggtggtgttcctatttgttgtttttctcttgtagcaatgctgaatccagtctgctcccacttacagtttacatgatggaagaattagagacttgaacacagaaatgaattatccctgttaaccctaaccccagaacattgaggccacaggaaatacaaccgcagtgacctggacttctgcgttagtcatgatcagtacgtattaggtcacagctagtctacgctttatcacatggtggtgacattccagtttcatatgagagggctctcagttaagtaagtgcactaaaaatgcatactggaaaacacccgtgatctatctaaaacattgttccagtgccctcgtttttttgttttgctttgtttttttaaatcccagagagcaataccataaaatatttcattagacctttttattcaagatccatcttaaaaagttgaggctgtacctcaaatatcttttattttccttgctgacttgttacatgacccccactggcctgtgaatatatccaaagatttttctgtgttttaatctgaactcactttgaagctatttatatgtttggcatggtaacacaatggaggtaataaacaccatgcaggtctgactcagctttgaaagcagctttctgagtgacaccttcctcaggattccctgagctaactttatgggatctgaggtaagtaacttcatattcactccatagcacttacgatctcccaatcatttcctgcagatctagcctggaagctaaattttaaaactagctgtgaatttagaagatgattcataagctctgtgcataccatggttatgactggtggaaggcagagattcttacatcagtcttctttacattttaacagcaaggaaaataacaggttagaggagtacttggtatctaccctcccttgcttccggcaaattaatgaaagccaaataaattgcaacactttgatatctgtgtctctgtaacgttaaagacagccctgggctgcgagagatgaacgtggtagagcacctccgggccagcttcccagtggagcaatggtattggagaggtggacaacgtg

SEQ ID NO: 204701 - DNA, 688 bp, Homo sapiens
tatggatcacaacgtcggtgcgtgggtctgtctgggcaatggagaacatgctaatttaggacaaggacaaggataattagaaacgggttgaacgtttaagatgtcaacatcctatagaccgtccctctttggtggctgcaccttgggttcccgtgcatatccaggacacgctctgcccctggtttactctttagaggggagttcctctcaaccacgttttgtcttctactctgctctttggagctgctttgactatatccggagctcataagctgtagtcttttcaccaaatgtcaacccgtttttcatgttgagttttagaagcagaaagactaggtggccttctgaagttttgccacagggtgcttgtttaacaaggatcatatctgaagggctgtcagtcccaatgacgctgaatgaattcttagcttcgttgtactctgaatggctcctactcagaagtcaaggtaacatttaactgttcagtagtccccaacacacaaagggtttgatttttttgttgttgttcattaagtattattttgctttcatctgaggactaggcttcctgcatggcattatacctgacacaatgccaacctccagttatttctttggagggtcagatttacatctgctttgcaaatgggagccagccattgtgcccgagtaaatggtggcttggcgg

SEQ ID NO: 204702 - DNA, 438 bp, Homo sapiens
ctagggggcgacgtgagcccacctaacaaacagcctggcttccttcccacagggatggcaccacctggtcatttgtatttaaacaattcccatctgctttacacagaaggggcaaaccaaacccaccacccccattctcagcctatcttcttaaattatcaacacccagtagctggaataggacttgaaatggataaacctaccaacacttgactgcagtgagcccagaaatggacaaggcaggatttcctgtttaccccacatagggtggggagtgcggggactaaggggtcctaagaagagacagcatttgccggaggaaacagtggggtttccagtttgtgtctggttccggctggtggcggggggtttctagtgactcgtctcactgcataggagcctgccctcagaggacgcaggcaggtgtcatttcaggcc

SEQ ID NO: 204703 - DNA, 263 bp, Homo sapiens
ctcctttttcctcctccagcactggaatgagaagaggcagaacggtagagaggccaaatgattgcttaaagacacctcttagattgcaacagagcttgaccagcaaaataacctccagcaaaactttcttaagcagttatctgaggcaattgtaaaaattggttggttacagcaaagtggctaaagtcacatttgaattactgtaaaagtaccctgagttatataatctccatttgtgtgtgtgtgtgtgtgtttgtgtgtgt

SEQ ID NO: 204704 - DNA, 553 bp, Homo sapiens
tggcttcaaataaatatttgcatatgaaaattaacgaaacatctgctttcttccagtgataggcgttctacaggcgaggatgcccacggccaacctgatgactcctggcatttaggtgcgaatgagcccgggctgccagatttactcattcccatcctcccctagaatgaaaaccctccaccctaaaacagtcccactatgacctggaccacaggtttaatcctgcaacaaaaatgactgcaacccaaactgactgtgcccgaggcacaggcgctggggccctggcagttagcaaaataccggctcgaccgcaacgccatctggggctcccagcaggcatcttgctcatctgttttctttataaactaactcaagccaaagaatctcgagtccctgtgactggagctgtggaacagaatgccccccccagcctccttagccttccttctcccttgcaaattgcttgtgggcacctgtcttcttgcccttaggaaggagtggacagtcccagcaatggccatgctgggaagccaaacgcagcttgagaggggac

SEQ ID NO: 204705 - DNA, 421 bp, Homo sapiens
aaatatcctcctgcctaagccaactacgtagctgggaccacaggaccatgtaccacacctgcttaatgctcaaaagtttttggtgatggggtaagcaaccaaagtttggagaccactggtctacacgactcattgtcactgaactttcatttttatcagctccctcccaagagttaatctatggaagtaagtcctgatgctgaaaaagaaacagaagaaaaactgtttcaaactattttgaactcccaacaagctaaagatgacaaatcactagcaagaatatatggaattgaatactaatatgctattgacgggaatttcaaatagacatcctatctaaagggcatcttgagtatatccacatttaaaacacacataccctttgacctaataagcccttttttttttttttttttttttt

SEQ ID NO: 204706 - DNA, 243 bp, Homo sapiens
tgtagaggatcccgctgaccgcttacgcatgcttcaggttgtagcaacagcacaaaggcaaaacttccagacgatagccatgctgaggacttaactataagcatggtaccatctttggtgttttacatatgctacaccacttaattttctcagtgagctcatgagatggccatcagtatctctgtttcacatatgaggaaactgaggcaagttaagttccttgcccaaagtctcccacttagc

SEQ ID NO: 204707 - DNA, 371 bp, Homo sapiens
tccaaatccttgcctcatatctggcttttggcccaatcacaccaacaaaataactcttgctaaggttactgtgacctccatgatgataaaagccaaaatatgtttttcaatcttcatgttatttaaattctagaaatttctatcacaaatcattcttttgcttctgagacattcttccagtcctccttcctttcttctgtatctcctgtaggttcacctgttcttcaccattaaatgttggaactagtcaaggttctgacttagctgaccttacccacacctatggctcaattcatgtatatacaaattatgcccaattttatattcccaacacaaatctctcttctgagcacaaagctgtatttcaaact

SEQ ID NO: 204708 - DNA, 579 bp, Homo sapiens
ccctgtagccgcctgatgtggtgctagatgatatgagtgaagacgtggacaagagagatgtggaaactcccagagattgcattcaactgtgggagacagaaaataacaaagcaaacaagtcaaaggaaaggcccagctataggtaaatcctctaaattaggggtgtccaatcttttggcttccctgggccacactggaagaatgattgtcttgggccacacataaaatacactaatgatagctgatgagctaaaaaaaaaactcataatattttaagaaactgtaggaatttgtgttgggctgcattcaaagctgtcctctgccacatgccggccaagagccgcaggttgcaagagcttgctctgaaggaaactaaagaagacaatggggtgcagggtggccaggaggggagggccagagcagcgggcagggtctgcattctccagggccttccagacagtcagggtgcaaagcagagagggcctctggacgcagctgtgtctcctgctactctgggcctttaacatttcaacaaaattgtcactgtaaaccaaaaacagaattctaagctccacccca

SEQ ID NO: 204709 - DNA, 518 bp, Homo sapiens
agatctgaaaccatctttaattgaaacttcagggatcgacaagcacagaaagcatatgggtaatttctccctaggccctccacaccagctgagatgtcaggagggcagctgcagcctttgggcagctcattagggcagagagtgaggatggatggagtgagacagaaagcctcttcctgctgaatcaccagcaccagttccaagatctgcctgggccatcctcacaggctgcttggccaaggactgactaagcacaaggctgtagaactggcagagagtcaagaatggtggggctgggcaatagctaaaggagtgacatttgtgaatgagtgtgatgaattgtttctgtttgtttagactaaaccccagctccgcctcacgcaagtggagcaaccaagtgtgagacactgagatcctggaaatgaaaggattgtctgaccagctgttcaaattggtggctgaagctctccggtaagaacagctaacactcaggtctcactcagagtcttatagataac

SEQ ID NO: 204710 - DNA, 375 bp, Homo sapiens
catgtcccttctgtcctcaccccagatgcatgcagaagtaatgtagtttactggcatagattctgaaagcaaagtacctgagttcaagtcttggctttctcatctcagatgaatcccttgacttccctgtgtgtcagtttcctcatctgtaaaatgggggataataccatctacctcatagggttgctacgaagattgaatgagataatatctacacagcagttagaacagtgcctggtacccagtgagtactatgttcctgcaggaggccccctccccaaatttctatgccctatgagttgccatctatagttctttgggagatgatgggggcatcataaggtagttcctagtcatggaaaatagggccagaac

SEQ ID NO: 204711 - DNA, 145 bp, Homo sapiens
taagagcgtctgcagggaggctgggagtaggcagcaaggaggtaaggaaggccagcctggagctgagagcagtgacgggcctcccaagctgagccctctgtactcttcacactgctttctagcaaaaagagcactggatacagag

SEQ ID NO: 204712 - DNA, 431 bp, Homo sapiens
tgagaaataaatttctgtggtttataagccacccagtctatgatattttcttatatcagcccgaacagactaagagtacagtagctttcaagggcaactggatcaaggggaaggagaactttttttatttgttaaagatgtcagcaactggccgggtatggtggctcaccctttaatcccagcactttgcgaggccgaggcaggcagatcacctgaggtcaggagttcgaaaccagtctgaccaacatggtgaaaccccgtctctactataataaaaaattagctgggtgtggtggtgtgtgcctgtaatcccagctacttgggaagctgaggtatgagaattgcttgaacccgggaggtggagtttgcagtgagctgagattgtatgactgcactctagcctgggtgatagagagtgactccagctcaaa

SEQ ID NO: 204713 - DNA, 285 bp, Homo sapiens
agcctcccagtaactgggattacaggtgcacaccaccatgcctggctaatttttgtatttttagtagagacgaggttttagcatgttggccaggctggtcacaaacttctgacctgaagtgatccactcgcctcagcctcccacagtgctgggattacaggcgtgagccaccatgcctggcccccatttgagtttcttagcatcttatcaaatagcaattgtgaccatttatttcaccttctaccttgggcacagacacatccatatcccctttgactagagtgg

SEQ ID NO: 204714 - DNA, 352 bp, Homo sapiens
tttttggtaaagatggggtctcactatgttgccaagctggtcttgaactcctgagctccagtgatcttcctgtctcagcctcccaaagtgctgggatttcagatgtgagccactgcatttggcctcagtcctattttcttcactcagggagcatgctggactctgcccttgttccccttagactctccttccctgttacatttcttggaaacactgtttagggattaagcctggataatcacaggactcacctcacttgtttcccatctcccaaggaatcactatcgttcactgcctgatgcccagtaacttaaaaactattgtttcatatattttttctttttttctttct

SEQ ID NO: 204715 - DNA, 353 bp, Homo sapiens
  misc_feature (323)..(323): n is a, c, g, or t
  misc_feature (332)..(332): n is a, c, g, or t
tttttggtaaagatggggtctcactatgttgccaagctggtcttgaactcctgagctccagtgatcttcctgtctcagcctcccaaagtgctgggatttcagatgtgagccactgcatttggcctcagtcctattttcttcactcagggagcatgctggactctgcccttgttccccttagactctccttccctgttacatttcttggaaacactgtttagggattaagcctggataatcacaggactcacctcacttgtttcccatctcccaaggaatcactatcgttcactgtcatgataggtggtggtggccgtgctggnctttaattnttagaatggtgaggttcatca

SEQ ID NO: 204716 - DNA, 467 bp, Homo sapiens
tttctccctctaagacatatgtggcttttcactttattttcaactgaatgctttcgctgttttgggtttagcaagcttttggtcttaaaaatatccaacaatgcagttaagaggccagatgactttatgcatgaaacattgttaagatgaggaattttcccatagaaaggtgaccagatttgaggaaattatttagtcagtataaacatttctctggatgtaaacagtacagattttactttcaggctttcctaataaagtttctaacagacctggaaaggagaaggaagagtaacatctgttgcaaaaccccagttacgtgtaggacaaataagaatctgggagagaggtgacttgcccaagtgacacaccgatttgggatatattagggagaaccattaattcttgtccataaggcttgatttagaattgttttttattttaatggaagttctgtagaaagaaag

SEQ ID NO: 204717 - DNA, 474 bp, Homo sapiens
agtacagtggcgcagtcacagctccctacagccttgacctcctcaggctcaggtaatcctcccacctcatcctcccacaggtgcaacaccagcattcccagctcatttaaaaaaatgtttagagacagggttttgccatgttgtccaggctagtctggaattcctgggctcaagcaatctgccctgtccttccaaagtgctgggattactggcgtgagctaccacccctacttgaggtttctcttaataaatattttgcttagtgtcctggtgaacccagttgtcagtaagagccatttgcctcctgccttggttagtaggtggaggaaatagatgcctcatatgctctgtaaggaaagcagggctgggtgcagtaactcacacctgtaatcccagtgatttgggaggccaaggtgagagtattgcttgaggccaggagtttgataccagcctgggcaaccccatttgtacaaa

SEQ ID NO: 204718 - DNA, 405 bp, Homo sapiens
gaagaaatctgattaattcattcaaatatttattgagctctattctgtttcaggcaagtctaaatgcttagggatacaggagttcctaagagagaaaaattcccccctatatagtggacaaatacaaagaagagagtacctaatatatattaaatggtgatttaagtgccttggagtgagtaaagtgagggtggtagagaggaagttggcagctggagggagacagggaggaggcttcatcaagaggacaaggtccaagacaaggcctcaaaaatgcactggtacacattacaacagctaccgtgtcctgtatgaccaccactgcaaggagatgcatgtcaagcccttcgcttatgtcatctcatttaatcctcacaataaccatgtgcagctggcatcaaggaa

SEQ ID NO: 204719 - DNA, 371 bp, Homo sapiens
ggagacttcatggagaagaacaagatggcttagattaacagtcacagttgtatctgagagaatgactgaaaatatgggttatacatcatatattccatttaatcagcaaagttatattaagcatctattctgtgcagaaactaggataagagataaggataaaaagatggaatcagaaatatgagcttatagtctggaacagggaataagacatttatataaacagttaaaatagaaagtaaagaattataacacatgacagagaggagatgcagatgaagtgactaccccaggatcggtagagatgaacatctaagaggaagaagcacatgtaaaggcaagtggtcgagaaagcattgagtacatacagg

SEQ ID NO: 204720 - DNA, 669 bp, Homo sapiens
cactaacaccagcctgtcatccaagctgacacccttctatggtcctggacaaggctcagttcccttgctttgtccttggggagctgagcagaacaattgctttgagtctcacaatcttctgaaccaattcagcttcctaataatgatatttaaatcaaactcactttgagtagatggctgagccatctcctttatgaaggagaaaaatccctagcacataccataaaccccacataaaccaagcaatatcaaatattcagatcaaggtgaataatatgcaaaataaagatttcttctacatgtacaataatggtgctttggaattcatttttcaaatttgcgtcttaaagttacgttctccaggccaaaaaataattgcaagttcatctcagcaggttgagagaaactcagattttgtctgagaagatacttttgcaatttgtggaggatggcatttgggaggatattaggttctacagtagttaggatcaggcgttaatagccacatgtaatcagatccaaaataacgctaaagctaatggaagatacagcttttgtcaattctcaagaatgccaatcttcccaaatagaatttcattcacctgcccaattttcactgggtcaaatcacatcagatattttataatcaccaattcccagacagccaag

SEQ ID NO: 204721 - DNA, 612 bp, Homo sapiens
ctttccagacacaactgccaggtaattttaatggtcatttaaatctgtaataccttgggtgaaagtccactgtttgaaaggtgaatggtatcgcttgtgatagtatggtccaaatttggctttcagaatttacctatagtgcctcctgtatagaagtccttatgtgaggtccacaaggctgcacaggcagctgttccacagcgataaccttggggcaggggaatgttactgaggggaatctcttctcctttctgtctttcacatactggagttcttctaatgtttagtgttttttaaacagctttactgagatataatcgttatacagaaaactgtacgcatttaatgtctataatctgaagtgtggacatacgcatatacccatgaaaccatcaccacaatctagacaataaacatacccctcactaccaaaagggtccttgtgcccttttgttggttgttttctttgttttttaatgttcagttttacaatgtggtacttctgaaatcagaaaaaggaaatttacaaaatggaggaatgctggggaatttaaagatactatattaaaaaaatgtttaaagcaagtgtagtttttcctgaagcctaagaac

SEQ ID NO: 204722 - DNA, 475 bp, Homo sapiens
agttactagaactgaaccctttatatagtaaatcaagacatatgttcatgaatctctgagtcagtacatgccttaagtcacttaaaacgttgccttgcaatttcttcctttgcaaaataaggatcatacccactctgccttttacagagaagtagtctgtgaataaaatgatatggtgaatattaaagtatttggaaactgtagggagaaagaaattgattgttgctttgtaaccatgtttataggcatcaaagaaaactcaaagcctcctgccttcttaattctgcttctggagatcccacttactttctttagattctttaaataacattaacaatacaaaccaggctgggcaagccttctctttctaaaagtctcccttggcaggcttggtggctcacacctataattctaatgctttgggaggctgagcttggaggatcccttgaggccaggagtttgagaccttggcaag

SEQ ID NO: 204723 - DNA, 424 bp, Homo sapiens
caaaaatcagctgtctaattatccttcttgcatctgaattgcaagaaccaaaatctgtcctaatgataagtttgaagaatatcaatccagttaaccgtgatgccagaactttccttggactttactgcaacatgtaccagttgcattgagtttgattaaactggtagtaattcttcctcgctaacactaacctatacaagcaacgctgagacgcgcgattttgctcgggttacactgagattcttgtttctatgggagaaaaaaactgcataagacaagttttgtcttcctctagggcctgtaaccatcacggacaatcatgaaaagcaatgcctggagtcacagggggccagttctgctacatcccatacctaacgcgttaagcaaagaacagtttttttgtcaatgaccacaccacgttgtt

SEQ ID NO: 204724 - DNA, 246 bp, Homo sapiens
cacccacgcccttttcaaaggagacttttcatccactcagaattctaaaaatgatcaaaactctctaccataatggatattttccttgggtgaagacagccctaagccattctttcatatttaataacagcctatttgaaaaaagccaagttcctccacacaggcctccaacttgtgccatctgatggcagaagagggatgctgtcattacccaagtgtacagatgtacactaacacttcggacag

SEQ ID NO: 204725 - DNA, 227 bp, Homo sapiens
agccctaaacctcagtatgtcagaacttgactatgtttggagatagggcctttaaagagaggagagttaaaatgagatcattaggatatccctaatccaatctgacctgtgtccttataagaagaggaaatttagagtcacagccattcaggaatgtacatgtacagaggatagaccatgtgaagacacagtgaggaggtggccatctgcaagccatggggaggggc

SEQ ID NO: 204726 - DNA, 565 bp, Homo sapiens
cagcaactagcatatgcaaccatcattccctgcctagactacagccatatcctctctcccagctggtctccttacatccattcttcgtttcttaaatccattgtccacacacaaccagtaagtgtaaaccccttattgttcgtttacttcaaactatttagtggcctctcattaaacttaaattctaaactccttaaactgatccccatgtccttgcaagatcttactcacttttctccaggcttatcccatgcccccttttcctttccttaccatgcttgagccaaactgatctcttctcactaccttgtcacaagctcctttccagttttgcacttgatgttgttctttctctcagttgtcaacccttattcttaagtcttggcttgtatctcttcctgaaagcactatttctttttacttcagaatagatcagaccacccatagtatgtgctgccagcctgcagtacttctctcttgttggcttatcacaattgtaatcctgtaaattgtcttgtgataactgtatccccattaaactgtaaactccatatggacaagaact

SEQ ID NO: 204727 - DNA, 509 bp, Homo sapiens
caagaaaatgaagcctgagcaagcttggaacatgctttgcacaacagtagcagggcagagactcaaggccaaggccaagcccaagtggttgctgaggcccaagtcctgtcctggacagctcccccacccaaatttggagtccaaaatcccaagctgtaggtctgggcctgggccacacttggtttcctcatcgatcaagggatcagaatgccgagctctgggcgtggcttgaaggctgccctccaggtgaaaggcatttggtgaccctcagcacctcagggatgtgaacagggctgataataatttctccatccaagagaatgggaagacttcatgggggaggaggctgggagctgggctttcaggacgagcaggatccagagggtggagaagggaaaagggacattccaggctggaagcagggaccggctgtgcaaaggctgggtgcgggggtggggggggtcagtcaggggcaggaccactgtgttttggccgggacataaacactt

SEQ ID NO: 204728 - DNA, 548 bp, Homo sapiens
aaaggattcagtcccaactcctcagtgtggtatagtcaggccccaccttatccggcatcccacatcccataaatccacaggtacaccctgattccacagattccagaacacgccacaggcctccacacctctctgcctgcacgcactgttcctcctcactaagatatccttccaccttttttgcccagagaattcctgctgttccccaagcccagcctcagtgccacttccttgagaaggcctcctgatgaccccagcagaagtcatttatcacccactcattcattcaaccagcactaggcacccaccacataccagcccctgggcggggcacaagtatggttcttgcttagtgggatgaggagtcaggctaacctaggctcaaaagcacctaggagctacttgaccttgaacaagtttttatttaatctgtctgtaaattgaggaccctaacgtcctccattcccaaggggtagattaagtgaggtggatgcacaagaaatacacagatcatggtaggcgctcaataaatgtggccatcctttctc

SEQ ID NO: 204729 - DNA, 164 bp, Homo sapiens
aaagttcagactcaataatatggccaatggaaaggcacagaaaggttttaaccagaggattccattacagttcacataactgtttctgataccttttaatccatttaacaatatttattaacacatcaggcaattctaacgaatgagtttggacttaactgctg

SEQ ID NO: 204730 - DNA, 803 bp, Homo sapiens
tgatagcaatatccaaaaaagcttcagtaaagaacaatttatatcaaagatctttcttcactgtggagaatcacagacttccttggaaatatactttagatggtcaaatgatacatcatttaaacttaattctatttgggtccatgcatgtatatcatgggcttgggaagaagtgaggttcttcctttcaagttatgtctgtagcctttgatattatcactttgttatatttttatgtccaggtctttaaaaggtttatgttaggaaatacttaaatatacccaaaagtgtataagaataatgttaattaaaacgttaacacttatgttatcaatacctaaatttgacagatgtgaatattatgtatattttcaatctacctgttttatatttctataacttgctttgttttgactaatgctatgactttcaagtttgcccatgctaatagatgtagcactatttctataatactcaattgctgagtatccattttctgttgatgaatatgtatgctatttccaatatattgctattatgaacagttctgtaatgtttaagtttatacatattttcttggagactcattcattcatccatccagcaaacactaattttgccactggtacatattaagccatatagcaggcattagaaaaatatatatatataaacttggttcagctcttgagaagtccagacactagtggaggagaaagatgtgcaaacaaattagtgtaatacagcttgctagtgcaatattagatacatgtatgtatgtatatgtacatgtctatctgttt

SEQ ID NO: 204731 - DNA, 347 bp, Homo sapiens
taatacccatgagactatgattgatgtccacacatctgtcattttctcttatcaatcaagccatttgattcataggttaaagaacaattttctttgcagattttgcatgtatggtaaaagcttgagcctccgagtttaacagtcctgggttttaattctaactgacacattgtgtgaccttgaatatgttcctttactgaaaatcgaattcctcatctctaaaatggagatgacacctacctccgtcgcattgttagagtatataggagatactcatggatgtataaaagtaattgttattaatatctcatgttactaaaggggtgctttgggtgggtatttagtgt

SEQ ID NO: 204732 - DNA, 299 bp, Homo sapiens
tggtgcgctctcggctcactgcaattccgcctctcaggttcaagtgattctcctgcctcagcctcctgagtagctgggattacaggcgcccgccaccacgcccggctaatttttgcatttttagtagagacggggtttcaccatgttggccagggtggtctcctactcctgacctcaagtgatctgcccacctcggcctcccaaagtgctgggattacaggcgtgagccaccgtgcctggcctggctgtgattttaaaaatcattattatggacatgacaatggctgatgtgatttttt

SEQ ID NO: 204733 - DNA, 379 bp, Homo sapiens
ttgtattctgctatggataacagaaaatcctactagtggtttaaacacataagcactttcttttccttatgtaacaggaagtctggaggttgttggcattggttcagtgtctcagggaggtcagggctcagttcactgtttctatttttttttccctcacaggctcacaatggctgttgaagctctagccatcaagtgcagtgtccaaacagaaagaaacaagggctggaaaagggaagggcagtaactatatttagaaaacaagacttttccagaaatcctcagtagacttctacttaggtctcattgttccacaaagtcttgcctgctgcaaaagagtttttggctttgcagcctttatactagaggaaagaagaaa

SEQ ID NO: 204734 - DNA, 702 bp, Homo sapiens
tcaaaaccagatgagttcatatttatttctgtatcttcatgacgcttgctgctttttttctcttcattttcacatgcgagggtataactgagtgttcagggttttctctgaaagcctgaagggattgtgtacttttacattgaacttgactgcagttagaaccattaacctagatgacttcagccaaattatgtattgtttttgtttttgtttttttgagacagggtctcctgtcacccaggctggagtgcagtggcacagtcatggctcatgacagcctcaacttcctgggcttcagctgtcctcccacctcaacctccatagtagctgggactgtagtgcacaccaccatgcctggctggctaattttttttttttttttttttttgagacagagtttcattcttgttgcccaggttggagtacagtggtgccatcttggctcactgcaacctccgcctcctgggttcaagcgagtctcctgcctcaacctcgagagtagctgggattacaggcgcccaccaccacacccagctaatttttgtgtttttagtagagacggggttttgccatgttagccaggctggtctggaactcctgacctcaggtgatccacctgcctcggcctcccaaagtgctgggattacaggcgtgagccaccatgcccggccaattttttggtattttttgtagagacggggt

SEQ ID NO: 204735 - DNA, 768 bp, Homo sapiens
tggcttgtgctgctgatcttgaggatccccggtgtaacggatcaggtttcagtgtggagatccagagaaggcctgcctgccttactaaaaggaaggagtagtttagaggaaatgggcaggagtaagctgagaatgagttgtcagaagtcacaagcccttagagaagggtggcaagaaattagcccactgataagaaaaaggctgaaacaccaatgtgctgccctctaaagtgagaggaacactcagagccagctacaggcaggaggagccctgaggaagaagttgggaatgccgtgaagactatgtgggccatctctccagtcaagggagaaaaggagcccaaaaggggacggcaagccagaagaggcatcggctctgcacaattgtcaccagagtaacttctaaaatttaaaattgggattcattccctagggtgtacagacgggctacaggtgtctgaaaatgttttgctgtcagaagcaaaattgtttgtgtctaggtatttttctggggagagtctctatagctttcatcagattctccaagggaggtctttgcaccataaagagctccaccgagactcaccaccgacatacttggaggaagatattataattatagaggacacaacccatttactgaataatctctcagataagctgatcatcatctaacagagaagagctactgaaggagctgaactagtgctgctatgggaaatgcctggttccttctcccttcgttataaatctttttggcccggttgat

SEQ ID NO: 204736 - DNA, 503 bp, Homo sapiens
ggtgctctagaggagtcgggatgaggaacgtcatcaggttctttttggatataatgctgaattctgggtgttatcatatgctttttttctattctaatcttttattctttgttaaaaaatatggtcatgtttataaaatcacaacttctacatttaaagggtaggttgaccaattaaagcagcctttccaacctaagtgcatctggctaggtaattctctctgagctttattatttgttttagagcttagatcagagtttgacaatgtagtgtatatactaagatttcttaaagatttatctgtgtattccaaggtgtgcttatctgtgtaaaaaactcagcaagacatggcattgccacaggctatcaaacatttgaaatattcctttggagttattttctggaattaggccacttttcaataattagatgactttgagctcttggagtcatctcctagaaccacctttggaatagagctgcctctgtgctcgtcttaccag

SEQ ID NO: 204737 - DNA, 828 bp, Homo sapiens
agttatttctcctagaaggtattctgattcttgttactctgttagccagaagtggaatcccctcccccaacctgtaaagttttcattagcattattacacctattgttactgactactatccaataattcctttgtttctcgaattcttgaaaagggaacggcagccaaatagagctcagacaaaaaagatacttctgatgttgttcagtgtctcttgaagcccacataattccagaaaattgcaaatcaatcagatacaggcttagagctagaagtaggtcagctaccatagcacaagatgatggtgtgaaaatattttagtgacagcttgtgcatgataatatatcctttcttgttcagggttctttttggatataatgctgaattctgggtgttatcatatgctttttttctattctaatcttttattctttgttaaaaaatatggtcatgtttataaaatcacaacttctacatttaaagggtaggttgaccaattaaagcagcctttccaacctaagtgcatctggctaggtaattctctctgagctttattatttgttttagagcttagatcagagtttgacaatgtagtgtatatactaagatttcttaaagatttatctgtgtattccaaggtgtgcttatctgtgtaaaaaactcagcaagacatggcattgccacaggctatcaaacatttgaaatattcctttggagttattttctggaattaggccacttttcaataattagatgactttgagctcttggagtcatctcctagaaccacctttggaatagagctgcctctgtgctcgtcttaccag

SEQ ID NO: 204738 - DNA, 454 bp, Homo sapiens
tccgtgaacctcttcagaccggatgatgtgtgttacatccagaaaacctcagaggccctagccatctgcaaccgtgggtttgctgtcctgtgtatttatgttgcattgtttcatgtgtcagagccctctgcagacctgttactgtgtcccctgtgagtctagtactcagggaagccctccctggcagtagcactttgccctggggaaggagaaggagacgcagcaatctgtaggtgtggcgcccgcatgtgggtaagagccagcagccggttctggaaccccgcgactagcacatctgtttggatggccagtgggtgttagctgttgagatctctggcagggcttctgtggatccttcttctcactcagcttagactttcaggctcccattttgggtgctgtcagctttcagcgtatcagctctgtggcaccatacattatgcacaaaatcata

SEQ ID NO: 204739 - DNA, 285 bp, Homo sapiens
ccgctgcagctaaatgcgccctgcgcctgagactgcggggaggctccacgcgaggtggtgctctggagacatccacaggcttcaacacagcaccagatgaggtcagcagtgggaaaggggctgggtttacaagccttggatcacctgggatctcccagcaagccaccaccaaagtcttcagtgcccacctcaacagggataaaacagttatgaaaattttcgcaaagagccctgtcattagaatacatgtatacaaagaaagacagctgctaatatgtcacctga

SEQ ID NO: 204740 - DNA, 355 bp, Homo sapiens
tccctttgccccactctgatgtgctcactactgtatcctgcatcaatctcagggctggcacacagtaggtactcaatgtatactaagggacgctcaacaggcgtcctctccagactccatcctctggagtgacatcacctttcagatccccattcaccttgacctctaatggctgcaggatcaggctctcagcagatctacatctgaatagaaatcaaagactctggcgcaaaggccaaagggaggaattgtccgcaaaggacctttggggaagacacctaaaaccacggcggaggggtgaaattaaagactttcaaaacttaaaaataaataaataaataaaaaataaaaccac

SEQ ID NO: 204741 - DNA, 567 bp, Homo sapiens
ggtgagatttctaaccaagatgcctacgtcattgtcttccttgaaatgctcttcaaattttaacatgaaacaccctctgaggatggtttgtgtttgtttttgtttttgagacggagtcttgctctgttgcccaggctggagtgcagtggcgcgatcttggctcactgcaacctccgcctaccgaattcaagccattctcctgcctcagcctcccgagtagctgggactacaggcatgcaccaccacacctggctcatttttgtattttcagtagagatgtggtttcactacgttggccaggctggtcttgaactcctgacctcgtgatctgcctgcttcggcctcccaaagtgctagaattacaggcttgagccaccacgcccgggctggggacagttctgacacagaagtgagcttatactcccgagagctctagagctttggcctggacatttcttcccagcctggaaatttcttggaagtgtcctttattcatgctcaaaattcctgggaatgctgcaacctcttccaccatgaaatgatagcattgcagactcttgttttact

SEQ ID NO: 204742 - DNA, 502 bp, Homo sapiens
cttattagaaaagtcagcgtgctccatcttccctccagccacaaggctgtaggcagcacgcgcgtgctcggcagtcggctagtctaagggtgattgagcgtcgggagctgctccccatgaccggactctcggtgctgtccccgtgcctgatgtttcctcctggtggatgaggggctcctccaggtgggcgggcaggctcacttaggaaacaagcccaccgcgggggatggagcaggagagattgccattctcgccagggctgccttcccgctgtctcctcctccctcctgtgccatagcaaggtctggaagaggcagcgcatgctctccctggacgtgcctcccggcgccctctgaactctgctgtcctctggctctcctttctcagtgctctgcgtctttcgccagccaggtggggccctttggcatttctctagcaggcatgatggagttcccgctcctgccgagcttccaggatgcggtgttaaggtgaagagatgtgc

SEQ ID NO: 204743 - DNA, 263 bp, Homo sapiens
tccttattcatgagtcacttttgataattcgtatttcctagatcatttcttttagattttcaaatctgttactatataggtgtgtataatcttttgtcattaagatctgtggtattcatttccttttttttattagtgatttcactatttttctgaatttgccaaatgtttgtctacttagtggttttttttactaaccagctttgagatttacttattgtattggtttttttttgtttgttttctgaatgcctgatttctac

SEQ ID NO: 204744 - DNA, 1106 bp, Homo sapiens
tactggacatgctggagcctgcccgtgtccttgtggaccatggaatttgcccggggttggggggcaggggtggagagaaataaaacttcctgtgatctatgtatcggcccagtacatagatcctggatagaggcgattgagctaagcatgggaccaagcatttctgtgcagtgcctgcagaattgagtttccttctggctatgggagattcttctgagctgtctcagttgtctgacatctggcatctgccatgggccaggacgtctggggcaggggcagaagaggacaggaggagactgccctagaggattctgggaaaacgggaaaacagcaaaacagagctacccaccaatctcaggctgatgcattattaataaaagtgactgttgactgagtttgtagacataatatgtttgaggtacctggcctagtaagcaccatacaagtgctattatttctaaatgattttatcaagataaaagacaccagccaggcatagtggctgccgcctgtaatccctttgggaggtcgaggcaggaggatctcttgagatcgtaagttggagaccaacctgggcaacatagcgagtccccatctatgcaaaaaatttaaaaattagctgggcatggtggtgcacacgtgtagtcctagctcctcaggaggccaaggcaggacaatcccttgagtccgggaggtcaaggctgcagtgtgctgtgatcacaccactgcactccagcctgggcgacacaaggagaccctggatctaaaagtaaaaatgaaaaaaaaaagaaatgaagcagcagggcgtgatgactcacctttaatcccaaagctttgggagggaagatgggaggactgcttgagctcaggagttccagaccagcctgggtaacatggtgagaccctatctctattaaaaaaatataaaaattggctgggcgcggtggctcacgcctgtaatcccagcactttgggaggccaaggcagccagatcatgaggtcaggaggtcgcgaccatcctggctaacactgtgaaaccccacctctactaaaaatataaaaaattagccgggcgtggtggtgggcagctgtagtcccagctactc

SEQ ID NO: 204745 - DNA, 943 bp, Homo sapiens
tactggacatgctggagcctgcccgtgtccttgtggaccatggaatttgcccggggttggggggcaggggtggagagaaataaaacttcctgtgatctatgtatcggcccagtacatagatcctggatagaggcgattgagctaagcatgggaccaagcatttctgtgcagtgcctgcagaattgagtttccttctggctatgggagattcttctgagctgtctcagttgtctgacatctggcatctgccatgggccaggacgtctggggcaggggcagaagaggacaggaggagactgccctagaggattctgggaaaacgggaaaacagcaaaacagagctacccaccaatctcaggctgatgcattattaataaaagtgactgttgactgagtttgtagacataatatgtttgaggtacctggcctagtaagcaccatacaagtgctattatttctaaatgattttatcaagataaaagacaccagccaggcatagtggctgccgcctgtaatccctttgggaggtcgaggcaggaggatctcttgagatcgtaagttggagaccaacagcctgggcgacacaaggagaccctggatctaaaagtaaaaatgaaaaaaaaaagaaatgaagcagcagggcgtgatgactcacctttaatcccaaagctttgggagggaagatgggaggactgcttgagctcaggagttccagaccagcctgggtaacatggtgagaccctatctctattaaaaaaatataaaaattggctgggcgcggtggctcacgcctgtaatcccagcactttgggaggccaaggcagccagatcatgaggtcaggaggtcgcgaccatcctggctaacactgtgaaaccccacctctactaaaaatataaaaaattagccgggcgtggtggtgggcagctgtagtcccagctactc

SEQ ID NO: 204746 - DNA, 856 bp, Homo sapiens
tactggacatgctggagcctgcccgtgtccttgtggaccatggaatttgcccggggttggggggcaggggtggagagaaataaaacttcctgtgatctatgtatcggcccagtacatagatcctggatagaggcgattgagctaagcatgggaccaagcatttctgtgcagtgcctgcagaattgagtttccttctggctatgggagattcttctgagctgtctcagttgtctgacatctggcatctgccatgggccaggacgtctggggcaggggcagaagaggacaggaggagactgccctagaggattctgggaaaacgggaaaacagcaaaacagagctacccaccaatctcaggctgatgcattattaataaaagtgactgttgactgagtttgtagacataatatgtttgaggtacctggcctagtaagcaccatacaagtgctattatttctaaatgattttatcaagataaaagacagcctgggcgacacaaggagaccctggatctaaaagtaaaaatgaaaaaaaaaagaaatgaagcagcagggcgtgatgactcacctttaatcccaaagctttgggagggaagatgggaggactgcttgagctcaggagttccagaccagcctgggtaacatggtgagaccctatctctattaaaaaaatataaaaattggctgggcgcggtggctcacgcctgtaatcccagcactttgggaggccaaggcagccagatcatgaggtcaggaggtcgcgaccatcctggctaacactgtgaaaccccacctctactaaaaatataaaaaattagccgggcgtggtggtgggcagctgtagtcccagctactc

SEQ ID NO: 204747 - DNA, 213 bp, Homo sapiens
gccacctaaatgatgatgttataattattcttttaattgctatattgctaacagtcaccatatgtagaacttagaagccagaacttgactaagtttgttttcctgttttaaaattccatttgggtacatgacctcacaattaagttttgttttgaaaaatacaaagttttctgaaggaaaaaagcaatagttaaaactttatttgctttgttc

SEQ ID NO: 204748 - DNA, 303 bp, Homo sapiens
gctatggttattttcttgctcttaaattaaggaaaaaacaactctactaaattatgtgaattttctctctggaatatttagttgttttacgtattctctattattgtaacatattaaatagtgctccgaaagcccaaacagatcactctctgctaacttaacacacttgagaatggcaggaaaattccaccctgagtcataataaattatgttagctaacagaataaccaattaaatagaattttatagatgttttattttaaaatataatatattgtaatatcttatagaatctgttccttt

SEQ ID NO: 204749 - DNA, 164 bp, Homo sapiens
attcaaaattactactgcaaaggtcactttttgagctatgcttcatggagaataaagtcttctagaagaggagcatgggtcagaactcagtggagaggagagctctgggaagtgtccacatctcatgctctgggctgctgccttggtagggaaaatgagtgtgt

SEQ ID NO: 204750 - DNA, 587 bp, Homo sapiens
tcgtgatccgcccgcttcggcctcccaaagtgctgggattacaggtgtgagccaccgcgcccagcggattattgtcttaatttgccacttgggggaaatgaacacataaagttgagtgccacatacaaagtttcatagcagagtcatctctaaaacctaggtttaaagttctcttagggcagtatgactttaggtaagtcacttctctgaatctgtattctcaactatataatgaggaaaaatatctaccttgaagctatggtaaatattagatatgtgaaagtactattcgtttatcaaatacaattctaacatgactcctgattggtcaatcccacaactatctctcccactctccagccgtccttttcagaagcaagcctccaggagagttgataccactattcccaccttcctcctgtgcatccaccaatctacctcacattctcctcccctgcacccagcacccctggaatgctaccaccctgctccagccaggaggccagaagggtgatgtaggaagattgcagcactaccatggaagttctcaacagcacccccgacccaggaccccaggttcccactgg

SEQ ID NO: 204751 - DNA, 431 bp, Homo sapiens
cagtcactgttctcaaattgtccattatctaaaacacattacatgaccatgctggccactgatcgaggcacctttcccaggggctttttttgtgaattaagaaaacaaggtaattcaccagttattgccaagatagtttggcttcttggctcatgtggatatcacctaggccagtacttttgtgatttactgtgtactccactttaacggcctgcgatcttctagagaagaacccgccagggagcagtgagaggcctccctggtagactgagacactgactgtccctccccctatccttttcgtctttctggccagcagaccagcaggtggccctgccactggctctgccacaggcatttcctttctgtgcagctgtgctggcctggctgggggttggtgcgaaggggtccccaaaatactaccttaaaca

SEQ ID NO: 204752 - DNA, 479 bp, Homo sapiens
ctgtaggtattattcatcttggaatctctcggtctcagtgcagagcctggcatacaggacacgcattttttaaaaataagcgaatgactatgacttggtagcactcatttcgttggctcctttcccaggggctttttttgtgaattaagaaaacaaggtaattcaccagttattgccaagatagtttggcttcttggctcatgtggatatcacctaggccagtacttttgtgatttactgtgtactccactttaacggcctgcgatcttctagagaagaacccgccagggagcagtgagaggcctccctggtagactgagacactgactgtccctccccctatccttttcgtctttctggccagcagaccagcaggtggccctgccactggctctgccacaggcatttcctttctgtgcagctgtgctggcctggctgggggttggtgcgaaggggtccccaaaatactaccttaaaca

SEQ ID NO: 204753 - DNA, 516 bp, Homo sapiens
taaggtgcgtagaaatggttatacttaagtttggggcacaatgggcgtggggctaagaaagatctcacatgtatcattaggctcatgaaaatcattcagagacttttctgcagcacagcatattgctagttccttccagccctcccttcgctaattctattttcagatctaagctaatatgcacatatttatcttcctcaagagacgccactgtctcagcaattaataaaataattgcttattgaagaaagatatctgtttctggtattgccagaatcacttgtgacctcatagggatgttgatcagagccttatattctaaggccaaggacaggggtgtgagttttgtatgggccacttcccaaaatctgcatcattgttcttatactacatgcgtgtaggtttcgtattaaatatgagtccttggtcacagtagcaataactgacaatggatacaatggtgcagatcatctgctcctggaaaaacaaagtctatgccctccagattaatggaat

SEQ ID NO: 204754 - DNA, 847 bp, Homo sapiens
tgcgttctctgactgtggaatggtattctttcatgcaaagtactttcaaaacttcccataaagaaactaaactagagattgtctttattaattaatggaactctgggtatgattaagggaattaaattagaaagtagaataacctagttaaaatcattatattagttatacatgagagtcagtgaacgatgacttgatttttacatgacatttgaattctgtcactatctgattcttgacctaaaggtttctttgctaaatctgatatttattatagtataatatgataatttggagctcctgttgcatctcactgccccaaaaatgttggaatgccatatgatacagggaaaagattggagttcatcaccgtggaattttgatctgtcttaatgacacaacttaattttcatgatgatagatctctgaatgattaatccagaatgatttggtacagtgactggaagaaattgtttttctgggaatttgcttcccataatgacctgatatacaggtgaccttagtataattgaaattaattataattttaattagaacatgctctgtttacagattataattgcgcagcattttaaaaaaatatacataattatgaggatgagagaattgcaaacttgaacagttcttttgttttctctccttttacttgaaaagctttcagaaagcttttgaaagatgacacagttttcatagcaacagtatgcaaattaggtttttctgccaagaaactcataaactaaagtatggaataacacaaatgcttaatcttaatcttggctttggattttgtaagcaaaagcattttctgcatcaatttttttcagta

SEQ ID NO: 204755 - DNA, 793 bp, Homo sapiens
tgcgttctctgactgtggaatggtattctttcatgcaaagtactttcaaaacttcccataaagaaactaaactagagattgtctttattaattaatggaactctgggtatgattaagggaattaaattagaaagtagaataacctagttaaaatcattatattagttatacatgagagtcagtgaacgatgacttgatttttacatgacatttgaattctgtcactatctgattcttgacctaaaggtttctttgctaaatctgatatttattatagtataatatgataatttggagctcctgttgcatctcactgccccaaaaatgttggaatgccatatgatacagggaattttcatgatgatagatctctgaatgattaatccagaatgatttggtacagtgactggaagaaattgtttttctgggaatttgcttcccataatgacctgatatacaggtgaccttagtataattgaaattaattataattttaattagaacatgctctgtttacagattataattgcgcagcattttaaaaaaatatacataattatgaggatgagagaattgcaaacttgaacagttcttttgttttctctccttttacttgaaaagctttcagaaagcttttgaaagatgacacagttttcatagcaacagtatgcaaattaggtttttctgccaagaaactcataaactaaagtatggaataacacaaatgcttaatcttaatcttggctttggattttgtaagcaaaagcattttctgcatcaatttttttcagta

SEQ ID NO: 204756 - DNA, 173 bp, Homo sapiens
atttacggataagaaaagttaattaaaagtgtgttgtttggggggcagacatttagtaattgtggaaattactgacttaccaaccctaaagatgccacattctttacgaacgaagtgagacgtttcatttggatgtaagaagcttttgagtcatctcaaagttgaaaagtacc

SEQ ID NO: 204757 - DNA, 445 bp, Homo sapiens
tgtttttcgcatatcagctaagtacttacataaaagtatctcaaatgatattggttctgggaatttcatttcattcttcactagccactcttagttgcctgaaattgatcattatcatcatcaaatatctatggaaagactatgggatacatagaagtgttgattcagggctgggcacggtggttcatgcctgtaatcccagcactttgggaggtcgaggcaggaggatcacaaggtcaggagttcgagaccagcctggccaatatggtgaaaccccgtctctactaaaaatacaaaaaattagctgggcatggtggcacgtgcctgtaatcccagctgaggggaggcaggagaattgcttgaacccgggaggcagaggttgcagtgagctgaaattgagccactgcactccagcctgggcgacagagggagactccgtctcaaa

SEQ ID NO: 204758 - DNA, 365 bp, Homo sapiens
ttgtatgtttccattttttaaagcaaacaaaatctccttagggtcagtgtctttaaaactgtatataaattcgaaggtacgatttagtgttgaacacattatacattattctagtatccttgattttgctattttaacgggaagaatggtgagtaccaatttgaactcctatttgaactcctatttaaggcagatctgggttctcctggctctacttcttacttgctggttgaacaaagttacttacattttctttcctattgtataaaatctgaggtgaataaggctctttatttctgaaatgcaccatatgagcacctaccctcttaatcactcgtaatggtcgtctactgtgatagcccgaa

SEQ ID NO: 204759 - DNA, 444 bp, Homo sapiens
gccgccacctaaatcagactcaggcggagagaattgaccgagtcggaggaggggtaaacagccctgcccctcgctcccactgtcccgccagagaacgcgccgcggaaaccccgagggcgggtcaagggccaggtacccgagtgggagtggactctcgtgccggggtggtaggggctaccctagcggtccagggccagagcctgcacgcggcgcccccacccccaccgctgggctgatcttgggtgtgtcagatcttgcccaagcctcactttcctccacggtggaggtgagaatgaggacgagcctggagctgcgtgaaccccggcgcccagcaagctctcaggaatcgccggcctgtaggtggacgcagagcctgaaagtgaggggcctgggtcgtgcatacggaaataaatatgggactctaaataaagcgagtttctgcag

SEQ ID NO: 204760 - DNA, 157 bp, Homo sapiens
atacctgcttgattgtaatgtactttctgaaaagtaataaataaatcagggaaacattccaaactaagtttctctcagttgtctcacaaaaactttgatggctttttaagcattttcacaaacttatggacactgaatatgatagcaacacttaaag

SEQ ID NO: 204761 - DNA, 580 bp, Homo sapiens
agcaatcagcgagattccgtgggcgtaggaccctccgagccaggtgtgagatatagtctcgtggtgcgccattttttaagccggtctgaaaagcgcaatattcgggtgggagtgacccgattttccagggtggactatccttttgctgagcaggactgaaatataaaacagaaaacctgagagggaagaagtaacgctatatagaagacaattcataatgtaaaaaggtctgcatggaagaggattgaagagccagatgacagatgagagccaaaaggtttggagatgctggcagaagacccaagactcctggatcagagacaaaagatttattactcacagcacagcaaacagtggtcccataagaatgtccagacaagctttatgtgaatatccctcttgcaggaacaagggtcaaaaactggagccaggatctgtctactgtattcgtgataagcattacctttgctgtccattctgcttcatgatttctcctgccatgatgagtgagcacctttccaagcggcacctgtcacagaaacaactgtcctcgcacgaccgtctatgtgacatcctcaag

SEQ ID NO: 204762 - DNA, 443 bp, Homo sapiens
tgaaaatatgtttttctctcctgccaatattttgattgcaacttcatgagagaccctgagctggaaccgtctagctgtgctgcttccaaattcctgacacgcaaaaactgagaaatcataaatgtgttgttttaagccactacattttgggctaatttgatatgtagcaagaaatgagtcatttcctccttcaagcacagttgaaactgagttgtaggtaattaacatacaacctaactttaaaagatgtatctatgtctttttttctttctctttcggacaccggctttcactctgttgcccaggttggagtgcagtggcatgactgaggctcacggccgcctccacctcccaggttcatgcgatcctcctgcctaagcctaactcaacagctgtgactagaggggtgcaccatcacactcagctaactttttatttatttt

SEQ ID NO: 204763 - DNA, 321 bp, Homo sapiens
gccatggaggtgctgctcaggcccttcctgccctccgtgcatcctcctcctgccctttctcagcagcccccagtatgactgccctctggggatcacccaaatagccttgtttcaagagctagagctagtatcattttcaacttagtagaaatgtcactggtacacttctaacaagcttgtcatttaccaagatgatcctgagccaacaatttaaggacacaaatatctcctaagttactacacaaacagttctagctagtgatactttcctttaatggaaggggaagtaagcagttcatatccaactggtctttccatttc

SEQ ID NO: 204764 - DNA, 460 bp, Homo sapiens
agggcattttcctggataatgagaagactctaaaatcaaataaagcttttgaacattgaagatgtttgccactgttccgttgaagaatcctatagatttatagtgattctaaaaggtgtcttatatccactatattaactagctttttagaagcttatgaacattgtagcttttattgattctagggaattggacccaacaataagcaataaaagtcgatggtaactttcttcccatatagggttgtgcagatcaatacttcgaatttactgtaatttgctggtaatggatggaagaactgaaaaaattgtggagccttgtggggcacagctgtgcggtgttgcctttttatctaagctcactgtaggtcacaggctttcccaagtaacaagaaacatagttaagtggcagggctgatacgcatatttatcaagagccttcataaatcattctaggaaaa

SEQ ID NO: 204765 - DNA, 375 bp, Homo sapiens
agaaggaaactagcatatcctacaaaggaaacttttcaaaggcttccggctttccatcacttggttcttccatctctcctgatatgcaaaatccatcctgggagggtgtaatagaggaaggcatatacgtactcctgcttgttcctgccaaagcccagggcttaaactccagatctatgtcacagcatcctgtctcaccttaataaaaacagtctctgagctacaccaaggcagaaagaaaaaagcaacagatggagacccagggtgtctgggttctcgctccaccactgtgtgaccttcaccaggcccccatttccctacctctgacattcctggagtctgtaactccctggaaactgtgtcagtccttcccag

SEQ ID NO: 204766 - DNA, 307 bp, Homo sapiens
cttcctctactacaactgctctaatatttattaatggtatcaccattaatgagtgagcaccttgatatctaagaatcatctttgattattcccttccctttacctaacatccatttctgtcatttcatacttcaaaatgctcccttcttttctactccttttgtattcccacatctttatagtaatagcatcctaagtccatctctaaccttccctttcaagttcattctatatagtacctaaattttctgaaaatgctcctttacttttctgaatctttactgttcggtatctgtcagggtactgc

SEQ ID NO: 204767 - DNA, 522 bp, Homo sapiens
gggagcagttgtcagatgctgaccggcagccacccctctcccagtggccccggccctgccacacataccagcagccctgccacacttgactcattcctggaaggaacctggtgcctggacacctgagtgtgcagcgccactgaagctcaacgcttactgtcgctcagggcctcgaggctcagaaagtgtgtgacttaaacacgtcacggaggccaggcacacagtggggccaacactacggcttcctgagctgtccagcaggtttctgcttctcaacgcggccctgcctggttctgtaagagcaggagcaggagcaggtgattaggacgtccgcgcaggagccgtggcaaaaacgcttccagacaatggggaactcagacgtctggaagggacgggggcagaacgtcagcgccacagacaaatgtgaatcaggcttattacacatctattgagtgagtcagctgcacacctcaagccttttcctgattctgatttttaaatggaatttcaaattctttcttt

SEQ ID NO: 204768 - DNA, 281 bp, Homo sapiens
ccctgtcctctggtgggacaatgcaaaggcgtgttccaccctgtttctcagaaggtctccagtgggactgagctcactgacacattcttaatggcttttctccttttccagtctctctttcccataccctcactccacttcctagaatcacttcccccaaaaccttcccacacccaaaccttgaagctgatattttgatctttatccatctgactcttattaccatctctcaattgattctgaacaatctcctatgatgaaagatgaggatttaagtgggg

SEQ ID NO: 204769 - DNA, 349 bp, Homo sapiens
ttacctgaggcctcaccagaagctgagcagatgccttgcaccatgcttcttgtacaacttgcagaattgtgaaccaattaaacctttttaccttataaattatccagtcgcaggtatttctttatagcaaattagagaataggttaacacagaaaaagttgaattcactattatagttggagacttcaacactcctctatcagaatgaagagatccatcaagcagaaaatcaggaagtcaacagagaaaattgataaaaccaaaagctggtttttgaaaaattgataaaatcagtaaacctctgtcaagccagactgagagagacaaaaattaatatcagagatgaaag

SEQ ID NO: 204770 - DNA, 410 bp, Homo sapiens
atgtgattctcttgctgtgtgtgataaagttgaataaaaccaacttgatgggttgaactggaaggagtaagattcgatgggagggcaataggtaatacggggaaagaaaggttggccaggatggctgtaacccagagatggggtcataggcagagatatttaatatattggggccttttgggcaacagatccatggggacaaatggttgctgtggaggtgtgcgccctcatcctttacatcttgaaccctaggttactaggagaaatgttctctatgctgattatgccctgttgtatgctctgcacaaaggtgttcttgtgagtggaaggagtttatcaatatattgcagcctactgagggagttgaatgcaagagagggagtagaaaggaggaggccagagttgggttt

SEQ ID NO: 204771 - DNA, 445 bp, Homo sapiens
aggtaatccttctagaaataaaactaattgttattgggcacttgtatgtaccagacactacactaagcatggtacttgggtttttaatttattacatgtaatgtcagtaggttcaattatatgatcgtaacatcttcatgaccagcagcatgtattttagagttagaaatgtagtctggtttttgagaagttttacaaggtgtatgtccaaaattgttctttcctcacatgtcagtgggggataaatacagcattgctctcacttctttgactctgggtgctttttcggatacattttcttcaacactgttaaggggcctcactgtcagattaaccaattatttttccacagttggtcaccagactttggaaaaaatccacctcaccaaaattttggatatcctgatctgtgttcatgaaatgctcttctttttgtaaaatctat

SEQ ID NO: 204772 - DNA, 570 bp, Homo sapiens
cattgcctatatctacagttgtaattagcctccccagagaacagaaaatcgtatatcttatgcatagagggtgtgaactttcccaccaacatgtaaagcattaacaaacctagaccatgtatagctataaacagccctttccatgtgttgatttggattattagttttgggatttttttttgtgtgtgtgttactgttgtttttgtatgatgaggccttcctttgattaagttggattatttcattccagttaagcatgaaatagcataacctggatccacattttccaaaaaatagaaagtcctcatgtgaacgtggatattttcttctgtttggtaggagattcatctccatttggtccattaggttcaagtaaacttttaggctatggaggattaggacagtggccctatgctccattctgggagtattggcagtaagggcagggtccattcataaaatggatcctcttcaaggaaagcaaactttttaagggaaggggttgtagaaaaatgtatagatatgtgtgtgtcaggagaagggaaatagttcggagttcacgaagcacac

SEQ ID NO: 204773 - DNA, 755 bp, Homo sapiens
caggctttttcttatatttccaagatcagactaataagcctagtcatgtagttggatttatagatttaataagttgaaacagaagaataggtaaacaaaatgtggcctatccctacaatgggctactattcagcaataaaacaaatgaactcttgatatatgctgcaatatgtatgaacctcaaaaccttgtgccaagtgaaggaagccagtcactgaagaccacacaccatgtatttccatttatagagatgcccagaaaaggcaaacccataaagatggcaggcaggtgagtggttgcctcgggctagcagtgggaactggacatgactgcagatgggcagcctaggccttttgggggtgatggaaatggtaagaaactggattgtggagattgtcatacaactctgtacatgtactaaaaatcattaaattgtacacttacaaagagtacattttatggcatgtaacatatacctcaataaaacttttttaaaaagaaaattctggacatcatctctaaaattagagtaaattaaacagccagtggcctaaatacgagtcctgctgcgtctactgggaaatgttttctgtgtttacattacttgtacaaagcttagcgccagggccagtgggtgctaggatgagcacatttctttgatactgaaacactttcttcctgggaagtctatctgagctgtgatctctgttatgaaaacaagcaaacttaggttgtttccggatgcgacaacataa

SEQ ID NO: 204774 - DNA, 430 bp, Homo sapiens
gtgactctacaggatcccccttgtcttagaaatactaattctgagccacataattagctaaccacatgatccagcattatacaacgaaacacttcaaaaaaaccaacacaagttgggcgcggtggtgcacacctcaagctgcctctagttccagctaatgcagaggttgaggcaggaggatcacttgactccagaagtttaaggctttagtgacctatgattgggcctctgaatagccactgcactacagcctaggcaatgtagtgagactctgtttctaagtttaaaaaaacaagtccttaaattgttgtatgtcttaaaagccagtggtaataatggtaacagctcattttaaatagtgcttaagtgttcaacactgttctaagtgctttatatgtattaaccacaataaataaaatgtttaaaaaca

SEQ ID NO: 204775 - DNA, 387 bp, Homo sapiens
cagggtgtgagaatcctacagaactcttggtgcattttgtaaaaccacaaacttcttgagtttggaaagaattctggagtctttcagtcctaagtcacagaccccagcattgattatggagtctacagcagcacagaattccagagtcacagaaatcaaagctccaggacagtcctggaaagaaacaggagagcgtggccacccatctgcccagccaccaaggcctaacccaccagcggggctatattggcttcttcttggggacgcccagtacagcaggccccctggtcctccctccccaggcctgtgtctcacgtccccacagtgggattgcaagcaagctgtccccatgcagcagataaataaataaataaataaagagcatga

SEQ ID NO: 204776 - DNA, 1015 bp, Homo sapiens
gcaattctcctgtctcagcctcccaagtagctaagattacaggaatgtgccaccacacctggctaatttttgtatttttagtagagacggtttcaccatgttggccaggatggtcacgatctcctgaccttgtgatccatccgcctcggcctcccaaagtgctgggattacaggtgtgagcctcctcgcctggactcttattgagattttttaagataattactttgaattctctgttagacattttctagatctgtgttttattgttagttgttcctggagcatttttagtttctttttgtgctgttaggtttgcctgatccttcataatctgtgaagccttgttttgatgttcttgcatctgaaggagtaaatacttctttcagtcattacagactagtttagggaggtaaatatcttctattggttttctgggctgatgagattttcactaggatcacagtcaactgcattggatcctggtcacataactactactgggtctacagtgaagttaatgcttggcagacctgttatttaagcatcagacagttgaggattccattttctgaggagactgaactttctttaagatcttgatcaataagactggtgctgagaaaaaaaaaacccagttaatatctgcaaatggagatgctgatacaataaatatgagtaggtgtggctcctgctgtttggctcttgcgagatgtttggaaatgctctaacctagtcattggacaggtttctagatgaccgttactgagcgttgatcacagctgagagggtgtgaaactaattcatagggctgcttcaggatacacagctgagaccaaagtcttcaggtttgttctgggttcatgacatttctccctccagatttctaggtgggcaggacttctccctgcctctagctgccagggactggagcttggttataggactgcttcacaattcacggtgggaataaagtcagccagcatgcctacagggacacatgtagctgtgcttttgg

SEQ ID NO: 204777 - DNA, 516 bp, Homo sapiens
gagcctctgggcatcaggctgcccaaggtgcaggctctgatggggaagaaaccggtgccgtcatggggacctcaggtagccagatgtggcctgaggagtctgtgctgtggcctcctctgtcctcaaggttaggctccagctggggaggagtgattcactcttgtaaattacagggaggctccagggaggcagatgctcccagcctgatgactggcagcaattctggggcccttacctaggttctccctgccactgcgggctccgggagctctccatggtgacctaggaactcccctgggtgcttatgctccgccgagagttgctctgttgcacattcattcaacaaacatttgtttagtgcctgtcacatgggctcagagtcagctttttgggttctgatcccagtcagggccacttcctgtggccttgggccatggcttaacgctgagcctcagcctcagaagtgccggccttgtagaggatcgatgccatcgggccagtgctcggctagggctg

SEQ ID NO: 204778 - DNA, 369 bp, Homo sapiens
gtatagtgttgaagggctgacaagagttcctaagtgcaagaaggctgcgatgtgccttgcagagaaaataggtgtattagataagcttcacttaggcatgagttacagtgctgttggctatgagttcaaggtcaataaatcaacactatatattaaggtttatttaaacagagacacacataaaacaaggttataaacagatcattaacaaaaatcttatgactagaggctcacaggaacctacccctgtatttcccccaggaacattacttcactacttgctatttcactgttaacttgactctgtagaactaatatgaataacaagattcgactatttctaaacaaacttatatgcacaagcttgat

SEQ ID NO: 204779 - DNA, 245 bp, Homo sapiens
gaagattgtgcagtatgagaacttttagcagaaagcagaaatatcagaaatctatgccttagcatcctagaagctcaaagttggagaatagtttagaggttttacatccaatgcttgatctaatgctttaatttctttaaacttacgaatgactgcgtctgttgacagtactcactgtattcttattaagtgacctattgcatgtctgatcacccaaaaattctctcattttgcttaaggatcaa

SEQ ID NO: 204780 - DNA, 416 bp, Homo sapiens
tggcaacatggatggaccttgaaagcagtatgttaagtgaaataagccagaaaaaaaaggctgcagggattctaatttagtgcacagacacctattcagcaatataactgaaacacaggaggagcaataatacaagtattcgttatgtatgataaatgaatcaaagtacaaaagtggagaataagctgaatcagccagctaaaataattgcagtgttggggctaactttgaacccaacctaatatttctgtttcagtggagcagtgttactggctttctgaatgacaggtttaaaaattactgtatggcaatgggaatatgtgattcatgagatgccaacagttagtttggctgccagcctcttacccaatatcagtttctctcttggggccatggcaagaaacaattctgactga

SEQ ID NO: 204781 - DNA, 409 bp, Homo sapiens
ctcctgacctcaggtgatctgcccacctcagcctcccaaagtgctgggattacaggcatgagccactgcacctggtcaggatgtctttccacttatttattccttcgctgatttctttcagcaatgttttgcagttttcatgtacaagtcttttcttccttagttaagtttattcataagtattttattctttttggtactattgtaaatggtgttgctttcttagtttccattttggattgttcattgttagtgtatggaaatgcaactaatttttgcatgctgactctgtagtttgcaactttactaaatttgttttttctaacattttttgaaatctttagggctttttacatttatgactatatcatctgcaaaaacagatagttttacttttcctttatgactt

SEQ ID NO: 204782 - DNA, 337 bp, Homo sapiens
cctgcgtaggggcacaactccataggtagcttggccgtgccatatgcaagcaaggccaaggtcatccgctgagggtgagagaggagctaggaagggtgactgagaagagtggagaagttcgaagtagtcatcagagagagcaagctgaccaggaaaacacagtggggttgccaggcagcactgcacgcccatttaaggatgttgagcatgaacgcaatgtgatactaagctgccctggtatgtgacttcctcagggaggtcctgactgccctggtgtgaccctggggaaagccagtggtgggttcacctaagattggcacttggcctgatgatgcaa

SEQ ID NO: 204783 - DNA, 273 bp, Homo sapiens
gctttcattcaagcaagcttcttcatcgaaagggtttggacaatgtcggattttcaaagagaagtgggggggaaaaaattaaaagtagccaagcaaaataaagtgcatggtaagaaacctgaaagcagtacaaaatattccctgatgtcaacacttcatttcaatagatcttaaaactcctattcatttccaatgaaggtactgtgagccttgccatgggcaacataactgcatgatcatattttgaaatatttggggaccacatagctttaa

SEQ ID NO: 204784 - DNA, 436 bp, Homo sapiens
ggacaatgagtagccagatgtagttaccagctgagccggttttactcaccgctttctctctgtgtctggatccagcagaaactggactgggtccaacagaaggtcttaagaaggcagggtttagggaagacaaagaatcatgagttcatctgtatccaggtagtctggaacctctccatctgggactctagctacgttcatgtataaaaattatggacccagaacctgtgtttttctaaataaatgtgtaaactttactaaagacaacttagaattacactggtcacagtgaagaaattttaacctaaacagttattcatctataagctacattgaaagagaagtgatcttaaatgcctcaaaaaaatgagatatgtttttaattggcatgcagaagcttctaaaagactaagcaaatcaaaacttgcctttctta

SEQ ID NO: 204785 - DNA, 390 bp, Homo sapiens
cagtggcatgaaagccaagacatgacgcaggtaaacgagcaagctagagagtgttctaggcaaatgtaaaagcctcaaggtagaagtctgtctgtttttgaggaaggccagagtggctggagcagagtgagtgagggagaggatggtaggaaatcagggcagggagattaataggggaccggttagtagggaccccaggaggccactgtagtgttggatattcctggatcagagtttctcaaatcattctccacaggtaatgtctattctccaagagagttttccttggcctgtggccaggctgctcaaatagaatgcagaaacaaagaatttgcctgaattctgctagccactctccaaggtcttctcctgcgatgggtggagggactt

SEQ ID NO: 204786 - DNA, 125 bp, Homo sapiens
gatgatgtcctgggatatatggttaagaaggcacccagccacacttactctgtcttgctaaggggtacaggttgatcaaaaccatttgtggccaggcgtgttggctcacgcctgtaatcccagca

SEQ ID NO: 204787 - DNA, 367 bp, Homo sapiens
aatatgtcctcagaggttatggtcaggtttcacttagggtaagaaagagaagggatgttccccttcctgtgtccatgtgatctcattgttcaattcccacctatgagtgagaatatgcgatgtttggttttttgttcttgcggtagtttactgagaatgatatatcccttggggaaaatattgcctaagtatgcaggaaaaaaaaaaatatatatatatatataaaacattaataagagagattagattgatttatagctatgctataaatgaaatgagatagattttatattgtcttataaccttatatggtaaatgttcatattacaaagttaaataaaagtttcagtggatccaatttgttgtt

SEQ ID NO: 204788 - DNA, 522 bp, Homo sapiens
ccatacttacttctcattcttggtcaataaaacaatatccacaattccagctctcactgtacaaggtctctacatgagctacagtgagtgagtgagtgagtgataaggaagagggtgaatggcaggtgcaggaatgcccatataattggtgagctctttctccagccactgtgtccaggatctatgctcagatcttaagacaatccctgtagtcctcggtagaaagcctcttaggaatcactctttcatatttagatttattcctgggaaacttaaagctacctcaaacccagttcttttgctcagagttctcaacacaattctctgagttgtctagtgagtagaaatagaagccagaggttcatggaagtccataaacgcagtgtacatgttaagcgtttaagaaaatgctgtccgtcttgaaagcagatcaggaatctaagagtcagggtcattctctgtgactgcagtcaagatgagagcaaccaactggccctcacaggaagttttgggaggcagaaa

SEQ ID NO: 204789 - DNA, 492 bp, Homo sapiens
agcacaatggttgcagagccagtgccttgaattcatatcttctgatcccagttccaggtttaggataacacgccactgctgtctctacttcggtgagagcaaaggatgatttttacttccaccactgcccccttcaacccatttttgttcagtcccagaagaccaacttgttaggaatttgaaagttttactgtgtcagccacacgtgcaaggaaaatcactccaataaaatgagaaattcttctctagaaggtaaaaatagaatcccagcagcagggcaactacaaagataaagaaaaaatagcctttaggctaaaggcaggttggtaagttaaggtggcatctaacaaacacattgggatttcctgggacttgagtgggactgcttactgaagcatttaatagaacagagtgctagattgcttagcccagattacagataaaaaagatttgaaaagaccattacataagcctaaatcttcattcaccaaa

SEQ ID NO: 204790 - DNA, 968 bp, Homo sapiens
actgcatccaacgccgcgggggagcgtgcccacatcaccctcggctgtgcagctgacgtagaggccgtgcagacgggccttgacctcttagagattctgcggcaggagaagggggggcagcgaggcgaggaggtgggcgagctaagctggggcaaagctctattccttggggcaatgggcggggttggatgcagtcagcggcgttggatgcagtcagcggcgttggatgcagtcggcgggcgttggatgcagtcagcggcgttggatgcagtcagcggcgttggatgcagtcagcggcgttggatgcagtcagcggcgttggatgcagtcggcggcgttggatgcagtcgactgcatccagccgcaggtgcagatcttggtggtagtagcaaatattcaaacgagaactttgaaggccgaagtggagaagggttccatgtgaacagcagttgaacatgggtcagtcggtcctgagagatgggcgagcgccgttccgaagggacgggcgatggcctccgttgccctcggccgatcgaaagggagtcgggttcagatccccgaatccggagtggcggagatgggcgccgcgaggcgtccagtgcggtaacgcgaccgatcccggagaagccggcgggagccccggggagacgtcgcggttccggcggcgtccggtgagctctcgctggcccttgaaaatccgggggagagggtgtaaatctcgcgccgggccgtacccatatccgcagcaggtctccaaggtgaacagcctctggcatgtttggactctgggcactgtttgaactctgggcactgtttggactctgggcactgtttggactctgggcactgtttggactctgggcactgtttggactctgggcactgtttggactctgggcactgtttggactctgggcactgtttggactctgggcactgtttggactctgggcactgtttggactctg

SEQ ID NO: 204791 - DNA, 1016 bp, Homo sapiens
  misc_feature (282)..(282): n is a, c, g, or t
cgatcgagcgcggtaccggtgttatcgatgcacagaaacactcacctaatccaggctctttgctcccgattattaaagatacttctttctacaaaagtaacaagcagacagccttgttcctgggctaagaaagcagagcgggaacctccctaagctctgatctcacgtagagagcacgaaagcttagcacgtgggctcacaaggcatggctgctcttctccagtggaatgtcagatgaaggcgacgcgcaggacacagatcccagccatgtccctccacaanacaccccaaagtggttacaggtgagccaactgatggactctcttccgctctccaagccaggcctctacccctgcatgccctgaaaatacactcatttcctaaatgagccacctggggaaagcgctggccgcaggtgcagatcttggtggtagtagcaaatattcaaacgagaactttgaaggccgaagtggagaagggttccatgtgaacagcagttgaacatgggtcagtcggtcctgagagatgggcgagcgccgttccgaagggacgggcgatggcctccgttgccctcggccgatcgaaagggagtcgggttcagatccccgaatccggagtggcggagatgggcgccgcgaggcgtccagtgcggtaacgcgaccgatcccggagaagccggcgggagccccggggagacgtcgcggttccggcggcgtccggtgagctctcgctggcccttgaaaatccgggggagagggtgtaaatctcgcgccgggccgtacccatatccgcagcaggtctccaaggtgaacagcctctggcatgtttggactctgggcactgtttgaactctgggcactgtttggactctgggcactgtttggactctgggcactgtttggactctgggcactgtttggactctgggcactgtttggactctgggcactgtttggactctgggcactgtttggactctgggcactgtttggactctgggcactgtttggactctg

SEQ ID NO: 204792 - DNA, 770 bp, Homo sapiens
gtacacgcgcccgttacatcgctggctcagcctcagtgccctctgccttctcgggaatcgggtccccaagccggtcaggacgatggctggtgctcccacagagaccatgtgctggtgcactggtgatcgagtgaatgggacagatggaaaaacagcaagcaggggagggagagaacgtggcctggtgccgttctgagcaaggccttttggtccagtccccttgataggaaataaccttccctccttccctcttgggtggcgctgcgggtgaagggatatgggctggcgggagcccctgcctgtgtatgatgggcgcgtaagggccagcagccgatcgaaagggagtcgggttcagatccccgaatccggagtggcggagatgggcgccgcgaggcgtccagtgcggtaacgcgaccgatcccggagaagccggcgggagccccggggagacgtcgcggttccggcggcgtccggtgagctctcgctggcccttgaaaatccgggggagagggtgtaaatctcgcgccgggccgtacccatatccgcagcaggtctccaaggtgaacagcctctggcatgtttggactctgggcactgtttgaactctgggcactgtttggactctgggcactgtttggactctgggcactgtttggactctgggcactgtttggactctgggcactgtttggactctgggcactgtttggactctgggcactgtttggactctgggcactgtttggactctgggcactgtttggactctg

SEQ ID NO: 204793 - DNA, 829 bp, Homo sapiens
gactgcatcaacgccgccggtgcaaaatcgtatacgtcctcatcgatgacttcaggctccaacgcaggcatgacgctgagaagctgggccacttcctggagcacgtgctgggctccggcatggtgaccgatgggaccatggccaccgaccagaggaaagtcaagatgctgtgggccctgaggggaaggatcacagaggcgctgagccgggatggctacgtgtacaagtacgatctctccctccctgtggagcggctctacgacatcgtgactgagatgagagcccgcctcggcccgcacgccaagcacgtggtgggctatggccaccttggagatgggatgggcgagcgccgttccgaagggacgggcgatggcctccgttgccctcggccgatcgaaagggagtcgggttcagatccccgaatccggagtggcggagatgggcgccgcgaggcgtccagtgcggtaacgcgaccgatcccggagaagccggcgggagccccggggagacgtcgcggttccggcggcgtccggtgagctctcgctggcccttgaaaatccgggggagagggtgtaaatctcgcgccgggccgtacccatatccgcagcaggtctccaaggtgaacagcctctggcatgtttggactctgggcactgtttgaactctgggcactgtttggactctgggcactgtttggactctgggcactgtttggactctgggcactgtttggactctgggcactgtttggactctgggcactgtttggactctgggcactgtttggactctgggcactgtttggactctgggcactgtttggactctg

SEQ ID NO: 204794 - DNA, 175 bp, Homo sapiens
cggtaacgcgaccgatcccggagaagccggcgggagccccggggagagttctcttttctttgtgaagggcagggcgccctggaatgggttcgccccgagagaggggcccgtgccttggaaagcgtcgcggttccggcggcgtccggtgagctctcgctggcccttgaaaatccgg

SEQ ID NO: 204795 - DNA, 700 bp, Homo sapiens
  misc_feature (123)..(123): n is a, c, g, or t
ggatacaggttggttccaaacacatctttctgactcagacataggcattgggtctgcccacaagtgacaatgcggtcggtcttgggagcccagtcaatacctggtgatgtgtccggtggtctncttgagttcatgagctttcaaccactggctcccgttcttcttatagatttgcccttcgggattattgggacttggggccatcttggtacgatccctgttcccaggcattacagggtggattggctctagtaaaaaactgttgcagtgacatttattctttagcgttttcaaaaggagagaaagctgggatcgggggagtccggacgggctcggagcggaggattcgcggactctgggcagtcgacgcgaacaggctccgtcgcggttccggcggcgtccggtgagctctcgctggcccttgaaaatccgggggagagggtgtaaatctcgcgccgggccgtacccatatccgcagcaggtctccaaggtgaacagcctctggcatgtttggactctgggcactgtttgaactctgggcactgtttggactctgggcactgtttggactctgggcactgtttggactctgggcactgtttggactctgggcactgtttggactctgggcactgtttggactctgggcactgtttggactctgggcactgtttggactctgggcactgtttggactctg

SEQ ID NO: 204796 - DNA, 779 bp, Homo sapiens
gtaatctagaggatccctcttgcgtccatcaggaagaagaaacgaggaagcagcaagaactcgaagccttgcagaaagagccagaaggaagctgaactgacccgtgaactggtagaaacagaaggaaaataagctgatgggagaagactggccatcttgctcccaatcagggccgcaggtgcagatcttggtggtagtagcaaatattcaaacgagaactttgaaggccgaagtggagaagggttccatgtgaacagcagttgaacatgggtcagtcggtcctgagagatgggcgagcgccgttccgaagggacgggcgatggcctccgttgccctcggccgatcgaaagggagtcgggttcagatccccgaatccggagtggcggagatgggcgccgcgaggcgtccagtgcggtaacgcgaccgatcccggagaagccggcgggagccccggggagacgtcgcggttccggcggcgtccggtgagctctcgctggcccttgaaaatccgggggagagggtgtaaatctcgcgccgggccgtacccatatccgcagcaggtctccaaggtgaacagcctctggcatgtttggactctgggcactgtttgaactctgggcactgtttggactctgggcactgtttggactctgggcactgtttggactctgggcactgtttggactctgggcactgtttggactctgggcactgtttggactctgggcactgtttggactctgggcactgtttggactctgggcactgtttggactctg

SEQ ID NO: 204797 - DNA, 615 bp, Homo sapiens
aaagatcctcccacctcagccttccaagtagttcagactacaggcacgcaccaccatacgtagctaacttttgtacttttttatagagccagagtcttgctttgttgcctgggctggtctcaaactcctggcctcaaatgatcctcccacctcagcctcctgaagtactgggactaaagatgcatgcaccccacccggcctcagtcagtatttgtcattgattatcatcttgtctttcatcatcattaatgatgcctgactcagaagaggaaaccagtggctattagttgaacaaacggggataataatattataataatgactgatgtttgttaccactattatttgaagcatgtagcagtcacagggcacacccaccatgtgccaagtacgtcggacacttccagccaagagtacatgagccatggtttccttgtgcctctgttgtgaggaacatcactaatagaggtacctgtcccaccccacccgccagcctccaaagtccctggcaggcatatctcctcctttggctcaaaccactgctcccagagcacttaccagcctgtacaattctctgttggcatgggtctggcttttagatcaccttggaattcc

SEQ ID NO: 204798 - DNA, 922 bp, Homo sapiens
  misc_feature (665)..(665): n is a, c, g, or t
tggcgactctcgcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaaaatgcccccaaagcaaaaaaaaaaaaaaaaaaaaaaaaaaaaaaaaaaaaaaaaaaaaaaaaaaaaaaaagaggggcgggccgcccaaaaaattcccccgggggggccccattggcgcccccccgctttttttgtacacaagggggggcgccccattatgaagcgagcggcgcatattattaatgacgacagaggaagcgcagacgcccgccgtggtatataaaacaagcgccgcgcgacgagcagggaagaaacgcggtcgccccacctggggagaactccctttgggggaaaaaaggaaccacaccacagtgtctgagggggggggggggcaagaccaatatagttggcgggcgaancaactctcatcccctccggaggaatatgtattaaacagccccatcgagcgggggaaaaatatatacaaacaacgttcttaaaggggggttgtacattacttggggtggtgcacacccaaacacggctgcgcatatatattcgcctgcggcgggcatgtgggagaaaaacctgttgtcctctcaccgccgagtagtgttgttctgttacgagacaactattttttcgcccggggggcgcggttgtctagaaataatgt

SEQ ID NO: 204799 - DNA, 352 bp, Homo sapiens
ggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaaaatgcccccaaagcactatgctggtcatgaactgcttcaaaatgtggaggtaataaaatgcaactgtg

SEQ ID NO: 204800 - DNA, 291 bp, Homo sapiens
cgaggttacaaaagtgcactcttctacatctacgtggtatcatctccctggttcattcaggcccttatcatgcctcatctttttaaaaaggttttattaattttaattggcacataataattatacatattaatggggtacaatgtgatgttttgatacatgtatacattgtgtaatgatcaaatcagggtaattaggatatctgtcatcttaaatatttattgtttctttgtggtaagaacattgaaaatccttcattctagctatgttgaaacatacaacacattatta

SEQ ID NO: 204801 - DNA, 672 bp, Homo sapiens
ttggtgcatttttacagagtgctgattggtgcatttacaatcctttagccacagagtgctgattggtgcatttacaatcctttagctagacacagagcactgattggtgcattgttatagagtgctgcttggtgcatttacaatcctttagctagacacagagcgctgattggtgcgtttttacagagtgctgattggtatatttacaatcctttagctagacacagagcactgattggtgtgtttataatcctctagctagacagaaaagttccccaagtccccactcgacccaggaagtccagctggtttcacctctcactagtaggaggagattaaaaacgaatgccaaatcaaacataaaattatagaaatctatcataggattatattagaagactgactttatttatataagtagttctaaatttagtctgccttttaactggatctctgagcttctggcagagcccacactgaattccgggtctccaaaaagagaattattatgaggctaagaccatgtgatggttttatgagtgcactctccttttttttttttttaacaaaaatgtttctctaagtgtctgaactactctcttcctaactttaaacacccaacagtaacctctgttgttactctttgactaaaataattattttagttaaaaa

SEQ ID NO: 204802 - DNA, 450 bp, Homo sapiens
taattgcagtttttgccactgaaagtaatggaaaaaccacaattacttttgcaccaacctaataatttgtaaaatcttagcaacaggttgtcacctaatacagtcagctattgtttattgagtagtttcttttggctaggcttttttgtattttttgggtcttagctaattttcattataaccttgtgtgccaagtaacatgactataccctgcttagatggggaaattcaggcaggaaaaagcgtcaacttcctcaaggctgcaagaggagtaattctttgcagtgttatttgaacctgtgcttttagtgactggtccattttggctttccatgtagcatatagataggcaaagaatttgagagcaaagaatcacttctctttgctcccaaatttctgggccttcatttagctcatttgtaaaatttatgtgagtagatgagtgagtct

SEQ ID NO: 204803 - DNA, 375 bp, Homo sapiens
acatggacctactcagtatcagatttcagttcttagatttaccatcaacattctaccgacttaaaggccttaccttcctgctgcagaagttggagtattttaaaaacaagagaacacttgaaagtggatgcagaatactacttttataatagaacgtgaggttgctctttttattttctccctccaggtgccgattttatataatttttaggttattctctgatgataagagatttggttatttctatatacttacttggaagaataaatttactcttgatattttaaaattgttgaaatgttctgcgtcagaaatttttcttttcaactgcaattgttctctgtagtctttatggattaagagggcattttaaa

SEQ ID NO: 204804 - DNA, 313 bp, Homo sapiens
aaaggagagaaagacaactatcttagaaacatatttaaagcacatgatgaaaaagaagaggtttttaaaaactgttgaaaatacattttctttgtaccaggtaccagatgttgatgttggcagtgcctcagagggtcacagggcatttaaaatcactaggctgtagggagtaaaattccagatctcttgcactgaaaattatttaaaaattatctttacttagcgataagtagtacaagagtactttttctatgaattcctcttaaataggtaccttagaaatacatgatcaatgaaattgccagaaaaaaaa

SEQ ID NO: 204805 - DNA, 211 bp, Homo sapiens
ctggctccagcttaccctattactcccagtctgagagagaacatcagctgagccctccttgggggccggaggcagaatgggtctccctgggcaggtgaggagcagcactacattagagcctgctgttgcccctcaacccttgctgtgctaccctccagccaggaggctcctgctctccagctctggctggtttactgctttcctcttccca

SEQ ID NO: 204806 - DNA, 292 bp, Homo sapiens
gccgggattgtgccactacactccagcctggtgacagagtgggactccatctcaaaaaaaactttaatagcttcctgtaatgcggagcataaaactcaaactccttaacagggatgagttggttttctgccttttcatttgaatcaaccatttagccccatgggccgtctgtgtgccttctaaaatggcaagttctttcctgtctcaagtctttttgtgctattctgccctgcagctctcttctccacattgttcagatagctgacttcttatcctctagaccagatacatc

SEQ ID NO: 204807 - DNA, 161 bp, Homo sapiens
gtggaaagaaataaaataaaattaaaaaatcctggaagcttgtaaagaatgtgagcaaaggggaggaagttgtgaaaaaaatgaataaagggcaccgatccagagtattgaagaaggcagagtggagagcctagtaatgagtatctggtacctcagtatcc

SEQ ID NO: 204808 - DNA, 659 bp, Homo sapiens
gttaggtgaaagaaaagcacctaaatgtttctcacaaagctttggttcttaattctaatatgagacaacagaatggcgtgggagttgacttagccctaaacattctagatctttaaagttttcgttggtccttccacagactgcagactgagctcacaggagtgtgtccatgatgcaaacagaagtatcttataggtgccaaaggatggacttaccttttcctgccttttaccaacatatttgcaacagaaaaaggatcatgtgaacagatatcacctagggtagctgtcatttggaatttgtgtaattattagaatttgtacaaaacacagaatatccctttttttaaatccattcattctacatttgcactcttttccctcccactatcccaggaagttacttaattattcagtggctcttctagctgttatgcattaagaattcctattgttggcacaaaatccatcatttaagcctcatcttgaggaggttgtcatcttcttatttctgatatgtctgtgaaatactgcattttttagcatatttgtgtgtaccctggagggttgtttgcaaatacatattgcctgtgttgtgcatttatctgtaaaatgccggaatttcttacacttttaatgggtcttgagtaatgactttgt

SEQ ID NO: 204809 - DNA, 441 bp, Homo sapiens
gttaggtgaaagaaaagcacctaaatgtttctcacaaagctttggttcttaattctaatatgagacaacagaatggcgtgggagttgacttagccctaaacattctagatctttaaagttttcgttggtccttccacagactgcagactgagctcacaggagtgtgtccatgatgcaaacagaagtatcttataggtgccaaaggatggacttaccttttcctgccttttaccaacatatttgcaacagaaaaaggatcatgtgaacagatatcacctagggtagctgtcatttggaatttggattgataggaatgttcacataaacaccagcagtggctaactgttacacaacattcaaagtattcgagagaactgcctggagacagagagcgagggtccacagacacattagcaccatactgatatgccattcttgctg

SEQ ID NO: 204810 - DNA, 668 bp, Homo sapiens
gaccctataatcacggctacatgtcctgtgtggataggcgtgttgcaccacgtcgtgtactcggtgatcatcccgggggcttttacactctaactttaatattcctcaaacacaccaagctcattgctacctcagagtctttatacttcctgtttctgttaccaagaatattcttctgatggctcatactttcatatcactgagatctctaatcaaaagttacttccttagagctgatttccctcactaccctactatcaggaatagccctcaaaaaaaccactattacctctttactctttattctcttgccttattattctttatcatacttatcattgtctggcattatgtcatttatttgtttattgtcttctcccctatttctttttacttctgtatccgcagcaccttgaacagtgcctagaacaatgtgggcacttagtaataatacattaaataaaataatctatatgccagtatgtctaatttcctttacgagactgcaagctactcaagggcagaatttgtgttgtttcatcagtgtatgctcacagcacctactacaaaatggcacaaagtaagcatttatcatactgcctaaggaccaggtgccagtcctctcagcatgtgacacagctaattattcctttcttcttttttttttt

SEQ ID NO: 204811 - DNA, 682 bp, Homo sapiens
ctatctcccatccactcctccttactgtggcctacaaggtcctgtgtgatatggccctgctgctcctcactttatttcctatcattcctggagcttttacactctaactttaatattcctcaaacacaccaagctcattgctacctcagagtctttatacttcctgtttctgttaccaagaatattcttctgatggctcatactttcatatcactgagatctctaatcaaaagttacttccttagagctgatttccctcactaccctactatcaggaatagccctcaaaaaaaccactattacctctttactctttattctcttgccttattattctttatcatacttatcattgtctggcattatgtcatttatttgtttattgtcttctcccctatttctttttacttctgtatccgcagcaccttgaacagtgcctagaacaatgtgggcacttagtaataatacattaaataaaataatctatatgccagtatgtctaatttcctttacgagactgcaagctactcaagggcagaatttgtgttgtttcatcagtgtatgctcacagcacctactacaaaatggcacaaagtaagcatttatcatactgcctaaggaccaggtgccagtcctctcagcatgtgacacagctaattattcctttcttcttttttttttt

SEQ ID NO: 204812 - DNA, 302 bp, Homo sapiens
caatgaaagtacagcataccaaaactcctgagatacagcaaaaatagtggtaaaagggaagtttatagcaatgaatgcctacattaaaaagaagaaaaaccacaaataaaaaacctaactctataccacaaggaactagaataataaaaacaaattaaacccacagttatcagaagaaggaaataatacagattacagcagaaggaaacaagatagagaataaaataacaatagaaaaacatcaatgaaactcaggttggctttttgaaagacaaaattgacaaacctttagctagactaag

SEQ ID NO: 204813 - DNA, 130 bp, Homo sapiens
ggggagggggtgttgctggagcccgagtctaacagagtctaacagaaagctcattaagacccacagcaagttgaggcctgtcagtaatgagtacttttatgctgttttctacagaaatttcacttcaaaa

SEQ ID NO: 204814 - DNA, 691 bp, Homo sapiens
aaaattctagtgaggtgtgaccttgcaaagatttttccagagtatttctggaggatgccgaacttgagtgaattgttaacatgtctaacagtattcctgtggtcactcctgaattggatttttaactatgttagctccagatgcgaagaaagtatataataatagaaaatgactgttctccatcttttaaacagaaaatttgttaataaaaatttcttcaggccatctcactacatggtccccgaagcactttctcctgagtaaaccaataggctctgactctttctcaacctcttatgataaaaactgttttgatgtactgttggattcagtttgccagtattttgttgaggattttgtatcgatgttcataaaggatattggcctgaagttttcttcttttatgtgtctctgccaggttttaatatcaggatgatgctggcctcatagaatgagttagggaggagtccctcttcctcaatttttggaatagtttcagcaggaatggtaccagctcttctttgtacatctggtagaattcagctgtgtatctatctggttctgggtttttatgttaagtaagctatttattactgactcagtttcagagctcattattggtctgttcaagatttaatttctccctggttcagtcttgggagggtgtatgtgtccaggaatttatccattt

SEQ ID NO: 204815 - DNA, 528 bp, Homo sapiens
aactgcacggcttctccctgtcctgttcaaacgcagaagcaaatgtcacacttttctgcttcaggagatacctaaaattcatgtggccattgcaggaaatcactgaaccccagacagatctgcaagcggagaattcagacctccaagtggatagagttattacatttttcctcacacctgctgtctttcaatctaagacctcttcctcttgaaaattcttaattttgtgccacgccagcaccctctgctggtactagtgtcgtcattcaggtggtttctgtgcccctggagttgcgttctttcctgaaactaacttctcttaccttaaatcctggactagtggatagtgctcttcattgccttccatcaagacacacacacaaatgaagcaagatgaagtgtaaaaaggttgtgagttaattaaaatcacatttcagtttattgtacttttgcctgagcaacccctttgtttgtgtatttcatattattttgaaatataggataattaaaagtggttttattttctgg

SEQ ID NO: 204816 - DNA, 783 bp, Homo sapiens
gaggcagggaaatcgcttgaacccgggaggcagaagttggagtgagctgacatcatgccactgcactccagcctggtgacagagcgagacttcatcccaaaaaaaaaaagaaaagaaaaagaaaaaaagctagctttctgtgctacccagagaggggtccatacagtgttgttctggattcctgttgtaacttaaagggaaactttcacaatgtccagagcccttgatgtcctcaaatttcttgcagcaggaagtcacttaggtgacactaactttgatttccaaatggaatgatagtacatctaaaaatgaaggtgatggcatctatatcataatcttttttttttctaacaagatccaaagtccacaaatatatcataaatctgaagaggaactgggagaagcttctgctggcagctcatgccattgttgccattgaaaaccctgctgatgtgtcatatcctgcaggaatactagctagtgggctgtgctgaagtttgctgctgctgctggagccacatgtattgctggtcacttcacttctggaacctttgctaaccagatccaatcatcttctgccacccacatcttctggtggttactgattctagggctaactatcagcctctctcaggggcttcttatggtaacctacctacctaccactgctgtatgtaacagattctcctctgagctatgtggatattgtcatcccatgcaacaacaaggaagctcaatcactgagtctaatgtagtggatgctggcccaggaagctctgtgca

SEQ ID NO: 204817 - DNA, 2230 bp, Homo sapiens
  misc_feature (59)..(59): n is a, c, g, or t
  misc_feature (131)..(131): n is a, c, g, or t
cccatttcaggtgggacttgtggcataggagaggtcttgggactggtgcccagcctggngcagtcccctcccaaagcctccctctcccacacagccgtgagagcctgtgggcctagaggactcagctggcnggttgcagggaggcgcagccttttgcaatcccccagggccacaggttaccctccttctctctctagacccccagctctaccaggagatccaggagcggggcctgaacaccagccaggagtctgatgacgacatcctcgatgagtcctccagccccgagggaacccagaaggtggacgccaccattgtggtcaagagctaccggcccgcccaggtcacctggagccagctcccggaggtggtggaattgggcatcctggaccagctctccactgaggagcggaaaaggcaggaggccatgttcgagatcctcacgtcggagttctcctaccagcacagcctgagcatcctggtggaggagttcctgcagtccaaggagctgcgggcgaccgtgacccagatggagcaccaccacctcttctccaacatcctggatgtcctgggtgccagtcagaggttcttcgaggacctggagcagcggcacaaggcccaggtgctggtcgaggacatcagtgacatcctggaggagcacgctgagaagtacttccacccctacatcgcctactgctccaacgaggtctaccaacagcgcacgctgcagaagctgataagcagcaacgccgccttccgagaggccctgagagagattgagaggcggccggcgtgcgggggcctgcccatgctctccttcctgatcctccccatgcagcgggtgacccggctgcccctcctgatggatacgctctgcctcaagacccagggccactccgaaaggtacaaggctgccagccgtgcactgaaggccatcagcaagctggtgaggcagtgcaacgagggggcccacaggatggagcgcatggagcagatgtacacgctgcacacacagctggacttcagcaaggtcaagtccctcccactgatctccgcctcccggtggctgctgaagcgcggagagctgttcttagtggaagaaaccggactttttcgaaaaattgccagccggccaacgtgctaccttttcctgttcaacgatgtcctggttgtgaccaagaagaagagcgaggagagctacatggtccaggactacgcccagatgaaccacatccaggtagagaagatagagccgtctgagctccctctgcccgggggcggcaaccgtagctcctccgtgccccaccccttccaggtgaccctgcttcgcaacagcgagggccgccaggagcagctcctgctctcctcggactccgcgagtgaccgggcacggtggatcgtggcgctcacacacagtgagagacagtggcagggcctctccagcaaaggagacctgccccaggtggagatcaccaaggccttcttcgcgaagcaagcagacgaggtcacactgcagcaggcggacgtggtcctggttctgcagcaggaggatgggtggctctatggcgagaggctccgggacggagagacgggatggttccccgaggactttgcccgcttcatcaccagccgtgtggccgtggagggcaatgtccgcaggatggagcgtctgcgggtggagacggacgtgtagccctggcgaggccagccggcggcagcacagcctgtccccaatcagcaagtggtcgtgcctggctctagagagcgtggggagctggtctcaaggacccagcatggttccctggggcttcccaagagcctgtggctgtggtgccgggctccagacacttcacggaaggaagatcacatgtccccagagaggcacccccaggcaagctcgagggggccacaccgtgtcccagggagcccagcctattcccgttggctggctgggcccctctcagctgctgggccccacctccccactgcacccaggggacaactccacctggactgatgggcacaggaggcaccaatagcgattattgggggcaatgcgaggtctcctcctatgcccttcctacccctgagtgggacaagaagggccttgagtgcccaggagtgccccacgttctgagaaggggccggccggagggaggggacccggcagggagatttcggttttgaggtttctaaatacattaaagttatttcttaagaaaaaagattt

SEQ ID NO: 204818 - DNA, 2809 bp, Homo sapiens
agcgaagcggctgcaggacaggacaggacccggcgctggaagctgcaccgccagcgcgccgcccctccgtccctccgccccgcggcgcaggtgagcctgggggacaggtgagccgggggacaggaccccacagccgcccagcatggcccagcggcactcagacagctccttggaggagaagctcctgggacaccgcttccactcggagctccggctcgatgccggggggaacccagcctccgggctcccaatggtccgtggctccccgcgtgttagagacgatgccgccttccagccccaggtcccggcacccccacagcctcggcccccggggcacgaggagccatggcccatcgtcctgagcacagagagcccggcggccctcaagctgggcacccaacagctgatccctaagagcctggctgtggccagcaaggcaaagaccccagcccgccaccagagcttcggggcggctgtacttagcagggaggccgcccggcgggaccctaagctcctcccagcccccagcttctccctggatgacatggacgtggacaaggaccccgggggcatgctgaggcggaacctgcggaaccaatcctaccgggcggccatgaagggcctggggaagccaggtggccagggagatgccatccagctaagccctaagctccaggctctggctgaggaacccagccagcctcatactcggagcccggccaaaaacaagaagacgctggggaggaaacgtgggcacaagggttccttcaaggacgacccccagctctaccaggagatccaggagcggggcctgaacaccagccaggagtctgatgacgacatcctcgatgagtcctccagccccgagggaacccagaaggtggacgccaccattgtggtcaagagctaccggcccgcccaggtcacctggagccagctcccggaggtggtggaattgggcatcctggaccagctctccactgaggagcggaaaaggcaggaggccatgttcgagatcctcacgtcggagttctcctaccagcacagcctgagcatcctggtggaggagttcctgcagtccaaggagctgcgggcgaccgtgacccagatggagcaccaccacctcttctccaacatcctggatgtcctgggtgccagtcagaggttcttcgaggacctggagcagcggcacaaggcccaggtgctggtcgaggacatcagtgacatcctggaggagcacgctgagaagtacttccacccctacatcgcctactgctccaacgaggtctaccaacagcgcacgctgcagaagctgataagcagcaacgccgccttccgagaggccctgagagagattgagaggcggccggcgtgcgggggcctgcccatgctctccttcctgatcctccccatgcagcgggtgacccggctgcccctcctgatggatacgctctgcctcaagacccagggccactccgaaaggtacaaggctgccagccgtgcactgaaggccatcagcaagctggtgaggcagtgcaacgagggggcccacaggatggagcgcatggagcagatgtacacgctgcacacacagctggacttcagcaaggtcaagtccctcccactgatctccgcctcccggtggctgctgaagcgcggagagctgttcttagtggaagaaaccggactttttcgaaaaattgccagccggccaacgtgctaccttttcctgttcaacgatgtcctggttgtgaccaagaagaagagcgaggagagctacatggtccaggactacgcccagatgaaccacatccaggtagagaagatagagccgtctgagctccctctgcccgggggcggcaaccgtagctcctccgtgccccaccccttccaggtgaccctgcttcgcaacagcgagggccgccaggagcagctcctgctctcctcggactccgcgagtgaccgggcacggtggatcgtggcgctcacacacagtgagagacagtggcagggcctctccagcaaaggagacctgccccaggtggagatcaccaaggccttcttcgcgaagcaagcagacgaggtcacactgcagcaggcggacgtggtcctggttctgcagcaggaggatgggtggctctatggcgagaggctccgggacggagagacgggatggttccccgaggactttgcccgcttcatcaccagccgtgtggccgtggagggcaatgtccgcaggatggagcgtctgcgggtggagacggacgtgtagccctggcgaggccagccggcggcagcacagcctgtccccaatcagcaagtggtcgtgcctggctctagagagcgtggggagctggtctcaaggacccagcatggttccctggggcttcccaagagcctgtggctgtggtgccgggctccagacacttcacggaaggaagatcacatgtccccagagaggcacccccaggcaagctcgagggggccacaccgtgtcccagggagcccagcctattcccgttggctggctgggcccctctcagctgctgggccccacctccccactgcacccaggggacaactccacctggactgatgggcacaggaggcaccaatagcgattattgggggcaatgcgaggtctcctcctatgcccttcctacccctgagtgggacaagaagggccttgagtgcccaggagtgccccacgttctgagaaggggccggccggagggaggggacccggcagggagatttcggttttgaggtttctaaatacattaaagttatttcttaagaaaaaagattt

SEQ ID NO: 204819 - DNA, 2776 bp, Homo sapiens
agcgaagcggctgcaggacaggacaggacccggcgctggaagctgcaccgccagcgcgccgcccctccgtccctccgccccgcggcgcaggaccccacagccgcccagcatggcccagcggcactcagacagctccttggaggagaagctcctgggacaccgcttccactcggagctccggctcgatgccggggggaacccagcctccgggctcccaatggtccgtggctccccgcgtgttagagacgatgccgccttccagccccaggtcccggcacccccacagcctcggcccccggggcacgaggagccatggcccatcgtcctgagcacagagagcccggcggccctcaagctgggcacccaacagctgatccctaagagcctggctgtggccagcaaggcaaagaccccagcccgccaccagagcttcggggcggctgtacttagcagggaggccgcccggcgggaccctaagctcctcccagcccccagcttctccctggatgacatggacgtggacaaggaccccgggggcatgctgaggcggaacctgcggaaccaatcctaccgggcggccatgaagggcctggggaagccaggtggccagggagatgccatccagctaagccctaagctccaggctctggctgaggaacccagccagcctcatactcggagcccggccaaaaacaagaagacgctggggaggaaacgtgggcacaagggttccttcaaggacgacccccagctctaccaggagatccaggagcggggcctgaacaccagccaggagtctgatgacgacatcctcgatgagtcctccagccccgagggaacccagaaggtggacgccaccattgtggtcaagagctaccggcccgcccaggtcacctggagccagctcccggaggtggtggaattgggcatcctggaccagctctccactgaggagcggaaaaggcaggaggccatgttcgagatcctcacgtcggagttctcctaccagcacagcctgagcatcctggtggaggagttcctgcagtccaaggagctgcgggcgaccgtgacccagatggagcaccaccacctcttctccaacatcctggatgtcctgggtgccagtcagaggttcttcgaggacctggagcagcggcacaaggcccaggtgctggtcgaggacatcagtgacatcctggaggagcacgctgagaagtacttccacccctacatcgcctactgctccaacgaggtctaccaacagcgcacgctgcagaagctgataagcagcaacgccgccttccgagaggccctgagagagattgagaggcggccggcgtgcgggggcctgcccatgctctccttcctgatcctccccatgcagcgggtgacccggctgcccctcctgatggatacgctctgcctcaagacccagggccactccgaaaggtacaaggctgccagccgtgcactgaaggccatcagcaagctggtgaggcagtgcaacgagggggcccacaggatggagcgcatggagcagatgtacacgctgcacacacagctggacttcagcaaggtcaagtccctcccactgatctccgcctcccggtggctgctgaagcgcggagagctgttcttagtggaagaaaccggactttttcgaaaaattgccagccggccaacgtgctaccttttcctgttcaacgatgtcctggttgtgaccaagaagaagagcgaggagagctacatggtccaggactacgcccagatgaaccacatccaggtagagaagatagagccgtctgagctccctctgcccgggggcggcaaccgtagctcctccgtgccccaccccttccaggtgaccctgcttcgcaacagcgagggccgccaggagcagctcctgctctcctcggactccgcgagtgaccgggcacggtggatcgtggcgctcacacacagtgagagacagtggcagggcctctccagcaaaggagacctgccccaggtggagatcaccaaggccttcttcgcgaagcaagcagacgaggtcacactgcagcaggcggacgtggtcctggttctgcagcaggaggatgggtggctctatggcgagaggctccgggacggagagacgggatggttccccgaggactttgcccgcttcatcaccagccgtgtggccgtggagggcaatgtccgcaggatggagcgtctgcgggtggagacggacgtgtagccctggcgaggccagccggcggcagcacagcctgtccccaatcagcaagtggtcgtgcctggctctagagagcgtggggagctggtctcaaggacccagcatggttccctggggcttcccaagagcctgtggctgtggtgccgggctccagacacttcacggaaggaagatcacatgtccccagagaggcacccccaggcaagctcgagggggccacaccgtgtcccagggagcccagcctattcccgttggctggctgggcccctctcagctgctgggccccacctccccactgcacccaggggacaactccacctggactgatgggcacaggaggcaccaatagcgattattgggggcaatgcgaggtctcctcctatgcccttcctacccctgagtgggacaagaagggccttgagtgcccaggagtgccccacgttctgagaaggggccggccggagggaggggacccggcagggagatttcggttttgaggtttctaaatacattaaagttatttcttaagaaaaaagattt

SEQ ID NO: 204820 - DNA, 1464 bp, Homo sapiens
agcgaagcggctgcaggacaggacaggacccggcgctggaagctgcaccgccagcgcgccgcccctccgtccctccgccccgcggcgcaggtgagcctgggggacaggtgagccgggggacaggaccccacagccgcccagcatggcccagcggcactcagacagctccttggaggagaagctcctgggacaccgcttccactcggagctccggctcgatgccggggggaacccagcctccgggctcccaatggtccgtggctccccgcgtgttagagacgatgccgccttccagccccaggtcccggcacccccacagcctcggcccccggggcacgaggagccatggcccatcgtcctgagcacagagagcccggcggccctcaagctgggcacccaacagctgatccctaagagcctggctgtggccagcaaggcaaagaccccagcccgccaccagagcttcggggcggctgtacttagcagggaggccgcccggcgggaccctaagctcctcccagcccccagcttctccctggatgacatggacgtggacaaggaccccgggggcatgctgaggcggaacctgcggaaccaatcctaccgggcggccatgaagggcctggggaagccaggtggccagggagatgccatccagctaagccctaagctccaggctctggctgaggaacccagccagcctcatactcggagcccggccaaaaacaagaagacgctggggaggaaacgtgggcacaagggttccttcaaggacgacccccagctctaccaggagatccaggagcggggcctgaacaccagccaggagtctgatgacgacatcctcgatgagtcctccagccccgagggaacccagaaggtggacgccaccattgtggtcaagagctaccggcccgcccaggtcacctggagccagctcccggaggtggtggaattgggcatcctggaccagctctccactgaggagcggaaaaggcaggaggccatgttcgagatcctcacgtcggagttctcctaccagcacagcctgagcatcctggtggaggagttcctgcagtccaaggagctgcgggcgaccgtgacccagatggagcaccaccacctcttctccaacatcctggatgtcctgggtgccagtcagaggttcttcgaggacctggagcagcggcacaaggcccaggtgctggtcgaggacatcagtgacatcctggaggagcacgctgagaagtacttccacccctacatcgcctactgctccaacgaggtctaccaacagcgcacgctgcagaagctgatagcagacacgcgccttcgagaggcctgagagaatgaaagcggcgcgtgcggggcctgcatggtccctcgaacccccggcggggaccggtgcctctgaggacgctgctcaacggccccaggcagggcccccccgcgccacatgggctc

SEQ ID NO: 204821 - DNA, 2588 bp, Homo sapiens
agcgaagcggctgcaggacaggacaggacccggcgctggaagctgcaccgccagcgcgccgcccctccgtccctccgccccgcggcgcaggtgagcctgggggacaggtgagccgggggacaggaccccacagccgcccagcatggcccagcggcactcagacagctccttggaggagaagctcctgggacaccgcttccactcggagctccggctcgatgccggggggaacccagcctccgggctcccaatggtccgtggctccccgcgtgttagagacgatgccgccttccagccccaggtcccggcacccccacagcctcggcccccggggcacgaggagccatggcccatcgtcctgagcacagagagcccggcggccctcaagctgggcacccaacagctgatccctaagagcctggctgtggccagcaaggcaaagaccccagcccgccaccagagcttcggggcggctgtacttagcagggaggccgcccggcgggaccctaagctcctcccagcccccagcttctccctggatgacatggacgtggacaaggaccccgggggcatgctgaggcggaacctgcggaaccaatcctaccgggcggccatgaagggcctggggaagccaggtggccagggagatgccatccagctaagccctaagctccaggctctggctgaggaacccagccagcctcatactcggagcccggccaaaaacaagaagacgctggggaggaaacgtgggcacaagggttccttcaaggacgacccccagctctaccaggagatccaggagcggggcctgaacaccagccaggagtctgatgacgacatcctcgatgagtcctccagccccgagggaacccagaaggtggacgccaccattgtggtcaagagctaccggcccgcccaggtcacctggagccagctcccggaggtggtggaattgggcatcctggaccagctctccactgaggagcggaaaaggcaggaggccatgttcgagatcctcacgtcggagttctcctaccagcacagcctgagcatcctggtggaggagttcctgcagtccaaggagctgcgggcgaccgtgacccagatggagcaccaccacctcttctccaacatcctggatgtcctgggtgccagtcagaggttcttcgaggacctggagcagcggcacaaggcccaggtgctggtcgaggacatcagtgacatcctggaggagcacgctgagaagtacttccacccctacatcgcctactgctccaacgaggtctaccaacagcgcacgctgcagaagctgataagcagcaacgccgccttccgagaggccctgagagagattgagaggcggccggcgtgcgggggcctgcccatgctctccttcctgatcctccccatgcagcgggtgacccggctgcccctcctgatggatacgctctgcctcaagacccagggccactccgaaaggtacaaggctgccagccgtgcactgaaggccatcagcaagctggtgaggcagtgcaacgagggggcccacaggatggagcgcatggagcagatgtacacgctgcacacacagctggacttcagcaaggtcaagtccctcccactgatctccgcctcccggtggctgctgaagcgcggagagctgttcttagtggaagaaaccggactttttcgaaaaattgccagccggccaacgtgctaccttttcctgttcaacgatgtcctggttgtgaccaagaagaagagcgaggagagctacatggtccaggactacgcccagatgaaccacatccaggtagagaagatagagccgtctgagctccctctgcccgggggcggcaaccgtagctcctccgtgccccaccccttccaggtgaccctgcttcgcaacagcgagggccgccaggagcagctcctgctctcctcggactccgcgagtgaccgggcacggtggatcgtggcgctcacacacagtgagagacagtggcagggcctctccagcaaaggagacctgccccaggtggagatcaccaaggccttcttcgcgaagcaagcagacgaggtcacactgcagcaggcggacgtggtcctggttctgcagcaggaggatgggtggctctatggcgagaggctccgggacggagagacgggatggttccccgaggactttgcccgcttcatcaccagccgtgtggccgtggagggcaatgtccgcaggatggagcgtctgcgggtggagacggacgtgtagccctggcgaggccagccggcggcagcacagcctgtccccaatcagcaagtggtcgtgcctggctctagagagcgtggggagctggtctcaaggacccagcatggttccctggggcttcccaatagcgattattgggggcaatgcgaggtctcctcctatgcccttcctacccctgagtgggacaagaagggccttgagtgcccaggagtgccccacgttctgagaaggggccggccggagggaggggacccggcagggagatttcggttttgaggtttctaaatacattaaagttatttcttaagaaaaaagattt

SEQ ID NO: 204822 - DNA, 592 bp, Homo sapiens
ttttatcttctccagcattttgtccctgtcagcacatcagagctaaacataagtcatcagtcaaaaggcagtctcagccaggtgcagtggctcacacctgtaatcccagcactttcgtattagagcctttcttcaaatgcctgctgacctttggttgtccattcataaattgactaattagtccattaaaaagtcgactgaaagctctgtgtttgtggatgtggcttgttctctgagggatttcatagcaagatgattggttggggacctgatcatttcattaggaaacctccagatgtcattatctgtatgtattttagctagagctttcagcttctccagaggtaagtctgtatctgctgccagtgtcttggaaccaagttggtttagagatctgactccatgccaccagcaggttttcttcagtctctctgtgttcagtaaaatgcttcattgcttcctttgctgggcctggcacaccgaagtgtagagcctctctggttcaattttatgagaaaacaaacttcctgttccttatgatggtagaataagaatagttgctggctctatgagaggaaggtatgaatcagag

SEQ ID NO: 204823 - DNA, 479 bp, Homo sapiens
caatagtacaccagataggtcaaccatgaataatataaaatagtaataaaaatagataacacagcacacagatacaaacacaaggtgataaaaaaaaccaagaggataaggggagggaggcacatgtgcatgaggaaggcacagtaagaaagctgaatcctcaaccagggcgggaagtcagttctcaaaatccaaagctaagaagtcaagacagatagacaaagttatttaaaaacacagcggcaaataccaaaaggaagaattttaaagctatgaatattctggtgtatttcaggatttcttagtgggaaaaaatctttttcattgttgtttgaggaaatttactcagcagactatattcaataacgtaacctaaggttttatttctcagaccttctctttccagtacctcctatctatatagataatttggaagccagggagaagaatgggaaccgaagatctatgagcccttatgg

SEQ ID NO: 204824 - DNA, 1385 bp, Homo sapiens
  misc_feature (1024)..(1024): n is a, c, g, or t
  misc_feature (1026)..(1026): n is a, c, g, or t
ccagcagctacacctacacgctgaccatcacaggcacacagaggcacatccacctcacatccacctcatacttgtgtactctcagggttcagtctttcatcctatccctctctgatctgtgcctcccaataccttccaagatgtttacagagacccttctccctgtgcagttaggagtgtaaggcaagagagcccctacttcatggggcagatcaagagctgagaccaaagatggtctatgttgctgaccttgtcctgtcctcctgctgtcttaaactatgatccctgctgcggtcactgaagcctttccctgtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggttcaccaactatacggattttgaggactcaccctacttcaaagagaacagtgcctttcccccattctgttgcaatgacaacgtcaccaacacaggcaatgaaactgcaccaagcaaaangntcacgaccaaaaagtagagggttgcttcaatcagcttttgtatgacatccgaaactaatgcagtcaccgtgggtggtgtggcagctggaattggggggcctcgaagctggtgccatgatttgggtccatgtatcggtactgcaatcctaaataagtccactttctgccttctgccactactggttgcacatgggaactgtgaagaggcacctggaaagcagcagtgattgcgggcagcgggcaccggactctaccactgttcccttggggccaaagggcctgcccttttgctccagacttggggccaatagggccactcccttaaggcgagctgatttcctccatggggcggaggggcg

SEQ ID NO: 204825 - DNA, 1231 bp, Homo sapiens
ccagcagctacacctacacgctgaccatcacaggcacacagaggcacatccacctcacatccacctcatacttgtgtactctcagggttcagtctttcatcctatccctctctgatctgtgcctcccaataccttccaagatgtttacagagacccttctccctgtgcagttaggagtgtaaggcaagagagcccctacttcatggggcagatcaagagctgagaccaaagatggtctatgttgctgaccttgtcctgtcctcctgctgtcttaaactatgatccctgctgcggtcactgaagcctttccctgtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggggttgcttcaatcagcttttgtatgacatccgaaactaatgcagtcaccgtgggtggtgtggcagctggaattggggggcctcgaagctggtgccatgatttgggtccatgtatcggtactgcaatcctaaataagtccactttctgccttctgccactactggttgcacatgggaactgtgaagaggcacctggaaagcagcagtgattgcgggcagcgggcaccggactctaccactgttcccttggggccaaagggcctgcccttttgctccagacttggggccaatagggccactcccttaaggcgagctgatttcctccatggggcggaggggcg

SEQ ID NO: 204826 - DNA, 1448 bp, Homo sapiens
  misc_feature (1087)..(1087): n is a, c, g, or t
  misc_feature (1089)..(1089): n is a, c, g, or t
ccagcagctacacctacacgctgaccatcacaggcacacagaggcacatccacctcacatccacctcatacttgtgtactctcagggttcagtctttcatcctatccctctctgatctgtgcctcccaataccttccaagatgtttacagagacccttctccctgtgcagttaggagtgtaaggcaagagagcccctacttcatggggcagatcaagagctgagaccaaagatggtctatgttgctgaccttgtcctgtcctcctgctgtcttaaactatgatccctgctgcggtcactgaagcctttccctgagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacggtgtgtgaaacccagctccacaggctgatgaccaagagtcccctcgcccttgacaccaggccctgggattcccaaaccctgctttggacccccctaggctcaggcttctgtctcacttttcccgggggggggattagggcaaggagggcatgagggactgtctctccctaaaaccagacccctgttccccactcagttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggttcaccaactatacggattttgaggactcaccctacttcaaagagaacagtgcctttcccccattctgttgcaatgacaacgtcaccaacacaggcaatgaaactgcaccaagcaaaangntcacgaccaaaaagtagagggttgcttcaatcagcttttgtatgacatccgaaactaatgcagtcaccgtgggtggtgtggcagctggaattggggggcctcgaagctggtgccatgatttgggtccatgtatcggtactgcaatcctaaataagtccactttctgccttctgccactactggttgcacatgggaactgtgaagaggcacctggaaagcagcagtgattgcgggcagcgggcaccggactctaccactgttcccttggggccaaagggcctgcccttttgctccagacttggggccaatagggccactcccttaaggcgagctgatttcctccatggggcggaggggcg

SEQ ID NO: 204827 - DNA, 739 bp, Homo sapiens
  misc_feature (689)..(689): n is a, c, g, or t
ccagcagctacacctacacgctgaccatcacaggcacacagaggcacatccacctcacatccacctcatacttgtgtactctcagggttcagtctttcatcctatccctctctgatctgtgcctcccaataccttccaagatgtttacagagacccttctccctgtgcagttaggagtgtaaggcaagagagcccctacttcatggggcagatcaagagctgagaccaaagatggtctatgttgctgaccttgtcctgtcctcctgctgtcttaaactatgatccctgctgcggtcactgaagcctttccctgtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctgccatgattgtgtccatgtatctgtactgcaatctacaataagtgaaatcagcagagcctctgnggtggatgtgtagaaggcacttcaaaatgcataaacctgttacaatgtta

SEQ ID NO: 204828 - DNA, 1504 bp, Homo sapiens
  misc_feature (1143)..(1143): n is a, c, g, or t
  misc_feature (1145)..(1145): n is a, c, g, or t
ccagcagctacacctacacgctgaccatcacaggcacacagaggcacatccacctcacatccacctcatacttgtgtactctcagggttcagtctttcatcctatccctctctgatctgtgcctcccaataccttccaagatgtttacagagacccttctccctgtgcagttaggagtgtaaggcaagagagcccctacttcatggggcagatcaagagctgagaccaaagatggtctatgttgctgaccttgtcctgtcctcctgctgtcttaaactatgatccctgctgcggtcactgaagcctttccctccaatccatcctccattaaggctgtcagcactttggggtgcctgccatcaggagtcccccatatatgtaggggtgctatttcacagagatcatcctttggcgtgcctaaacagaaccaggtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggttcaccaactatacggattttgaggactcaccctacttcaaagagaacagtgcctttcccccattctgttgcaatgacaacgtcaccaacacaggcaatgaaactgcaccaagcaaaangntcacgaccaaaaagtagagggttgcttcaatcagcttttgtatgacatccgaaactaatgcagtcaccgtgggtggtgtggcagctggaattggggggcctcgaagctggtgccatgatttgggtccatgtatcggtactgcaatcctaaataagtccactttctgccttctgccactactggttgcacatgggaactgtgaagaggcacctggaaagcagcagtgattgcgggcagcgggcaccggactctaccactgttcccttggggccaaagggcctgcccttttgctccagacttggggccaatagggccactcccttaaggcgagctgatttcctccatggggcggaggggcg

SEQ ID NO: 204829 - DNA, 1144 bp, Homo sapiens
  misc_feature (783)..(783): n is a, c, g, or t
  misc_feature (785)..(785): n is a, c, g, or t
aggctaactggccacgggtggggccagcaggcgggcagaaggaggctttaaagcgcctaccctgcctgcaggtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggttcaccaactatacggattttgaggactcaccctacttcaaagagaacagtgcctttcccccattctgttgcaatgacaacgtcaccaacacaggcaatgaaactgcaccaagcaaaangntcacgaccaaaaagtagagggttgcttcaatcagcttttgtatgacatccgaaactaatgcagtcaccgtgggtggtgtggcagctggaattggggggcctcgaagctggtgccatgatttgggtccatgtatcggtactgcaatcctaaataagtccactttctgccttctgccactactggttgcacatgggaactgtgaagaggcacctggaaagcagcagtgattgcgggcagcgggcaccggactctaccactgttcccttggggccaaagggcctgcccttttgctccagacttggggccaatagggccactcccttaaggcgagctgatttcctccatggggcggaggggcg

SEQ ID NO: 204830 - DNA, 1252 bp, Homo sapiens
  misc_feature (891)..(891): n is a, c, g, or t
  misc_feature (893)..(893): n is a, c, g, or t
ccagcagctacacctacacgctgaccatcacaggcacacagaggcacatccacctcacatccacctcatacttgtgtactctcagggttcagtctttcatcctatccctctctgatctgtgcctcccaataccttccaagatgtttacagagacccttctccctgtgcagttaggagtgtaaggcaagagagcccctacttcatggggcagatcaagagctgagaccaaagatggtctatgttgctgaccttgtcctgtcctcctgctgtcttaaactatgatccctgctgcggtcactgaagcctttccctgagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggttcaccaactatacggattttgaggactcaccctacttcaaagagaacagtgcctttcccccattctgttgcaatgacaacgtcaccaacacaggcaatgaaactgcaccaagcaaaangntcacgaccaaaaagtagagggttgcttcaatcagcttttgtatgacatccgaaactaatgcagtcaccgtgggtggtgtggcagctggaattggggggcctcgaagctggtgccatgatttgggtccatgtatcggtactgcaatcctaaataagtccactttctgccttctgccactactggttgcacatgggaactgtgaagaggcacctggaaagcagcagtgattgcgggcagcgggcaccggactctaccactgttcccttggggccaaagggcctgcccttttgctccagacttggggccaatagggccactcccttaaggcgagctgatttcctccatggggcggaggggcg

SEQ ID NO: 204831 - DNA, 318 bp, Homo sapiens
acatcttccggaaagcaagcctccaggcttgcttggccttgcacccaggctcaactctctttccttctttcctacctgacaagtcctgctgagcctcagctgggcccctgaacttttcagacagctttgctgctcttttcttctaggtgttagcagcacctgctgcctgccgtggtggtatacgctctgtgcctgcctctctccccattgcaccgagcccgatggaggcagctactgcgtcctctgctagagcgccagtgcctgggacagagcagccagttgttcatgtactgcccgaagctgttcctgtagttctga

SEQ ID NO: 204832 - DNA, 428 bp, Homo sapiens
ttagccaagtagaggccattttatatatagaaactatacatttcttggtgtcttaaggaatcagcacttttagtagtaattccatagatgaaggccttatataccatatagtaagtttgtgatagattcaaagatttcctataggtttgcattcaagaagaggtacaacttttcctcttggagtatctgattattactgtggataagaaagccctgtaattaacgggaacattaatatgccttatttttagttctgatctcaaaaatgattagcagccaacttcataatacagttctctcattttgtaatattttcttctttgctcaaccaaaagaaggtttaaatttatgattgatgaatttttctaactgaaggctaaaaaaaggctgattgatataaagtaggtagaatgtaagagttctttctg

SEQ ID NO: 204833 - DNA, 228 bp, Homo sapiens
atagctatttattgtacatacgttttgcaatcttcagcagcctcgggtgcacatttatttctagagctgagggtggtagacataatactctcagcttctacttaatgaaggcatcagaattttagctccttcaagatgtaagggaataaaattgtgtgattcaagagtcgtcagctggatgacaattttagatgtgtctttagagagaaggtgatattggtgaaatag

SEQ ID NO: 204834 - DNA, 363 bp, Homo sapiens
cactctactctcaggtgcgctggctccacttcatcactgaactgctcgggccgcataggcccatcatttcaggaggctgtacatagcgccttggtcctaggccacatataggtcgatcttcctcgccaactcatatttcacacagataaatctcagtagaggaaccggttcctcttacaaagggggatgagtagggcctgaaatgtttgactccttacctgtttaaatttgccttgtcacctttcacagatacgtgatctctgggcctttaggagagcctttggcacaaatagttttccacctttttcctacaatatattattcctgaggctctgaatgtcgtctgctttttgttcgccaagt

SEQ ID NO: 204835 - DNA, 316 bp, Homo sapiens
aaggaaacactgacaaattcaacaatataataaccaaatatctctgtataggaaaatacgataaagtccagtgacaagggagagaagcttaaaatgcatactacatacaaaggactgttttccttaatatttcaaattggaaatatagaaatggattttttaaaaagagcgacagtccaatcaaaaatgtaaatggtatcaacagctagttcacacgcagcacgtttactgaacactccctcatgccagacgtagagttggtggctggcacacttgagaggccagacagacaacagtccctaccccttgcaatcga

SEQ ID NO: 204836 - DNA, 174 bp, Homo sapiens
agttcaccctctgcacactggctggagtggagtttagagtcattctgtttgaaatgactggtaaagtgtccattcagggcagctctgctatgaatgcaaggaagtggtctttggagctcttgtgtagtatttgaaagtacttcgtgttactgcagacagccaaagaactgaaat

SEQ ID NO: 204837 - DNA, 739 bp, Homo sapiens
gtccttgtcttcctagtaccttcctatccacatgtccccggcaagactgatttggaatggcaggcactcacagttgtgtttatttgagggtaccacaggaagtgggggcccccaaattggctaaggagccccagggtggagggaggtagaagcacactgggtctgtctgggagcctgagcaccttctctgtgggctccttcctacccatggattccaacccccacccacctccccactgcccacccactcacccatctcttctgctttccttctccctgtgccccaggccacaccattcctctgtgcaccctgcactttcccctctacacctttgtccttgacacctcctctgccctttatcttcctcctcctcctcctcacagcctttccccctccccatcaggattctggctgcccttgctctgcaaccctgcctggaacttcaggtccctgatcttacagcctaaaaaaaccaaatattcattgacacctcattttgcttcagcaccatgctgaatgctggggacacaggggacacgaaatagtccctaccacatggaactaaaactctggaggtgaagagagaagatgaatcaaagaataatatataggccgggtgcggtggctcacacctataatcccaacattttgggaggctgaggcaggtggatcatctgaggtcaggggttcaagaccagactgaccaacatggcaaaaccctgcctctactaaaaatac

SEQ ID NO: 204838 - DNA, 100 bp, Homo sapiens
aggaaagagaaatctgctaataaaaaggagaatgacatagtttgagggtctacttattgtaaagcaagagaaagaacagtaactggagtaaaatgagctc

SEQ ID NO: 204839 - DNA, 590 bp, Homo sapiens
ccctgacttgaggcaggctggtctaggggtcttgtgtgctggccctggagtcagaccagctggggaagatcccagtgccacactggctgtgtgatctggggcacacttcttaagtgctctgagccttggttcccttatccgtaaaatggaatagtaagagcaccttagggaagtggtggtgaggattgaatgagatagtgcaagttgagcagggttgatacactattaataattcaggtggggcttgtaccgcttcttccccaatttactcccgtccattgtgttgtcaggtgcaggtttccaaagcacaccttggttcgtctctctgcgttttgtgggatgcctcctctagctcgccattgcctacttattcagtattttgtcattcagggctgcccttgtggcttatgtgacccagcccccagctgctcttgctgggcctctccatgtagccttctttccaggagaaaacgtgcgggatctctccagactccagacctcgatgatctaccggcccgttcagtcggttgtaaccttgtcccctggaacgcctgccggatcattactctcaagtgtcgtagggctagagt

SEQ ID NO: 204840 - DNA, 511 bp, Homo sapiens
caagcagtatatacagactcagcattcacacactcagccacccttggcctctgtccccattccaagccctgtctactctccctcacttggttcctccattcctcctctcctgccctgttgtctcagcctggactggtgcagtgcgcttcagtgggccctgccttccagccgctccctggtaattctctgccactgtaaccacctctgcctcttagaagatggcatggtcatcccgtgatacttggacatttgccgggagtagctagttggcccagctggtcccctgtgtctctaggaggctgggtagccagtcagctcgaaacctgtaggctaatatgcgtagcgcactgagaaccccacagcccttcctggggcccagaaggatgagaatggtgagggaaacagtgtgctgtgaggaaatggccacaggagtcccagaaacattcccccataaagagaggatatgaccagtggagaagagaagcgagaggaagaagcccaaacaaagggc

SEQ ID NO: 204841 - DNA, 449 bp, Homo sapiens
cgttttacactgttcgtcggtttacagtgtctaacagagatatactcaggaaacagctactactttgaagtctactgatgtggcaaattacactgattaatttttgcatttgaactaatcttgcattcatagggtaaatcctacttggtcatgatttacttttctttttatgtatcacaggatttggtttgctaatattttgttgaagatttttggtcctgtgttcatcaaggatattatttgtaattttcttataatgtttttgttttctggttttcgtataaggacaatgctatcatcataaaatgggatgagaagtgttccctcctcttgcactttcttgaaacgcttgtgtagaattgctgtgatttattccttagatggttggtagaactccccagtgaagccatctggaccttcagtaggttattaactacaaattttatttc

SEQ ID NO: 204842 - DNA, 382 bp, Homo sapiens
ggcaagagaatcgcttgaacccgggaggcggaggttgtaatgagctgagatcacaccattgccctccaccctgggcaacaagagtgaaactcagtctcaaaacaaacaaacaaacaaaaaaaaaaacaagaggggtgcaactagcatctagtgagtagaggccagggggtttgctaaacatctacaatgcatgagacggcaccccaaaatcaagactgtcagtcatgcaaggttgagagactgctctagattttgcctttgccttgtccttctcaagtggactctctctggctgctaatcacaccctagcatgtacagcacaaaatggaaggaagaaaaagatagaacaagtttgttctacagaaacatcagtagttttgga

SEQ ID NO: 204843 - DNA, 197 bp, Homo sapiens
tctgaatatgatctgtatataaacaaacatatactgatgctactcaagatgggcgttctgtgaaacggcagcgtgggcatctccaagaaggtttttagaaaagtagaatctcaggccccattccagatctgttgaatcagaattcgcattttgtcaagatcattggatgattcacattaaagtttgagaaacactga

SEQ ID NO: 204844 - DNA, 361 bp, Homo sapiens
tctgacccccttaaaggtgactggggagccacagaggatctgctgcatggagatgtcaaatcctagtgagcagtctggatatctgtgacttgctcggagtggctgcaggggctggtgggttacactattcatgtggacactccctgtagggagaggccagggattctgacagatgcaccactttttttcaccctgtttgatattactctccagctaggtgagagtgatggaaatcatgcagcaaacaatttaatgattatctgctttggggttcttgcaccagaataactgagtgttgagttgtcatgagcaggcaagaaaggctagagctgcatgtcgtgcaggcagagagtctgtcaga

SEQ ID NO: 204845 - DNA, 547 bp, Homo sapiens
aatacattaaacagactcatagcataagtaagattgtaaaggtgatgtctgatagattgagaacaagcttttaaagggcttaatcactttgtgtgcaaatatatcctgcgaaatacaagtgagtgtgacaggtttggcggaacattttgttagcagctagcttgtgctcctctttgtactttataaacgttaggctgcacaatttcagactgactggctctccttcctccctatccccacaaccaccattagtttgaattaatgagatcttagtgaacagttactttgttgtttcctttctaatcttcagacatctccccactgagtttaccaaataattcaaccctttcacttaaagcagcttagacctgcataactcaggtagataactgtagtctgaaacaggtctatagacactgttgtgtgttcaataataggtttatttcaaatactgtctccctacccatttccattgtgctggcattgaaggtttttacttagacttggccttatctcccagctgtttactgttcttttccagttagta

SEQ ID NO: 204846 - DNA, 581 bp, Homo sapiens
gaaagtttgagggattagagaagtaatgacaaatgtatcttaaccaagtcttgaatagatgacctgtactacatagttattttccttggaaaatatttcaaaatttaaaaacttatttttgacatttcacatctaaatatctagagtagtttgaagggttttctttatttcttttatttgtcacaaagtcaataaaattaaattccgttgtggttttaattttattccagaaaggaaaaaaacaaaatgatttgtgtttcaaagataaataagaacttagatcatgctgtggattgaaactccaaccctgttgaaagaaaggggtctcctgaactttagtggaccttgtttgtcagccttactcccaaccttggggcatggcctcttgacataacctactgaaggtaagaggctgagggaaggagacaggccagaaggcagagaaaccatatgccagccagtctcaagaagagaagtgaaatgaagctttctaagtccaagggcctgctttttacagctcatcaggcttagggcaattgccaaaaagggaaaaaaaagatccccattaggcacaacctaag

SEQ ID NO: 204847 - DNA, 530 bp, Homo sapiens
agaataactgtttcaaagaggcaaccggtaactcctgaaaaacatcgagctagaaaaagacagtcatggctttgggaagaagacaggaatttgagatctggcgtgaggaaatatggagagggaaactggtctaaaatactactgcattataaattcaacaaccggacaagtgtcatgttaaaagacagatggaggaccatgaagaaactaaaactgatttgctcagacagcgaagactgattgtgtttctaaaagctttatgaaaggacagttaagtattttgatcactgcattttgtttgaaacttgtgtcattgatgtattttaaaacttctgtttaaagcattacagtatttttctgtgaccatcaattaatatgagggtttgtgctataagagttaaagcatatgctatcattgtattctttaagaactttattttgataaaatgtaaatttgttgaaccctgccacatttagtatccccacccccaaaacctgttccaatgaaaaaattaaaacctgttatgaaa

SEQ ID NO: 204848 - DNA, 361 bp, Homo sapiens
tataatgtctcagatttggcttcaaaataatagagcaaaggataaagtggatggaatgaggtgaagattagacaagaattaaagttgttgaagctgagagatgggtacacagggctcactatactactgtctacttctgaatatgtttaaaaatataagttttaaaaagcttttatggaaatagcttaaaaataaagatacaccagtttcacaaatgggaattatattcaatacaggtctaatccaaatcccaacaggccttatggaaaacctgacaaactaattttaaaactgatctgtaatagtcaaggactaagactggccaaaacacgacaaaaggtgaacaaagacaaagggatct

SEQ ID NO: 204849 - DNA, 244 bp, Homo sapiens
tgctgggatgataggcatgagccaacgtgcctggccagaatatgctgtattataaagaatcttacatgttacttgatgcctgtgatctattttcttagtaagaagagaaacttctctccactcagcctcagtccactgtacccactcttttgtgtgtcaggatgttcaggggagaagagggcttagcatctctgtcctgtgttgagttgtggttgcccgtcactgggctgtaaagtgccttgcc

SEQ ID NO: 204850 - DNA, 248 bp, Homo sapiens
aggactcagagcttggggtggagactgaaggaacagaccgcagagaaagaagaaagatttgggatgagtcgcattgggagcagagactaaggagggaccagtgtatgaaacaatgcctggatgtcaggcacatcagacccatttgcccatttttcaacaaaaatcatccaggtcttgtaaaatggagaaatcaaaagtgtcattttctagctatttagaaccattattgagtttgtattggggccaag

SEQ ID NO: 204851 - DNA, 435 bp, Homo sapiens
ctccgcaaaaaccctaaatggagttcaaagagcttccaggaccctgaaaacccccaaagcaggaataacagctaacacttattgactggaatctgagctcactaaaagcctccatcctggagttgctggctctgtcaccgctgagatgagtctgcatgtcctgcagttttgacttcaaaccaacatctgtggtcagctctccactccctgccaatacagccagcactgttctgacagcagtcactaagcttgaggttcagtagcactgggggtgtgtaccgggggccctgttgaatgggtcttctaggagactcatggcctatattttaactcacactatcacaaatgtgccctctgaatgtggtgaacatctaccaagccagtttcacataaggtcatgggtaagctcataaacaatgcaagcatcctcttatt

SEQ ID NO: 204852 - DNA, 331 bp, Homo sapiens
tggagttgttttgatcatgatttgaagtaatatatgtaaagtgttcagtgtagggcctggtagagaattggtggttaatcagcgtagctcttattactgtgattagaccctctcttagtcttggctacacctccggggacttcagagtccattgtgcctgccccctgccaggctgaacagccctgaactgcacttcctagggcaggtcttggccccctgcccatctctctgctttggcctcccccggctgtctctgcggaatggtgccaccctctgccatgcctagagctgtgcctgactctcccactgggggtgtttgcgaaggagagtg

SEQ ID NO: 204853 - DNA, 208 bp, Homo sapiens
gaccctgtggtaggcatcgcacataaatagatgatttcatgctagctcttgagagatgtaaaatcagcgggcaacacaggctacgaaaagataaattacactacagtgtggaaaggtccaaagagtaataaggagacatattgttgtgccaatggtggtttctccattgattagggttctgtttcttggtgcactgggatgctgagtt

SEQ ID NO: 204854 - DNA, 175 bp, Homo sapiens
acctgattgtaaggtcatgacttaatttgtttaatatacacactatatgtttatataattcagtgtgacatgctgatttgcattaataaaaacatgtatctttggccagtaattactgttaagtgggcttccttaagaagccaataacagccaggcccgggcacggtggctcacg

SEQ ID NO: 204855 - DNA, 410 bp, Homo sapiens
ctcttaaaggccggactccatgaccttcaaggatggagccaaatctccctgttcctcgtgtgatcttcctgtgcccccctttggcctgaacctactgtgtggttcacccagggacttcaccctactttactactgtgtggttccctggagactgggggcttaatccgtctctgatatctccttgattgaatagaatttataattggccaacaatttaacaaacgaatgcattgtttaaagaattatttaaagttttaaaaaatgtttgattcagccatcttaggaagggatcaaaataagaatgtatctggaaatgcttcatggactgcaaagatcaatatgatttaaagaaatgccattttatacatggttcttcgaattttttttgattgagaggattctgtgcaatt

SEQ ID NO: 204856 - DNA, 621 bp, Homo sapiens
gggtatcgcaaggtgcttctgaagatgaactcagataaggtatgcagtgaccacaacgtctggtacaaggtaaccacttattaaatagctggtgctgtggttacactgatcgctggccctggctttccgtggcactgcttggtgcctcctaaggaagtacttcgaccaagtgctgctgccgatggcctgaagaaggcagccggattaagggaggaggaaaggaatcaagatcaaaaacccagattgaagcgcagctgatatgcctatctcagccacctacagcagctgacaaagtactagtgcacactccaaaccagttcatccaactaaaggggccgaagctgccaaaaaaaatgcctcaagtgttccttggatgcctgaagcagaaagaacgattagagatttcacagattaaattcctgcctgcatgtctatcgtcagctgtagtcatttgttgaagcgaaacacgcagtttcaaagccattaatgccccaggtttgaacattttatctctattttctttaatcaggtgacatttcttaaggaagaaaaaagctgggatggtgtcaattaaaacaaaagcatccctcaccacaatttgaaagtaaaaacgatctggtg

SEQ ID NO: 204857 - DNA, 221 bp, Homo sapiens
aaagtgctgggattacaggcgtgagccaccgcgcccagccccagctgctgctttttaaaaaaagactaaatagcattctgaaatctttattttattttattcctgtatttattttagagacagggtcctgctatattgaccaactggttttgaactcctggcctcaagcaaaagttaacctctatgtataaaaatattaaacagttttactcccttcaaca

SEQ ID NO: 204858 - DNA, 686 bp, Homo sapiens
ccctgagtctgatatctgctggacctttttgagtctcctatgcacatgcattgagactttgggtaaaccagaagcatataaagggcttctgtctcttcagtctccactgcccatatgcacagcctcagccagcaatatgctgtctctgatcacaactgcaacttcaggctgatggagctgatggccctcccaactcactcccatccaagatgatcatttctattgacaactttgcttggtgtctgcactgcccagctcttcaaactggttgagtctccttcaacatctacagagaagctactggtcatcatggcttgctgtaccttggcagaacctataggctgggttgaggtggatgagaggagccctaggtcagaacatctcagattcccagtgttcctgagtgatgtcccatgatttttaaaaaataaacacgtctcaggttgtcataggcctttggctgatttccagagcacaaatagttgaagtttccaactttgcacagctctatcattgcattttgggaagaggatttacccaacctcctcctagagtcatagctaaaagtccactctttgccttgggttttgactcgtctctctcttcttccttcattttcccctttcacacacttaagtccaacacttgctagtggctctagagcaataaaatctttcttgcacata

SEQ ID NO: 204859 - DNA, 503 bp, Homo sapiens
tgaggaagaaggactccttcctaattcattccatgagccgaataattctgatatcaaaacctggcaaagacataatgaaaaagaaaactacaggtcaatatccttgatgagcatagatggaagaatcctcaacaaagggttgagtgtggtggctcatccctgtaatcccagcactttgagaagacgacacaagaggatctcttgagactaagaactcttgccatcagctgcatgtctgagtgctaaatattcagcaaagaaagaatctcttaaagccccattgaaaaagactatgcaaggtactctgttctcatcctgctcataaagacatacctgagactgggtaatttataaaggaaatgggtttaattgactcagttacgcagggctggggaggcctggggaaactaacaatcatagcacaaggggaagcaaacatgtccttcttcacatggtggcaggagagagaggtgccaagcaaagggggaaaagccccttattga

SEQ ID NO: 204860 - DNA, 218 bp, Homo sapiens
tcaccaactgagtctaacaggaaaagactgtgggcagagaggcacagggcctcacccaactcagggcaagcccggtgggggcagggtaaacccagaaaacaatcatgggatggtaatcccgagttcaggatgacggtcactcctgggagcacaggagaaagggacccacattgtggaagcgatgcagggcttccactgtatttgacaagtcttttttt

SEQ ID NO: 204861 - DNA, 1508 bp, Homo sapiens
ccgtctccctcagtggccgcagcgcctcccgtgagagcggtttctcctccttgtactgctggacctggccccgtatcttcgtggcagaggccaagcaaggggactccgatgccggggcgtaggggggtttgggtcaaaggatgggggcagagttcaaagtgcagggggcgggctcgtttaatggcgaagtcctggcaccgcgccccagggaggaggctccggaggccagtggaaccccgctagacttcaggggtcttggttggggacgcggggcgttttgaccccctaggcctgaggatcctaggcctgagtaacccatcggatttggagggaagggtggggtttaggtgaaatgtaaatactgcgtggtttccatttggcaaagagcaagcttgtaaaggggtcaccctcgggtctgggctgcgaagtgcagccgggacctgtttccttgggaaccacaagataagaccgctgtagattgttatgtccggaaaccgcttatcagagccctgcacctgggttggaaatggagacggattctctgtgtccaagaaaatcagaccctccggccggaaaagggaagtttattcttactgataaaatgtcaatcactgtgtatgattgtaatgggcaaggaaggcatttagcgagctagaagacattgatggctcagaaaaaggtgttcttggcaaaaatactgttttctgttaattttccaactgataccatctgggtctgtcctcccagcctgatgaatgtgtaggcagatactttctcagtcggagttgatttttattatcttgattgctgcatcctgtgcacagaggttttctgctcagctgggcttcatcctggggtcccagtcctggccccaagccttaatcagctctcgggtgatattaggcaagttgccaagcccctaagtgcctcagtttccaggtctgtaaaatacataacattacctgcatttgtcaaatagtgctgtgtgtggattattattggcagctcatcatcaccattatcaccctcctgtaaacgtcttggaccccttaagtgaagacagcagggttacggcggataaaatgatggacttcagagaaaagactctaagaccaaatagagtctaaagcagtgattatcaaagaggggaggagaaattttacgcccaggggacactggacaatgtctgcagacttggttgtcacaaccggggatggggttggggcgactggcatccagtggatgaggaggtctagggtgctgctcaacaccctgcaatgaatagcacgccagtcttttggatttgagcccaccttaatctcattttaatcgaattgcctctttaaaggcctatcttcaaataccttctgaggtactgtgggttaggccttcaccttacggatttgtggggacgcaattcacccgttaacgctatacatacacaaaaattcatagactacacctcaaaagaaaaattcaacatgaccatataatactataaaataaaa

SEQ ID NO: 204862 - DNA, 801 bp, Homo sapiens
tccccggatggcgaccattcaatctgcatcaaattcttggtttaaagggtttttttttgtttgtgtttgtttttttgttttttttttaaatggagtcttgctcttgtcatccaggctggagtgcaatggtgcgatttcggctcagtgcaacctccgcctcctagggtcaagtgatccacctgcctcggcctcccaaagtgctggaattacaggtttgagccaccgcatctggcctgcagtgaagctttctaagtctatcttttcctttctcctttccttcctcgtgtcccaaaggcaggaatatgcccctcctcttgaagttcctctgattgtccagtcctccacggaaaatcttattatttgtttatcagaccagaagcaaaataaatgcccttgaaaggtgacaagcaacagcgtgaggaggacctcgcttgcccaggcagcttcctccaatcccacccttgccccacaccagaacagaggataatttcagcacccgtgcctgggaagacacccaaaatgagtgtctgtagtttgtcccctctttgaaagaatgcagggcttgagaaggctcactttccctgcaggcctctgtctggtgccagatgtaggctctgtgaaaagaagcacagctataaccgggagccttaaaatagtcaaagtttctataacagaaattattagtggtgtaggggagcaaaaacaggcaaaagaatagctgctttgagcttcaggctttcattgtggttaatagacaattgaaatcaaagaaacatgtttacttcttttttcttttctttt

SEQ ID NO: 204863 - DNA, 800 bp, Homo sapiens
tccccggatggcgaccattcaatctgcatcaaattcttggtttaaagggtttttttttgtttgtgtttgtttttttgttttttttttaaatggagtcttgctcttgtcatccaggctggagtgcaatggtgcgatttcggctcagtgcaacctccgcctcctagggtcaagtgattccatgcctcagcctcctgaatagctgggattacaggtttgagccaccgcatctggcctgcagtgaagctttctaagtctatcttttcctttctcctttccttcctcgtgtcccaaaggcaggaatatgcccctcctcttgaagttcctctgattgtccagtcctccacggaaaatcttattatttgtttatcagaccagaagcaaaataaatgcccttgaaaggtgacaagcaacagcgtgaggaggacctcgcttgcccaggcagcttcctccaatcccacccttgccccacaccagaacagaggataatttcagcacccgtgcctgggaagacacccaaaatgagtgtctgtagtttgtcccctctttgaaagaatgcagggcttgagaaggctcactttccctgcaggcctctgtctggtgccagatgtaggctctgtgaaaagaagcacagctataaccgggagccttaaaatagtcaaagtttctataacagaaattattagtggtgtaggggagcaaaaacaggcaaaagaatagctgctttgagcttcaggctttcattgtggttaatagacaattgaaatcaaagaaacatgtttacttcttttttcttttctttt

SEQ ID NO: 204864 - DNA, 741 bp, Homo sapiens
cggctcagtgcaacctccgcctcctagggtcaagtgattccatgcctcagcctcctgaatagctgggattacagatgcctgccaccacacccggctaatttttgtatttttagtagagacgggttttcactggtctcgaactcctgacttcaggtgatccacctgcctcggcctcccaaagtgctggaattacaggtttgagccaccgcatctggcctgcagtgaagctttctaagtctatcttttcctttctcctttccttcctcgtgtcccaaaggcaggaatatgcccctcctcttgaagttcctctgattgtccagtcctccacggaaaatcttattatttgtttatcagaccagaagcaaaataaatgcccttgaaaggtgacaagcaacagcgtgaggaggacctcgcttgcccaggcagcttcctccaatcccacccttgccccacaccagaacagaggataatttcagcacccgtgcctgggaagacacccaaaatgagtgtctgtagtttgtcccctctttgaaagaatgcagggcttgagaaggctcactttccctgcaggcctctgtctggtgccagatgtaggctctgtgaaaagaagcacagctataaccgggagccttaaaatagtcaaagtttctataacagaaattattagtggtgtaggggagcaaaaacaggcaaaagaatagctgctttgagcttcaggctttcattgtggttaatagacaa

SEQ ID NO: 204865 - DNA, 891 bp, Homo sapiens
ccatattctacctaaagctgctaattctttacagaattcataagcccaggggatagtaagtagtcatttagttttggaaagttcttaagagaatgctatcttctacagtctcatgaagcagtttttcaagattagaatctgtggtcagctataacgtacagtcctaatatccaaccacctgagaagctcatcctaagctgagaaagcctaaaatgttagagaatgtttagagaaaacacctgaaattttttttaagagaacaacctaggttttattgtagagaacaatcaaaatactcctgaacctttctatagaatctttaggagagaggctgacaaaaagaatccttctgttacaactttcttttctaatgtaacaaccagggacaatggtgatctgtcacgcatctgcccatctagcttctcaatcggcccacggttttatttcaggataaaatttgagaaactagtatcactggggaaggaagaaacctaagctgtaaaattatgcttttcccctcaagggattcaataaagcttatttttcatgaaaacaagcctataaatactgactttccttaaacctaatcaaattgtgttcctccaaggtatagctttagaaggatcttctttcagttgctctttcaaacttttccttgttagaaaagaaaaactaatacaaattgttaaaaaattaaagcatgagcagagagcatggattttagatgattttaagtttcctcatcttcatgaatctcatatttggatcatccttcactgcagcatccctcaaaggaacattcattctcccaagaacaagaggaattgtttgcagataaattattcaaggtagcaaaatggagcatgcttcaatctcctcatcctgtccaca

SEQ ID NO: 204866 - DNA, 521 bp, Homo sapiens
caatcggcccacggttttatttcaggataaaatttgagaaactagtatcactggggaaggaagaaacctaagctgtaaaattatgcttttcccctcaagggattcaataaagcttatttttcatgaaaacaagcctataaatactgactttccttaaacctaatcaaattgtgttcctccaaggtatagctttagaaggatcttctttcagttgctctttcaaacttttccttgttagaaaagaaaaactaatacaaattgttaaaaaattaaagcatgagcagagagcatggattttagatgattttaagtttcctcatcttcatgaaaagaagaacctaatactctgagaagtaatgcctgtccagaatgcacactaaacatctcatatttggatcatccttcactgcagcatccctcaaaggaacattcattctcccaagaacaagaggaattgtttgcagataaattattcaaggtagcaaaatggagcatgcttcaatctcctcatcctgtccaca

SEQ ID NO: 204867 - DNA, 397 bp, Homo sapiens
cgaagattcggaatgaattgtcttacctggggcagctcggcctctgcagagccagggccctgggacattttgggcagggtgccttcacagcaactgttcagatcaaccggctttcccctccaaatcccattcttcctctgtttgttccctagaattcccgaaactttctgacactctgcttttccacctttctctctgtcactttctttctcagcactcttttgtctcactctcctgtctgagccccaatctcaaagctggggggtgtgtaggacttgaagatctggcctctcagagctacactgggaggctgggtgacctggaatacaggggctagcagggtgctgagtatagatgcaccttcgtatctgtttgaagttgagaattctttttatct

SEQ ID NO: 204868 - DNA, 605 bp, Homo sapiens
ttatccaaattcataactctctattggtgaaatgccaaccatggtggcaatatggggaatagctagccagtatgcttacagtgcttttagaaatagccagagagaacagcaatagtagaaacagattacataaattcagtttattcatcatgtatttgggcacctctggatgccagaaaggttactaggtgctggggaattaatgatacaataatgtagagatgacaaattaatagccaaaggccagatgcagtggcttatgcctgtaatcccagcactttgggaggccaaggcaggtggattgctcgaggccaagagtttgagaccagcctggccaacatggtggaacctcgtctctaccaaaaacacaaaaattagctgggtatggtggtgcatgcctgtaatcccagctactcagaaggctgagacatgagaatcgcttgaacctgggaggtggaattgtagtgagccaagattgtgccactgcactccagcctgggcaacagagcaagaccctgtctgaaagaaagaaagaaagaaagaaagagagaaagagagaaagagagaaagagagaaagagagaaagagaaagaaagaaagaaaga

SEQ ID NO: 204869 - DNA, 483 bp, Homo sapiens
  misc_feature (464)..(464): n is a, c, g, or t
cagtaccttcccattaactgtgctactcaaccccttactccacactaattatcactactgaccttttaattttcagattctcttataatttgcctgcatcatctgacatcaatcaccactcccttcttaaacctgcctatcttgcattcatattttccttattttcttcctatctctctgaccatctctcttgggttacatttctgacatcttttctatgttctgtaactaccaactctgtattggtagtttggaattcccaaatgaccatatgctattaaatatcactaccctggatatataaaagacatactcaaaagagatttgcctgttactccatccatcctactcttccatcttccttgtattgactagtagtgccacccatctagctagtttttcaagtcagaaacctgtgagttatcttactttctctaattcattatctaccatacactcactcnaaccaaagtctacagatct

SEQ ID NO: 204870 - DNA, 385 bp, Homo sapiens
  misc_feature (366)..(366): n is a, c, g, or t
gggatcccctgctgctgtcgctcccttcttaaacctgcctatcttgcattcatattttccttattttcttcctatctctctgaccatctctcttgggttacatttctgacatcttttctatgttctgtaactaccaactctgtattggtagtttggaattcccaaatgaccatatgctattaaatatcactaccctggatatataaaagacatactcaaaagagatttgcctgttactccatccatcctactcttccatcttccttgtattgactagtagtgccacccatctagctagtttttcaagtcagaaacctgtgagttatcttactttctctaattcattatctaccatacactcactcnaaccaaagtctacagatct

SEQ ID NO: 204871 - DNA, 477 bp, Homo sapiens
cccaacaccactatcaacttcccaacaaggccaggcctaattaacagtcagctgcatttatcatatggcttgagtgcaaatgaactaacagcacctgcatcccatctgaaataacatcagaatcaggaaggagagaaatgcggttaatttccatcctgactgcaggccacaaccctcacgtaactttgggaaaacaattcctgaattattttctgagtaacttggattagaagtaaatcaaagcatattcctgagttggagatcatttataagctaccctatatatctgtttgagaatgaaagagaaactaaggaaacttgtcattctgaatttctaacaattattctaaactactcatgaacaattacagcaaaactcaccccaaatgttaaggaaagatcctagggtcactgaagtctgattttcagggcaaataaagccaccacttaaaaggtttttcctgacctaactatctg

SEQ ID NO: 204872 - DNA, 224 bp, Homo sapiens
agacacacacaccacacacacacacacacacacacacaaagagacttgaacaaaccctagcatagtttttattcgctcaaggccatttccctagtatgacaattgacaattccagccctcttaaaatgccttcctgagacagttcaatgctgccaaaaggccatttccctaggatgacaatcccagctccccttaaaatgccttcctgagacagttcactgctg

SEQ ID NO: 204873 - DNA, 173 bp, Homo sapiens
agacacacacaccacacacacacacacacacacacacaaagagacttgaacaaaccctagcatagtttttattcgctcaaggccatttccctagtatgacaattgacaattccagccctcttaaaatgccttcctgagtctgtattaactgcttgggggtcctctagagtcaa

SEQ ID NO: 204874 - DNA, 506 bp, Homo sapiens
tctaacaagggccattagccaaatgttagagactcattagcagagatggaggcttcctctctttatgagaaggattacaggagaattaagaaaggaatagccttctaatggtgggattccatgttcctgaaaacctttttgtaaatcatcttccacattgctgggaggacttgggaaagggctgtggagggctttgaattccgagctaaagggattgttgcatttgttgcatttgcagaaaagcccttgggataccttttggggggttatttaggggtacaggagtagtttctgcagcagaatatattgatgaatagggcgtccctgtcccccagcgggtgggaaattcccatttaggcaaaaactccctcttcggtccagcgattggcaagaggcaggcataagcctctgatcccctgcgcccaggcctgtctttgaacaggcactgaatagcatccattcctcaggagatgtcctgcactgctcgagctcctgagagctcttgg

SEQ ID NO: 204875 - DNA, 485 bp, Homo sapiens
agtcatcctcctcagtagttgtcaaatggtagttctctatttccatccttctcgctacacttctgggttggcatcctactttgaaagagttttcctttttctctgtatcaacacggacttgcatattcctattttattcaatgggttgtaatccgttatcgtcgttgtttacttcatgctcaaattgtcccttatttggcccatgggagtcccttcaagctggctcttaacactgcaacaatttaaagtatatatactgctaaaattcatccgtgttgtgtgtatggctgcagttcattaactttgactgcttgtaatatgccattttgtgaatatgccacagtttattggtccactcatccactattccttcgacgggcacttgggttgtttccaggttattgctattgtgttttgctattctagctctttaatgttaaattttgaatattaaaaatttgtattaacatcataaacttcaggtc

SEQ ID NO: 204876 - DNA, 372 bp, Homo sapiens
tgtttgtagagccagggtttcgccatgttgcccaggctggtctcgaactcctaggctcaagcgatctgcccacgttggcctcccaaagtgctgggattacaggcgtgagctgccgcacctagcttcctttcatatgttatcattttttttctcatttcaaaagtaatgagtacaacataaaattttaaataaaaaagtagaaagttaaggtcctcaatatagtatctgttaacagttgggtgggtggtgaaagacgttgttaacagttttatatatttttttcagccctttttattttattttattttttaaaggaaaccaagtttattaagaaagtaaaggaataaaagaacggctacttcataggcagag

SEQ ID NO: 204877 - DNA, 250 bp, Homo sapiens
catgaccgattaatttttgtatttttagtagagacggggtttcactatgttggccaggctggtttcgaactcctgatctcaggtgatcccaccctcattgttctcccaaagtgctgggattacaagtgtgagtcactgtgctggccagaagaattttaaccaaatgtgtagacccatggattcattccatcctatgcagagtcctggtcttccatatttaattagcacaaatgccataaaactgccttcc

SEQ ID NO: 204878 - DNA, 455 bp, Homo sapiens
ccaagtaactgggactacaggcatgcaccaccatacccagctaattttaaaatttttttagtagagacaatgtctcactatgttgctcaggctagtcttgaactcctggattcaagcagtcctccaaccttggcctcccaaagttctgggattgcaggcatgagccaccatacctggccctaagtcttttatatgtagcagtgggcagcttctgaaaaggcccccagtggtccctgcctcccagtgctcacacttttgagtaatccccttcctctgaatttgagctggacatagtgatttttaatagaataggggaacagtgatgggatgtcactctcaagattaggttacaaaagactatgattcctgtcttgtttctctttctcttcccaccatcacccccactttctctttttggcttggcttcctggctttgatggggccagctgccatgc

SEQ ID NO: 204879 - DNA, 542 bp, Homo sapiens
agtgcctagaagtgaaattgctgagtcatatagccattgtatgttccattgttttagaaactgccaaactattttccagagtgactgtaccattttacattctcaccagcagcatatgagtgatctagctttcttacatcctctccagcatttgtggggtcaccgttttttatgtcagccattctgatagatgtctagtggtatgtcattatgcctttgatttacattaccctaatggctagtgatgttgaatatctttctatgtgtttatttgccatccatctgtcttcttcagtcaaatgtctcttcatgtcttctgcccatattcaaatgagatcatttgtatttttgtcgttcagttaattcctttgattaatgtttgtgtggtataccttcttctatcttcttactttcaaccttcctgtatgttatatttgaaatgagtttcttggagacagcgtataattgagtcatatgtttttaatcaactatgctgttctccatctttaaatcgtaatgctttaaatgtaattattgatatg

SEQ ID NO: 204880 - DNA, 501 bp, Homo sapiens
  misc_feature (460)..(460): n is a, c, g, or t
atcttctcctgaggtccagcggctcttcccgatagtcaggccatcctctgaagtccagctgtccctccaatgtcaagtcacctctctccagtcaagctgcttctctctctctactggctgagtctggggtctttataggcacaggacaggggttgggccgtggggccggccgtaggtagttttggaaaaggcaacattcgattggtaaaaagacatttagaaagaaccaatcaggagagagcaggcaaacagagatagaagttctcactttgggcaatgggtttcaggcttttcatcttgaaggtggggtttcgccaggacccacccctgtctgcctagtatttctctgccttctgtctctatcatcagcacttggggaggcttgaggcagaatgattgcttgagttcaggagatggagaccagcctgggcaatatggtgagtttgctctgaaggctgcntttctattattactttcgtatatcgatatatgttatttttt

SEQ ID NO: 204881 - DNA, 1273 bp, Homo sapiens
ggtgtgaacagcataaggtactgagcaggagcacagttaacactcatcagaatttaaaatagcatcggtggtgttaaagataaagaaattgatacattttttcttattttcattacttatataaatgtattatgtactcagtttcacaaaatcattgtatttaaatatgataaaaatctctgccgcaacctgtttagaaaattagcaaaaatgaaggacattgcttttcatcttccctgtacagttattttttctatcttaagtttattactgctataaattatttttatgctcataaccatattctttctaaattagtaaggactgtctttccttggaaacaattcatttttatttggagagaaattttcaccaaagtttatgtagttagccccttaaccttacttaatttattctgtgaatagagccttttataagactcactttcttgaactcctggcctcaaattctcctcctgcctcagcttcctgagtagctgagattacaggctcaggccaccacacccagcttaaaagtcactttcttaccaaaaaaaaaaaaaaaaaaaaaaaaaaaccctttttttaaaaaagggcccccaaaggggtgcccacaacaattggggcgcacctctcctaaggagagcgcctggcgcgctggggaaaacacactggggtgcacaagcgcggggagtgtggattgccgcggcccccattcaaaaatggtggccgtacaagcaatttcttggggacagaactcgtcggcagaaataggccgccagaggaggggcgccaaggagtggtgccccgggggcgcccccacagagagggggtcgtcaaaccacacacgcggcggtaggagggacaacagccagatatcaccagacggtgcggcgagaagatcccccatataaaaggcggcataaagcgcgcgctctttatataacgaacagaacggccaagtattgtggcggcgggcggagcgccccaacggcgtcgggcgcggttgggagaaacccaatacgcgccgggggcagcctcgggacaatgagaacataggcggccaggggggccaccacttttaaccacacacgaactccttgtgggaaaagagaggggccgaattgggctaaacacggccaaggacccaggcggcggggacacccaagaagagcggcggggatcgggggcagactcctgtgcccccaagatatgcgcctcttggaacaggactcgtccctctccagtaccaaaccggggtctcccgcggaaaa

SEQ ID NO: 204882 - DNA, 430 bp, Homo sapiens
tagaccgcaaagactttatatcttgtttctactttttccacaagaaaacacatttttctctccattgacagctccttccactgccttttctttggaatggaggtcagggagcaatggaaactgaattcctgttatagatgttcagcagaagaagaacacagggaactggggagaggcaaggaaaaaaatctattgaattaaattctgcctgttagtagctgtgctgaaagtctggtgccaaagaaggaagaatttcttccagtattaattgaagcataattagaaggatatatggcacaggcagaatggaagggacatgtgtatgacccagtgaagtggttctaaacccgtgattttgcaaacctggtcatgtgtcagaccccctgtgtgggacatgaataaatcaaatgattgagactttcccagacgt

SEQ ID NO: 204883 - DNA, 566 bp, Homo sapiens
  misc_feature (22)..(22): n is a, c, g, or t
tacatcagctcggtaccggatnacgccacgtggtaagggagctacagatctgagtggaacagataatgggaaaggcagcgagcagattagactacctgatgagaaggaagagtggaagcccaaagagaaacagagggccagaggcacaacactctggaatagcccaacttcctcaaggagggtccctggtccgtcgtcacagggagggaaccatgatggaagaagatatggaggtgggattaagaagcaaccactgaaacatcaagtaggctgggcacaatggagaaagcggcaaattgttatgaatggtgaacacctgtaaaaagcaaaataataataccccatgctgaaacagagaagggggcataaattcatcctctgcccttctcttccttactcaattctcctaacctttggcacccttgagatatcccagatatactatatttgagggtacatctacacatctttctactccggttctacagtaccttccattagcccttgagtcttcccggatactaggagagacgggattaggtgtgtgtatgagacgtggcgtctgt

SEQ ID NO: 204884 - DNA, 1079 bp, Homo sapiens
ttctttgtctgctctttctctgtgatcagaagtagatatctgcaatcagaaccctgatatttggaggaagtggctattattgtccaccctggctgcagcaagctgacccagaaatgtggggttgtgtctccacagctgcctgccatggagtgggtggggatgggtagctgctacttcactgaaggctgaaatccaccaatgttaactgcaatttaccactcagaatttcccctagaagctacaagtgttcagatggactcatgtgctcccaaaataatcactttaggaactttctgccgatgtaattattatctaggtggagaggtggattcctgggccactctatccatgtctttgatttttcctgctttcttgaagatttcttcaactttatcttccagctctactattaaatgttgtgaatgtttttatctctgctgtcatatttttatttccaagtgcattatctgattctttcttccttttttctaattggttttgtttcataggtgaaatattttttctctgagcatgttaattatagtgtctttctgtgttattctgctccctgcattatccctgtttcctttgagttgttttcacctgttttctgtctctcacactggaggctttcctgaagcctctgatgatctttgactatttatatttaagagcagggctctaaaaagctgattggaaggtgttttaggtacttcagcaccatccaacagtaatataatgtgagccacatacataatttcaaattttctagtagccacttttagaaaataaaacaggtaaaattaaaaatgtattttacttcacccaatatatccataatattatttcatcatgtaatcaatgtaaaaaagtattgagacattttgttttttgcactatttttgaaatctggtatgtaatgtgttaatctacacacaaaattttcatttgtaatacataactcacatttagatttataaaacgtagagttgataagtagattcacatagttcttccaaacatactttgttgttgttctaaatatacttaattttccaataactgaatcaagtatccag

SEQ ID NO: 204885 - DNA, 365 bp, Homo sapiens
aagaagtgaatgatgaatatataactgtacatgagctacatggatttcttttaaactttttattttgaaataattgtagatttacacgcacttgtaagaaataatactgagaggtcgggtgtaccctttatctaatttcccttaacaataagatcatacaaatctataagatggtatcacagccagaatattgatattgatacagttccccatccttgttcagatttcctcagttttacatgtgtgtatatttaggtctatgaaattttcccatgtcggtttatatatccaccacaatggtcaagattgaagaagtgttatcatgaggctacattatcacagctacttccctcccatcccccttc

SEQ ID NO: 204886 - DNA, 427 bp, Homo sapiens
agcaccagccctctacgtcccataaactaggaattaaggttaacacagaccaagagcctacacagctctaagtaaatacaaagtacttaactcctgaaaacctaaggactgcaggattcatcctacatcaattgaatgcaaatcgaacactttaattaagctaaatcctcactagattggtgggattacatacccacgacacttatagttaacagccaaacaccctaatcaactggattcaatctacttctcccgccgcaggaaaaaaaaggcgggagaagtcccggcaggagaatcacttgaacccacgaagtggaggttgcagtgagctgagatttcaccattgcattcgatcctggcaacaagaacacaattccatctcaaaaaaaaacccccataaaactaaaaaacaaagtgaacactcggg

SEQ ID NO: 204887 - DNA, 403 bp, Homo sapiens
agatttttacctccagaactgtaagataataaattcgtgttgtattaagccaccaagtttgttgtaatttatgacagcagccataagaaactaatacagtggggcccattaatgtcttactaatacctcccagaattatagttctgtgttacaatttttagagaaatgctattcaacctgtaacaggggcccacatcagactgtcaatcaataaatattatagactgaataattcattttttttgtatgagaattgttagtatttggtcattaagccagcccatctgttagcctatttcactatctttgcattttataacaacaatttctaccagccattttgaatcatgaagcaaaaatgcatttactttaaatgatgctaaaataaacggtatggaataga

SEQ ID NO: 204888 - DNA, 288 bp, Homo sapiens
tggctgagtgtggcggagcttagctggacttgttcatacatctgtggttcattatgggtcaggcaggtagctctgtagctctgctgatcttgactgacttacatctctgggtatcagttggatgttgatgaatctaggataatttggggtatgggactgggatgactgaggtgactcaactcttttccttgtgttaaatcttctactagagtagtctaagcatgttcccgtgacatgccataggaataggagtgaaagctaagtaagggcttttttaagcctctgcat

SEQ ID NO: 204889 - DNA, 637 bp, Homo sapiens
aattctgacacacgctacgacacagatgaaccttaaagacgttatgttaagtgaaataagctagatacaaaaggacagatatagtacgattccacatatataaagtacctaaagtagtcaaatttattgagacagaagtagaatggtaattgccaaggactgggtggggattgaaggagtttagttggtaccaagtttcaatttgagaagataaaaaggttacagagatgatggttgcacaacaatgtaaatgtgcttaattccattctgtacacttaaaaatggttaaaatggtaaattttatgttttgtatattttaccacaataagaaaaaaatgtttaagttaataatgatcattatgacaagagataattaaggccaggtacgtaagcagaaacactgatttcattcactgctagtattcagtaacatgcaaaagttttggaaagatgatacatcaaatgatcttttactttactatacaaaggagtagcttgagaaaccctttaaatagacagcttgacttccagttccaagatggcaaaatgaagaaatatctgtccccttctactctaaaaaatcaattcacaacaaataggagggaaaaaaaagaaacccaagtacaatttgggtgaa

SEQ ID NO: 204890 - DNA, 488 bp, Homo sapiens
aattcatactgaagagaaaccctacaaatgtgaagaatgtggcaaagcctttaaccagttctcaagccttactcgtcataaaagaattcatactggagagaaacgctacaaatgtaaagaatgtggaaaaggtttttaccaatcctcaatccatagttaaaaggactactgactcaaactctgcctcttgagttcatggttcaccacttccagcctggtgacttggtgctgattaaaacttggaaagaagacaagctccacccaagttgggaagctccctatcaagtgctcctgaccactaagatggctggatgtgcaaacagctgaacaaaggtggactcactacactcaagtcaagggactggtaaaagggaccccagaaggcaaggaaaaagaccagtggaaagtgcatgggtcacctgaggaacccttaaagttaactcttggaaaaatctaaaaggaaaacatgggctggccccatttctgga

SEQ ID NO: 204891 - DNA, 214 bp, Homo sapiens
agaagataatatattattcgtatcacaattgatttttttctgactttttcctctgaaaggaaaagtgtatcaacttcaaaacctttgggtatttcttgacatgacttcttcactctgtcacaaacagctttgaaatatccatcattcctctcagatgataaacaactatattgctctttttttttttttgagacggagtcttgcactgtcaccc

SEQ ID NO: 204892 - DNA, 654 bp, Homo sapiens
tcaagaggtagggtctttttctttggctagtagcaaacatgacacagagtttgaaacatgcctgtgccttaggacagggcccattcttgcagcctgagaccacagtgcagagaagctgggctggcctccagaggtccaggcaacagccctgcaagccccacaggaactgccagacatgtgaatgaggcagtctggctgccaggtgactgcagaacatgtgtgatcccaggcaagaccagcagaagaaccaccagttaaatctggcccgaactgctgagccacagaattgggaacaaatagaatggtgtatttcacactactaaattttggggtggtttgttaagcagtgataaataactgatataatcatgcaggttgaaaaacatgtgcatatttgaagtggccacaggctgctagtttgagaccctctgctttagataaatgggcttaaacaacctccaagggtccccaggctccagcatactgcagtagcagcagaattattgcctgtgtatgaggtgctagcacagactgggccagaccaaaggggacatgttgataggaaacatgctggtagcaaaccatgtggactgatgcctacggaccgggcagctgataggaaacctcagcatatgtcagcatagacagatggca

SEQ ID NO: 204893 - DNA, 211 bp, Homo sapiens
tgttgatcaattttgtttcattgatacagtgccatctactgacaaaaattggtaatcataaggctttaagtctgtcagaagtcaaagagttgggtccgggcacggtagctcatgcctgttaattccagagttttgggaaaccaaaacgggcagatcacttgaggtcaggagttcgagaccagcctggccaacatgctgaaaccccatctct

SEQ ID NO: 204894 - DNA, 468 bp, Homo sapiens
ctgaaattctgtacctattaagcactaactttccatttccccctttctgggtttcttttcatccctcaaaggagctctgctgccttccacagagttcttatatacatgctaatctctccatctgaaacacacttcctctcccctttgcctagttagcctcctgtgattcccaacaccagcctagaagcttctgtaaattctcccaaaacccctgctcctccctgaagagcagtttgtatttatacaggtgtttgattgtttgaagggtgctctcaccctgcctcctctcttaacatagtttttcgtgtcaggaattcctcgctttgtccacaacccctggcacatagcaggtgctcaatacttgctaaatgaataaatggacggactctgctacctacctaatctccttccagccagtcatccatctgtgggtgcctcggtccccagcttggggtgtgtccccctggg

SEQ ID NO: 204895 - DNA, 401 bp, Homo sapiens
aaagaaatgagaagggaactagcatcaactgttccaagtacttcatatacatcatttgttgaatcccaatcaacagtcttacaaagtcttattacctctgttttgaaaataacatagccaaggatcaaagaacctaacagacttgccagtaaagctgtttgtcttcagaactgcccaggtctacattattgacaactcattaatctccctggcaaacttatattctactgtcaacaaaattataccatacatttgggtattttcttatgttattgagtttatgtcattcttaaatcacttatattattacagcaaagctgatgttttccttaaattttcatcaacaactctaactgctgagaatattttgtgccgaataaaatagtcatgtaaatagatca

SEQ ID NO: 204896 - DNA, 178 bp, Homo sapiens
ttggggatttcaagatggcagctattcacatatgtgcgttagcaataaagaaagacagggaaaagggaatacagagagccatttgaaatgtcaaacaaaaatcaatggagcaaatcaggaaaaaaaagaaatatgtgtcaggagcagtggctcacacctgtaatcccagcactgtggg

SEQ ID NO: 204897 - DNA, 536 bp, Homo sapiens
taactctatgcccacaaatttaataatttagatgaaatggaccaattccttcaaagacataatatgccaaaactcatacaagaagaaacagacttactgttattaaataaattaaatcaatagttattaaccttccaaaacagaaagcatgaggtccagatggattcagtggtgaaatgtaccaactattaaaggaagaaattatctataatgtattttagaggacagatgtagagggaatatttccagaatcattctacgaggtcagcaaaaaacttgacaaagatattacaagaaaactacaaaccattatctctaatgaacacagatgcaaaaatcctcaacaaaatattagccaatcaaatccaacaatgtattatgcggtgtaaaagaattatacgccacaaccaagtgggatttattacaggtatacaagactggttcaacatttcaaaatcaattattgtaatccatcacaccaacaggctaaaaaagaaagacagatgatcatatcatagatgcagaaaaagcatctg

SEQ ID NO: 204898 - DNA, 440 bp, Homo sapiens
aatatccctccctagtgcttagcctgttctcatggagttagaaatgaccatttgcaaatgtcctttactgagtaactgaagaaatccctgcagcagtgtgacacctctcacattttacaacaattatcaagatgaaggcaagatcaaagacgtgaagtgctttcgttttaacagagcatttggcgaaatatttcatgatacccatgtgaatgaattagagaagtatgacttaaacaaaatcagttggttgaataattaaaaaaaaatccaaagaatattgactacagatcactgtaaacttgaagggaagactcttttctagtcagttaccacatctttaaagtgaagggagtgttccaatatttggtgtaaaagatgatttttggttgtgcatgagggatttttaaaaatatttaatgtgtttattttaatgtatagta

SEQ ID NO: 204899 - DNA, 349 bp, Homo sapiens
cccctctgcaggtcagtgtacttatccataagatgggccacagtgatagcaccaaccccatggtggttactgcaatgattacatatttgagtgaatatatgtaaagcacttagaacagtaccaggcacatagtaagtgttcaagaaatttcagtcatctttctaaacatttgtatgtgtctataaacattgttttgtgggtttaaaaatgtctataaatgggattaatatctttaaaatttatatattttaaagtcagaaacacatgtatgtagtttaaagaatgaagtagttctagaaggcttgttataaaaaacagcagttccctgattctagaaccctccttctcc

SEQ ID NO: 204900 - DNA, 786 bp, Homo sapiens
gcctcacgctcgacctcttcatgctcggctacttccagctaccggagatgggcctgagccgcgaggatcgcaagttccgccacctactgtgctacgagatgttccaccggctggacagccacccgtgggagcgcatccgcctcttccaccgcgtggtgctggaggaggtggaggccggccggcgcggctggagcgacggcttcgaggacctcaggcacaggttcttcggaaacggcctggaggctgggccggcccccgaagaacaggcgaagaaaaaggaagagaaggggaaagaacaggagcggaccgaagaggccgctccggttcagaagggggacccgcccaaggggcagcgcgaggccctggcccctgtgccgcagccgccgccaccgcccgccgcgcctccccggatctcagactctccgggttccgaagcccccgccgaagaccctttggaactagtgtctgagatgggcgaattcagcaacgaggacatctgccgctacatcgaccgcagcttctccttctggaaggagaaggaggcagagctgtttgacatctgagcagcggaattcggaattcgcagttcaccctcgagcgtcttaacgtgggcctggacgcctgtctgacgccctccagaggcgtgaagcagcgggaagaacccaggactgtggccttgagcagcccggagggcccaggaccaggctgcctcagcctctgaggtcccatcgtgagcaggttgtgtggggcgttggtcggataggcagggcaggcacagaacaaacc

SEQ ID NO: 204901 - DNA, 551 bp, Homo sapiens
tgagattacctcaactaggatggatccatgggaatggaaatagggagtgagaaatactaaagacagtaaattaaaagcaaaaagtcttggtgactgacaggttgttgaggctgtggtagagagaggagtcaaggttgaccacaaagatttaaatcagaatagatgggaaaataatgtaattaatggaatacatcattcaagtcaggaagaggaacataatgtttgagactcgaagattttgaagttgtggcaggaatctgagtgggttgccaagcagattgttgaaagttcaagacagaagcttgggtgagagtttggaactgaaggtaccaatttggtggtcatgttcaaggaagtgaggcttggaatcttgttagttcatagtcatcaagctgtagagttgagagagcaatgtgaaaatagccaaagacataacaaggggagttgcttgaggaatgagagaagtgatagagtgcccactcagtgttgaaagacaggacatttaaacattgctaagtgctagttgctaaatgtaattaagaaatattatt

SEQ ID NO: 204902 - DNA, 546 bp, Homo sapiens
agagaaaaatgggtgataatgcttttattatttaaaagtgtttttttttcctgagtcttattttgaaaaattatacagaatagtttgcatggcatattccttgcatcatagaacttgctctgcttcaggccaaattgaaatagagacagaaaagaaagagaccaagaaagaggatatggagaatatcagccatttgtttcctttcccgtattcaaagacaaacatctcagttgcctggatctcttgaaattagtacttgtaaaagcttttaagtgttactggaatacattgttaaagccatatctggttgaaattttctgattaagcacaattaaataattgtttcagcaattacacagttcatgattatggtatgtgatgggacattatttttttaaaatctattattaagtaaaatatgtattggtggccaagtataagttttagtacaacttgctatatcttggacattttgcatatatagcttaaagaccagtggggtagactgggaagttttgtcagcttcataattttggaaaacagaaa

SEQ ID NO: 204903 - DNA, 177 bp, Homo sapiens
gactacaggtgtgtaccatagtgtctgacttgggttaagacttaaatgtaaaaaaaaccctgtaactagtataagaaaatataggtaaaaaaataacctcaaggtggagagggcctttctaaatataaaaccaaaggaagaggccaggcaccgtggctcatgcctgtaatcccagca

SEQ ID NO: 204904 - DNA, 396 bp, Homo sapiens
tcacctgaacctgggaggcggaggttgcggtgagccgagattgcaccgttgcactccagcctgggcaactagagtgaaactctgtctcaaaataaaataaaataaaataatttagccaggtttggttggtggcaagtgcacctgtagtcccagctacttgggaggctgaagtgggaggatcacctgagcctgaggaggtcgaggctgcagtgagccatgattatgccaccgcactccagcctgggtgacagagtgagaccttatctccaaaaacaaaggaaaattcatatgtaagtttttgtgtgtacatatgttttcacttctcttgggtatttacttaggagtgaaattgctgggtcatacgccagttaagcatactcggtaagtttaaccttt

SEQ ID NO: 204905 - DNA, 452 bp, Homo sapiens
ctgacgctggacaacaggctcgactcccagggcgtcctcagcaccccgtacttccccagctactactcgccccaaacccactgctcctggcacctcacggtgccctctctggactacggcttggccctctggtttgatgcctatgcactgaggaggcagaagtatgatttgccgtgcacccagggccagtggacgatccagaacaggagagtttgaatatctaagatgccagtcttggaagatgccaaaattggaaggctctggggctctagaattcttggatttctggggtgtgtgttcccaatcaccaacacttgtaatttgcttgttggctgatcctattcaaaaggatcatccagacaaaaggtgacgaagaatgacaaggtttgcttgactcctttttgcaatttatctgggactaggattaaaagaaaggagaagaaatactcatg

SEQ ID NO: 204906 - DNA, 767 bp, Homo sapiens
tacttcagttccaggcatgccttcactgtgcagctgccttgggctcctgccggctcctgcccagggctaattcctaaattcccaattcaccaactagggccaatctttagagatgaaactacagcaatggattcagagtgggggggtggtcacagaactgcactctgagatgagaagcatgaatgagaacgggctgtcaggctcctctgtcagttgactgagttatttttacttaagttagctagatcattcaaacgcttcattctactatctagccctctctatgactgcacacccaccccctaggaaattcctttttctttcctttgtgatttaaaagctaaaaccaaaatgcttcataggaataaggtatgtacccttagccctcctttctcacagaaaaaagcatttattcaaagtacttcacatggtaggacgaaagtagtatttaatgatgacacccaattaaatggcttctggccttccaaagccacatgactatcctcgagttccctgagggtgaggcccctcagaagccctgtctgcctcagtgaccactgcacataaggtcatgcagaagcctctggtgccagcaccacctgcaggcctctggacacctttgctcggcctgggacagtcacatggccatgcagttctgtccatccactccaagacacggagttaggggcaggggagaacagatttgagagaccatcatccagcattccttctcccagcctggggcccaggtacacaggtgaggaccc

SEQ ID NO: 204907 - DNA, 778 bp, Homo sapiens
ggaataattgtttgaggccaggagttccagatcagcctgggcaacatcatgcgaccccatctctaaaaacatctttttaaaaatgagccaggtgtggtagcatgcacccgtagtctcagctactcaggagcctgaggcaggaggatggtttcaacataggagatcgaggctgctgtgagctatgatcgtgctactgcactccagcctgggtgacacagcaagttcctgtttccaaacaacaacaagaaaacaaaacaaaacaaaacaaaaaatagatagaatagtgacaataaaaatggagaaaaagtaggctgactcaggaaatgcttagaaagtacagccatacctcaaagatattgtagatttgattcgagaccaccacaataaagcagatattgctacaaagtgagtcacacaaattgttttgtttccttgtgaatatgaagttatattggctgggtgtgatggctcatgcctataatcccagtactttaggagacggaggcgggagggtcacttgagcccaggaattgtgagatcaacctgggcatatagggagatcctgtctctatttaaaaaaagaagctatgtttacactacactatagtctatttaaagtgtgaaatggcgttatgtccttaattttaaaactcttgatgctggctgggttcggtggctcatgcctgtaatcccatcactttgggaggccaagacaggttgattacttgaattcaggagttcaagaccagcctggacaacatggcaaaacacgtcttta

SEQ ID NO: 204908 - DNA, 181 bp, Homo sapiens
cattagcatgggtagtcatgacctaattgggtgagccattcaaaaaagtcaagagagatctgaatccagagaaactctcctgctggtcttaagggaacacaatggcaggttgtggagatgaatggggcagaaaatggccagcagcctcaagaacctaaggatacccccagttgacaaccag

SEQ ID NO: 204909 - DNA, 322 bp, Homo sapiens
aacaagcatgtgggtaaatcagtgtgcataaagcatgggagcacgggatggggaaagaaagggagtggaggttcacagcagatgcccaggctgtatttcagaatgaaaggaaacacatacgcagcctgtctcaaagttacatcttgagattaaggaggaaggaggaaggaggaaggaaaacaaagtttgaaaacacggtttgaagccacgctgctcctttacaaaacctcatgggcacctctcagactcctcttctatgaatgaaatgtgtctcttttctttaaccttgtctccagagtgattttttaacctgttttcatca

SEQ ID NO: 204910 - DNA, 436 bp, Homo sapiens
aaagtccatacatgtagcgcaagtaaagctaaactaagtgtatattacagaaataaaaacatttttttaaaaaaatcacagggaataatatatataaaaaataaacccactaaatctatttttcctgtggttttaaaaactgcccaaactgaccttgcccatgaacttccaaattctaatactttttaaattgaacactacagataatgttagtcagtttctttttacattataaatttacatgagccttccctcaattatgtccttgctggatactacatgcatacttttctcataagtctatggtctacacaaagtacactaagagagaaactaaggtggctttgattggagtaaagatagaacaggggaaataaaagttaaaagagttcattattattgagtacatactatatgctagaggtaatccttactt

SEQ ID NO: 204911 - DNA, 520 bp, Homo sapiens
aaggtgatggcacccacctttaaacacggggctggtaactcagctcacacccgaccaatcaggtattaaaaaaagggctcactaaaataccaatcaggctaaaagcaggaggtaaagaaatagtcaatcatctatcgcctgagggcacagggggagggacaatgatcaggatataaacccagggcattcgagcaggcagtggcaaccccctttgggtcccctcccgttgtatgggagctctgttttcactctattaaatcttgcaactgcaaaaaaaaaaaaaaaaaaaaaaaaaaagctattgcattgcatgtctgagtaactctctgacatcactttctatcattctccccaactttcattctgttccaacctctcaactaccattgctgtccttagaattcactaattataatcttgacccaagggcttggtcctcactgttccttctgcctggaatgtcttccctcaactatctgcatagcttgttctctcacttcaattaaagccctgcataaat

SEQ ID NO: 204912 - DNA, 119 bp, Homo sapiens
gattccatttgattccatttgataatgattctactagagtccattcaatgactccattcgagtccattcaacaattccattcgactccatttgatgattccattggattccatttgatg

SEQ ID NO: 204913 - DNA, 313 bp, Homo sapiens
gctccaatttacatctcaccataactcaatgggttagacactagccctactctcattttcacaggaggaaactgaggcacagcggaagtgactgagccagtgaatgagctcaaacccaggtctgcctggcctcagaaccacctttagccatctctctatactgtctctccttaacacagaaatgacatcagctcaaggtcagatactggaaagaaaaatctgggccaatgacaataagtgaagggtggtgggatttggtgttttagtttttgtgtttttcctctctctcttggtttctattagatttgtgcag

SEQ ID NO: 204914 - DNA, 446 bp, Homo sapiens
tcatattgtatgattctatttatatgaaaggcccagaataggcagagagacagatagcagagtggtatttgctggaagcttcaggtggggagaggattgcagggtgaggggctgataactattgggtgaaatttctttgtaagtaataaaagtgtttgattaggcatggtgactcacgcctttaatcccagcactttgggaggctgaggcgggcggatcacttgaggccaggagttcaaaaccagcctggtcaacatggtgaaaccccatctctactaaaaatacaaaaattagccgaatgtggtggcgggcacctgtaatcccagctacttgggaggctgaggcacaagaatcacttgaacctgggaggcggaggttgcagtgagccgagatggtgccactgcactccagcctgggtgacagagtgagaccctgtctcaaaaaaa

SEQ ID NO: 204915 - DNA, 449 bp, Homo sapiens
aagcaattctccttgatttttactcatctactcctcttcaactgctcactccattatgatagggacatgcctgtttactcacctagcacatgggagttgccctatactgatggtgaaacttaatgcttgcgccctttgttgagtcatctctcagagcccttcagcccatataaaatatttgagaagctgcccttttggaaactgtgtatgatgctgtcacagggtattatatccccagtcatatgtagctgttcagctaaagtgtgatccatggactagcagcatcaggatcacctggcagcttgttaaaaatgcagaatctcgtccgggcacggtagctcacgcctgtaatcccagcactttgggaggccgaggtggtcagatcacgaggtcgggagatcgagaccatcctggctaacatggtgaaaccccgtctctactaaaaatac

SEQ ID NO: 204916 - DNA, 368 bp, Homo sapiens
cagccggccccagtgtagactaactattagtggcaggttagttgtatagggctcatggtaggggtaaaaggagggcaatttctagatcaaataataagaaggtaatagctactaagaagaattttatggagaaagggacgcgggcggggggttaggtctacctggccaggtagacctaactatgcactacagccaaaatgtggtgctgcatgaattccaaagaggcaggggcaacacatctagttggaacatcagagatagcttcatgcttgacggctatgggtcctgaagaactgagtgagttttaacaggaatatatagtccacatcaaagaaacaacataagcaaacatgcacgggaaagacaga

SEQ ID NO: 204917 - DNA, 498 bp, Homo sapiens
gattaatacccttttactagtttagtttttctattattgcctgaaaagcatttttctgctttagaaaacagtccagttgacttttgattgttctgtgttttgaggacgtatcttgagtaatttaagaaataaagtgttttgggtttaaaagctcccatgtcttaagttggtgaaatttgaaaaggtatttttaaaaagagggatattcagggctgggtgctgtggctcatgcctgtaatcccaacactttggaagacagaggcaggaggatcgcttgaacccaggagttggagaccagcctgggcgacatagtctgtacaaaacaaacaaacaaacaaacaaaattggctgggcgtggtggtgtgcacctgtagtactagctatttggaaagctgagacaggagaatcgcttcagcccagaaggttgaggctgcagtgagccaagatcacgccactgcactccagcctgggcaacagagcaagagcctgtcttaaaaa

SEQ ID NO: 204918 - DNA, 280 bp, Homo sapiens
ctcccaaagtgctgggattacaggcgtaagccactgtgcccggccataacattttaaacgtcatagaagtcataatgggaatgataaaaaagaaaaaagggatatatttggattaagatataaataaaaacttcatagttatcgaacaggaggcaaaaataaaagattgttgtgagttttaaagcttcggtgatatagagaaagctattttcagtgatggctatagggtggtcagtaagaggattgttcacataaagtctaggagacttccttttgactg

SEQ ID NO: 204919 - DNA, 713 bp, Homo sapiens
ctattgttgtagtacgaaagcagccatagacaatatggaaatgaacaagggtggccgtgttccagtcaaactgtgtttacagaaacaggcagtgggctggatctagcccgaaggccatagtttgccgaccccgatctagaagatagctacttctgataaatatttatctaaaagatcagtatgtgactgtgtatgtaatctagaagacagatacatgccagttgctgggatgagtggtaagtgacaaatgtgtggtccctggcctcataaagttctcagagttatggagggagacagctgtaataaccacaccagtagtgagtcagtacatttgtgacaagtgccatgatggaaaaacacaaggtgctctgaaagggtttaacgggtgcctttgggaatgaaaagtggcctctcattgctcttagctgacaatgtttttgtttcactgaggaaaaaaagcaatcagaagaaactttgttttcttcctttgtctagttttgcctgcatcatccatccatacctgtactgggctttccctcctgttagtggataaactgtccttgatcctctcctagcccagcccttgctccctgcattccatgccctctcaagaacttgttgaacatttacccccttctcttttacatcatcagtttctctcctggattattcctgccagcatgcaaacatgtcaccagttgcaaaagttttct

SEQ ID NO: 204920 - DNA, 720 bp, Homo sapiens
actgcattttcaatccatggtgaatataaggatacagagtctataaattcagagcttgcatacaagagtagatagaatgccaattgctggtggaaatatataaaaaataattttttgttcatttatgccatgccttgttttaaaaaatacttacaggacaggcatgttggctcacacctgtattcctagcactttgggaagccaaggctggaggattgcctgcgctcaggagttccatacgagcttggacaacatggcaaaatcacatctctacaaaaaatacaactagctgggtgtggtggtgcgcacctgtagtctcagctacctgggagactgagacaggaggattgcttgagcctgggaagatgaggctgcagtgatctgtattcacgccactgcactctagcctgggtgacaaagtgagaccctctctcaaaacaaaaacaaaaactccaaagatttgattatagggaccccatgggtcctcttgggttactggggtgcattagggtatctgtggatcccctttacttgcaggcagtcttgtctacagtttctgcatacatatttcacatatactttctggggggacagttttgggcttcatccaattctcaggcaaattgagtcccaaatgggttttaacaacactgatctagggtaatgatttccaatatttttggatcatggacccccaacagttgaaaattgagcacacag

SEQ ID NO: 204921 - DNA, 464 bp, Homo sapiens
aaaatgctgtagtatttcacatatcccatgtacatcctcctgtatactttaaattatatgttgcttataatacctcatacagtgtaaatgctatggagctatattgtttagggaataatgacaaggaaaaaagtctatacatgttcagtatagacacaaccactcgggaccctctctcaaaacaaaaacaaaaactccaaagatttgattatagggaccccatgggtcctcttgggttactggggtgcattagggtatctgtggatcccctttacttgcaggcagtcttgtctacagtttctgcatacatatttcacatatactttctggggggacagttttgggcttcatccaattctcaggcaaattgagtcccaaatgggttttaacaacactgatctagggtaatgatttccaatatttttggatcatggacccccaacagttgaaaattgagcacacag

SEQ ID NO: 204922 - DNA, 210 bp, Homo sapiens
gtgtttcgtttcttaagcaggagagtgtagacagtttacagggccatttccaagagtgaataggcctgtttttcttcagcaactctaaagtattatcagtagtaaaactgtaaacctatatctgcccaataaaaactagtattgatatttattccccaagaagttccccaacatggacccgtactaaggaaatttacagacatttaagct

SEQ ID NO: 204923 - DNA, 169 bp, Homo sapiens
tgtctctacgtggtggtaattgtggtcactagcagttctacatttatagcattgttttaactaataatcctcccccaaaagagagagtatctttcttgatagtttcagccaaagtcttcgggtgggggagaagtctcattgacgttttgtgtcacatgttcattcttga

SEQ ID NO: 204924 - DNA, 1126 bp, Homo sapiens
aaatattctaggcattcatacctcatgagtcatccattgatggcttctttctggacaactcgttcctccttcacctacattggagttcagttttatttactgagatatgaggtgacagacatcaaaataaaagtttctgaaataggtgtggaaaccattcaggttggggagtgatctgtgagttagctcagaacttaaagagtagaaagagtaaagtatataaagataggttgggggagaagaaaaagaatcagcaacggatgtcaaggactattcatagagaataaacaggacagataaggtaacatttcaggatatggtggcaacatcaagtggagaaaggcaaagcaaatcaggctaaagaaaaagccactgagcttaacactgacaatgagagggcagttccagtgaggtgtggtggtgaagccagaatgtaagggatggggcacttggtacattacttagtggcctgtctgacaccgcatacacgcaggagtgtacatttctgatcacattaacaagtcatgtgtaattactaagacaaactaaagaaaattttggccttggagttatttataaggtctcttatgatccttttgcttttaagtctcctatcctacttttatgagggtactacagagcactttatttttggcaggcaagagtaaccctttagttccacagctatcaaagcaactttcccttttattgtagcttttaaccattcaaagtactgcaagtcttcagtggttgtgattcatctagtcttcagcccctttgttacaatcactgtcccccataattaaaacatactctgtaggaactcagtacactgtgatgccagccctaatggtagaataagatactgctcaccctttacaagggcactgatttgcctcctatctgtgtcacacctccaaacctttgaaacactcacgtgcagcagggagacttatttgagcacccataactatctttctgaacactgcaactcagtagtaatgctttgggttcaagactaaaaaacaatacatcacagcttccaaagggaaaatataatacaagtaaaacattgcttggccatgcgtgtggctcatgcctgtaatcccagcactttggcaggcca

SEQ ID NO: 204925 - DNA, 126 bp, Homo sapiens
aagaggtggtatatcatcctccccacctgtgaaaagaaatgattagattgaacagggttaatctaattgtggttaatctttgggactcaaatacaggcttcctgaaatgtttctttgttgaaatat

SEQ ID NO: 204926 - DNA, 813 bp, Homo sapiens
gtcaggagtttgagaccagcctggacaacatagtacgggcctgtctctacaaaaaaagaaaattcaaaaacttagttgggcatggtggtatgtgcctgtagtcccagctactcaggaggctgaggcatgaagattgcttgagcccggaattttaaggttgcagtgagctatgatggcaccactgcactccagcctgggtgacagagtgagcccttgtcctaaaaaaaataaaaaaaaaataaaaaaataaaaaaaaaaaaaagaaaaatataaagaaagaattagaatacttgaaacctagccaaaaccttatccttacttagggtgatcctgtgcttccatttgctaatccatagatactcctaatatcttccttctcttcttcataagtgaggagataagatgaaataaggaattcgtaaatacaaagagagtcataaagcatcacataaatgttatgtttattttatattgaaatgtccacctgaaaaactttctctggcagagtgcagggccagatgaaattcacatgaaggaggaacacctgatctgtatggccctgtcattattatgcatacccatggaaccagctgggcactcagggttatatgtggtagccacagcagggtgatttgcaacccccactcctatatccatcaagacaaggccaccacgaggccccctatcctgctgtagatgacctgaaatacgctgtccccttagaggttgctttctttggaattgatcatgaacatctgtttggtttattgcagaacccacagaggccaacacagtgcctggcacattctaatt

SEQ ID NO: 204927 - DNA, 511 bp, Homo sapiens
tccatgtgtgaaccttgagtgatactaatcatgtaaagtaagagttctcttatgtattattttcggaagaggggtgtggtgactcctttatattcgtactgcactttgtttttccaaggaaatcagtgtcttttacgttgttatgatgaatcccacatggggccggtgatggtatgctgaagttcagccgttgaacacataggaatgtctgtggggtgactctactgtgctttatcttttaacattaagtgcctttggttcagaggggcagtcataagctctgtttccccctctccccaaagccttcagcgaacgtgaaatgtgcgctaaacggggaaacctgtttaattctagatatagggaaaaaggaacgaggaccttgaatgagctatattcagggtatccggtattttgtaatagggaataggaaaccttgttggctgtggaatatccgatgctttgaatcatgcactgtgttgaataaacgtatctgctaaatcaggaaaaaaaa

SEQ ID NO: 204928 - DNA, 240 bp, Homo sapiens
atcatactaaaagcaatgtttaaatcaaactaaagattaaaaattaaaattcgtttttccaataatgacaaatgccctgcacctacccacatgcactcgtgtgagacaaggcccataggtatggcccccccttccccctcccagtactagttaattttgagtaattgtattgtcagaaaagtgattagtactagttttttttttgttgtttcaaaaaaaatttttttgtgtgtgtttttt

SEQ ID NO: 204929 - DNA, 465 bp, Homo sapiens
tcagaaagatgtgtttggtaacatatattaaaaggcagaaatatgcaaatgcataaacaatagaatttgacataattatgtgataaagtgaaatgctcctgcagttagttattgaacatgaaggacctctctaattcttcagagaaactgtgagataatctctaccatttatgcttagcaaggagccatgctgcagaggaaaagtagaaatacacacgagtgacaaaagcaaaaaaatatatatatgaaaaactctgaaaccaccctcaatgaaaagtaatatgtctgtatttaaagagtaggtaaatcatatagtgaatttagaaggtaaaaaacgaggtctataattacatgagtatatagaaaatgttaagtgttttcgtgaaaaggtatataaacaataatgaataatcatttcacattgaaaataatttaattttaaaaggagatagtacaaataacaaa

SEQ ID NO: 204930 - DNA, 510 bp, Homo sapiens
aagcagttaatacagaccagctccaggtaaagtcagaaacttctccctcaatttctccagtgggggcatgtgttcaggatagcaggctctctcttacccacttccactgttggggcactcacaatatttggggtgtctcccaggtcctacaggagcagtccccttccttcagagggtctgtggggcctcttgagattgttggtttgtccttgcagttctggagttaaaattcaccatgtgagtcttcacacactgctctctctggagctgcaatctagtcgtgtctcctgtctgccatgattatcctagaggtccgcgaatgtccctaagaattcattactttgggaatctagttgtactggagcagtgacattacacagttctctaagttactcatatgcccttaagaagaagcaatctaaacaacataaaattgacacctctaaatatttttatcctacaaaagcatgcattagatgacaagtgagttatgtgagtctgtattaactg

SEQ ID NO: 204931 - DNA, 340 bp, Homo sapiens
gctgcagcagccctggagtggggagtccagcatctctgggcttcattgcttccagagcatgagaattctagagccgaggtgctcgtgacttccttagagtaagttaaaattaaaagcagcccagccccagctagagtcagtgccatgtgtgcacatgccggcagcagagccgggagcagtgggtctgggagggtcttcagaggtttccaaggcgaacacaccaaaggccagaaggaaccactttcctgcctctccgtctggtggtccaggggctgcatttgtgtgctagagtcagacttttgagttttcctttaaattggaaaaaggaaacaataatgat

SEQ ID NO: 204932 - DNA, 543 bp, Homo sapiens
aatagtaaacacaaactcaaatgtaaatactgaagtcccttcatggttctctattataaggaggtggttgttataccaaatgtgttcatatgtatactccagattacccctgaaattaaacacaacattgaatgtcttttagaaaacaatttcttttgcatccaaggacaactaggtacctgggtattcaagtttaagaattactgattttagatgttgaatcacactttgaatcctaatgtaatatataagtgggaaaatttttagccattttgacctgtttttttttttgttcctcttagcttatcaagattaggcaagcacttgccgtctttcttaaagaatggtgcacaggagtagcaattttttatgggaagaaaatctgcttaatacaaagggttgtgtcagtggaaatttcaaattaggtacagggagaaatgatgatcttattattacatttaaatcctgctgaaattttgggtaaaaaaaaattcaaacatgaataaaatgtttctcgtgctgactgagcgaatttactgtgaa

SEQ ID NO: 204933 - DNA, 374 bp, Homo sapiens
accactacatccactctcgcattctatcagtgaacacctggacctaattgacaacacctgccctcttaggaaaaccctgctccaaagaggcagcctggtactgtgggaacgacagtttagggactctgtagaaccacagacctccatgcagatctcagctctaccatccaagcgctttataacctcaagcagtttccccctgtgagcttagttcctcatctgcaaaataagaatggggttaatggcaataacctttccatgtttgtgtaaagactaaatacgataagatatggaaacaacctagcacagggcctgtcacagaccaagggatcaataccaccaagtcaccctaaaagggaagcacagcacattga

SEQ ID NO: 204934 - DNA, 404 bp, Homo sapiens
gtacaaaagctgataaacttaggacacagtgagtggtgtctggtgtctagtgtctagctttcatttacatttagtaagcaagtggtatagaggtggtatagcctctataccaccagagttagtgtgtgggggtgcattttaatcaaccacgttggccaatgctgcctacctggagtgaccccaacccccaactaaactgtgagctgtggaaatgaacaaaagccagccaaatgaggagcaaaggctatttattcagagcttgtgctagcgagggagtcagccaccatcccttgtgttttggcagaaactcagaggcaggtaggggagtgggaaagcctcaaagaagaaagaaaggaagccttcgggttgccctgagtggagggtgttggcctggggaaaatgaa

SEQ ID NO: 204935 - DNA, 300 bp, Homo sapiens
ctcctgactctgcctttttagttgcttaatgagatctttcatagagcagaaatttttaattttaatgaagtccaatttatcttttttttctgttacggattatataaagttttatcataggtgttgaattttgtcaaataccttttatgaattttgtcaaatatcttttatgatcatgtgatttgtcttatttgccctgttaatatggtgaattacatagatttttaaatattaaaccagccttgcatccctgaaataaaccccacttggtcataatgtatgattttttaaaatgttact

SEQ ID NO: 204936 - DNA, 383 bp, Homo sapiens
aaatataagctactatatacataggatatcatttaaaagttggatttcaatggaagtgaagacataaggaaaggcagaaagaccatgtttcttgaaactatttctggtctggttcttgagggtttctagattcttgggtcttgtgcatatttatattatcttatcaatattaatcaggcaatggctctaaaaattttacccgtctaaaaagtgttgtataaaaaggcctcggaaaatggaaaccattaacgaagtatcttctacttcactttaaactctgctttaagcatcaactagtctgtcttgaaattcactgtaaagcttgactgcctggattcgaatctatagtataagcaaattttgtgaatgcataaactggtatc

SEQ ID NO: 204937 - DNA, 622 bp, Homo sapiens
atacgttttttttagagacagggtcttacgctgtcagccaggctagaatacagtggtacagtcatagctcactgcagccttgaccacctgggctcaagtgatcctcctgcctcagcctcctgagtagctggtgctacaggcatgcaccaccatgcctggctaaatttttttttttgtatttttggtagagacggggccttgctatttgccttgaatgcacaagttgtgtggttgtggtttcctgtgaatgggggccccatagcaaagtaaggtcagttatagaatgtaaaggggattatccatgttgagtaccatctcctagggtttcaaggcctagcctacagtcctaggattgcagaccagagcccaacaggatgagcttagggaagaagggacaatttcctggccaaggacctcctgggacaaaagtccagacagctggttttatgaaaggtgggagcatagcgccaccccgtggcagttggtgtgagtgcccccagcttctggaacggcacccacaggtgcagttctgattcctagaagcagagctcccagtgccaatggcaaagggtggtcagcccaaaaccaggggctaatgaagaacacagcagagcctcagagg

SEQ ID NO: 204938 - DNA, 626 bp, Homo sapiens
ggctagagtttacactatcccaatcaaagaattacagtacacatctccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgt

SEQ ID NO: 204939 - DNA, 384 bp, Homo sapiens
acactcactgttattgttgttgtttttgagacagagtcttactctattactcaggctggagtgcagtggcatgatcttggctcactgcaacctccacctcccgggctcaagtgatcctcccacctcagcacctcccaagtagctgggactacaggcacatgccaccacacccaactaatttttgtattttttgtagagacagggttttgccatgttgcccaggctagcacttttttcttttacaaggtttcaggaagagtagatagagttcaagatgggagcctgtgaaagtgaggccaaaccaagggaaagggttcctagagtcctgtcctcatcttacagacgaggagactgggtccacagggggctttctgcgtgtcagca

SEQ ID NO: 204940 - DNA, 606 bp, Homo sapiens
taatctgatgagtacgaaatagtatctataataggcatttatcattcttttaggctgcacagtacttgaatctcattgcaatgattagaactaatttgtggggaaccatcatctttataatttataaacatagtttctctgaccatatattcagatttttcaattttcagtaaggtttatcatgtattctttaaaaattttgtaccttatatagatatattcctttatatttaatgtcttttattgttataaatggcatttttcaaattatatatattttttggttttggtggtagtacacagcatacaataaacttacagtactaactacatacatcagaaaaagagaaaaagtttcaaatcaataatctaagctgtaccttaagaatctagaaagagaagagcaaaataaacccaaaacaagcagaaggaaggaaataataaaagagcagaactcaatacaattgaaaacaggaaaacaacagaaaaaaatgagtgaaatgatgaactggtttttctgaagatatctagacaggtgaaaaaactccagcaattatcaacatcaataataaaacagaacaccactgcataccctaaaaaaaataa

SEQ ID NO: 204941 - DNA, 343 bp, Homo sapiens
tccagcctgggctatagaacaagactccatctcaaaaaaaaacaaaagagatttggtccatatgaagaatacatgatttcaaaattcaaattaatacaaatccaacatgaagaatacatgatttcaaaattcaaattaatacaaatccatcatttcgggtcagacatctcaagggcaaacaattcattgcttattaagaaatatgcatggacgctccagaattgtcctgccagaacaacactgcttccttagttaatctgtctgactcagtcactcacattcaatttcccttaagtatggctttaaatctaaggttgagaatttcagcagtcaaactgaatat

SEQ ID NO: 204942 - DNA, 253 bp, Homo sapiens
caaaggccattgcctgtgaagacttctacccttcctgccaacagggtaaagagttcttcgtcctctatctgctcatcatcacctagggaccacactcagcatcacacatggtggacagctggccttaagtgcctcctgccaacctcaaaggaagaggctggggcacgaaatataatttgaagagtttacttgagtcaaagtgaggacagctgctgagaagactcagaatcaagtaacctcagatatgagctcc

SEQ ID NO: 204943 - DNA, 294 bp, Homo sapiens
agcctgggcagcaagagcaaaactcggtctcaaaaaaaaaaaaaaaaaaaaaaaagaaagaaagaaagaaagaaagaaaaagaaaagaaatgaattcttgggaattattggtgagcaaatgtaaatataatgtaaccacacaaattaatacataatcacagtaagaaatgctataaagaaaggggttgtgaaagattagggggagatactgacccagtctgtgatcatgggaagtatctttgaagaagaaatatttgaacagagatagatggagtgtgatttaaccaggaaaaa

SEQ ID NO: 204944 - DNA, 422 bp, Homo sapiens
aatttagaaattttagaatttatatttaaaattttaatctctaaaaataaaattttaaagtttagacatttttccataaaaaatttttataaccattggtaacaaattattataatatgtcctctttataatctatgtccaaaagtatttgagctcctgtttcaatttttttagtagaacttttacatattattttaagagacagatgtacaatgctaggagttagagcaccttggtggtattaagtttttccttattaataggaatttttaaaataaactatgtgactggattttaatatattagtgtattagtatagttatcctgttttaagtgaggaccaatcattcatatctgttttaaatgaaggatgctaatcttaatgctgtaagcagtgacatcggtgtaggaacttgatatac

SEQ ID NO: 204945 - DNA, 604 bp, Homo sapiens
  misc_feature (580)..(580): n is a, c, g, or t
acctgcacacgccgagggtccagaccgcatgagctaaagtctcgatggacgaagttgttgcaggtcacggtggacgaagttgttgcaggtcagggtggacgaagttgttgcaagtcgttatggacgaagttgttgctgcacacgccgaaagcccaaactcagccccatggagaatatagtcaactcagtcggtggctgttgttgcctctgcatgtgttccccaacttgttgagaaaagagagaaaaagaaacaactagcaatggattcgtgtatttggaacttgagtaccttaaattcatgtccttgtcttttcctggtctctgcttgtcatgtaaggtaaaaatgctaagagtgaccttaacacatatggctttcaacttacttttgttgttgttgttttgtcttgtttgtttccatgaaaaatatttatattattttttttctaacctccagctgattaaacaggtaccttacacttattaatttggaggaaaaataatagtagctgcctgacataccttctcactttgaagagtctctacttttttaatttaaattttttttatttttaagtatgtnactcgcgtttcaggtaccgactga

SEQ ID NO: 204946 - DNA, 857 bp, Homo sapiens
acctgcacacgccgagggtccagaccgcatgagctaaagtctcgatggacgaagttgttgcaggtcacggtggacgaagttgttgcaggtcagggtggacgaagttgttgcaagtcgttatggacgaagttgttgctgcacacgccgaaagcccaaactcagccccatggagaatatagtcaactcagtcggtggctgttgttgcctctgcatgtgttccccaacttgttgagaaaagagagaaaaagaaacaactagcaatggattcgtgtatttggaacttgagtaccttaaattcatgtccttgtcttttcctggtctctgcttgtcatgtaaggtaaaaatgctaagagtgaccttaacacatatggctttcaacttacttttgttgttgttgttttgtcttgtttgtttccatgaaaaatatttatattattttttttctaacctccagctgattaaacaggtaccttacacttattaatttggaggaaaaataatagtagctgcctgacataccttctcactttgaagagtctctacttttttaatttaaattttttttatttttaattctggggtacatgtgcgggtttgttacgtaggtaaatgtgtgccgtggtggtttgctgcacctatccaccagtcacctagatattaagcccagcatgcattggctatttttcctaatattctccctccctccccaccccccgacaggcccggtgtatgttgttcctctctctgtgtccgtgttcaacttacttttgttcttcatctaggatgtcaaactttctagagactgagggtcaaatagaaaatctgggtttagaattgtccttattctcttgctcctg

SEQ ID NO: 204947 - DNA, 257 bp, Homo sapiens
  misc_feature (33)..(33): n is a, c, g, or t
tcttctctagaggactccctgagagaccgtgtngcatgtgcatagaaagtgtccagtggagtgtgttgctgtcatcctgaggaggacttaggacacacctgactgaggaggtcacatttgagcagagagacttgaatgaggggaggccatgagtttcatggatacaggggaaaagtgtcccaggaagaggcagcagcaagtgctgagcctttctgagctgcggatcctgcacctccccagctctcgactctccaaag

SEQ ID NO: 204948 - DNA, 351 bp, Homo sapiens
gccaggaagcaactcaggcagaaagatgtgggaagcctttgacctggaggggcatggcttcaggtgaccagaactgtggctggttctggggaatgtgagcgaggtgctagccacatctgctatagtaaccatgagagcttcctgaaaagtagttatttactgataaactactcaagaatacaaaagtagttgaataaaaagtgtgccacagccaaataagcatagaatgaagcaaaacaatttttataaatatttacaatagtaagcaaatgtaaaaaaaagtattgccatggtaaatgcataatttaaaagattaataaaaataatcccataatctcagttataccaata

SEQ ID NO: 204949 - DNA, 593 bp, Homo sapiens
aactatgtttttgagagtctatcattcatctgttttttgttttatttagagataggatcttcctctgttccccaggtggaagtgcagtagcacaatcatagctctctgtagcctcaaacccctgggctcaagggatcctccttactcaacctccctagtagctaggattactgggatgtacgaacctaagtttcttattttttgttgaggtgggatcttgctatgttgcccaggctggctcaaactcctggcctcaagcaatcctgcctcagcttcctaaagcactgggaatacaggcaggagccactgtacccagccctcatgtctatttttaagtgaaccaacccatattcctttggggacatattcttaagttacagtatattgccggaaaacctgtcccatagaaaagcatacattttatgtgaccaaaagaagcaagttcattcaaattagatgtggagtcttagttgtgcaggcagtgagagaccttttgtgaggtcagggagtggatacttgtggaatgctattctttgaaggtccccactggctttttatctgtcttcattctctatagcatttgataatcattt

SEQ ID NO: 204950 - DNA, 362 bp, Homo sapiens
aaaggacttgctttagctagatacatggatatttcatccacagtaacagaagaaaatataaaatatacatgcatagatacaggttatgaatgtacgtggtaacaggatattatgaaacatctctttcaatttcctcaatttttcagtggagaactatggtcatgagctaagagaaaagatgtgaaaaaatatattaaatgaaagtgaaggaagtataaaagagttggtcagaagagtgggccaggtaacataacaggaaaaatttaatgattgcaaggcaagaataagggcacaaatgagatgagtgctcatgaatttaaaatgagaccagtgtaggtttcttttttttcatcaaccacatt

SEQ ID NO: 204951 - DNA, 314 bp, Homo sapiens
cgcccggggaccagaggctgccccgggtacaaggttgcgccggggaacgggaggctgcgttggcaacaaggctgcgcctggggacggtaggctatgtccctggggagacgctccgcccggcatgggacgctgcgccgggggacggcaggctgcgcccgggatgaggctgggcccgggcaggggaggctgccttgggaggggacgctgtgccacgggagtggagactgcgttggggacgagtctgcgccctggacggtcctgcgtgtccttccgagggcgcagtgtccgcgcgggatgctctgcgccgcgggcgg

SEQ ID NO: 204952 - DNA, 433 bp, Homo sapiens
tgtggaatgaaaagctctgatttaacccgtctttaagcctggtatgcatattcctctctgttccggccaccttgtctagacacactacactgaggcagtgcccatcttagatgatgttgatacattgtcaaaaaatgggcaaaccaggcgcggtggctcacacttgtaatcccagcacttttggaagccgatgccgacagataaccagaggtgaggaggttgagatcagcctggccaacatggtgaaacctgtctgtttttctgtaaaaatacagaaacaatgagctgggtgtgggagtgcacttctgtaattccagctacttgcggggctgaggcaggagaatcacttgaaccgggatggtggaggttccagtgagccgagatcacgacactacactccagcctgggcgacagagtgagactccgactcaaa

SEQ ID NO: 204953 - DNA, 465 bp, Homo sapiens
gccttatgcagagcagaggatcctcatcccagtggtccctcgactgccatggggttcactcttgtttttattcacttattaccaccaagtatttatttagaactttctacgggcaggctccattccaggctctgaagatagtctttcctctcatggagctgacattaggggtagagggaatgtggtgatgggcaacacagaaatagttacgttatgtcagtggtccagtggcgtgctaagataaaaataaagcagggtaggagggccatggacggatgctgtgtgtgtatgtggggagtgatattttagataagttggtcaaggaaggcctttcggttagggtaacatttgggtagaggccagaatgaaatgagacagccaacttttaagggaatctgcagcaggaggctttcaggcagaggagcagcaaatgcaaagaccctgaggcaggactgtgtttgaaga

SEQ ID NO: 204954 - DNA, 482 bp, Homo sapiens
gcgatctagaggcccccacaccacctgagtccagcagtatctctgctgttccctgactgctcactgccgcccccaacccagacgactctgtcaggggcctaattaagctccagggatcctcagaccacagtgtagaaaaagacgcaggactttctctagaacaagctcccagtaacacaaagaaaaatataagctagagaaccttcaggcaacagcaatgacttacagcaggaagacttgtaagtaatgccttataagacgttagtgtacaagtttgcacgtcaagaaaggccaacatcacctttaggagtattttttttaaataacataaatactttgttttaccagaaacaaaaccatctatcactgtttcagaagccataaagagacctatttaaggtatactctctccctataccactcatcctgatctcaccacccaagggccaaggcatatacccctctccgactcaggtggtgtg

SEQ ID NO: 204955 - DNA, 613 bp, Homo sapiens
acccatcccagcaattggaatttgagttctggctagccccaccactgaggcctaaagcactctggggtcctaaataaacttgaaaggcagtctaggctacaaggactgcaagtcttgatcaagttctggtgctgtgctgggcttggagccagtggatttggggtgcacatgacacaatgagacaactgccagggtggccaaaggaatgcttgcatcactactcccccaatcccaggcagtgcagctcccagctctaggagggaatccctcttttggcttgaggagaggagagggaagagtaaagaggatattgtcttataacttggatatcagctcagccacagtagagtagggcaccagggagagtccttaggcccccattccaggccctagctcctggatgacattgttagatacaccctgggccagaaggaaactcatttccttgaagagaaggacctggtcctgacaggattaatcatttactgactaaacagtccttatgccttgagtaaacatcagtggtacccaggaaatacttaccatgggcttcaggccttgggtgaaacccagggccttgttcacttcagatgtgaccagtgcattcccagat

SEQ ID NO: 204956 - DNA, 356 bp, Homo sapiens
ctcaatattgaaatcccctccagattcaatgcagtgacggcagaaagtgtatgggcatgaagattcaaagaaaaagatgcggccgttgaaagatttatatgctcctttgctccaggagaaatctcttgagacctcactcagagtgcacatccttaccacagtacaaggctaatgagcttggatcgatggtgttctcagcccagtggactgaaaacaatagattgaagatttgtggcaaccctgtgactaccaactctattgaaaccatttctccaatagcatgagctcacttcaggtctttgtatcacattttcataattctcacaatatttcaaatttattattattattatacc

SEQ ID NO: 204957 - DNA, 518 bp, Homo sapiens
ctaggctggttttaactggaatgacttgggtgacttgactctgctccatgtgcctcatcctcaaataaggcagcccagatatggtctcatgagggtgggagaggtgcaagagagaaattcaaaccagcaagcacttctccaaatgcctgtatgtctcatgtctgctaacatctcttagtcacacggaacagagtgtagagatggagaaagtcaaagaattgattcatgcattaatctaacataggatcccaaatctcataattatctacattgacatggtcccaggaaactacagccaagaggaaggtgacaagtagggcttagaattctttcccttaatttgcttcatttagaaaaccaccagttgtatgaaatttcaccagctgggaggatgattggaagacagaccatgcaatgaatttctggaaaaaaaaaatctctatctatatagcagcaatgcacaggaaggcagtgagtggatgcagttccatccagaaccctgtgtgggaatcggtggg

SEQ ID NO: 204958 - DNA, 315 bp, Homo sapiens
actcctaccccacgccagcttaggctcaactttgtatatgactcactcactccatgatcaacaatgtctgcatatccatcactccccagcctgcctgacttagccagtaattttacattcctattgcatacctgcttttatctattcttgaattttagccttatattctcaaatagattacatgtttcttgaaagcaacaaatggaatttacactgctttgcattccacacaacatgtagcacaaacgacaggctcttaaaaaagatccacaaaagtactgatgaaatttaacattgccccgtggatttgtaggc

SEQ ID NO: 204959 - DNA, 984 bp, Homo sapiens
tttgcctattctggacactttgtataaagggaatcctataatatgtagtttaggggactgacttttttcacttagtgttgtcgtctaaaaactcaccagtggcgaggcacggtggctgacgcctgtaatcctagcactttaggaggccaaggcgggcagatcacgaggtcaggagatcgagaccatcctggctaacacggtgagaccccatctctactaaaaatacaaaaaattagccgggcgtgttggcaggtgcctatagtcccagctacttgggaggctgaggcgggagaatggcgtgaacacaggaggcggagcttgcagtgagctgagatcgcgccactgtactccagcctgggcgacagagtgagattgcatctcaaaaaaaaaaaaaacaaagaaaaactcaccagcatggctaaatgatagaaaggagagttttatttgccatatcagtttgcagacccggaagagagagtctctagcatggactgaggtgctctctttgaagaggggaagggcagtttgagttttatgcctcccaaggtccatatcacacaatagagtcatacatattcagcaggtttggggaaaagccatacatatttatgaggggacccgagaacatatgcaatagataaacatacatgtaacatacatcccatgttcactttggggcagggttttagcattaaaatgaggtagaatctggatctttccatcagaaggtgagctctaggacacagttggagtgcagcctctatgaactgctgaaactggcttatggtctgtagttgcttatcagaaaagagtgtttgaaggctggttctctgtccagtcagggttgtggtggtctgggctgtcaagagttaggagggtctgataacgtgtgtgatctctactgttgtgagggagtttatcaagactgtggtttttcttgtagctgtaggaatttagggagttgctgagacagctgccctgaac

SEQ ID NO: 204960 - DNA, 227 bp, Homo sapiens
ttctcttgttctagtttgctagtggattgatttgggtctttactgagagaagggagtgtttttgtaagtaatacatgtataaatgttcacttttaaagatgtaaactatactgagtatggagagtaaaaatatgaaagtttattttcagcagctcagggaaactggaaaaggcaattatcctaatcctctgaggtttcaaccgtacaaataacagaaagttaacaaa

SEQ ID NO: 204961 - DNA, 694 bp, Homo sapiens
gtgtctccgcttatctcaaaatattgcaacattagaaattagtaataatctgactcactttaaggttcaggatggggaaaagaaataccatgaaaatcaactaatgttacatgggaccaggtggctgattcccaggcacacctacctactatagactctaaaagcaaccatctcctaaactgaaagggtgataccttttcttctgccaaccacaaatcagataagtgattgaacttttaccaggcaccgaaagccccagagatttccaagcactgaaccatcaagatcaagataacttagggtccgttttacaagcaactgtggcttggttcccagttagtcgagcaccaaaactacagataaacttgttcttaatctccacatataaaggaaaccgttttcttctttgcaaaaccagctcatggcaagtggaaaacgaaccctaacagaattctagaataaggtcactggattgctcataatgaggtagtacctttaaaggtcagagattccccaaatttgttcttagaactttcttaccgcatttcaatttatcgggagatgttacaaatactcctacaatggaaaaaaaatgtaatcttatttaatgtaaaaaaaaaataacacacacacacacacacacaaacacacccatttgtgtatttgggtgcacagccatcacaaaaatcaaaga

SEQ ID NO: 204962 - DNA, 430 bp, Homo sapiens
cagggatattgtaaggatgaaagattagctgttggaactgtgcctggtgcagagaaactacttcatgtgtgctttgcacacccgaaaccttcttttttatatttatttatccttggcctgggggctgtctcctctcactcagtggtgtgtctcatttgttctcctctgtgcctgagccagcacatggcacatcatattttctcagtaaatatctggcagaaaaatgtattcatcagcctggccaacatggtgaaaccccatctctactaataatacaaaaattagccaggcgtggtggcgggcacctgtaatcccaactacttgggaggctgaggaggaagaatcgcttgaacccgggaggcagaggttgcagtgagccaagatcacgccactgcactccagccagggcgacagagtgagactctgtctc

SEQ ID NO: 204963 - DNA, 299 bp, Homo sapiens
caggcatgagccctgccaaatgttggcagttattaaactgtatagatttgttccttaaatattttgactattccatgagaaaggtttgtccagcatcttgatttctatctacaaaacaaaaacaagactaaagggttcagtaatttaacatcttggtcagatggcgtgaagaaattaaattttcttactcctatagtcgcgatgtagtgtacctcttaccttttaagtctcgtttcagtgaagttgaatgcatattctagcaactaataaaacaataccaatgaacattttttaattga

SEQ ID NO: 204964 - DNA, 357 bp, Homo sapiens
cttgagtacttcaatgttcaagcatgtttagtccaggaaattggaatgaaagtattgacattctatgattaggaagggtggggattttctcagtatttttgacataataccaaatttgcctgtggaatcactaaaaaagttttatgatttgaaaatattttaaaatcaaacattcaaataatttttagcttatgagatcaaatattcatttcattaaaatgatgtgttcacttgcttgctctgaagtggttagaaaatgggaatggaaactcagtatgtttggcccatttccaaattttctgctttaatccatggttctcctaatgatatgaccccatatgagaaggaaaaaatagc

SEQ ID NO: 204965 - DNA, 1021 bp, Homo sapiens
aggcaggccacaggacactcaaattactggaagagcctcagaaggaagcttcttaactcgagtgcctgcagcccagcccatggctccaaagacaacacaggtcctacccctgcaccacggcttgttacagctcctatttgggcacaccaagatgggcctgggtttcaaggcaccctcaaatctggccctactttagtaaaagggaaacaaaagccaatgttataaaattccagccagaaacacttcttgcaaaaggtcggtacgctctcttgaaagggagagagaaacaattgctagaagcaacacctgcaccaaaataagcctttccactggaaggattgaaggcgacctgaaaagaaaacagcctggctgtgtggctccatgtctgctcctgtatcacggttatcacccctccctaaccctggccttcacccacctctgcctgctcagcacaagggcattccaacctgcacagggcctggcacaggatgcttgataaacatgtctccaataaaagcatcccacagccaaacgcttgcttagatgttgtcattgactcctcgctagttgttttcatgtttgttaggtttgtttcacccactagggatatatcttctgttgtgtctccccaaatatgtcacagtgatgggcatgaaaccagatgttccacagaacactaatcaacggacaaaaaaggttgctactctgcaaaacaaacaaacacatacatgcctccaaggaaatcccacccacacaatagatcacaggtaagtagcacagcagaaaaagcatcttctgaagcaggaaattccctatcatttgaaaaaagctaaccatgaaaagtcacccgttagagggtaccttatctagacacttcatatgaatgaaagtgtacagtatgtccataaaaggcaaatcaatagacacaggaagtagatgagtggctgcttggtactgggggtgggaatggggagtgatgggtaaaaggatctttaggggatgatgaaaatgttctaaaatt

SEQ ID NO: 204966 - DNA, 304 bp, Homo sapiens
aaccttaacccccatttccaccaccccacagacctcttcccatccctcagtgaactaaaatctctggaggatccagtttctcagatgcccagtatttttctggccttgccattgccatttttgggggaaatcacttatccacaccaattaaaggaatgtcagatgaagttttctgttagtcttcctaaattgtggcagccagtgtctccccatgagttgcgtgcaaacccccacatggctctgtacaactttctctttgcaaaattaatatttttagtatataaaatgatatgccagatgtatg

SEQ ID NO: 204967 - DNA, 485 bp, Homo sapiens
actcacttgaatccaggagtttgaggccagtctgagtaacataacaagattccattcctttaaaaaaaaaatcgtggtatacctgtatagagcacttactatgaatggagcttgtaggactggaagttgttctgggtgggtcagtgagtgagtggtgtatgaatggagcttgtaggactggaagttgttctgggtgggtcagtgagtgagtggtgaatgaatgttaaggcctaggacattacactattgtagattttataaatactatacttgggctacatttaatttaacagtttttaaattcagtaataacttactgtaacttttaactttataaactttttaatttttttactttttgactcttgttatagcacttagcttaaaacacatcatacagctgtccaaaatattttctttatattcttattctataagttttttctatttacatttttgtttttactttcctaaactttttttta

SEQ ID NO: 204968 - DNA, 473 bp, Homo sapiens
gcggggagagggaggcggccccgcacaggccagggaggccccagcacacatgaggccggggtggaggccctggctctgcggtgccacctgtcctccccagggcgcacccaagcccaagggttccttcccaaccgtggggtctgagtttgtcatcttccagctttctcaagtcccctgagtcatgagaacttcctctacacacaggcaggtctgtgttttatatgaaccatgtttccatggtaaatagattttaagaattcccaaaggacagacagtgtcaccaacagcagagagtggagcctctggctgcctcatgtttgaaagtgttaaaaataaagacaacactgacatttggggttgtaatgtgacggaattacagtcttttaaaggcaagaaccacttatctacactacatgcaatattcagtgttttgttcacttgtctaattggattaaaatatttagctcccttta

SEQ ID NO: 204969 - DNA, 406 bp, Homo sapiens
tttcagtatgtatctctaacaattacagacacattaaagaagtctgtttctcctaaaatttttcccttaataaacggctcaagccaaaaccttggagtcatccttaactcatctttctctcatacctcacagccaatccaacagccaatactggataatttggaaccttcactgctaccactgtaatctaagttacaatcgccttttacgtgtattatggccacagctccttcattggtctccttaatgcccctgaaacttcagtctttgtacttcttcctgctgcctgaaatacttttattccaaaaaaaactaggtctgtcacttccttgaggtctcttgaatttcatcctattagaaagacttgccctgaccatcctatctatacacgatactaatgttagaa

SEQ ID NO: 204970 - DNA, 369 bp, Homo sapiens
ggaaagaaaaatttgtgtgtgtgtgtatctcataagcctctggctgctctccaaactcttatttagtcttatccagtagaaacacattaaccatcaaataaatccttgatttttactgaaaaataaagaagcttatatttagcaaatgtactatcacaatagtacttctcaaaaagttcctgtttaatgcattatgtcatcaactgattaatgaaaagggactcacaacaaacgtgagtcgtatctgaagctacaaaatagagctattctatcatcctccttctgatgaaaattatctagactatgtattgtattatatacatattttgtatatgtcattatattaaaatatataccgttttagactgt

SEQ ID NO: 204971 - DNA, 232 bp, Homo sapiens
ctaaaccaaattccgtctctttttctctctctctttttctacgtgttgaaaaagttgactggtctgttctgcaggacaaagtttctcacagtctgaatgttgctgatcacaatattgctgtatttcgtagtagttagattttgaggttaaagtgggttcacgtgtgattattttggccacactacttttagggttgccaggcttagtaaataaaaatacaagatgcccagtt

SEQ ID NO: 204972 - DNA, 709 bp, Homo sapiens
aggcttaaactcatacgatagaaagaatgagaaaggagatattagccagtttggaagctagcgagtggtaaaggaagtgggatctcaaattgctagtgaagaaagcagagaaccaacctagtttaaactgcagaatcccctccaggctcaggaatgggcaggccagggctccagaggcgggcttgtggggccgtgaaatgaggaggatgtgttcaagtgcgtttaaaaagcagtgactctgtccttccctagagaaggacaggcctactctctggggagggtagagcagggtctctgggtttgggcaccaggcacagttgaaggtggggatactggcaaaatgggggattgagccaatacatatttttttggttgtgatttgctagttttcccctttgtcaatgaaagagcccactaatggggacaggcacagtggctcacgcctgtaatcctggcactatgcaaggccaaggtgggaggatcccttgagttcaggagttcaagaccaggttgggcaacacagggagacctcgactctacacaaaacaaaaattagccgggtgtggtggcacgcgcctgtggtccccagctactcgggaggctgagatgggaggatcccttgagcccaggaggttggggctgcagtaaggcgagatcgcaccactgtgccccagcctgggtggcagagtgagaccctgtctcaaaaaaa

SEQ ID NO: 204973 - DNA, 325 bp, Homo sapiens
gactgtggtaagccgtgatcacaccactgcactccagcctgggcaaaagaacaagaccctgtctcaaaaatcaaaaatttttaaaaattgagagaaaagaaaggtagatactatattagaaatactgtactggttttgttgtatatttttctctttttccttctgtcatctcccaccttctacaacatatattcagatagctatatccttccttcattataccacaagaaatgaggctacttattgggggaagaaataactagaatgttctcctaacatttcactaaagaaggaaaaaaacatggttttctagaatatacctaac

SEQ ID NO: 204974 - DNA, 128 bp, Homo sapiens
gcaaggcttagttgagtgattcagtcataatactctgtataattgtctattattgctcttatattgcattgtaatcattagcttttttattgtacttagacacagataaccaaagatttgctttagtg

SEQ ID NO: 204975 - DNA, 467 bp, Homo sapiens
gatcatgaggtcaagagatcaagaccatggtgaaactccatctctactaaaaatacaaaaattagctgggcgtggtggtgcgcacctgtagtcccagctactagggaggctgaggcaggagaatcgcatgaacccaggaggcagaggttgcagtgaactgagatcacaccactgcactccagcctggcgacacagtgagactccatctcaaaaaaaaaaagagtcttaatatcaaaagtaaactgatgcaaaactagaatttggtcttctctgtgaaaatgacagttttctttttaaagagtattgctccagtttttaaaagtgattgtgaaaaattttcctttcccttgtaactaatcggcctacaaaatgaagattttgtgttttctcaaaataattctttgtgcttcgtgttgcctttttttggtctttaattacttaagaaaattgaatcttcccaacaaaag

SEQ ID NO: 204976 - DNA, 405 bp, Homo sapiens
  misc_feature (1)..(1): n is a, c, g, or t
naaactctgcgcggcgggcagaggctgcaatctccgcactttgtggggccaaggcaggcggctgggaggtggaggttatagcgagccgagatcacgccactgcactccagcctggacaccattgagcactgagttaacgagactccgcgagtgatccgccagcctcggcatcccgaggtgccgggattgcggacggagtctcgttaactctgcactccagcctgggaggcagaggttgcagtgagccaagatcatgccactgcactccagcctgggcgacagagagagactctgtctcaaaaaataaaaaaggaaaaaaaagaaaattgaggagccatgttaaagacctgccatagtaatgggatttcaaggtcaaaggagagggagagactgagaaagaacatt

SEQ ID NO: 204977 - DNA, 495 bp, Homo sapiens
actaagaaaccaagagagaaatcaatgggacacaaagagttcatgctacccagaagcacaaaccaaattttcaaatacctagaatcatgccctcgggtgaagttggtaatttaagcatttccttttaatgcatatttagcagagatattttcccagtaattaattactacaggcagttaaatatctttctcttcttcctctgttttgtttaggtttttgttgagacagggtctcgctctgtcgcccaggatggagggcagtggtgtgatctcagctcactacagcctcaacctcctaggctcaagtgatcctcccacctcaagcctcctgagtagctgagaccaaaggcacgtatcaccatgcccggctaattttggttatgatttctttttttggtagacaggaggttttgccatgttgtcaaaactggcctcaaacttctaagctcaagtgttccacccgccttggcttcccaaagagctgggattataggta

SEQ ID NO: 204978 - DNA, 386 bp, Homo sapiens
aagcagttatacagactcattttaacttgatgttgatcttacataaagtgtgggtggaaaagtatatctgctgggcagcatctagtgcatcaaataacgaatcctaaagttaaagtggaaattatttttaggttgtctgggcaaatagcacagaaggtggggggaatccagagatatgacctcagatgtgacacatgcagacacacgacacaccacacatacacacacacacacacacacacacacacgcatatgggtacacacaaatgcaccttctctcttccttctgcccccacactagcagctccttcctggcttcctccgcccctcactcacacaaagggccaaagcaaatacttcagcactgagtctgtattaactgcttg

SEQ ID NO: 204979 - DNA, 693 bp, Homo sapiens
gttcacatacttcaagccatcctgagtgatctttttatcaaggaattctagtgatcatgacgtcatgtatatcaaaatcttagaaatctaaagaaaaccaggcccagattaaagttccaccccctacacacacacaccccagtcagtgtgcaaggggaaaatttaccaggtctttatgttctgctagaagatcttcaacatcagagaagcgcgatgctggctactgtgatgaacaagctgacaacagccagttcacacacaaaaatgtttgagccccttgatgaagtaggtgctatattgctcaggtgggatatcagaacagggggagtctcttcctttatgaagcacaaactctaaagtggtgaggcatacataaaacatggatgggggctttcacagtggaggtctgaatggtggttgctgacatgagttgactgatttccactgtgggatatcagaggttggacctctgacagcagccatttgaacatatattgccatttattttataaggttagaaagaaggtttaatgctgagattagctaatgcatgtgaacagcctacttttgaactttaactggtatgtgtgtacatttacataaacaatcatccatatctacaaccaaacaggtgaccagagaaaaataacatccatttacagaagtttcgaaacaaaagactcagagtgttgt

SEQ ID NO: 204980 - DNA, 653 bp, Homo sapiens
tttcatttttcagagcttcttttcatttagtcagtcacttatttccagagatttcctggtgatgttgcctcacatttatttgtggaaatgccagtatgttttaagcttgcaggtcaaactcccaagagtttgaggtcgaatttgatggaacacccagatgtcctcagctgccatggagaatacttaccatatttgcttgcatattttccctattatactggcagacacttttagttgttaacatagaggaaagaggtatttaggttgtaacttcctcaagcagttctttccacatcatgtagctctggtccatgccatgtgtgccaatggtaaccaaacctttcatcctgaccatcactaactggattggcgtcccagccaaaagcaaccaatctctgtggagaaaagagaagccaacgtcctctgagaagtcttttgcaggttttttgtatcatggttatattcatatcataaaatgaattgggaacctctggtttcagctccaacatagagctgaagttgcaaggtagaccaccactctgaaattgggagagacaggcaaatccagagaagtacagctaatatttgcatatctggagcagaagccacttggagccataaactgttaggaacacttaaatggtaattttgat

SEQ ID NO: 204981 - DNA, 874 bp, Homo sapiens
ttaagtagataggttcaaaagaaattcactggtcattggcaatatctgatatacttcacttccttacctttatttttagtaaaaatgatcaaatgaggtaccttagtgtaaacaatctgcacgacaatagcttgcttttggaaatgaatgcctcttaaatcacaatgcagttctatacagcaacaggcaattcaacttgatatgagctgaagtaattgaactgacacccaaacgtgggtttatagcaatatatagttacagtggatagactgacttttctggccgtttgttaatttaagggagtttctggctgaaaaacctaaattattaaagctctgctgagatgtgtatggtagtatttgaagcatttggaactgttgataaccaatcatcgcaacaggtaacagttgagagtggtgctgtgcatgatgaatgttcagaaacagctaaaactaataggaaagcagtaacatttcctgttgctgtcaacatataaaaacaccattaagtgggggagggattgtacatctagggaatgttgttattttgagtattatgttcagccataagcacatttgcctgaagaaacagtggattataaagcaccactgtcttctgtgatagagctttcaaatactttaatgattttgtacattgcaaaaatgagaaattttgtctaacaagggttgataatgattcagtaatgaacaatttgcaacagaaagtgtgtttatatattcatgtatatattttgaagtgttttatgctgaatcagttaatgtttcttttatgaattgcagaaatctcctgtggatatgtcaatatgggaaagagggcttttcttatgtttcgagtgaaataagtacatcttttt

SEQ ID NO: 204982 - DNA, 708 bp, Homo sapiens
ttaagtagataggttcaaaagaaattcactggtcattggcaatatctgatatacttcacttccttacctttatttttagtaaaaatgatcaaatgaggtaccttagtgtaaacaatctgcacgacaatagcttgcttttggaaatgaatgcctcttaaatcacaatgcagttctatacagcaacaggcaattcaacttgatatgagctgaagtaattgaactgacacccaaacgtgggtttatagcaatatatagttacagtggatagactgacttttctggccgtttgttaatttaagggagtttctggctgaaaaacctaaattattaaagctctgctgagatgtgtatggtagtatttgaagcatttggaactgttgataaccaatcatcgcaacagccagctgagacccccgctgcgcatgaccgatgcccaccccagctccccctactccgccacgaccctccctccctcccgctcccacctcatcacctcccccctcacctccccaggcctcttcacctccacctcttccgctcatcccctcctgccgcctcaccctcctccccgctctcttcccccaccgcccccttcctctcctcccatctcccccgcccatcccgccctcctcactctcttccccccccgcctcctccccccagccttcctcctctcccacacctcaccttttcctccctccccttccc

SEQ ID NO: 204983 - DNA, 396 bp, Homo sapiens
caaattcctcaaacttgcaggattaagtctaaactctttggaaagactttgattcctttcccatctgcttttttagcttaatctctttttaggctcacctacaacctggacactccagcagtgtccctaatcctttctggttccctaaatgttttatgcttttcatgcatctttgtgtatctgcacagactttggtcccgtgttcctgacaaagttctgttaacttattccatatcttgctttccctgcctgtgataaaactaatcattgatttctttgtaaatagttttgtgtcttgtaaaactctacaattgtacattgcctctgatactgtaataatgtatctatctatctgtcttatattaaacagaaagtcttttagggcagatatggagt

SEQ ID NO: 204984 - DNA, 847 bp, Homo sapiens
gatgtgtgccagggagcacagattcaagggatgggattgagtcagacctgtgttcttactcagtgtcagaaataactctgtggagctcctagagtaagacatttccggaagcaccacataattactgttgggctcttagggtagcccttttagggaattgagcattcccatgttttaccaacaattattctgctgctgtgttttattatattgccaatggttttgagacactcatcatgctcttatttagtgatttcttttcatgagcagagcaacagctcatccagcatggtttccaaatggagaaatttgggtcttctgtagaaaccacacaaattctccaatggcctacagccttatggttggcacactagttggccctatagggtggaaataaagctgtaagatgttaaactgcatttgatacttctcttgaacgctgagcaaggaagcaaaatagttcttgtctttacttaagcttctaagacattttggggcaaaggaccttacagatggcgtctgttgaaagtaacagcaacgtgccagggagaaatgtgggggaaatctcatcaaattctgccacctcaaatgtgttgtccagaagtcagtgttattcagggggccctgtgaaacttgaccaccagcttgcgccatcaacactcagcctttatccagcctgctctcagcttttgtgtttctgttagaaactcagataggtaagtatttttattcagtagactacctttcttatcttttcagcttaatatagctgcatcttctttctcaaagccaaactaagatattccctattaaaatgtccatgagcctagcattgagtgtctggcat

SEQ ID NO: 204985 - DNA, 558 bp, Homo sapiens
gaacaggttgaatcctgcttggataacttgctagctgttaggcaagtaatagctagttagtagaccttgattttttcacctatcatggtactgtgaaatagaactttctaccataatggaaatgttctatatctatgctgtcccctagagtagtcgtgagccatgttgctgttgagtgcttgaaatgtggctagtgtgactgaggaactggatttttttattttatttcaataaatcttaaataaccagtgtgtggctcttgtctactctgttggacagtgcagatccacaatgacgatgatcatatgcaccctaatatttagcttctaataaaataagatcataaaatacttcctaaatacaaatgattaatgtatatttatttgtgtatgtatatgtattacatggtgggataggatttaaatattcaataatcacatataaatatagctttaaaaatgaaatattggcaaggattaaaatttaaaagccgttttttaatacatttataggtgacatgaacaggttgataatgtgcataaatgaataactgttttg

SEQ ID NO: 204986 - DNA, 288 bp, Homo sapiens
atgaaagctataatagtcattccccagaaaaatacatatggacacatctacctaccccacccagaggtagccactgttaactgtgtggcgtgtttccttctgtactttttaggtatacatatatatgtactctttaacataaattgggtcatctatttaatacatactgttttacagttttttccacttggatgtctgtgagattttttgtataccattacatctcagtttatctttccaattttaatgcccacatatattctatagcatggattattcttttctcta

SEQ ID NO: 204987 - DNA, 501 bp, Homo sapiens
cctgatttggccagtatttcctgagatcctgtagagtgcccggctctggtccagaggcgaggggtgccaggatgtctcagacacagacagcggccttgtgcttaggcgttcattatctcatggggtagcccattttgaagcagtgcagaagggcacatattcagtagaggtgcagacccagaggctctgtgagctgcactagagagatgaggaggcatctcccccggcgactgacgatgggctggcatgcctccacctccgcccctccgccccctcgccctcccaaccaccaccttccctctctgcctgctactcccctcttactttcccattgatatttttgttgttgtttaagcaaattattattatttttttaaattttagcctcaagagtcttcataattttttaagggaacactagaggtactgcaaaaccagaaggatataaatgttgagaggaagacaatttgtgttgcatagaccctgagggactgtcagacc

SEQ ID NO: 204988 - DNA, 387 bp, Homo sapiens
ggtccggaatttctaccgtcggcccacgcgtcctgggctggatgtaacctgaaaaggaaaggtgggtagccaagtctttgtgatcttgttgatagtgttggacttgggttatcccagtacatgtgccacaggaaagaatactaaggccactcacccatcctaggatagaccctatcttgacttccctgtctttcaatcatacatctggcagcacatctactggtattgccaggaaaggcatcccccagacatatttccagaagaaaacaggctaaaaaacaagaagactgggtctgtttatttgtttttaaagtatagaagattcaggtgacaataagaacaagaaactaaggcctttatgttgcgacataggaatccatctcagtg

SEQ ID NO: 204989 - DNA, 530 bp, Homo sapiens
tcatccatcaaaaatgcagctctccattgattcttcccgaattgtcaatttccaagcagcctcagggataagcctcattctgtgagacgcaatccttgataaggaaaaagataaagtgataaatgatttttctggtcttttcctttgggaacgatagccaacttgctaagtcttagactcaggcaatagccattcatgagctacctgcacacaaggagtttgtgatgttagtaatgtgaatttggcaatagtgttttcagcaaaaaaaaaaagtcactacttaaatacaaacccctatacatgactggccttggagaaaactagcaaagctcagaaacaaactgacttaaagtacgttgccaaacacagcatcatatgttggctgaatacaatattttaaaggaactgaaaatattataacaaaataaacctcccatctgggtctatgagccaataaactaaaataattctcagtaaatatcttaaatgtaatcacatctagtgctaagaagaattatattcaataagaa

SEQ ID NO: 204990 - DNA, 450 bp, Homo sapiens
ggaggagggaagaagagggaccagagactaagcaagcctggtccaaaagccaaggttactcccttattctgaagtctaggagaagcaaatcagaatttgatggccttttaatacagaaaatactgtcttgaggtttgagtatagtacttatgatttctattttaatgacaaggaaactgaggctgacagtgactaaataattcatcccagaaacaataaatgagtggcatgactaatatataaacccagtttggctcccaaccttgtgttcttcccccacatacacaatgactcttggtttcattcttactgccatgtaatagaaatagcaacctctcacttgtagggcccctgtctgcttcggcacagggaactccttcacacctgtccatacttccacgaggaaagggagtgctgtcctcttctccacgaccacagcagatcttgttg

SEQ ID NO: 204991 - DNA, 285 bp, Homo sapiens
cctccagccagttgccacctggtccagctttgggagatgtggagaatgactttcgcagtgatttccactgggccatggcattgaaacagctgcaggaggggacacagctggtgccacccctactccgtccattagagctgctgtgaaggaatgccaccctccccatggggagtgagggggccctacttgctgtggttggttccagggaccatgggaagaggcaaacccctattttcaagggcacaagttggcttttattaaaataaaatttcatcatcacttatt

SEQ ID NO: 204992 - DNA, 357 bp, Homo sapiens
gtcatcaaccctccatttaaaccactctccccaagttagcaaatgaaatctaaaaggtggataagagctctttattagccaggcatggtggctcacacctagggtttcgatgaccatcgaaaccctacaagtagaccactacagccaattaacgcggttatttggggggctcctctatcatgtttcttgagggcacaaagctttattgcactccaagaagctgcagaggtgaaagaaggaaccgtgcccacttcatctctgaagtcatgtttatggcaggtgtttgtttatttatttaaattcattcattcaaccaaaaagcattctttgagcagggtttgagtctggggttgctta

SEQ ID NO: 204993 - DNA, 506 bp, Homo sapiens
ggtaaacgctacagtagtaactgttacaggcagaagccaacaatggatgctaaaattagtgggtaagaagatattggcatagtctcaaagagacttattaattagaaaggaaaaaaatagcaactttttagtgaagaaaactggcagacagcaccttaatgaagtgatcaaagttaacatcaccagcaataagacaaaatggtaccatgtacccctgcttcactgacatgatgtaattagaagggcacaacatagtttctgtggtattcctgacagaaatacacagcctcaatggaatccctaagaaacattagacaaacccaaactgatggacattctactaaactggctagctagtactcttgacaatgtgccaaggaaagatgcagacagagtaactgtcacagatggagaaggctaaggatacttgacaactaaaagcaatgtgggaaactggatcataaaaggaccttcatagcaaaactagagataccggaccggtctat

SEQ ID NO: 204994 - DNA, 486 bp, Homo sapiens
cctttgcttttatcgatttgcaaatcaaataagggggacatattgggaacagcaccccccccccccaaaatctggccataaactggtcccaaaactggccataaacaaaatctctgcagcactgacatgttcatgatggtcttaatgcccacgctggaaggttgtgggtttaccagaatgagagcaaggaacacctggcccacccagggtggaaaaccacttaaaggcattcttaaaccacaaacaatagcatgagtgatctgtgccttaaggctgtgctactgctgcagataactagcccaacccatccctttatttcagcccatcccttcgtttcccataagggatacttttaattaatctaatatgtatagaaagaatgctaatgagtggcttgctgttaataaataacgtgggtaaatctctgttggaggctctcagctctgaaggctgtgagaccccggatttcccacttcacacctctgt

SEQ ID NO: 204995 - DNA, 384 bp, Homo sapiens
agaggatccccacagcataaactattacagcataaactattacagcataaactattgagctatcattttattttgttttacctctgggtgccctgggcacagttccctattctgtgcctactctggggacacatatattaggatcagaggtggcaagactatctgtaaaaggaaattgaaaagacatttaaaaacctaaaggaagattagtgatttcccagagaaactcaatggcagatgtcactggaatcaagaaccattgctctcatgcctggaaaacctgtttccaaaatgttcccttttgctgccaagggatcagctgctccagtagctcagcatcttggcaattgtgggaagaggacagaggtgaagaatctctgggct

SEQ ID NO: 204996 - DNA, 206 bp, Homo sapiens
gcagccttgagggtccttgagacattgttatagctcgaaaagttcaagtccaggctgaaaacattctatttgtcaaaggcagtagatattccaaacctagcatggtagcccacacgacctccatatttcgactaaaagattttataattctgaaattaggcatgatgcctgtattaaggaggttaagtggaagaagaaaaatatca

SEQ ID NO: 204997 - DNA, 344 bp, Homo sapiens
agttaaaggaaagcaatgttatgtcgagctttcagtaattgcttgtgtgggctatctatagtccctggatggaataatgcttgagtagatgaatacaaatacatgaatgaattataatatttagacaatgaagattgtaaccttatttttagcataattccctaaagctatttgtgttatatgttcgaatacatttcaatatgaacttggtaacagtcatttctattttaagacttcagtgacctgggaggagaaaataattggctctggtggttatcattactagattttcctttgcttggaatctaggcatgtgtctttcatctgttggaataaaaacatta

SEQ ID NO: 204998 - DNA, 411 bp, Homo sapiens
cacccattttaaatggcgtgagagaacatcaaaagatgaaaacttatggccaataaactgattttggcctggtgtggtggctcatgcctataatcctagaactttgggaggtcaagacaagatgatcgcttgagccgaagaattcaataccagcttggtcaacatactgagaccccatctctacaaacagactttttttttttaaattagcagggtggcacatgcctgtagtctcagctacttggatggctgaagcaggaagatcacttgagcccaggaggtcaagactgtagtgagctgtgatcacaccactaccctccagcctgggagacagagagaccctgtctctccccaaaaaaggggtgggtaggttttgttttaaatccaactctaagtattcttatctgggtg

SEQ ID NO: 204999 - DNA, 634 bp, Homo sapiens
ccctagactcaggctggtctctttgtctttccagcagctgtgactcaggcgggaagtagtgagtggcaggacaagggtgtggtgctggcagccaggcaggaagcagggggaacaacgggacagaggcaggggcacagcccaggagcagctccagcagagaagggggacaggagcagaggtgggtggagccccaggatggcatctgggtggaatgggtggggtgaagagctctcgggcagcccacaggctaagtgccctggcagctgtggggtagtagcttcactctccccatctctggctgggtcctctttccatcaggacctgagggatgccccctaccagataagctggcaagaggcttatctgtgagttttgcacacacccagctcccctcgcacctgcctctcagaggggtggctgagtccagattttttttttgaaacacagtctcgctctgttgctcaggctggagtgcaatagcatgatcttggctcactgcaacctttgcctcccggttcaacctctgcctcccggttcaagcaattctcctgcctcagcctccccagtagctgggactacaggcatgtgccaccacgcccggctaatttttgtatttttagtagagacagggttt

SEQ ID NO: 205000 - DNA, 336 bp, Homo sapiens
gcaacctctgcctcccaggttcacatgattctcttgccgcagcctcctgagtagctgggattataggcgcaccaccacgcccggctaatttttttgtacttttagtagagatggggttttgccatgttagccaggctggtctcaaactcctgacctcaggtgatccgcccacctcggcctcccaaagtgctgggcttacaggtatgagccaccacacccggccccacttgctttaggtttagttgactcctgttgtccaggatcttaagacgaaaggtcaggtcactgatttgagatctttcttctcttgagacaggatctcgctctcggaagtgg

SEQ ID NO: 205001 - DNA, 521 bp, Homo sapiens
gaaggagaagtggcttggagggtgttggtgggaatagccaaggtatgactgtgatttcaggtaagataatttgaggagctgacaatttacctgcgtggaagtatccagcaggcatttgggaatatgtaattggctcctgaatcagacatgtcagtgaggtgatactcatataggagtcagttacctaaaagtgacagctaaaccttatgaaggcaatgaattccaggttagtgcagagcctctgcacagttccaaacccaggggatgctcttctcattctcttatctgaagttaagctccagggcttatcattcacataaactacattatgaacaatgctgtttccatctctctatcatgccagatgtcatatactagatgaggtctctcagaagagctagacagaagtataaggactcacctttatatatacaaagtgaggaacaagacaatatgtacaaggactcatattaacatatgcaggatgaaaggggaaaaagaggtcagttaattggttttaa

SEQ ID NO: 205002 - DNA, 602 bp, Homo sapiens
gatttccttaatagagaatacttctagctagctagcaagttcaaacttttcccagtttttagcccttcattctgcctgtttttttggagctgttctacttctgactgaagttccctattcttgggctgagctaaaccatctcctggattcctgaactctgtcttcttttggcctttaatatcaaagaccttttctatctttatttttttcctggaaggcttctgtttttctcctagcttcttgctttccctgtgatcttttgtgcttttagaatagatctttttccagatgttctcccaggcccatatatacccaatgtcaaatcactttttatgtatacaccaaaaaggcactcaatattaggacctatcccatatccaggcacacagtagggaaccgtactccaaagtgactatctgctaggccagaaaagaccaagataaccttgttagtctccttaccacttagaaatattgttatggttttagaatctatttttacaaaaatggttttctctaccatatataaatccatgaaaaatattgatgttaatattctttcattcctgagtttagtcaaaatcttggggtaattaatcaact

SEQ ID NO: 205003 - DNA, 503 bp, Homo sapiens
ggagtggggtagattccactgaagaaatgttcccatgccagtcatcttgggaggaagtttgtcctggggtagaaattgagaactcaagatgtggacctttggggtgagaaagaagtgtgttctctctctctctctctctctctctctctctctcaacaaagttgggtctgccctacaagggaagacatgttccaggcaacctgagagaaggggctgggctggaccctgctgatggggaacaagctggggctgaacagctaggtggtcctatgagattatctgggtaccaacctgggctctgagaaaatccacattggtcactgtgttgagtatgtatttctttgtattttattcttcttccatggtgcccaaatttaatcagctcctgctagacactgcatctggtttctgttgagtatgatgcactgaggggaaggctctggccatgcttggggctgagtggccaccataccttggccttgccatatgcaatagaacttttc

SEQ ID NO: 205004 - DNA, 548 bp, Homo sapiens
tttgacctgacagcactgggtggtagggaaggtattgtctggaggagcagggttgacagtgccaccgttccctcatacgcctgcagggctggggtttggggcagcagtaggtcaagtctggttcctcaaggtctcctattctcagtagcaaaaagcagccggtgggggtggggtgtaatggcttaaagctttcaacagctgtccccactgggcctacagtcccctcatctttgtttcaaaagccgctcaggccctgttgtagccagaattggaaatcaatcagtgccacctaaagacttgagaaaacacatctatttattatctatgtgaccaaccgagttgctttaacactcgttaatttgcatttccaaggagagcaatttagttttaattatttgatcaggcacacacgtcctctccaaacataattagttccttcctaaggggattattggtggctatgagcactcctactatggacctaccagttccttaaactcatgtcccttcatagcctgatttaaaatactccaaatctttccttaaac

SEQ ID NO: 205005 - DNA, 525 bp, Homo sapiens
tgtgcctcgcccatttcccccagggcattcgccattctgctgtatacccacagagtcctgttgcaagtacctgagactctgcctgaggacttctcttggtttgtgttggcacaagctgagagtaccagggagttagtgcccctgggacagctctcagccagtggaagtgggaggatagataccccagcttcctcactcagtgagggacaactctaaggcacattctacctatttctcagggttccctgtgggagtgaacctctctaagctcccagtaacaattaacgtacacttccttggcttctttctcttcctacctggcttccagctcctcttctgtattttcctgatcaggactgggactagggtgatgagcctttattcttgggttcatctaagtgcaaggttggcacccgtatgaacctgagagggtctctttacattctgtaccctaggcatatcatttgcattgccctgattctggccctgtcctggatcacttcccaaataaagttatttgcattc

SEQ ID NO: 205006 - DNA, 1126 bp, Homo sapiens
gcaggatgcccgatatggagagatagtgagtaaaatcgagcaagcagaccagagccagatggcagggcaactgtgagacatttcaagcaggaaggtgaaatagaatttcctttataagatagtttctctgttgtgagagcaccactgaggtagggtgggaatgaattcaagaatttcacatagggccaggtggggtggctcatgcctgttaatcccaacactttcagaggcagaggcaggaggattacttgagcccagtagtttgagaccaccctgggcaacacagtgagatcccatctctacaagaaaatttaaaaaaaataagggaatttcctgtaggaggacagtacagtaatccaggaagaaaagatgaatggctcagctgagacaggacagtagggctgggggaaaagtgctggcgtggagagattatggagacagaaccaacagttctcagctggcatttgggagtagaagcaggctatggtttaatcaccaggtttctgtcttgggaaaacaagacatggaaaaagtgttttgggtggaagaagatagtgaaactggcttgagactttctgagatggagatgtaggtggaacacttaggtggatatgtggttttaaaaaaaatgtctagaccaatagaaatatattgagcagcaaagagaagccacctatgtaatttttaatgttctatcagccacattttaaaaagtaaaaggaaacagatgacaccaacttttataatatttttaacctagtacagccaaaatatgatttcaacaagtataaaaaatagtaatgatttccttgacattcttttttttcgcatcttgtgtgtattttgcaggataacacatctcagtgcaagcaaggcaggtgcccgggagccacatgtagcccgtggttgccatgtagaccttcagagagaggctgggcaggaggtgtctgctggggatggactaggataaaaaccttctctgaaggtacagatcaaagattgctgaggcagggagggtgcagcagaggtgagcttgtcccagtggcaggagagaggaaggaattgccgaagctgccccgacctctttcttctatttttgagggtgtaggatgtgagattggagtct

SEQ ID NO: 205007 - DNA, 641 bp, Homo sapiens
cttcgtggcctcccaggtttcgccctgaccctgtctgggatggacggaggccggaccgcggttcgtggcgcctgtgcagagaggggcagcctcccgcgctgacgaccctggaaacaggatagatgggcgggtgacctgtggccacgtacccacgagtttgggtccgctgaggcatctctccaggcctctgcctgtaagaagaaaaagaggaaagataagaagagaaaaagagaagaagatgaagaaacccagtttgatatgttggaatctggtgaacagtaacaaactttggtgaaatttcaggaaccatagccattgaaatggatgagggaacctatatacatgcactcgacaatggcctttttaccctgggagctccacacaaagaattgccctgaaatctggctatggaaaatatcttggtataaattcagatgaacttgttgttgggcgttcagatgcaattggaccaagagaacaatgggaaccagtctttcaaaatgtttaaatcgccttgggccacaccgctgtgttccagagctcaccaggagccatccagatgagagaccacccagcccttgtgacttgactaagaaattaaatccatgttatcagcacgtttttaactggatgtgatataa

SEQ ID NO: 205008 - DNA, 681 bp, Homo sapiens
tgacattccagatcagccaacccaaccttggcaaccaagacagtagcagatgtcatggtagatccacttcctatcagagaaggcagacccaggaacaaccagtggcagctgggtagaggggaagatgtcaaaacagaagtgtcacaaaagaaaattaaatggctttggccaaataaaagagaaaaggacactcaaacatgaaaggaaactcaaggtttcttgcctgcaggatggcaaatttgatgttggcccatgaagaggaagatggttggagaatacacgtgaatgaacctgactatattcttaagagaaggtgtaaggtgcttgtgaacttgtgagcaggggagccacagagtgtgggtttaatggtgcagttttggcaccagactgcctggacccaggtcccagtcaccacttattcactgtgagaccttcagccaattgtttaacattcctgaacctcagtttcctcacctgtaaaatgagaataatagtagtacccatttcataaagctattgtaaaggttaactggatgacccacagaatgtgtaggttggtgtctctgttctttagtgggtgcacaaaaatgtaaaccatttattaatcccattattactaatattatcaatgttactgggaaaggacctcagaattcaagatgccattaaatagaattcaag

SEQ ID NO: 205009 - DNA, 364 bp, Homo sapiens
gcttgcttctagactacctgctttttaaaaatgtatccttttttcttaggtgatgtgaaagcctcaatatctggggctctaaatatcctctattttctaataattctaaaatctccatcttgggtatttcctctgagcaatagatctgaatgtccaaatgtctctacttctatgcctcacagatatttctaacttttattttatttttttgagacagggtcttgttctgtcacccaggctggaatgcagtggcgtgatcttggctcattgcaacctccgtctcccaggctcaagtgatcctcccacctcagcctcccaagtagttgtgactacaggcataagccaccacacccagctaattttt

SEQ ID NO: 205010 - DNA, 326 bp, Homo sapiens
agatgagatgcaaggaacaggcagtaagagggctttaaaggggttctctactcttcctctcttctccaacaaggacacctaacattcttccaccatatgaaaatcctctattgtctactccaagacgcttcaacatcaaaaggatcccagcagacacaggatatattttaggtgacttgcaaatttaagaaaacttaaatcttaatacaatcttaatacaaagctgcttttggcagaagaactacatatacaatatacacttaggaaagagtgagagaggattcacccagaattgaatcaatactgactggcctgcagcagcgcat

SEQ ID NO: 205011 - DNA, 526 bp, Homo sapiens
tctcgactatactgatatactgtgcaatcagcttggcatctgggaaatgttttgctgtctgcttcatctccagtgccttgaacagtacatgtttctctggagcccctgcaaggtttgttgaaggagggcatacatcaggtattccataatttagcaacattccataatgtggctgctagtaaatggttggttcaggatttgaacccaggtcctctgtgtcatgttctaaatgttgggagaataaatccctcccttgtctcagtgaagatttctaagctgccctgggttgttgtgtataggtgtttagcttatgggatgggactggaaggtggtgtagggacacaaaaggaattaaaccatgtaagttcaccttggttggcattttcatttctcctttggatatcaagcctgaacaatgattctcaaagatatgtattaaattcaataaggatttactactactgctcacctattaagtgcgaggaacagttgcacttagtaggaataaagaggtagctggcacaaa

SEQ ID NO: 205012 - DNA, 442 bp, Homo sapiens
aaaaaagagaaaacacacacgtacacgtacaatctccaaaggacacaccaaaaactggtaataaaggccatccctgagagaaggaaggagtaggagagcccaaatgaggtcatgtgaagggaaaacctctcactgaatatacactgtatacctttttcacataaaaagaagttttaccagatacatgtattatttgccttataaaaaatgtcaaggtcatatagattcactcagcttctcaacaaacattttagggatgttcagttgaactctctgataaagcttctgcaatagataatcagaagtctacagctgtctaattggcaggtatttattgccttcagcctaacttactactagtttgtcttagtgccacctaaatgtaaaatattaaaaatcccctctcaggaaagcattcctgactccctaatttggcttaagt

SEQ ID NO: 205013 - DNA, 187 bp, Homo sapiens
tctgtaactttacccatattctaatgctgcaccttctagcagaagattctgtgcatcctgacatgcatgtgacacaaatacactttgagtcttcttcctgtacctcctgatcatggtcccattaaacctgggcaaacaactgaactaactagtcagaattgggtagcacagactgggtagtcacaga

SEQ ID NO: 205014 - DNA, 370 bp, Homo sapiens
aggccactggcaaaagaagtgaggtgaatcctgattttccatttatttgctgagtgactctagtcttttttttccctctctttgtatacctcacaagattaatgtgaggattagacaaaatgacgtatgtaaggcacttagcacagtgcttggtccatgttagatactgaataaatgttagtttccttcctactttggttcaggttcaaagacaagaacaatcatctcttctttcctgcttttgtgttgtttttcattgagaatgcatgcaaggtcaatgtgagcagtgagatcaaatcttaatatctattatgaagatgcaataaaacgtcaattttttaaaaaagaattttccatgagtatttacagt

SEQ ID NO: 205015 - DNA, 561 bp, Homo sapiens
tgtaatcaagctcatccagcataaacaggtgtctccatgggcacttttggtcaaaaacaatcagaaacaactgtctaatattgtggctgcctgaggtataagataatatttgaggcaaacaagaagctaactaaaaagcttaaaaagaaaagctgggaaatgagatgtatgcaggggactttgaaaaactctgacatattcctgagaacctagaaggccatactcatgtagcactgtgcacatgctcagaaaagaccagaggaggacctaaactctcacctctgactaacattaaggctttgcacaggcaggaagagctcaagcagagttgtaaattcctggctgaatgttgaaggcatgccccaacacacacatagagccccctggcaaagaccagaggacttacatgttttaggcatccaaggaaatctctgctcattcaatagcttctctgcccattcactcaaccactaagctaactgtgcagagacttcagtaaccacagacaacaaaaaatatagacttcacaaaacaaacaacaaataaccctggggggtgggt

SEQ ID NO: 205016 - DNA, 173 bp, Homo sapiens
cgtcgatctaaggatccccctatgggaagaaggtaggtgagttcagaaaggaaactgagttgggttttgaagaccgagtgggatttaccacatttaaagtagaaaatgtggtaaagagctgggatgaaacaggtgtgtttaatactcattgcaggctggagtatgggaccata

SEQ ID NO: 205017 - DNA, 553 bp, Homo sapiens
ctctttatagcgattgtgtccggctacacatactagactgttcttccctggcacgtcttcacctagtgttgcacaggtctggtcaatgagctatagacagaagtccctgagaggggtgccccttcccagatatagcagtgaagctgtactgggtaaaagctctttgagactcattcatcctttcttctctttcttggaatgcaaacctgaggcctagagacgtagcagccactttcctaccatgagatgataaacctaaggccaaaggcctccattctacgcatggcagagtagaaagaagtagtctggggttcccaatggtacacgggagctatggccaggtttctgaaggtcacgtgtatggggaagggaagactaagactgacagcagagtaaccttgtgcagacgaccgagcttagttcttacttgcaataaaacgagttctgccaaggtttcaggccagggaacagttttgcctcagggccaagcgaagaccatgtccataacgaagtgagggatgatttgcctttaggtcctgtcaatgagaatcca

SEQ ID NO: 205018 - DNA, 346 bp, Homo sapiens
tacttagaatatatactgtggatatacaaacataaattatccagaatataagtacatggatattctttaaagtatttttttgtaatcaccaaaacattagacagaactgtccaacatattgtgataatgaaggtaaaatatctttattcttaggaattgcatgctgaagaatttagggagaagagaaatatgacaaaaatgctaactgtgttgaatctagatgatgaacacatgggtgtttattgtactatatctgtttttctctatgttgaacattttcataaaatgtttaaaaaaatagttcattgataagatattggacaaataaattataaaatggtaaata

SEQ ID NO: 205019 - DNA, 523 bp, Homo sapiens
taggaagtagtaccaaacactggtgcagcaacctttctttttggtttctgtcacaccttgtggcacactctggttgttcaggctcctgattctttgaaaaattactttggctcctggccattcagaagtggatcctcactttctgttacttggaccaattttgtcctaagtagttagaattagttagaagttactagagtgaattgctttatgtctaaaaaaaaccaaatgaagtcgaattgtgtagagaatccagatgaaggtctgttttgcattttaagatgggatatctaaggatctctggggaaagggtgaattagtcaatctgtggtactagcacaatgagcattttgaaaaagatttatttccatacttcatactaaacacaaaaataaattctaaatgtattaagtttatatataaaaaaagtaaatgtactaggtgaaaatatgtaaaatattaaatactaaaaatattttcatattcctggaaaaagatatttgtaagcataataccagaagcc

SEQ ID NO: 205020 - DNA, 489 bp, Homo sapiens
cgatcagactagtttggtatcagggtctgtggccttgtagaatgaattaggaagaattccctcctcttttattttctgggatagtttggaaagaattggtattaattcttctttaaaggtttggtagaattcagcagtaaagccgtctggttttggatttttttgttgttgaaagaccttttactactgattctctctcatgacttgtaattggtctatttgtgttttcttttccttctgggttcaatctttataggttgtatgtgtccaggaatttattcatttcctttaaattttcaaatttattggcatattgttgttcatagtactctctaatgatcctttatatttctatggtgtccattgtgacatatcctcttccgtttatgattttttcaaatttgagtctctttttttctttttttctgagtttcactaacgttttgttgattttgtttatcttctcaaagaactaactttctgttgatc

SEQ ID NO: 205021 - DNA, 582 bp, Homo sapiens
agttctcattttgggccacaggtttcaggctttttggtttgaagttggggtttcactgggaacccacccctgtctgcctagaatgtctctgcttcctgcctctatcattgaacttcagatatataaagaagttattctatgatatgtcattgactaagcattaattatgttgacccttttagtgactataaataaagagctctcaacaaacctatacctttaaagggaagaaaaactatacctgaattacacatgataatttcttagaaggcattaagtatttaatcatatctgaggagaatttggaaatgaaaccatttacagttgcaatttaaccagctctcaagagcattacttcctgtagcttatatcagtgctcctcaaactttaacatgcatacagatcacctcaggaacacttgagggtctgttcaaagtgaagattcagtagatggctgttgggacctgggattctacatttctcacaaactcaggtgattgtaattttgtgaaccacactttaagtagcaaagcctatagtatttacagttataaataaaggtaatattttacatttctaaaa

SEQ ID NO: 205022 - DNA, 292 bp, Homo sapiens
gtaagatgtttctgtatgttattacggttgacctgtatgaggaaaatgtggccttacccagaatgaagttgaaaaatggaggactaattcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtctggcctgggtgacagagcgagactccgtctca

SEQ ID NO: 205023 - DNA, 266 bp, Homo sapiens
cacggccggctcccccgccgcaccgcacgcatctgtcgcagttaaaagcgccgctgccagagcaaaagcgccggtccctcttgactgtccccctcctcacttttcgggctcagaaatgtggcccaggcagcccccttgtggcacgtgggggcgccacagactcttggctggtgtctgaagaattcagactgtctgattccaccgcaccgtgagttggcacaaatcttcggtggcccaactcctacccgatgcagaactctgctcag

SEQ ID NO: 205024 - DNA, 482 bp, Homo sapiens
acttctattagaaagtctgtatctaagctaacttcattagatttaagtagataaaagctggaactgaagaaatgaagaaaggggatatgttaaaactgatgcattgtcaggattttcccagttttctctttttggctaatttagaattcacagagtaacagcttatatctgttcaattaaagggtcagttaaagagctggcacctcaaaaatgtttatcagtctgtgttacgtaattaaatatggaatctattcagacaaacgttaaaaatcagtccaggggaaaggaagaattttaataaattttgaaatacaaatcctaaacagttctttttgaggatgtgatactttatgtcatcacaagagactggagagattagaatgaactggtttaaagtcttaaaatctaagcctggaggctttctttaatctgcatgcaagactgtttaacactgttgcaactgcaattaagtactagactgt

SEQ ID NO: 205025 - DNA, 717 bp, Homo sapiens
tcggcccctttgcctacttgacctcacagcagcccagcaaaccgggtattattaggctgaaacatagcaagtggcatttttgtaagtcaaaaatgtctggctattcgcaatttcacgtggctcagtctggtattatgctccccattttacagatgaggaagacaatggttagagaggttaagtaactcgttcagagtcacgccgctggcaaatggcaaagccaggcctgagtggagcttcttctgactccagcctctggctctgaagcacaggctcatccaacgggcacagggtgcgccacaccatctcctctgtcctccctccgaggaccccgctcttgtagtcaccaagttcttccttatgcctggtctaaagtcactcatttcttcattcactcgacaaaagttcactggtcacctactgtggacaacgtgtgcgccttcagtgaaccccagtgtcatccatgctgtttagatggaggagacaatttgggcaatgtccttaaatatccgcgcgggagctaatgaagcctcctctctagctctctggtatcttggctgatctcaggttctggtagctttctctaacaaacactcatctaactgaattgtaacccagaaccctttatctcccctcctggaagaaagtcaccaaaaggcaaatccaccgtggtaagtgcgttcgcacccagggtgaaagctgccctcactgacccaa

SEQ ID NO: 205026 - DNA, 430 bp, Homo sapiens
agagagaattgggagggagaaaagtcaataaagggtggcgaatgagaggttatgctgtgggcatacagggctgaatctcactggggaccctccaagcaactcaataaaataaacttcagaagtgccaaatcaggccaggtgcagtggctcacacctgtaatcccagcactttgggaggctgagccgggaggatcccctgaagccagaagttagagactaacctgggcaacatagcaagacctcatctctacaagacaaattttgaagttagctaagtgtggtggcatgtgcctgtagtccctagtcccactacttgggaggctgaggtgggaggatcacttgagcccagaaattcaaggtttcagtgagctaagattgtaccactgcactccagcctgggtgatgggtgacagagaccctgtctcaaaac

SEQ ID NO: 205027 - DNA, 554 bp, Homo sapiens
catagaaccacctctgagatactgtgttagtcttctgtggctgctgtaacaaatggccacaagcttggcagcttaagataacacacatttattatgctacagttctggaagtcaaaagtccacaatcggtctcagtgggctcgagtcaaggtatgggcagggctgtgttgctgctgcaggctctgggggagaatctgtttgcttgccttcccaacttctagaggggcccacatgccttggattgaggccccatcctccatctttaaagcactgaatcttcagatctttctgactccagcctctgcttctgtcctcacaatctcttctttctcctgcctccacttatcaaagacccctctgatgacattgggtccactaggataatccaaaatcattccctccatcttgagagctgcaacttaatcatgtctgcaaaatcctttttgctatgtaaagtaatatacaagttcaaggattagggtatgtgcatctttgaaggggagcattattttgcctaccacaccctgaagggaaataaggttcacagcagtatg

SEQ ID NO: 205028 - DNA, 329 bp, Homo sapiens
gggtaatggggcctgttatctgcctccctacagaagaaccacaacgagtttcctttaaaagccagtttcctggccaggcgcaatggctcacgcctgtaatcccaacactttgggaggccgaggcgggcagatcacctgaggttgggagttggagaccagtctctactaaaaacacaaaattagccgggcgtggtggcgcatgcctgtaattccagctacttgggaggctgaggcaggagaatcacttaaacctgggaggtggaggttgcggtgagccgagatcacgccagtgcactccagcctgggcaacaagggcgaaactccgtctc

SEQ ID NO: 205029 - DNA, 362 bp, Homo sapiens
gacctaaagttaatctagaggaccccccatcacagccaatagccagcaaagtgaagcctggaactgaacaaatcccccatggccatgccacctgtccagtcccacgtcttgcggataaacggactgccctgcatcctgccttcagtgctagtggggccaccagactgccactgcctccaggtgttcccccaaagcaccctggaatttgcaggcaacagaataaggacatttgataagacatttaagtccctgggcagtaataggagaggggaagcgaattaggctgagaaagcaggagaaagatgtagaatgggtcagtcgtcggcccacatttagtgcaggatggcctggaagtgaatgct

SEQ ID NO: 205030 - DNA, 317 bp, Homo sapiens
agtgtccaacacttgattgaaaatgtggattttgtcctgtggtgagatgtaaaaataaactcagtggctatcctcatgcagttccttgcaaaagagcagtggaaagcagctgtcagccttgcccaaaataaaccatcaccctgtatcttgggaggcatatcaaaggaaattgggcaaaacattcaaaagaatccaagagtgggagacacaatcttacaataactgggaaatgcatcaacagtctcatgttttctttgtctttggtttaattttgctttttgtgtgtgtttccttatttacaaaagaaagaatgagaa

SEQ ID NO: 205031 - DNA, 626 bp, Homo sapiens
gcctccgatcacaaaaagatcaaattaacatgtgaaaagatattccaaggagctgtgggagagaaaggcttttggctttcaccatcttacctactggatgggtttgaaagcataaaataaagctaaactaaattcagggaaacattgattcacccaagtgaataaacaacttactgcatttgctaatctaattaatcaaactctgcttctccttttccaaaggagattcacaggcagtaaaataaattaaatcaacattttttttttcccacttactaaaaataagctttctttccctgggtaaatcggtcatttaaattcccaaggctgcactcccgtagtcctctggcaggaagcaattgtatgggtataaaatcatttctgtgcagattgcagagcttgggctctgagcatcatgtctgagttctgccacctaaactgatgaataagatcagttttaactgaagttatctttagaaacaaatggcctatggatgatgttgattagcagataaaaaagcctgttacatggatgttttatgaaacttaaaactatattgatggcaggaaacaatgattttggaggaaatcctggaaaattaaggatatttaaagtttgaaaacaa

SEQ ID NO: 205032 - DNA, 6435 bp, Homo sapiens
ctccttgcggctccatcattcaggccttgtcatctctcacctggactgctgtgaccttcattcattcccaggagaagtccagaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcaaacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccagtcagactgaagtgttccaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcatcgctccactctcccctgcagccgcggctgctcggccactgaccaggggccctggcagacattaggggatcagttgtatttattgtattttatctgtgtgtgctcaggaggtgagcctagtgggtccttaagtttggttgtgaataatctcttgatagacaatttatacccatgaaagttcagccaatgcccagagtgaccaagcagcaccagcaggcctgcccaggatgctgaaagcagatttcttcttgatttcacttctgatggatgcatggggctctgggggaatgctgggaaaatgggcaagcagagtgcacagcccttgttctgccagctggagccaagaagcacagagacacagaggcacctgcccctcagctccgctggtctgtctgtgcatccactgtgccgtgggacatatgtaatttgtgcagtgtgacatggacttgctgtcctaatggatgtgttgtgccttgtgtctgtcatgtgtggccagcgtgattgtatagaatccagagtatgtagagagccaaaatgtgtggccctgtccccaagctcagcaccaccggccatgaccagaggatgctcggcccagggtctgggagctgggctaacaggctgacacttcggcagggtcaccaggaggcacagctaggggcatgctcacatgggtaggtcagttctttggtccaagcctctggtgcagattcaagctcctcctcttagaggaagcagctccttcctcccacaggagccccaagggagcactcaccctcctcccaattggatctgaatagctgtgttcctgatcccacataagcatgtctcatccttgccccactggtgagaggaggaccttgtgcctgcccagagcctgcaggacagcacgccttgaggtcagaggcctggcccttctttacagatgtagatagcagggtaggacgcccaggccttctcacatgggcaccatgaaacactttcttccaggccacctgagccttcgttcttcagcccgactggaggaacagcagctctgggaggcacagagtgcaggtctcaggggcagaagacatgggttccagttctggttctgccacacacccaccggccttgaatttctctggtggtctcaagacaagaacaagagctgactctagaatcttctgcctggctgacctctgagcccatgatccctggcttgctgtgcttctcttggatttgaggagagtttatgaatccattcccctgttttcagggacctctgccttctcccacaccccttacactagtgaggactccttcggcctcttgtgttttcttccttttgtgaccattacgccccctccctgtttcttatcaccagcccatcagcccactgactcccatatggtagaaaaggtaccgtggctgctgcagggcacatggagggacctaccctctgggaaagcccttgtgtccctcccagagtccttcaggtaggccctcgcagatgctgcttgctcagaaacaacccgtgcatccctgcccatggattctgcaggacctagaagagtggcattggttctaggaacctgagagtggagtgaggccagcatgcaggaaggagtttggagagagtgtttgctgtgatccattgaaagctccacattaaaccccagccctgtctggccagggagatccatgtgctcaatgttgctgggggacctacaaaagtcaaacattgctcagtaaaatgcctttggctggtcgccagctgtgcatgactgcagttcctagactctaacttaaccccaactttgcagtttctagagctttttgtctgtaatggtgattgggtctccactgtagatgcatgcagtgttcactccaacctcagaggctttcttgcttctggggaaatggcaggtggttgaaaccctgcacatcctcccagggccagccccagaatgggcctttctctgcctgccctgcccttggggccacctctgcctccagcaggcttgagcttgccccaggccttgggcataattatttccccccaaaaaaggcacaaaaataggttttggatcaaagaagtgtttctcagtgaaatgaaaacagtctttttatagcctttagcttgtgagtttggaagtttggggggtcttatgtttgttttgcctcttctgtttcttggaggagagttgaggcttttcttaggtgcatacacagacccaggtgaacacgctgactgtgaacctgccctgtatccggagctgtgctgggcactgaggggatgcaacaaaattaggagaggatccttgctcccaacgtctacttctcctacctcaacaggggtccagggtgcagtgaactcagttcttggcccttgggtgaggattcatggatgaatgaaagctagacctgatggggaggcattatgactaaataggcccagcctccttcccttccagctctgtcctaggagcataggcgggaaatctgagtagagtctgactgcagtttttgcttatgatttgtaaaagccgtcatggggtcaataagaaaataggggtgatggagggggagaagcccaggactgggagaatcgcacgtgccccaggggttttcaccaaggattttcaagacaaactggagtaagaattaaagccccagaggatttaattatcctggtttgcaaaagagcctcccatgccagtaccgcccagccttggaggccggaatgctcatggcccctgtggtctgcttgtccttcagcccatgcccagcagatacctctctgactggagacgggctcaaagctggattagaaaggggagaggcacttgtgactttgtttgactctgtgactcacttcctcgctcacaccttgtttgaactactggactttcaactggctttccttaggtcaggcaagcagacagctccccactgaagaggtctgtacagtgacaacccgggccggcagcaaggacacagatgcagccacagtaaggctccatcaggactgggtcagtgatggcaacaggatggccaaggatggctctagaacactctgtccatgcgtcactccccccagttttatttttagctttggcttcagggagtgacagccatcacaaatagccacattctgctctactctccaacataccagattgtacactgttgttatttcatgagacgtgaatgttgcagagagtggggggattctggttgttaaggaacttacactggggagctttactcttccgtgtcaacaatgtgactacatgttctccagattagccacacatgcaaacatcagtgtccttctagctttagccgagaaagaaaccagtcccagggaatgaatggtggtctccccactcccggcagcactttaggcagcccataagctatgcgagaatgtgaacgctcaccttgctccgtcacggttctgacctaccacataaacaggaagaagccagtgaccggaacagctctaggaataacaagtcagaatagaagtgtcctttatattaccagaaaatatgggcttggcctaagtcgctgtctcctaacctgccggggtcattccccaccaaacaccccatactaaggagccatgagccacctggacattcaccttttctttgaccatctggagtctggggcaacttaaggaggcaccacacagtggtgcaggcacatttccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggaaaagatttcataagcaggtgtcagtggacagtttaagcacttaaccatttctctttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctg

SEQ ID NO: 205033 - DNA, 751 bp, Homo sapiens
catctcaaggtgctggactttttgtcctccaaattgaggtttgcctttgacttaatggaaaaactttcttctggtgccacaatagccatttcattccaagatggattgcaatgtgaagcggtctttttccatttcatgtcccaaacctcagcacaattagttttgaaacaaatgtcaatagcttctgagggaggctgtgggtgtgaggctggagtatcagcggccagccacagagaaggactcagaggttctgattgtgcccatcgtgctaagacgtcctgtgattcctgagaggcattaattctggtgcatgttcattgagcatttttgatgcaaagtagtttaaaagacagaaagaagatggagtttgttttaaaggttttaagataaacacagatcagcactgtctcaaaaacgctgtgcatgtttccatgaactcatgatctttctgtcttgacagtctccaatcacgtgtggagatgaccttgccatcccacccacccttcaatcagagtggggacagatgttatccattgaattatatccccccactgagaattcctgtcttaaagtcctaaccccattgtatctcagaatgtggctttgtttggaaatagggtcattgcagatgtaattaattaagatgaggtcttaacttactggaatagggtgggaacttaatctaatctgactggtgtccttacgaaaagaggaaatttggacatagacactctcacacagggaagatacc

SEQ ID NO: 205034 - DNA, 421 bp, Homo sapiens
actttacaccatgcctggttaatttttctagtttttgtagggacggggtttcgccacgttgcccaggctggtctcaaactacttcctgacttttacaccgtagtggtgactatccagggatattagagagtagtatataggcctataaccaggctgaatcaatctcccagggaagatatgcagtacccagctaggaataatctcttgcaacagattgtattttccaaagatggtcacaataacatctctgctatagtttggaaatctgaccttccaaacctcatgttgaaatttgatcccctatcctaagtgaaataaaagaaattttaaaatattaaaaaacattaaaaattaaaaattaattaggcatggtgttcaaagttgaacgtgattaccgttgagaagcttcgttgagaagctt

SEQ ID NO: 205035 - DNA, 124 bp, Homo sapiens
aagttgataaacaaactcagattggaaaaaatacaatgaagacacatgctgccaaacagaatatgatgggagaagaagaagagaattttcactggtggaatttccctttaatgtgtcatttttt

SEQ ID NO: 205036 - DNA, 192 bp, Homo sapiens
gtaataaaagttacttaggtttattgagtttccttctaggagttaattctttttcacaggttaacattttttttataaaagacctgtacaatggccctttgcataggaaatataatgaagactcagatattttgctgcaaatatttattttcacctgctaatgataatttggtaatatttgaaatactttat

SEQ ID NO: 205037 - DNA, 485 bp, Homo sapiens
  misc_feature (394)..(394): n is a, c, g, or t
  misc_feature (402)..(402): n is a, c, g, or t
  misc_feature (407)..(407): n is a, c, g, or t
  misc_feature (414)..(414): n is a, c, g, or t
  misc_feature (425)..(425): n is a, c, g, or t
  misc_feature (432)..(432): n is a, c, g, or t
  misc_feature (436)..(436): n is a, c, g, or t
aagtttcatggagctgagttggtagagcctgcgtgcctgtctggcactagctaagcactccatgattgtttaagattatcttattccggccaggctcggtggctcatgcctgtaatcccagcactttgggaggccaaggcaggtggactacctgaggtcgggagtttgagaccagtctggccaagacggtgaaaccccatctctcctaaaaatacaaaaattagccaggtgtggtggcaggcgcctgcaatcccagatacttgggagtctgaggcaggagaatctgttgaacccaggaggcagaggttgcagtgagccaagattggaccactgcactccagcctgggcgacacaacgagactcagtctcaaagaaaaaaaaacaaaacaggaangaaaaaangaaangtcagtngctcagggccnttccaantcanctttcacactcgggtctttggataccaactcagttaagggtaccgagct

SEQ ID NO: 205038 - DNA, 411 bp, Homo sapiens
gcagggtgccacgagatggaggtagagggagaaaggagcaagagagaattgaaggatgaagtgcaagttatcaggctgggttaccacatccggttttggcctgtgggctgtcggtagatctgccttaacctgggagtggcgagggagtgatgcatctgccaaaacgaggagggtcactacatctcatgtctcatctccttgctcagctcatcctagccatgctggcctcctggctgttcctcaaccagctagtcgtgctccccatctcagggcctttgcctggatgctctttcctggagatcttggctatcctgtcaaaacttgtgttccccaccccgcctttatacactccctattctatgtattccttaccattttcagacaggttgcgcgtacaacgggtaccgagct

SEQ ID NO: 205039 - DNA, 548 bp, Homo sapiens
tctgtcttgttggaataaattattatacattcacattggaatactatgctgccatttaaaaagacagtctatactgacatggaaatattccaatgtgaatgtataataatttattcaacaaaccagtatttccaggcatctgtcttgtttttcattgtactcttgtaggcattgtgctgctgggaacatcatttaaacctaacattttctcacatttttttcatttttctccatggggtacatttgtaggtatgggcttgctgagtctagcagaacgtacattacaatattttatgatgttgccagtttgtcccccaacgtctgattgttatgtagtcagatgtatctttctaggcaggctttctccaccctaaaattataaaagtgttcactcattggagtagccagggttcttggttgtaaaaacagaaactgggccgggcgcggtggctcacgcttgtaatcccagcactttcggaggccaaggcgggcggatcacgaggtcaggagatcgagtccatctggctaacacggtgcaaccccgtctc

SEQ ID NO: 205040 - DNA, 284 bp, Homo sapiens
gtagttactgattgaatgtgggaaaaggagagacttctaaaagtatgttaagaaaagaattcttaataaaagtccttgtcacatattaagaggccatacaataaaagtactgcaatgactatctttccctgacaggaatgcacaacaatagttacgctgttgaacagcatcgttacaaagacttcattctcagaagttacttgaaactactctccaaaagagaacctctaccatttaaaagaagagggggaggaaagccaactaaatgaatccatcagaaactt

SEQ ID NO: 205041 - DNA, 461 bp, Homo sapiens
cgtggtgactctagaggacccccaagcagtaatacagactcatggccttttatagctatatttctctttctcccgactctgtacaaactcctttgttttagagtttgcacaaccctctatcaaagcacctaccacctcacttttaaatcttctgcatgtatttctgtcttccttcctagactgtgagcacatctgggacagggaccatatccttttttgtttatttgtttggtttggagacagagtctcgctctgtcggccaggctggagtgcaatggcgtgatctggctataacctccacctcccgggttcaagagattctcctgcctcagcctcccaagtagctggaattacatgtgcttgccaccaagcccagttaatttttgtatttggagtagagacagggtttcaccatgttggtgaggctgatctcgaactcctgacctcaggtgatctaccca

SEQ ID NO: 205042 - DNA, 340 bp, Homo sapiens
actccctaagcagtccattaagtgacaaatcaggaaattaaaaatggcacacacaaaaagcaatgaaacctagaagcccaggtgaatcttatgtctcttccatcttcttgtttttaagggacagggatcttactgtgttgcccaggtctttacaatgacaccatttgacctttctcttctattcctcaaacacaccaagactgttcttgcctgaggacatccgcacaagcggttccttctgcctgactcttctccctggctcatgtcttcaaatctctgctcaaacgtttcctcaccacaggccttcattgaccaccctagactctatcctccttacctg

SEQ ID NO: 205043 - DNA, 294 bp, Homo sapiens
taatttgataccaatacacactactagagtgactacaatgaaaaataatgacaaaaacaaatgcttgcaaggcaatggagaaatacataaattgttggtaagaatgtaaaatagtacagtccctctggaaaacagtttggcagtttgttaaaaactaagcaagtgatatcacacaaccaagcaattgcactcctaggcatttatcccagagaaatgataacttatgttcacataaaaacctagacacagatatttatatcagcattatttctaatagccccaaactggaaacaa

SEQ ID NO: 205044 - DNA, 388 bp, Homo sapiens
aggaatgtatagaaaaggcttaaggaaagcatccaaaggttagaatggccactcacgggagtgggacaggatacagactagaaggtttgctgggcagggagagggcgcaatggaagaggaaaggcccaaaatgtgacacgctcaaacccatcatagtgtggggtttccagcagtctgtgcatggaagtagacagtgacatcaatggagcaactgtttggagttctggaggacagttaaggaggcaagacaggagaataaaagtcagttcagggtgctgtggattacagaatgttgaaaaaaatgaatcatgagaagtaagctaaacaagtcacgggcctgaaggtcttcaggacctacaacaaatgatcaaaataggaataaatgagt

SEQ ID NO: 205045 - DNA, 687 bp, Homo sapiens
ttatgtagagtacttgcatgtgcaagttacaaccgtataaacaaagtagcagtgggtgtgttattctctggtcttttttctgctactcattatcaaaaatagcattccatcgtgtcttgtcttccactctgaattattttgtaaaattagttctctaaaagagggaattctgttggaacatgtgacccagttttttttttttttattaaagcagtccaactttttaaagcgttcatcgattaatttattgtctagtaacttcggagtggtgtggaacattgtaaattcacaggctcagcagtaacaatagagaaactacttgggaaattggaagccaatatcagataatgtttgaaataaaaatctattcttctcacagaatttaggaaataaagacacacaaaaacaaattctttgggttcaagtgatcctcccaccccaggctccgtagtagccgggactacaggtgggcacgactgcgcctagctaaaatttttattttttgtagagatggtggtctcactttttaatttttcgtatagacggctggtctccaactcctggcctcaagcgatccttctgctttggcctctcaaagtgctgggattacagactgagccaccgtgcttggccgtttgtagtaatcttgatggtatctggcattgtttcacctaatatttcttcttt

SEQ ID NO: 205046 - DNA, 540 bp, Homo sapiens
catttgtgtgagactgcaagagacgagacttcttcaaaggaggtggttgctcctccactctgcctgccagtagctctagggaatcctagagtagtgttgtctgaggtcctgatttttcaaggggaaccagaaattttgatttctgtgatattttaacatttttaaatgttagcactatttggaaactgtctaaagtctgcatctggcctgtggcctgacatttggctgtctctgctgaagttccacacttccactttattaggagacaaagcctatgaacctcattctgagcatcaaatgaagcttgtagttattaattgtctttattatttggagaaaatactattatttagctgtaagtaaaggttttatgtagcttacatggaatactattgatatttgtgcagtattttcaggaactattctaagtactctatctgtattaataaatttaatcctccacgactctataaggtaagtactattaatgtcccagttaacagaaacggaaatggaagcatggctgaaattaaataactt

SEQ ID NO: 205047 - DNA, 397 bp, Homo sapiens
caggagaatgtaatgcctcagttcattttcagttatctttgattatatgtgattgacaatgtgtatttttgagggagcaaagatttctgtacatatttcttaaaaatagtttattcagctgggtgcagtggctcatgcctgtaaccccagcactttgggaggccgaggtgggcggatcacgaggtcaggagtttgagactagcctggccaacacagtgaaaccccatctctactaaaagtaccaaagttagccgggtgtggtggtggatacctgtaatcccagctactcgggaggctgaggcaggagaatctcctgaacctgggaggtggaggttgcagtgagccaagatcacgccactgtactccagcctggacaagagagcaatactctgtctca

SEQ ID NO: 205048 - DNA, 913 bp, Homo sapiens
caaaaaacaaacaaaaaaatcaaaacaaatggtttagtcactttgtaacctggacagaggagtgaacatatatgaaattaactttctttggtcttttaagatttattactaagatttaactagagttaaaactttccttgtcctgttggccgggtgccttggctcaagcctgtaatcccagccctttgggagggtgaggcaggtggatcacctgaggttgggaatttgagaccaacatggcgaaaccccgactctactaaaaataacagagtagctgggcatggtagtacacgcctgtaatcccagctacttgggaggctgaggcaggagaattgcttgagcccaggaggcagtgattgcagtgagctgagatcacgccactgcacgccagcctgacaacagagcgagagactctatctcaaaaagaaaataaaagctcttcttgtcctgctaattctgcattttgatttttggcagcatttaggaaagagctgaggtggacctggtgtgtagcgttggtgggagttccttcgttttctgggctgaatgatttaataataatataatagtggctttcattaatttcttactatgtgccaggaatggactgtgttaagcactttatatacattaatccacttaattctcatgataaccctgtgaaatagattatctcattttgcagaggagaaaagtgggtctcagccagtgaaataacttgctcaagttctctcacccagtaaatggtagagcagtcatttatgtgtagctctgttggacttcagaactccagctcttaactcagtatatacttttccttcacttccttgaatagaactgtttggcttgagtctccttttctctaaaaactcctagttctggaatggtgccaacttaaggggtcagggaagtg

SEQ ID NO: 205049 - DNA, 105 bp, Homo sapiens
aggaattgagtcagaagttgattctgtgaatttggagttcagaagagaggttggagctacagcgaaaaagttgtgatttcatcagcattcagatgaaattaaaac

SEQ ID NO: 205050 - DNA, 432 bp, Homo sapiens
ggaggttgcagtaagctgagattgcaccactgcacctcagcctgggtgacagagcaagactgtttcaaaacaaagaaatcgaaggacaggcagagacaccagtttcttattcaggtcctcatagcaatttgaccagttctggtcttctcaggggtcgtttttaaagggaatggaaatatgtccctgcttcgaccctaagcaactacccttgactttgactttggtgtccaaaagctccatgttgatttgttaagtagggctgattatgtctcgccttcttcagggacagtggtcctcaaggttgttttggctttcggacaacttggataggacaaaaggactgtccgcctccttatcacctccttcgcatttgccgttcttaatagaaccccttctgagatagggaggcagttgtttctcccggcaacagga

SEQ ID NO: 205051 - DNA, 730 bp, Homo sapiens
taagttctgcctctcgaagataaaactttaattttgtggacacttagagaaagtaaggggtgggggagcttgaggtgagtaggaatttgcatagcccttttcttcctggacttaagaatgatggagaaaaaactcagtgaaagagataaggaagcaaatgtgtggaaatgtgtgataaggaaggaaatgtgtcaaggtggttacaatatggaagggaagcataggttttttttttcttttgttgagatggagtttcactcttgctgcccaggctagtgtgcagtggcatgatcttggctcactgcaaccttcgcctcctgggttcaagcaattctcctgtctcagcctcttgagtagctgggattacaggctaatttttgtgtgtttagtagagacagggtttcaccctgttagccaggctggtctcgaactcctgacctcaggtgatctgcccgccttggcctcccagagtgctgagattacaggcatgagccaccgtgcccgaccagaaagcatggtttttgaaggaccatattttattgtaaaaaaatgttttggttcagatagatgtgtgctgatgggagtaattcacatctatcagtgaccaccaccaagatatttataaaccttatcaaatacagtaggaagagcaaccagcacaattttggataaatgtatatgttgcagtgaacaaagaagatagtttaaaataaaagatgaccacagaata

SEQ ID NO: 205052 - DNA, 200 bp, Homo sapiens
ttattaatgagcttaagagatctttaaagaacaaaaacaaaaaactatgagaaagctgcagccaaatgctacccaagtggtcccctccactttatgctagcactggaagcttctaaaattgttgtggccttactggcttgtgtatttctgaatacttgtcaatcatcttagggaaaaaagtcttggtatgtcaactctag

SEQ ID NO: 205053 - DNA, 426 bp, Homo sapiens
aatactcttactgaatgcatagtcctaatggaagcaaaaataggcactgtgctccctgaagagggctgcaatctccacaggagcatggtcatgaagatgtaaaactcatctttcctcagactatggtcaccttatggctaggctacctgataaccttgtacccttattctcagccttttggaaaacaattttgtaaaaaaaataaataaataaggacatttctattcctgaagctgagttatcaaagaagcttaaagtagtaacttacatttaaatatagcattcttaactttctccagagttcttctcaatcacaataaagaaatgtatacatacataaggcataaaacatctacaaaatgttatttcaggatatctacttgcattacatttcacataggttatctcattttatcctcaccccca

SEQ ID NO: 205054 - DNA, 221 bp, Homo sapiens
ctcctatctacacacacacatacacacaccccttcctttaaatttaaatgttaaagtcttcattttcccaccatgggctgtttgacagctcagagctagagaaaagatgaaggagaagatagaatagaggaagggacaaacaagatttggaagagtgtgcactttattgattcttatgtaatacaatgatattaaacaagatgctgagttagataaatggg

SEQ ID NO: 205055 - DNA, 222 bp, Homo sapiens
taatgaaaaaataactttctgcagttagtcctagttcttttatttggtaagtgtttgcaaataaaaagtagtagatgtaatcaggctggaccctgctgtatgctattagagatttggttacccttctcttcttatacacaggccactcaccaagtatttattgagtactggttatgtgtccagcattgttctaattggtaaatgtttaatcgtctttgaaca

SEQ ID NO: 205056 - DNA, 465 bp, Homo sapiens
gtagacacgtgctgctgtgtctgaggggccatagcaaaggagccagagtggctggaggagcagagagtgaagcggggagtaggagggggccagaggtcagggggtggccaggtcccataaggccttgtaggtgatggtgaggactctatgccaagtgatatgggagccatagaagggtgttgagcagaggagggctatgatctggggtatatttttaaaggatccctctggccactctgttgcaaatcagtaaatcataggaggtcagggcagaattagaaagaggcacacaaaatttgtccagctgagaagggatggtggctctgaccaggagagaaggtggtcagagtctggatatattctgaaggtagatccaatcttcatggtggcttgggtatggggtgtgagagaaagaagacagtcaagtttaatgccagggtttttgttctgtgcaactgcaagaaa

SEQ ID NO: 205057 - DNA, 299 bp, Homo sapiens
tgattaattagatgtttatacactagtttggcatctgataatttcctatgggaaaaacatgtttcagcttccaagtaaacttttggaacataatctgtttggggtcacttgtcatttttcatgaagtgtcccttttaatttctggtcaggaaaaaacaatctaaaatcctgtgctctcttttcactttatgaaaaggagctattaaacttcctttagtttagaattctctacagaataggattagatagaaatactcatacattaagggagttcaaagatgtggttatttaaaacagta

SEQ ID NO: 205058 - DNA, 398 bp, Homo sapiens
acatggatgcctaagtctgtgacaataaagtctgtgaagtaaattgactgagagggtaatagtaaatacagaatatcagtggatgcctgaaactagcaggagaaaaatagaaaataattatctcatcgaggaacaaatagatctattgatagtataaatttttaaaaaatgtttgtaaccttttccattaagtatactagtttatgataagttgaaatattttgccatctgccttatgaaactccactcaatctgtgcaattcaaagtattaaaatggaaataaaataaatactgtttcacatataaaacaaattggaccttataactaatcatttcttctcatttcaatacctcccactattctcttcttaactgaaaatgactgcaaggaggcttt

SEQ ID NO: 205059 - DNA, 602 bp, Homo sapiens
ttcctgtctcttacgttgcctagtttctgtgagagtttgtttgggtgagagtctccaggaatcactgtcaggcaggtgacagacagcccatgatatcatcactggacctggtcactgtcttgtgattgcaaagggagatagaaggtgagatataccaagggagatgatttggagactcagatttctgcttcaaaattttgattttcaggaatggagtagggcccaggaattgacattttaaaagccctttagggattgttgatctagataatccacatgcctatctttgaaaaaccttaggatggaaataaatataatatgtagtcagagtaatgaagaatcctgagattaggatacattccaaaagtaaggaataacataaactatggagcacatttcatttctccaattcatatagaagtatgtttttaaaacgcaggattaaggaaactagcaggcttcttgtctctattgaaataaaatagatgtttcagaaaaatagttgagtctgaaatgccgcaaatcaaatgagggtaactatgcttcatttgtcgttgctagcttaaatcatggttctttacagaagggagagtttggcaaaa

SEQ ID NO: 205060 - DNA, 422 bp, Homo sapiens
ctgccagcatttgggtcccatgaaagaaataggcatgtaaaggacaaggtggtgcagactaactgcaagaactgggctgttactaaaacaggtgccaagaaccatggttccagcgtcccaggccataagattcccagtgacagggacctggtttcccaaggagcctcacagctcacatcattggagataaacttttcaaccagcattaagaatgcctgccaaaaatatcaagcccaaagtatgtttttgtgtgacccacgtgaacatttggtgattaaacagaaagatgggactgtagaaatgcgggggaaagacaagaagcagcagcccaggaaggcccacagggcccacagaggcaggctcatagccagcaagcaaaaacaaatcccaatccagacctgtaaattcaattccaaatatca

SEQ ID NO: 205061 - DNA, 262 bp, Homo sapiens
cagtcataatttagatatttactaattcttccaaatggtttcactgcttttgcacttgttaaacattatgggatttacaatgtttaaaacagcttattgcccagcatagtgacacacacttataatcccagcttctcaggagcctgagggggaggatcccttaagcccaggagtttgacaccagtgtaggcagtatagtgagaccttgtctcaaaaaaagcaccaaagaaggagactaacattatcacagatggtagagact

SEQ ID NO: 205062 - DNA, 246 bp, Homo sapiens
agaagttcaagacttctacactgaaaattacaaaactattgatgataaaaatggcaaagatagttaaaaaagataaaatgaataataggctaatttaatatatggatttaaaattaccaattaaatatagtagtttatcaaaataattctacattatgccaaagcaaggttcattcaagaaaaatacaattcagtgttagaaaaagcataagcaccaattggtgctaaaaggtacttgataaaata

SEQ ID NO: 205063 - DNA, 274 bp, Homo sapiens
  misc_feature (19)..(19): n is a, c, g, or t
tcagaggatccgctgatcngcttagcagttgatacgtttgtcaggtgtttgtgttttaatgtttaactcttgttaccatcaccacagtcaagacataagacatctccaccaggatcctttgtactttttcccagttaacttttaggcttaattttctctctgtttttttttttccaaaaaaaccacaaaacttttcttaaagtttagattattgattttagacctcttttcttttctcatctaagtatttaaggatagaaacttccccttaagc

SEQ ID NO: 205064 - DNA, 452 bp, Homo sapiens
atgcctggctaatttttgcatttttagtaaagatgcagtttcaccatgttggccagcgtggtttcaaactcctgaccttaggtaatctatctgcctcagcctttcaaagtgctgggattacaggtatgggccaccatgcctggccacaattttttctgttttatagcgttttgcaaacaccactctgttttttgtttttaacagtataactacttcatgtatgtcataaaatctgtgtctttttgtgattggctcatttcattttgcataatgccatcaagatttatatttatggttggtagaatatttcctgcttttgaatactgagtatattccagaatatatatatatattttttgagacagtcttgccctgtcaccttggcaggagtgcagtgagccaagatcacgcccctgcactccagcctgggtgatagaatgagacttgtctca

SEQ ID NO: 205065 - DNA, 412 bp, Homo sapiens
tattagacatcccaaacctccatatttcaccatcttagagaagatatatatgtaattctcctccataagcataaaatagtctcaaatactgataaatatagtactcccctgacactcctcaagagccagaatgctagaacagaaatcggttatgtagccaatttcctattataagttataatagtaaccaactattctggagaccaatcccaaaattcaagttagtttctaaattgtatctactgctaagtaaaagtaacaagcagcacagaatcagatacacagtagacactcaagaaataaatgtaagagaatggcagaaaaaactgtttattggtactaacctccctatcactgttcccccaaggctgccttccagtggaagtgctaatgagtgggaaatgggccaaac

SEQ ID NO: 205066 - DNA, 366 bp, Homo sapiens
caaagtgctgggattacaggcatgagccaccgcgcccagcctagataacattaatgaaccctggagccagctattgatttgaacttatgtttcttgacagcaagcagtagctgcaaagaaacatagggtccttctcttctttttcttatcacccataatgattgactgatagagtttggttgaaacttttttccaaagaattgtttggcttgttatagttcaaaacactcacaagaaagggtaacagtggccccttctgggatggggagctgcgtggctggagggataagagtgagaaggaagccttctttgcttatatttctgaattgtgtgcttgttttatctactgagaaaagtatttaaagc

SEQ ID NO: 205067 - DNA, 395 bp, Homo sapiens
atttcaggatatagaatttcaacacagcatcaatgctttaaactagcatacttaaagtcaacaaagtatggtccatgacctctggtataagtaaagatttactggaagacatccacgtcgattcatttatcattcctaagtattgtcttatgcaatactcattggcttattatctaaggctgcattcacacttcaacggcagaggtgagtcacttgtggccagctgtgaaaacgcaatttacttactatctggccctttacagaatttagttacttcttttttaaaataaagttcttaaaatttttcattaaaaaatgttagaaaaactcaatttttattttgaatagctgggaatttagtcacagatttacaatgaagatttacaatgaaaatg

SEQ ID NO: 205068 - DNA, 177 bp, Homo sapiens
tagccttccctcttgctgtagctgccacacaggaaccttcgtcttcacctggagtggttcgctcattggttatgtagaatgccctcccctctctctccatccttacagattgtgttaaagtccagctctagctttctctcttaaacaaaacgttacccctgatccccaggccgacag

SEQ ID NO: 205069 - DNA, 426 bp, Homo sapiens
caattgtgcatagactgaaaacattagacttttaaaggtggttaggtctttaaagtcaatgttaacttatctagaatcgacatgtaaaatcccactgagatctgtatgccccatgtgaaatttacttattttactcattcccatttgctccttgagtgatattttgaaggaaaattgtattttattgtgatcttctggaataatataaacagtttccatggttgttttaaaatattttcagaattccttgtccatcagtgcttttttacttatttatcttcaatctactgtttataagtaaacaggcaattccaaaaccaaaaatcaaggttctatagagaggtgcaagttaagaatattcttttatcattaagaaatgacacgtaaatcaatctcatataactaaagtcctgtccttacatcatc

SEQ ID NO: 205070 - DNA, 651 bp, Homo sapiens
atgagtgttaacattgaaaggccaccacaatcattagtcaggacattgatcaatgtcacattgatagcagagatagcctcagacctttactggctcttcctagtgatgatggtgaaggtgttagcacctttcatttgttcagggctctgaagtcttcctgaactctaatttcatttgaacctcttgtggctcctataggatggagagggacagatacagaaaaagattcagggggttgtctaaggtcacaggcttggttaagcggtaccattaggagtagtaggtatgttttttggctctttctacttgtctacctttggacttgtagtgtgtgctcaattacaaatgcctctcaacttatgatgaggctgtgtcccaataaacccaatcgtaagttgaaaatactgaaagtagaagatgcatttaatacacttaacctactaaacattatagattagcctaacctaccttaaacatggtcgaaacactcacattagcctactgttggacaaaatcatctgacacaaagcccatttgataataaagtgttgaatagctcatgtaatttattgaatactgtattaaaagtgaaaaatgaaatggttgtatgggtacttgaagtacagtttttattgaatgcctaatgctttt

SEQ ID NO: 205071 - DNA, 503 bp, Homo sapiens
tcaaaagatatctgaatataaatagataaagaagctccatgataagagttcaaagtgcagcttacaaggagtcaggagacctggaatccagctgttgtaactttatttatctcataggcatctgaaatatgaggaaattggactagatgaatggcctctaaactgtgatttagggaataggtaggcttctgggatggttggaaggaaatacagttgcatgcaggggtctagttcttggactcctttgctgcttcacctgtggaacagctctactttgttgagcattttgcattagaatttaatttatagtaaagatttttcttatggctgggcattgtggctcacgcctgtgatcccagcactttgagaggctggtctttctgggctcaagcaatccacccacctcagcctcccaaagtgctgggattacaggcatgagccactacgcgcagcctagataaagcaaatttttaaattgatttgatactagattttactcatta

SEQ ID NO: 205072 - DNA, 326 bp, Homo sapiens
atcatgggctgctcctataagggaaaggcccagctcatccttcactcaataaaataagaaattctgaaatccagagggtaggatacagtattcaaagtaacaagctttgcattcagcaaacctatgatatttcctaatagtgaatttgagcaagtgacccatttccagatgttttaaatgagacaattaactgacattcataggcggcttgaggataaatgttaatgtaggtatgtatgaatttagggcaagccagaattgacttatctagtagtatcctgatccagatcatgattttggcataagtgattcgactgaaacttcat

SEQ ID NO: 205073 - DNA, 429 bp, Homo sapiens
cacttcccctccctgctgcagagaggttagggtgggaccaggaaatcctgggagatggtggaggaagatgggcagagcaggagagagtggggagggcctgggagtcaggaaacctgaagtggagattaaagcagtggctgggtcaggcacagtggctcacatctgtgatcccagcactttgggaggctgaggcaggtggatcacctgagatcaggagtttgagacaagcctggtcaacatggtggaaacccgtctctactaaaaatacaaaaattagctgggtgtggtggcatgcgcctgtaattccaactacttgggaggctgaggcaggagaatcacttgaacccgggaagcagaggttgcagtgagctgagatcgtgccactgcactccagcctgggcgacagagcaaaattctgtcaaaaaaaaa

SEQ ID NO: 205074 - DNA, 677 bp, Homo sapiens
taggaagaagagaatgtcatccatgtttcttaattttctttttttgtgtgtatttttctttttttctattaaaaaatggatggcacaattttttttctataaaaaacctgtactcttatttatatatcattttagttcagcagccaccattatatttaacatagtacctatttctattctatattatgatttttttgtgtgtgtgtgtgagatgaagtctcactctattgcccaggctggagtgcagtggtgtgatcttggctcactacaatctctgcctcccaggttcaagcgattctcccgcctcagccttccaagtagctgagattacaggcacttgccaccagacccggctaatttttttgtatttttagtagagattgggtttcaccatgttggccaggatggttttgaactcctgacctcaaatgatccgcccccctcaacctcccaaagtgctgggattacaggcgtgagccactgcacccagacaggattattcttacttatttatttataggtctcaaagcatttgtaaaaggtcacaatcaatctaccgttttatgtaaagcctttaaaagatgacagtaagctgaatgatccatttagttatgtttttggtgaggaaggggtggtaggaagaagagaatgtatccatttcttctagattttctagt

SEQ ID NO: 205075 - DNA, 205 bp, Homo sapiens
ggcagctctccgggctgctccctgcctgtgtccctgagcactgactccagaggtttaatcattaacgggcacgtttggccttcggtcgtgggctggaatttgggacctgtgcccgggaacaatgatctccgacacattattttgtgtaaaatcacttttagctgccattagctaataaagctggaataaagtgaggtccattaac

SEQ ID NO: 205076 - DNA, 602 bp, Homo sapiens
tattcctttgtattatgaggcccagtgagtatatacacacaaaagcgagcatacacagttatttaggctgcgcagtggtggcacatgcctgtaatcccagctactcgggaggctgaggcaggagaattgcttgaacctgggaggcggaggttgcagtgagctgagatggcgccactgcactccagcctgggcaacaagagtgaaacttcgtttcaaaaaaaaaaaaaaattgtatcaaggaagggaaaaatgctttttttctcatcgcagtctagtcaaatatacttatattttataaaatttcctcgcaaactgcctttcaataaaatctaaagttaagtagtaaagttccaaccacaagaaaactcattcctgataatatttgaatgtggcctcatctggcaaagctatttaagcagggctctgctgcaggagtgggttcggtaacactagaataagggctcctggggaagatgggctctgttcagctccatgactgcagagggatggaaaggggaaggctgtgtgaggaggtgtgattagggggcttctttgagaaactgaaaatgattaaagaaggtaggagcgtgagaattcttatt

SEQ ID NO: 205077 - DNA, 574 bp, Homo sapiens
aggtttcagtgtcacactcctaagtatgggtaaaaagggaaatttctgaaaatgcaatataaatagtgtgtcgccatggaaaatggtttgtccttatctgaaatgaaagcattaagaagtatatctttaagaaaaaaagtacaatacatttgatgactcaagtaaaatcacaagatgcaaacaactctattagaaattttagattctgaggaggaagaccctttgggctgtcaaaattggtcttcacttcctcctttatgctgagaaaagactcctttttaaatccttgaaagtaataagaactgtgcctttggttgaacatggagagggaggggaaacacttgatggcttacagtcttaaccctctgcatcacagagtaaatcccttccctaagaaccactgcccaataaaatgctttttggcctttgactcaccctccaagtatgagtggtagggagataacaggagaagccttgagcttctcctagaggccaataccaccaagcactaccagcatctaagttacagggacacgctggattagcagcacgttgaagtctggctcctaatctt

SEQ ID NO: 205078 - DNA, 553 bp, Homo sapiens
gatcctttcctggttgtctaactcctggggtcaagtaatcctccgcttagcctcccaagtagctggggctacaggcacacatcaccacacccggctaattttttttttaagagatgatgtctcgctctgttgcccaggctggtctcgagctcctggcctcaagttatcctctcaccttggcctcccaaagtgctgggattacaggcatgaaccactgcatccagtcttagttgttgagttttaggaggtgtctgcatatcctggatattaatcccttaccgatatactatttacaaatattttcacccattctgtggtttgcctttttattccattgattctgtccaaaacttctctttactcatagagcaaaggttgtatatctctaaaccaagcttcttcccttgcttctctctgtggaaacaacagggtattatccttccactcctgtacccagagaactcctattcactcttgaaaacccacctcaacagtcatcaactcagggaagccttatttgtcaggcccctcctcccccaaaactaagtaaata

SEQ ID NO: 205079 - DNA, 462 bp, Homo sapiens
tagaggatccccaccccaaatgaatcctcatcatgcttgactgaaacttgatgcccattggtaagtaattccccattttgcccttcttccaggctgtagccaccaccctttcactctgattttctatcaatttgactatttttgttactttacgtaagtggaatcatctagtatttgttttcctgtgactagtgtttttcatttaccataatgtcctcagggttcatctatgttgtctcattgcagaacttccttctttttggggggctgaaaaatattccatcatatgcataaacacattttccttatccatttgttcgtcagtggacacctagattgcttccacgtttagctgttgtgaagagtgctgcaatgaacatggaactgctaacatttcttcaggatgttaatttcaattcttttgggtaaatacccagaggtgagggtgctgaatcatatggt

SEQ ID NO: 205080 - DNA, 479 bp, Homo sapiens
gtaaagtcagagaaacaagaagaataagaataaaggcaggaccaaggcaagttaatacctgaaggaaaggaattcccaggggaagcactgatgctgcggaaaaatgactccttccaagtgacggagacaacatattgcaaattattacatgcaggacaggacgctgtggtttcaggaacaagagcatgttctcatctcctgggcctgatgaagctgacaaatacaatcaaagcctttctcagtgaattctcaagagggaagtgttcagaaggtgttgctgtcttacaagtgaggctaacttgagaacccccaaccatttccttgcacccagcacagacatgtgaactcctggtatggagggcccttctctaggtccttgtctgttctgcccaacagtcctatgcggtgaatgcacacttaccctcgagggaaccaggagtgaactaacatgctggtgtcaacgagacatcagagcacat

SEQ ID NO: 205081 - DNA, 411 bp, Homo sapiens
gtgtgtgtcagcattgtggacctttatataaataataattttccagtgggaactgtgatctcttcttgtctcttctatttttaaatgctaattacttctgattttgtttacgtaggcggagctaataagaacatttgcttcataaccattgaacctaatgtatctgtttttggacactggtgatttatttttgcacacatgctccaaattggtgctaattactttaaaggatcagagtttctattccaagagggatgacgacagaatgtcaatttggagtctctgagcataatgtcccaattatcaatgcattccagaccagaatggacttggcaccttcttgaagggatttggcttcacttttatcagccagtccctggttgtagcttcattaaaacttgctttctagta

SEQ ID NO: 205082 - DNA, 381 bp, Homo sapiens
cccattcatggggggctaagttctttggatttgtaataagctttgtcttttgcagaagcccatgatgtaatgatgatttgggaatcttgggttggctatctgaaaggaaaattctcagaaagcagaataagaaccagctatcaggctcaatttagatttttgaatttctgaattaacatactagtgcatgtgtgcactcgtgtgagttcatgtgcacctgggggtgtcatcgctgtatctctaatggtaaaggtaaagaatggaaccagagcagagccagtgaaatgccagcaggtcaggattttgccccatggaaggaccaagtagcttgtaccttacccctgtgttcccatgtgcaatattatggcacttcgtgggcag

SEQ ID NO: 205083 - DNA, 486 bp, Homo sapiens
tctgaatgtctgtgtgtatattcacttgcctcaatctctatcttgggcttcagttcccaactaactttagaatagtctttacttgcaagactcaaataaaaacactatggtatcaaagcgggaatgtggtgcaaaaagggcctgctaaatagtaacaatcatggctgggcacggtggctcatgcctgtaatcccagcactttgggaggtcaagtagatcacctgaggtcaggagttcaagaccagcctggccaacacatggtgaaaccctgtatctactaaaaatacaaaaagtagacaggcgcggtggcaggcacctgtaatcccagttacttgggagactgaggcaggagaatcgcttgaactcaggaggcataggttgcagtgagctgagattgcaccattgcactccagccggggtgacaagagtgaaactctgtctcaaaaaaaaaaaaaaaaaaaagtaacaatcactaccactactatt

SEQ ID NO: 205084 - DNA, 455 bp, Homo sapiens
  misc_feature (3)..(3): n is a, c, g, or t
tanggctgttttggagttagagaagagaattgaagaatcttctgaaacttgttagaagaagtctgatattgtgcttctggtaggccaaaaacaggcacttgaagaactgaaattgtcagtccagcagctgagatgcactgaagcaaagttttcagcacagaaggaattactagagcaaaaagtgcaagaaaatggtgggaaagagccacctccagtagtaaattatgaagaagatgcacgatcagttacatctatggtagatatagaagagtgcacttttgcgaaagtgcactccttctatatctacccttaaacacagtagaggagatcagggttaggttacttgagagatttagcaaagacccctaggtagggggcacagcttcaagtaccatttactcactctgcaacctctattccttcttattggctactatgaactaatgacactatga

SEQ ID NO: 205085 - DNA, 399 bp, Homo sapiens
ctatctccctgggagctgagcacattttcaagcaaggttttgtccctttgggcccagttcacccttccttctgacccagggcccaattcatcaggaactttaattctcaaactgtgatccaatacagttctgtccttcttttcctcattacccttcagaacacctgagatggactgagattttttttttttttttttaaaaaagagtttcacaggccaggtgcagtggctcacgcctgtaatcccagcactttgggaggccaaggcgagtggatcacgaggacaggagttcaacaccagcctagccaacagagtgaaaccccatctctactaaaaatacaaaaactagccgggcaagtgcctgtagtcccagctactcggggaggctgcggcaggagaa

SEQ ID NO: 205086 - DNA, 444 bp, Homo sapiens
aatacttttattttcagtaagaaagtatttttaaatgggtactaacctatttaagactggttaatgttaattggtaaaagaaaggatccatttagatttatcagttcatggtctataatattatgtagcatgggtcccatggatcccagacaccagcacttcatacaggactacttctggtgatcctgggaccacagtgggacatgctggtttaggcatagtggtacacttctgtagaaaggcttcaaaggacatgtcgagcaaaactgatactgtgagcctgatagtttgagcatgggaccaacaacgtcggtcccatcccaagtctgacacacctggaagtattgaatgttgtattttgattgtggatgacttgtttatttggttatatcttttgaacgcctcaggtgattctgtctgtctttggaggatgggccctacgtt

SEQ ID NO: 205087 - DNA, 717 bp, Homo sapiens
atgtagatgtaaggcccaaaactagtcggagcagaagtgccgacagaaaagacggttatgtgtggagtggaaagaagttatcttggtcaaaaaagagtgagagttattcagatgctgagacagtgaatggtatagagaaaaccgaagtgtctttaaggaaccaagaaaggaagcacagctgttcatccattgagttggacttagatcattcctgtgggcatcgatttttaggccgatctcttaaacagaaactgcaagatgccgtggggcagtgttttccaataaagaattgtagtagtcggcactcttcagggcttccgtctaaaaggaaaattcatatcagtgaactcatgttagataagtgtcctttcccacctcgatcagatttagcctttaggtggcattttattaaacgacacactgctcctataaattccaaatcagatgaatgggtaagcacagacttgtctcagactgaattgagggatggtcagctaaaacgaagaaatatggaagaaaatataaactgtttctcacataccaatgttcagccctgtgtcataaccaccgacaatgctttgtgtagagaaggtcctatgactggctctgtgatgaacctggtttcaaataacagtatagaagatagtgatatggattccgatgatgaaattctaacactttgcacaagttccagaaaaagaaacaaacccaaatggg

SEQ ID NO: 205088 - DNA, 637 bp, Homo sapiens
agatgacatctgggtggggacacagccaaaccatatcaggaaggaaagggagaaaacttttaagatgcatttgaagactgagacacgcagttacagatgtgtgtaaatggatgttcacagttgcattgttgataatagcaaactttgcatttatcagttggattgacaaaatatttgatgacttatccattcagtggaatacagagtgaaatgagaggaggtacatttataattattgacgttggtagttactgagaatatgtttaggaaagtgggcagagacaggattttgtatgagtgtgtatatatgtgtatgtgatatgcgtatatatgtacacatatgatcttgttactttaagggggctcgtgtagtaatttttaacatttttgtaatgttttttaaagttctaaaacttttattttgaattaattctaaacattaagaaaagatgcaagaataatacaaaagaatcccacatattcttggggtctctaatgtgattgcagttagacctgttcatttccacatctactgcctgaactgagagaatgacacagctttggtttctcagacatgtctttctatctctctgtgacctcttcagcatggtgacttcacagaaactggacattacat

SEQ ID NO: 205089 - DNA, 1406 bp, Homo sapiens
gtgacccggaggcgctggggctgtcctgggtcgtcacatgcgagaaatcgtctcaccccagccagtgtgacggagtgagagcaaaagaaagttttgatagcagcgtacgatttatattcagctgtatgctgggcaggtccaacttggcatttcttggctgtatctctgaaggaaagtcatcttaatctctatgagcctccatttcctcagctgtaaaatgggaagatcttcctcacactgctgtggcccagaaccatatcctgctccacaagcctcgtccttggcaagaagttgcacctgcccagagagaaaaccttttgaaactggcacaaaggcactggagagactggcagggccccctacttgacgatctggctcatccatctgcacactgaccacgctaagagctgtctgcagtgatggaaaccttctctagctgtgctgtcctctatagtggcaccagctgcctgtggctactgagcacttcaactgtggctgcagagactatgttaaattgtatttaatcataattaatttaattgtaaacaactacatgtggctagtggtttctgtactgggcactgcaggtgcacatttcctgctggccatggacagtaagctccataagagactaattgtgcctggtttgcttataggcttatcctcagcacctgcaccagcctagaatatgattggcactctattaattaaaagttcccaggtaaatgaattagtggattctctgtttcctccactatgccacaacctccttaagggcagagatggtgtcttcaaaaaaaaaaaattctggtcaaaaacacataagatctaccaccttcaccattgttgtgtccagttcagtagtattaactacacttacattgtgatacaacaaaagattgtgtctttttacattcttaggacccagcacagtgtctggcacataatcttagtaaacactggcagagcacatgcctttgccaaggccagaacagaggttcagtgccatccattaccaccctttcacacatccactggggctttaaaaacaacctggaatgaaagctgttgagtctagagaaatgggctacaaagaaggtttacaagataatctattaagaatagggaatacaggccgggcacggtggctcacacctgtaatcccagcactttgggaggctgaggtgggtggatcatttgaggtcaggagttcgagaccagcctggccaatgtggtgaaatcctgtctctaccaaaaattatccaggcatggtggtgcgtgcctgtagtcccagctacttgggaggctgaggcatgagcatcgcttgaacccgggaggcagaggttgcagtgagccgagatcgcgccactacaccccagcctgggtgacagagcaagactccgtct

SEQ ID NO: 205090 - DNA, 904 bp, Homo sapiens
cgtcgacggtacccaacaggcttcagtcttggctcccacacagcttgatgctcctttcggggtataactgatgccaaccacccagggccactgccaggagtccactgtgtactcagactgtgcttggcccattcgcagcagtgccacagggccacaggcgcagagctctggctgggagtcactgccaatttacagtttgccctcaggtgtgtggaggcaaagccctatgaaagattagctttgcgctccggaggagagggcgcatggcaggtgatctgcccaccatggcttatttgtggcttcatcactgtgatgacactatgtttggcatttactcattattgttatccagaccccacgttatcaagaaaagtacaggaaatctgccgttgggaaagcggcagcacccatgtggagtgccactttctgatctgggacttaaacaacattgctgttttcctccttgctccaagtcatccattttgacaattttatatcagcatggacccttcaccaagactgaaataactctgttattgaggtgggaatctttctattaatgcatttatttagtatttcattccacagacatttagtgagtgcctgctgtgtgtcatccattgtgacagtgttgggaacacggagatgaataaaacaaggcccctgtcctgggagagccgagaggccacctgtcagctgacatcttagggaggacaccatctacatccaaccctgactactgaacacttccagtttcttggaagaaagattttaaaatcttcagaaatgagaactcctccaaataggattttcatttgtttcatatattttaaaattttatattttaatatgtaacagtcatatggtttaaatataaaaatgacatcagtggctcagtaagaag

SEQ ID NO: 205091 - DNA, 561 bp, Homo sapiens
gtgacccggaggcgctggggctgtcctgggtcgtcacatgcgagaaatcgtctcaccccagccagtgtgacggagtgagagcaaaagaaagttttgatagcagcgtacgatttatattcagctgtatgctgggcaggtccaacttggcatttcttggctgtatctctgaaggaaagtcatcttaatctctatgagcctccatttcctcagctgtaaaatgggaagatcttcctcacactgctgtgacatttagtgagtgcctgctgtgtgtcatccattgtgacagtgttgggaacacggagatgaataaaacaaggcccctgtcctgggagagccgagaggccacctgtcagctgacatcttagggaggacaccatctacatccaaccctgactactgaacacttccagtttcttggaagaaagattttaaaatcttcagaaatgagaactcctccaaataggattttcatttgtttcatatattttaaaattttatattttaatatgtaacagtcatatggtttaaatataaaaatgacatcagtggctcagtaagaag

SEQ ID NO: 205092 - DNA, 300 bp, Homo sapiens
gtgacccggaggcgctggggctgtcctgggtcgtcacatgcgagaaatcgtctcaccccagccagtgtgacggagtgagagcaaaagaaagttttgatagcagcgtacgatttatattcagctgtatgctgggcaggtccaacttggcatttcttggctgtatctctgaaggaaagtcatcttaatctctatgagcctccatttcctcagctgtaaaatgggaagatcttcctcacactgctgtgtgagttcagtgtgacaatgtgaatataaaagcttatacgtgagaaagcatggcag

SEQ ID NO: 205093 - DNA, 1379 bp, Homo sapiens
gtgacccggaggcgctggggctgtcctgggtcgtcacatgcgagaaatcgtctcaccccagccagtgtgacggagtgagagcaaaagaaagttttgatagcagcgtacgatttatattcagctgtatgctgggcaggtccaacttggcatttcttggctgtatctctgaaggaaagtcatcttaatctctatgagcctccatttcctcagctgtaaaatgggaagatcttcctcacactgctgtggcccagaaccatatcctgctccacaagcctcgtccttggcaagaagttgcacctgcccagagagaaaaccttttgaaactggcacaaaggcactggagagactggcagggccccctacttgacgatctggctcatccatctgcagtgatggaaaccttctctagctgtgctgtcctctatagtggcaccagctgcctgtggctactgagcacttcaactgtggctgcagagactatgttaaattgtatttaatcataattaatttaattgtaaacaactacatgtggctagtggtttctgtactgggcactgcaggtgcacatttcctgctggccatggacagtaagctccataagagactaattgtgcctggtttgcttataggcttatcctcagcacctgcaccagcctagaatatgattggcactctattaattaaaagttcccaggtaaatgaattagtggattctctgtttcctccactatgccacaacctccttaagggcagagatggtgtcttcaaaaaaaaaaaattctggtcaaaaacacataagatctaccaccttcaccattgttgtgtccagttcagtagtattaactacacttacattgtgatacaacaaaagattgtgtctttttacattcttaggacccagcacagtgtctggcacataatcttagtaaacactggcagagcacatgcctttgccaaggccagaacagaggttcagtgccatccattaccaccctttcacacatccactggggctttaaaaacaacctggaatgaaagctgttgagtctagagaaatgggctacaaagaaggtttacaagataatctattaagaatagggaatacaggccgggcacggtggctcacacctgtaatcccagcactttgggaggctgaggtgggtggatcatttgaggtcaggagttcgagaccagcctggccaatgtggtgaaatcctgtctctaccaaaaattatccaggcatggtggtgcgtgcctgtagtcccagctacttgggaggctgaggcatgagcatcgcttgaacccgggaggcagaggttgcagtgagccgagatcgcgccactacaccccagcctgggtgacagagcaagactccgtct

SEQ ID NO: 205094 - DNA, 300 bp, Homo sapiens
gtgacccggaggcgctggggctgtcctgggtcgtcacatgcgagaaatcgtctcaccccagccagtgtgacggagtgagagcaaaagaaagttttgatagcagcgtacgatttatattcagctgtatgctgggcaggtccaacttggcatttcttggctgtatctctgaaggaaagtcatcttaatctctatgagcctccatttcctcagctgtaaaatgggaagatcttcctcacactgctgtggaaatggcagcctaaccccaggcagcaatgtgctattgaaacttctaaaactagg

SEQ ID NO: 205095 - DNA, 702 bp, Homo sapiens
cataccaaaaaccaaagtaataaatgtggcaatggcctggacagacagattacaaagatgatagccatgattcacatgcataacgtttcctggttcctcaagttatagtttatgttcaatacataaacttctggcatatgaaacaaacattctatctttagttatttgtttaaatggaactttgcatttctattcaaaaaccaattttaactgttttgaatagataacataaaaatagagacaggatcattgccacataggtgggagtggttataactgtgatacaacaaaactgcctcagatataaaacatttgaatcttttgatctctaccatctatgatcgggcttctagtataattcacatggaaagaatttaaaggatggaatatactattaaagcaaattcccttaagtttttcatattatttaatttcatcaaatgcattaatcacctctaaaccattccctccaggaagtgttgaaatactcagcatttagtgcctttattttatcctaattttctgcaacaatattcaaccaagcatgccattcatcctttactaagtgcctgtctttgtgcaaagattccacaaagacacacagataacaaaacaaaatccaccttcaacagaattaagtctagcttgaaagagaactgtataaagaactaactgctaccagtattactgaacattattctg

SEQ ID NO: 205096 - DNA, 521 bp, Homo sapiens
gtaggattccatttacattatacagaaaaattccagctaataactgcagaagtaatgataaaaatagaaaatcattgttctacaacttttcttcttcttctttttttttttctgagacagagtctccctctgtcacccagactggagttgcagtgagccaagactgcaccagtgcactccagcctgggcgagagagcaaaactctgcctcaaaaataaaaataaaaataaaataaagatgtgctgttaattacattaggcatagtaatgacattgtgttatgtaaaaatactctttttttgagatgtataactaaaggacttcacggataatagtgaaatgatttactttgtaatacctaagcaaaacaaaaaggttgtgggggaagatagagacatataccaacaaacagatgaatggatgaaacaagtctggcaatgtattaatgactattggaacaggtagtacgtatcactgtactctctatttttgtgcacatttggaaaagtaaaaacagtaaaa

SEQ ID NO: 205097 - DNA, 846 bp, Homo sapiens
gactctcaaaagtgctgggattacaggtgtgagccaccacgcctggcctaaattagtaattttcaagagttgtatttcaatttgatttcagggtcgttaggtaccacggaccctactggattgaacaaaggaggacgaatgcgggaataaagacaaaggcaaaagaatatgtttggaacaaggggtcagggggcttcttgcttgtagtgaacgtgggccccgagcttctagcacccttcatgtttactgagtaaaggggatagagagaagcgggtggttgtaggtcagctacttgatttagagcaggcctgcatgactgcatttttcaaacaataggctccagatgtcccagtagataacctcaagcagcacagcaccagggagtgattgtcctcagtataccttctggcagcagaagcagatgtgagtttgcccacattctgcattcatgataaacagttcactgtttatcatatagccttcagtggaaagctgagttggtcacaacctttgggccttgggctcccaacatctctccctttctgtttatgcattaattgaatgaatgtaaggccaggttgggcagctctcattttctgattggcggtccatctgattttacagactatgaacaaaaaacagagactaaacaacatcattccaataactatatatgagatgttaatatagtgctttagattggtccaaatattgaggctctctaggccttgcaggaattcactccagacttctaaggaaggctgaaactcttgagtttgcttatttaagtcaagaattttgttttgcagttcaccaatatcaaaggtcccgtggatgctcactttg

SEQ ID NO: 205098 - DNA, 523 bp, Homo sapiens
caagaactctcagagggctttctctttctccttggtcttcctaaactttgccctaattaatcgatatcactgcctctctcagaggtgactgtggctgtgatgacggacacggaggagacgaacaggagcagaacagtttcactgccacgtccatttccgtgacagcacctgtgattgatgttgcgtggacgtgccacacttgcacttggcaggctttcgaggctgctggccttgctgccatgaggactgtgtccaaaaccactcttggaaggaaccataaacggctcccaaacatgagaaagtatgctcagtctcacgcaagccagagaaacagaagtgaaaaccacttggatgcagcccttcccacctaccagcggcaaagttcaaaggttcgctgatacctgaggctgggagacctgggacagaggtaccatgtctatggcactagggggacgccatcttggcaaagattattgcagggaatgtggcagtatctatcaaaataaacaataagcatccgcga

SEQ ID NO: 205099 - DNA, 910 bp, Homo sapiens
gacaataaaaatttccaccaccacaccaacaaacaaacacaccactttgagagtgaactagactctcttcttgaaccaccgctccaggggctcctgcaaccaaaagaacacttgactgtggcatctttccagcctcctgttagcagctaggtaaggtgcccccatggcaaggagctgcgggcagcctcaagaaactgggtggcctcttaggacctgagggcagcctccaacaagcaagcagcaaacctctggggccttctgttctacaactgcaaggaaataaattctgccaacagcctgaatgagcacggaagtgaactctttctcagtcgagcctctgaatgagaacacagttcaactcatgccttgactgcagcttgtgagagtctgagaagaggaccagatggagtctcgctctgtcacccaggctggagtgcagtggtgcaatctcggctcactgcaatccccgcctcccaggttcaagcgattctcctgcctcagcctcccaagtagctgggattacagacagctggttccagaaggaccctctgaggctggtcttccgggtaggatgtgctgtgggagggttctgtttccgaggaggagaggcgcgacacagcgtgcaaggacctgcagcaccttccacgcagcaccccctgctcctcctcctcagcccctgccgggctctgactcctaagtcaggcaggagcttcttcaggcccctggctgaggaagagccacagccaccctaaaatggcttcgggggcatgcagccctccatctccagcagctctggccatccctcgtatttgtttgtgtctgggctgttctttaagaactagagagagagaagacagagaaatataggcagtgagtgaggctgttcagaactcatgcccacatggacact

SEQ ID NO: 205100 - DNA, 629 bp, Homo sapiens
gacaataaaaatttccaccaccacaccaacaaacaaacacaccactttgagagtgaactagactctcttcttgaaccaccgctccaggggctcctgcaaccaaaagaacacttgactgtggcatctttccagcctcctgttagcagctaggtaaggtgcccccatggcaaggagctgcgggcagcctcaagaaactgggtggcctcttaggacctgagggcagcctccaacaagcaagcagcaaacctctggggccttctgttctacaactgcaaggaaataaattctgccaacagcctgaatgagcacggaagtgaactctttctcagtcgagcctctgaatgagaacacagttcaactcatgccttgactgcagcttgtgagagtctgagaagaggaccagcaatagaaaaccaaaccaacagactttgaagaatgaaagacttgggtgtgatttctgctctacttaccagttgtgtgaccttgcatgagtcacatcaccacactgagctccagttttctcatctacaaatgggtgcagacttgggagaattagagataataaatagaaagcacctaacatggggcctggcacagagtaggtgctcaataaatagtagttaagagtt

SEQ ID NO: 205101 - DNA, 326 bp, Homo sapiens
ggcctcttaggacctgagggcagcctccaacaagcaagcagcaaacctctggggccttctgttctacaactgcaaggaaataaattctgccaacagcctgaatgagcacggaagtgaactctttctcagtcgagcctctgaatgagaacacagttcaactcatgccttgactgcagcttgtgagagtctgagaagaggaccaggtaagcggtgcccagactcctgccaagggaaactgtgatatgtgtgtggttttcagccactgattttgtggtcacttgttacgcagcaatagaaaaccaaaccaacagactttgaagaatgaa

SEQ ID NO: 205102 - DNA, 365 bp, Homo sapiens
cagctctccaagcacatgcagagagcacgccagctaacgctctccttcccaccccttagtctgcaggagaaacatattcacagaaagtttagttcttaattctgtaaagtttgaggttctgctctcaatagttctaggagagggagtgaggaccatccctgccagaaagtctgaataggctgttctcaaaagagtgtggcttctggagaccatgaccttctctgcagatgctgagaggcatcaatttgcatcattttagcatgtgagcctagagaagaaccttcccagaggatgcacagcccaggcgtcagtgacgcaagactacaaatgcagagtgtgctgctctctcgctttccttctatata

SEQ ID NO: 205103 - DNA, 275 bp, Homo sapiens
tttaaatcacatactaaatgtgtcatttagaacatatgcttcaagaggtcagggtttatgcttcctttactgctatactgctgacctggaacaacatccagcacacagtagtaatcaatgtgtttttgaatgaatgagtggacaccttacccaggataataattcatgcttattgataaaggcagacaaaccagggttataagttagaacccagaggaagcctaggggtgggaggattcagggtatcacaactgtatctgagaatgaggaggttg

SEQ ID NO: 205104 - DNA, 294 bp, Homo sapiens
gcaatccccgaattcgacccacgcgtcctgagactaaaaacctacttcacaaatagaagatgggattaattggaatccacaagtttattatggacaaagctgataaactggtaccttagcaatccatgtagaaccatcatttaatcagtgtaacatctctgtgtaaaaagccttggttatgctaagattcaagaacaatcctgctgtttaaatcattattaagagaactgttttgttttgcatttcctgttttgttttaaaaggatttgtggtaactaaagaggatccagtcaa

SEQ ID NO: 205105 - DNA, 498 bp, Homo sapiens
atgcagatttccataaaaacccttacggggaagaccatcaccctcaaggttgaacccttggatatgatagaaaatgtaaaggccaagatccaggataaggaaggaattcctcctgatcagcaaagactgatctttgctggcaagcaactggaagatggatgtactgtctgactacaacattcaaaaggagcttactcttcatcttgtgttgagacttcgtggtggtgctaagaaaaggaaggagtcttaccccactcccaagaagaataagcgcaagagaaagaaggggaagctggctgtcctgaagtattagaaggtggatgagaatgacaaaatgagctgccttcgtcgagagtgcccttctgatgaatgtggtgctggagtgtttatggcaagtcactttgacagacattattgtggcaaatgttgtctgactactgcttcaacaaaccagaagacaagtaactgcgtatgagttaataaaagacatgaacttaa

SEQ ID NO: 205106 - DNA, 574 bp, Homo sapiens
attcagactgcagcttcctggttttagacatccccactggcaattgggacatctattttggagatgtaattgaaaagactgaagaatgtactgaggaccttctggctgatagaagctgacaaagaagccaagattggtgaagatttctgcaatacctgagtttctaatcacaacaacaaaaatgacctggatagaaaaccttggagatagtaattgatgggcatcacgtagctggttgctggagaaacactgaagcagaacttgtaatatcttcaaaacaagtgaaggccaggaatcagaaatgcttctgaaggtcagctgcctctccagccatctatgaagagctatggttctgaatcctggctaatatcagaatcatcctgggagcttttgaaaatcctgatgctcaagtcacactccatactcagacaagaagctgagtctcagagagagaaaatgactcatccaagcaaggtttgagacctaagaaaggttgtgtaagcagaagctggaagacccttgaaaagagcattcattcaagaaatgaagcatgagataggatggaaggagggaa

SEQ ID NO: 205107 - DNA, 230 bp, Homo sapiens
agattgttacctatcagtagttctcatctcacattgatgagaaggaaaagtcatttccaaggtaacccagactaacatatttgaactctttctcttttcaatatttttcctaaagaatattgtgatgttgatgtttctcttgagtattaaaaataagaataatgtgtttttatggaaccatattgctttatactgatacatcacttaataaacataaattacctcctaga

SEQ ID NO: 205108 - DNA, 526 bp, Homo sapiens
attggcgacatttcaacttttaaccacttcacctatcttctatttatcaaaatctatgagtaagcattatgtgttacaataaataagactcagcaaagctctgagtgaagtcccaaagagtgaggtgcaattctgaagtgcatatgatttgtgacagttatatgtgaacttcagagaataattttacaaacgttctggtggactaaagctgtaactaccaagaggtacaggctgtgccttaatcatctttgaatttcctctaattctgtgatggggtcttacaacaggaattaaaatatttgtagaaatggtcgccaatccgttggcgtaccattacaacatccttaataatgactggatcaagcaaattaagaaaaccaagccacggccggacgcagtggctcacacttgtaatcccagcactttgggaggctgaggcaggggaatcgcttgaaagcgggaagtggagcttgcagtgacccaagattgcaccactgcactccagcctaggcgacagagtgagact

SEQ ID NO: 205109 - DNA, 480 bp, Homo sapiens
cttaaatacactcttgatgaacatagttgcaattgtttagttcttttatgtggttctggccatattagtccaaagattttagccacattaatgcaataagattgaatttaagaaatagtgtatagcatgccatcataacaaagtgataaagaagtgagctaagccaggtgcggcagctcacgcctgtattcctggcactttgggaggctgagtcaggcagatcccttgagcccaggagctcgagaccagtctgggcaacatggtgaaaacctgtctctacaaaaaacaaacaaacaaacaaacaaaaacaccaaaattatctgggcatggtggcggcatgtgcttgtagtcccagctactcaggaggctgaggcgggaggattgcttgagcctgggaggtcaggctgcagtgagccatgattgtgccactgtactctagcctgggcgacagagcgagaccccatctcaaaaaaaaaaaaa

SEQ ID NO: 205110 - DNA, 296 bp, Homo sapiens
ttcaatcaataaaataaaaaataaaattgagggcttcaacaacagactagataaagcagtaaaaagaatatgtggacttgaatataggtcttttgaaattatccagtcagaggggaaaaaaagaataaaaaagaatgaagagagcctatgggacattaagtgaagaagtatttatactatggtatttctagaaggagaagagacagagaacgagacacaagcttatttaatgaaataattgctggaaatgtctcaagtcttgggaaagatatagacatccaaatccatgaagcttt

SEQ ID NO: 205111 - DNA, 259 bp, Homo sapiens
tctcaagtagctatgattacaggcgtgcgccaccagcccagctaatttttgtatttttagtagagatggggtttcgccctgttgagcaggctggtctggaacccctgagctcatgcaatctgcctgcctcggcctcccaaagtgctgggattacagccactgtgcctggccaagtaaattttaaactcattttttgaataaggaacctgaggcagagagaaatgaatacaccttatatcaacttcctctttgggaaagg

SEQ ID NO: 205112 - DNA, 595 bp, Homo sapiens
aagaaaaaaaaaagaaatatacttcagttcatctaaaatataggtagagtaaaaatcagaagcaactagtcttagatgtttcttagatttcagtagagaccttctcttctttgtctctaccatttctccaggatctagcagtattaggggcttaatataaatgtttgttgagtgaatacatatttgtaattacagagttaataaacgagaggggcagaatataattaaaggctaggacatattggccatttactctactaataaaagagtactatctactcagtgtcatttactgttactgtagtaattaatgcctttggaagaatcttttgaaatagttctcaaattggtaccactacttggtttggaattatttttttttcttttcataatcaatggttatataaatgtatattgtcctagtcagtattttatatatgctaaggactcactagctggcttggcactaatacctcaataaaaggaatacttcttttggaatcatgaaacaaaagtgaataaacctccaagttatttttccaaccaaccttctttgaaaaatcttggatgagtcactcaaatcaagacatgttat

SEQ ID NO: 205113 - DNA, 387 bp, Homo sapiens
cattcattcatcaagtcagtctaaaaccctctggttcatccttggctcctctccatatcgtataacatgcatctggttcatcagaacatgccattgctttgccttcaaaatagacttagaaatgcattgcccacatcttcagctcatcgccttgtcccagtcaccctcctatctcttgccaggactattgtccttgcctcctaattgctctccccgcccctgccatcactttccccaccctgaggccccgccaggatgtccgcactatgagagctgggcctttgtccacttgactcatgcctgtgtcctggtgcctacaagactgttgtcagttgagtaggtattcaataaatgtattctttattgaatgaatgagtatcaaaaaaa

SEQ ID NO: 205114 - DNA, 155 bp, Homo sapiens
tagaactgccaaactcgaatggagcccaggtctcttttgctcccaagtttgtgttctctgcagtacaacatgctgcttctgccaataagtgattgttgggaagggaaattggcgtacctcggctgaaaaaggctttaatgtcgcccaagtccagg

SEQ ID NO: 205115 - DNA, 711 bp, Homo sapiens
gaataacaaaaaaatacactacactatcagaaaattccaagggttctagtggctctgtaacaggaaccagggacaaagaccaaataaatttactatactacaaataccctgtttaacattgtctagctttccaaaattatgaatgatgctgcaacacatctatgtatatacatttgtgtatatttctaataatttccttgaaataaatggctacaagagaatcagcgttaatgctgtcatgtccaatatggtacttactagccacatgtgacgattttaaaattatttatttattcattttgagacaaggtctcactctgttgcacaggctggagtgcaatggcccaatctcggctcactgcaacctcgacctcctgggttcaagcaattctcctgcctcatcctcctgagtagttgcgattacaggagcccgccaccaggcctggctaattttttaatttttggtagagatggggtttcactatgttggccaggctggtctcgggtcgaactcctgacctcaggtgatccacccacctcggcctcccaaagtgctgggattacaggtgtaagccaccatgcccagccgaaaattcattttctggaattaatgtcttttttttttttcattgggaatttcttagaatatcgggcttccagttcctctctctctttttaataaagacgcggggtctcgctctgtaacgcagg

SEQ ID NO: 205116 - DNA, 559 bp, Homo sapiens
gtttatttctgtatcctgaaggtattaggttggtgaaaaagtaattgcggttttgccattacttttaatgcaaaaactgcaattacttttgcaccaacccagtattttacttgtttttaaatgctactgtttaatttttttctttctttctttcttaattttttttccccccagacagggtctcactctgttgcccaggctggagtgcagtggtgcagtcttggctcactgcaacctctgcctcccaggctcaagcgatgctccctcttcagcctcccaagtagctgggaccacaggtgtgtgccaccatgcctggctaatttttttttttggtagaaacagggtttcaccgtgttgcccaggctgttcttgaactcctggcctcccaaagtgctgggattacaggtgtgagctgccatgcctgaccttaattttcttttattgggtaatatatgtaattttgtggtaatttattttaagacttttctatattatttatttatttacttattgagacagggcctcactctgttgcccaggcaggcatgcagtggtatcg

SEQ ID NO: 205117 - DNA, 308 bp, Homo sapiens
gttacagatagctcgatcaacaatagcttgtgcttacgtaattttgatagtgtatctttgagatagatttctgtacttggagttgctagggcaaaaggtaaatgtatatgtagctttgtaggtattgctgtatatttgaaattactctccgtataggggttgtgccattttatgacctcaccaacaatgtaatagtttccctgtagccttgattaaaaaggtataatgtcaaattattgggtatttgtcagtctgatgggtgagaaatggtatctcaatgtattttaatttgcctgtctttaatatga

SEQ ID NO: 205118 - DNA, 471 bp, Homo sapiens
tagaggttttctctatttctccttttcactgtgacccaggaaataattttcagaagtaaaaaaatctcatctgagactctgcaacaggcaccagagagtgaggaagaactttgagtaacagaaactgctccaatttctcatccgcatctcacatctctgtgtcaactatccttctatcccatttattctggtattagatatgttgtcagtgtctcttgttaggtagagaaatcagcagtcagatcttaagaccatttggtaggtgcatcaggaattgacacgcaggccagttttccagtcctacatgtattcttttctctgtatcctgcctctcttgctcttggcttcctgccttctctcctactcatttttagaacagtctagatgcaggcagctagaagagttatttcctccaagctgtctaggaaaagggacaattaaagagagattctgcacttattatgatataaa

SEQ ID NO: 205119 - DNA, 589 bp, Homo sapiens
cttgggttcacccacaagttggaggcggcaggactctaggggtttcagttgcccttcccagagtggcccaccaagccttacagtgaatacttgtgaactgtttttgtttctctgcctcttggggccatcagaagtccctttgtcctctttttatttcttctgatgtgttgaagacactgtacaggtcttaatctcaccagtagtttattacaacccacacatatttggtttatagggatgtgttttcccgctgctttattggagatgttgtctgggaggtcttgcttttgctatcttagttgctctgtttccatggggtgatttggagaggtggaaaaattatgccaccttgccaccactttcctaattactttaagcaaccaaaattttagcaacgaaacttttaaattactttaagcaaccaaacttttagtctatttctgttgtactttattagtaagcatctacctgcctgtctatgttaacacgttttctgatgcactatacagttgacctttgaagaacacaggtttgaacggcacaggtccatttacatgcagattttcttctgcctctccccggctgctgc

SEQ ID NO: 205120 - DNA, 420 bp, Homo sapiens
tattctctcctctttgtttctacacattttcttactcagctataatcccatttcaaatcattttagagccagtttacaacctatgctcaggagaaggctgacatagcattctacagaattaagttagcagtaaggtgataatacctggcatagtatggtggctgagaaaggaaaggatataagtcatttcaaagaattaggcctggttactgacaatagggcatgaacaaaagggatgaattcaggatggctttcagcctgcttggaagatgtgggtgacactggcagcgaggcagatcagtgttaggtctcagcttctcattcgagtggccctattaatctagggagtacactctagggaaggtggtatgtggtagaatagaggctttggaattggacaacataggctttagaattgga

SEQ ID NO: 205121 - DNA, 396 bp, Homo sapiens
tcaaaaaagaaaaaaaaacaccagaaaatccatttttcctgtctattcagcagtgtctagcaccagcattcacagatcaggaaaaagggagaaagagagagaaactaacagatcaagaaagacataacctggtattcttctgtttccaaaaaatgtaattccatcaaaagcaaatgaaaaaccttcaatcttctcattagatttttactatttgttccattctactcaatctatctttaaatacttctttaaagtattctgacatctgtattgttttaaaatgaaaaataggtttttatcacacttggccacttgccacagccctgcttcacggcagctatcagaattctggcagtgcaaaatacaggatacgtggggacgaatattactctagac

SEQ ID NO: 205122 - DNA, 422 bp, Homo sapiens
aacaaatggaaacacatcccatgctcatggatgggtagaatcaacattgtaaaaacgaccatactgccaaaagcaatctacaaattcaatgcaactcccatcaaaataccaccatcatttttcataaaactaaaaaaccaattctaaaattcacatggaaccaaaaaaagagcccacatagccaaagcaagactaagcaacaagagcaaatctggaggcatcactgattacctgatttcagactatactgtagggccatagtcaccaaaacagcatggtaatggtataaaaataggcacatagaccaatggaaaggaatagagagcccagaaataaactcaaatacttatagcttactgatctttgacaaagcaaacaaaaacctaaagtggggaatggacactctttcaacaactggtgct

SEQ ID NO: 205123 - DNA, 583 bp, Homo sapiens
tgttccgtatctctccattcccttccttaggctgggcgatcgctattaccattaccgctatactatgcttacacattcatatcttcatttatgtgggtcttcttgtttaaaaacacaaaggcatatctatacacattttcctgtgctttgctttctttcacttaatttatctcagagctggttccacattagtacataaactgcagctttgctctttttaacggtggcaggccattcctctgaaagatggcctgatttatttcaccagttcctggttttgcggctcaggatgggaaaaaggaagtctgagtgaatcgcgttgaggttactaggaattgccatgctgcccacctcccgaagtgttaggaggtaacatctcatcgtctcatcgcactccagtggagtgtcgcgaagttgcaactcggccccaaggcggcccgcacttccacccgcacacaaaggcaggtcgcagccccgcacgcggggacagggccagcaaggggcggggaccctcggggccgccgcctccgcagccccgcgtgtgggaccctggggcgggccgccatcttgtggtgcggccgcc

SEQ ID NO: 205124 - DNA, 563 bp, Homo sapiens
ctgactaaatttagcattgttatattgggtagcagagagctgaagcattcaaacgttttcttacagattctcaaaagagacgcatgatttgaagtctgtacatttgtgaacgagtgatcactattcataatcacctagcaactttgtataatttataaaagaaagaaaagagaattttaagaaaaaactaaagtgtatttttttgctaaattacatttaaaaagacattttatggattagtaaagcacattctttgtaatttaaaatctagaagtttgttctgccttgactaaaccgtcagtttcatttaataagggttttttttttttttctttcccctctaaccttagttactttatttggttggtagatatgtcttcctgtaaaggactccaatgcatatgtaagtaatacttacgttcaggttgttcctccctaccccggtcttataagaagaattgcaaaagtattagaactagaagggacaccatatacaactcagtctttctccagcctctttattttgtaaatgcaagaagagaggctgagagcgattatgattc

SEQ ID NO: 205125 - DNA, 469 bp, Homo sapiens
cccatggagccgaggcaggataatcagttgaacctgggaggtggaggctgcagtgagctgagatcatgccactgcactccggcctgggtgacagagtgagactctcaaaaaaaaaaaaaaagaagaagaaaaaattgttcaagcatacacaaaagtagaatagtatagtgtatgcatctatagcaattgtccatattaatcatctatccctctacttttttttctggaaagttttaaaggaaattccagacatactccatttcacccacttcagtatgcacctctaattgataaggatttttttcttttttaacataaccataatgccattataatacctaaaagatgtaacaatacttccttaatatggggtatttaaatgaagtagagagataccaatcggatttgacaaaatgttgatgatttgttaaatttacttccaatattattattattactggtagaagga

SEQ ID NO: 205126 - DNA, 269 bp, Homo sapiens
acttcaaaacccatctatgattttttaaataaatctcaaactaggaatagaaacaaagttatttaatttgatagagaatctaccaaaaagttacagagaatattactcttaatatttcacattaacaaaactctctttagatcaaaaacaagatgaccctttatcacttccatttaccaatgtactggaaggctgactcagggcggaaagcagaccaactggcaagtatgtccactccttactcatagacaatctgtctaccaagaaaa

SEQ ID NO: 205127 - DNA, 598 bp, Homo sapiens
ttcacaccctatagtcaatgagcaaaatatattgcagaaatgcactttcaaaaaattaaaacaggctgggcaacatagtgaaaacctgtctctcattaaaaaaaatttttttagctgggcctagtgatgtgcacttgcagtcccagctactcaggaatctgtggtgggaggaccacctgagcctggggaggtccagcctgcaatgagctgtgattatgccactgcactccaccctgggcagcagagtgagaccctggctcaaaaataaataaataaaaatctttaaaaagtgagcttaaaatatagccatcacctaggctggatgcagtggctcacgcctgtaatcccagcgctttgggaggccgaggcaggctgattatgaggtcaggagttcaagaccatcctggccaacatggtgaaaccctgtctctactaaaaatacagaaattagccaggtgtggtggtgcatgtctgtagtcccagctacttggggggctgaggcaggagaattgcctgaacctgggaggcagaggctgcagtgagctgagatcactccactgtactcttgtctgggcaacagagtgagaccctgtctggg

SEQ ID NO: 205128 - DNA, 469 bp, Homo sapiens
tcccctttctcttggcaagggtgctagggcatgggggagtagagggagatccagcaataaacaagaaccccccgactgccccagacaccagccaggaggagaaaaggatctggggtcctgcacccatcttggagtttgaggaatgcctcgggaatcttagcaggtgctataattctgaataaaagaagactttagttccctttctctgtgtcaggcccttgggtaggtcctctcacgtacagcatctcgttgaatcctgaaaacaataatgatgctatgataatgccctttttatagaacctcagtcagtgaggttaacttaccctgagtcacagccagtaaatgacaaatgacagaggtggcttcaggtcgggtctgtccacctccaaagcctatgttcttggcctatgccaggcaggggtttacaacctttaaggcaccactctcccttttaacagacataaaaata

SEQ ID NO: 205129 - DNA, 483 bp, Homo sapiens
gctacctagaggaccccaagcagttatacacactcacacatatacactgatagatacggaaatataggtgtgtattcatggataaatatacatacatatgtttcctagctctgtctactgagatggcctgtagcactgtagcactaaaagcactgacatcccagtagcagtgagcacatcaggttccccaatcttggtctctaaatgctattatttaataaaaggagccaggacttcttggaaacataggctccaggactgggtaggcaaactacaagatgagcctggagcatcttctggtgctagaaagtaagaaagtgctgaacaacaacaacaacaatgggaatatgcagagtacaggaaccaacctgaaaaagctcttattggccaaagctggaacaatttaggtcaaaaaaataagtaaggatatattgggttataactgaaggaataaaataactatccatgagtctgttttgataa

SEQ ID NO: 205130 - DNA, 696 bp, Homo sapiens
tgccattgctgccctggacttaccttccaaagaaatgttatcactttaatatcagacactggctctagttctagacctccaaagctaagatattcattcagtggtataatttatttttcactcacttttctgtgattttataatatggcaattaaaatgttcatttagaaaggatattaaaaatattatataaaaatcacattttagtaaggtaattcataactaactcaatttttaaaattgaaatgcattttttacataataaccagctagaaatatcagaatacaaatatatcattcacaatcgagaaaatatatacaaatatccaaaagtcttttatatgctgttttgaaggtattgtagtgggtgccatgtgattttgatgttccaccttatctccatgtttttagtctgatatagctgcatcaaggctatatatagcgatatttcccctgcaagtatggaataaccacacttttactctgaaaaatgcttcttcttagataattctgtcatctcaaccagaaaccagaataggcaaattcatgcaactgtagattttgtgatgcttcattttcactggttcaccaccccaagacatgtaatttattactctattcactaactcatttgttcttcaaaatatttttggctatctattttttatgtgatcttttaggtcctggcagtcaaca

SEQ ID NO: 205131 - DNA, 552 bp, Homo sapiens
tttcttggttttaacctcctcctggcagttctgtgccttctcatttaccccaccagagttgttcttgctagacttttactctggtatcagagtctatttagccaagagactcactgggtattagctaattggcccatggaggagcttccatagtttccctgtccccactcaacatcaactgcagaaattgattcataggggccgtggtcccctatttgttagcaatacatggatgtttatctgttgaagaagacattgtggtacattggaaagggattggaataggagcaaataagccccagctccagtcagcagttttactgtgctatgtggataatcattttgctttgccaaactcacagacatgttatgtgactagaatatgatatcttgtgtaagagtactttcaaaattatacttacgtggaaatgagaactgatattaatacgtaatatatctgtgaaacattttatgagatttttcatgtcatttctctttgaaacagatgagtatcattagaatttttttgcaatttctgaaaggcagacctct

SEQ ID NO: 205132 - DNA, 570 bp, Homo sapiens
gttaataagctttatttcagagtagctaaataaggacaataattttttgaataaaagaaaggaagtaatactagtctatattttaaaatttctcagcaattttaatattaactttaaaaccagataacaagtttaataacaaagggataaagcagtcacacagaaaataatggttataaacaagaaaaacataacaaaataataacttattttatgttatcctcttctgctgctcagtaataaatgtcataggtagaatactggagcaaatatgtaatacagattataacaaaaatatctgtgggttttagggaacaaaaatcccatagaaactgttacatggaggagggttatgagaataagaacaggccatgtgatgagataacctcaagataggaaggcacgagcactgatgatagtggagtacaaggacgtcaaacagaaatgctgcttcttggattggggtaccactcaatgcagtaaattacacctgttattttctttcttttctttgtttcttttcttttcttttttttttctttttgagatggtgtttcactcttgttgccc

SEQ ID NO: 205133 - DNA, 265 bp, Homo sapiens
agttgtaaatatagaaatgtactggaggaaagatttctaagccaggaatttagactggaaaagacatcagaatgtaaatggagattgaagccttgaggaaagagtgggatcacccaaggggaatttcaagtcagaagaaaagagggcctcagagtagtccctgggaaaagactacatttgagaagccagcagagaataagaagtctgaggaggcagctatggagaacgtaggcctgtggatccctccaagtaataagcttgtttt

SEQ ID NO: 205134 - DNA, 346 bp, Homo sapiens
ggagagaaaaaagccaaagggtgggaactggaaggaggggaagaatatgatgacattgttactttctgccaggagacatcccttcttctcagtgcctctggccaaggaggttccaatcatatgcccttccaagctagtaagctcctctaccctatcagccacagggtgcatggcagggtaatgtatgatgctgctctgccctgcagactagaccttctggtctcacaatcccatagcccatgcaagaaggagagggaaagctgctttggtaccaagttgcagagtggcgaaaattgaaacagacttaagtggaaaaaaacgtttttgccagctcctctattggcct

SEQ ID NO: 205135 - DNA, 198 bp, Homo sapiens
ccacattgccaagtcaatcctaagccaaaagagcaaagctggaggcatcacgctacctgacttcaaactatactacaaggctacagtaaccaaaacagcatggtactggtaccaaaacagagatatagatcaatggaacagtataaaaaagttaataacaattgttggtggggatgtggagaaattggagcacgcatc

SEQ ID NO: 205136 - DNA, 350 bp, Homo sapiens
tttatcaaactctattctaacaaagtagtttatctttcacttcatttctagggttaaatgttacaggaaatgtttactttatcaaacacttaaatagagcttactataagcctcaccctcttctaattgctttacaaatactaatttctttagcaatctatctatgacaaacctatgaggtagctattacaggtacaaaacctgttttccaaaacccttagatcatgtatgtttcagaatgtaggcatttttgtacttttgaaaagtaaaacagcatattctagaacttggcccagtgggctagggtagcctgccaccaagatagctggactataaaatggaagaatatt

SEQ ID NO: 205137 - DNA, 470 bp, Homo sapiens
gcaataagtcagttaataatttgttccaccttctgctgaagtgtttctcacttcgtcaccacatattcactgccaatctggtttcctcagagtcctcctaaaattcatctctaggcaagttgcaattcattctttttcaaaccaaaaattattagacccaaagctaaacagcaccttgtctcaacacataaaacaaactttaaaacaaaaaaaaagtcttcctggcattttccctcattatctaatatccaagtgacctgcatatttctgattgctctctttctcccctcccatttttccctcttaagccttgccactgaaagatgatacatcagtttttcagaaaattagcagcaacagcaacatgtccctttattgtaagttgctttagttttgtttgagttttaagataaagcctaattccggggaatattttctttcctgtgttgttttacattaattaagaaaaa

SEQ ID NO: 205138 - DNA, 340 bp, Homo sapiens
tttaacatcagaagattacaggataaaattatttgtcatgtagtgagccaggggtagaaatcctgttttaaaactgattttctgtggcttcagcaaatcatagaattgtcagagcaattacccaaagctccagtggaaaggaagagtcagtcttgtttgcatacttgcctggcctagatcttttcatgatctttctgccaccatgttgctgaagaaatcttcactccctttgcctgtgtgtgtttgggatggaattactgaaatccttcctgaattctgcttacgtgaaatgttactccatgtggttttaattccatgaagatatttcctccagtgtatg

SEQ ID NO: 205139 - DNA, 220 bp, Homo sapiens
cttaagcaatacttaataggaacatttatagcactaaacacccatattagaaaagacaagtgatctaaaatcaatgacctaggcttctaaactaagacaatagaaaaagcagcaaattaaatccgaagaagtagaagaaagaaaataaagttcaaaccagaaattaaaaacagaaaaacaacaacaaaaatcaatgaatccaaaagttgcttctaaaaga

SEQ ID NO: 205140 - DNA, 381 bp, Homo sapiens
acagggcacagctgtacagtaccaattgccctgtgtcctgtacaaattttcaacgatccaaacatctaggtgcaaaacctgtttgaaattctctgtgttggccaggcacggtggctcacacctgtaaacccagcactttgggaggccaaggcgggcagatcacctgaggttgagttcgagaccactctggccaacatagtgaaaccctgtctctactaaaaatacaaaaaaattagccaggcatggtagcgcgtgcatgtaatcccagctactcaggaggctgaggcaggagaatcgcttgaacccgaggcagaggttgcagtgagttgagatcgagccactgcactccagcctgggcaacaagagcgaagctctgtctca

SEQ ID NO: 205141 - DNA, 644 bp, Homo sapiens
ggaatgactgtaagaccttctgatctcccctggtattagaacagtggctcctggataccatgtgggtcaataatcctcacccaaccccagtctctgcttgctgaagttacccattcctcatcccagaactggagaaaaatatttcaacgggatctagaaaaactcctgtggtgcccttgtgccctgcagttgtttgtgcagtgtggcttgaggagttcccaggtggactgtttagctgtgtctttacttgaagggtactgaggatccaaaagtgtgtccatggacattgccttcttgttttcagccatttgttcctggacttaactatgggatatttttgccagaaggaagaaacaccttcctttcctctggcttatcacttaggaataacatggtaacttttgcataacagtaaaatatgttatatttgaaggcattcagctttgcaatccaattactctttatgcaaatgtgtaatttaaacatcttggccgggtacggtggctcacgcctgtaatcccagcactttgggaaactgacgcaggcagatcacctgaggtcaggagtttgagaccagcctgggcaacatggcgaaaccccgtctctactaaaaatacaaaaattagctgggcatggtggcccac

SEQ ID NO: 205142 - DNA, 333 bp, Homo sapiens
ttaacatagctaaaccaacttgattattctagagaagattattttattatccagacctattttttctccctcttctttctgtactttataaatgaaattatttgttatatataaatgtaaagcattatttatatatgtaaagcattattatttatatatgtaaagcattatttatataaagtgttagccacatgtgtaatttaaaattttctgctgtccttattacaaaaagtaagaagaaagaggaaagattacttttagaaatgttttatttaaacaaatatgtctaaaatattttaacatataatcaatatgaaagttactaatattatt

SEQ ID NO: 205143 - DNA, 312 bp, Homo sapiens
tttgaattataaatatacttatctaccattgtcatgttttttgttcttagttcatgtggtatatcaaaaatgttaaacatttacagataatatgttaattagttgtaacccattttctttaatccaatcaaatatttgtatagcatatatgcctctgttttaattaaactaattgtttatttaacatatactgttagttatatgacatatactcctttttaaatgttagaacaaaaacatctaaaagaagcctatgtttaactcagtttgtagaatccagtgtttgatataattttttaacaataaaataaa

SEQ ID NO: 205144 - DNA, 561 bp, Homo sapiens
cctagaattttctatactcacattcactcaatgatgattcatagaataaagatgttttcagacttgtacccttccttaggaagcagttgaagattggctaggaaaagtaacggctgagggggcggccaggataaaccaagaaagaagataacaagatcctgtaaacacccttctgccttcactagtccaaaaggatctctaattataactggaacaggtctctcttcgtttcccagctttaaagtcaggttggttgcaaattaactgtaagccaccaggtgcggtggctcacacgtgtaatcccagtaattttaggaggccaaggcaggtggatagcatgaggtcaggagttcaagaccagcctggccaacctggcaaaatcctgtctctactataatacaaaaaaaaattagctgggcatggtggcaggtgcctgtagtcccagatacttaggagactgaggcaggagaattgcttgaacccaggaggcggaggttgcagtgagccaggatcgccccactacactccagcctgggtaacagagcaagactccatctcaga

SEQ ID NO: 205145 - DNA, 117 bp, Homo sapiens
cgttcacctctgcactgtagggtggggctctaggccctgcttccctctccaacctctggagaggatgcagtgcatgactggatctgaaaacaaaatcctcaggcaaacagggaggcc

SEQ ID NO: 205146 - DNA, 335 bp, Homo sapiens
aaataaaatttgaacttgcaatattggtcaagtaaaaaataatccaaggtaaaaagtattaaattgagccacattagtgaaggggacaatcgattcgtagacatttttgaaattaaaatctgtgatatgaaaactgttggagatacaagaaaacagacacagaaatctactgaaagggttagactttaatgcacctctctcaagccggattggcaaaaattcaagtctggaatgaaggtaggaatatttgtacattactggacaagtattatgggacaattttggcagtgtcataaaattcaaactgtgcctatcgccacaaccctttgatacca

SEQ ID NO: 205147 - DNA, 353 bp, Homo sapiens
tgatatacacaagtttacaagccttttatttataaacttgtatataaataataaaagacttatttataagccttttaatagcaaagaagacgtaatctctttgaaataacatccctaatgacttctgaggctgagcccaagagctcagagcaatacttcgtcatctcttcctggatctgtgaattaattacagtgcagaaaatgcaggagagattgttttgttttatttctaatagagtcaatgtatgtttgcaatgtaagactctcttgttatttaaggaaataacatgaatgtcaggcaattgtgtataatgcattacacggtaatgtttaggcccttctcaccattcttc

SEQ ID NO: 205148 - DNA, 415 bp, Homo sapiens
cagcgctttgcgctcccctctccaaaccggaccttgggtttgctgtcctccgaccagctgaaacttgggtgagccccagggggtcacacaagcgagcccaggcgcataggccaacagcgccacgagctcagccaaagcttcgaagcccactcttaaccagcggggaccagaagtcagattctcattttagaggtagaagacaataaaatgagaagttttatccgatacaattgcataccaatatttgcatatctgaagggaattgggtaacaaaagtttagggaaggagaaggggggagctccatgatattatattaatttttgtattctctctcccccctccaaaaaattcccataactttggtcttttatctttgactttaataaaataatgattccttgagaaaatggggta

SEQ ID NO: 205149 - DNA, 407 bp, Homo sapiens
gggtttagtattccattaaggttgggaaatgctttactacaggacttcagagcctttagtggactgatgtgtgttgtaacactcaaatagcaatttttctataaagtcatcccttttatatatggcttcactttccacagtttcagttacctgtggccaactgcagtccaaaaatattaaatggaaaattctggaaataataagttttaaattgtacaccataaacagtcttcttttcatttaacttagagtacttgtatgagtttggtagatttctagaagtagaattactatattggcagcctaagaaaaagacactagagaaaattatctccaaatatgatgagtttattagggaataagaaagaagtatggtaatttggaatgcactggcaaaccaccagtac

SEQ ID NO: 205150 - DNA, 622 bp, Homo sapiens
agtatcccccaaaataaggaaaagttgagtatgttgtagatactagtctgttttattatttactaccataaaatgtacacaaatgcattagaaagttaatacagccatttgcagttgagaaatgtaaacaaacataaagattcaggcagcattaaatcataactgcacgacattcactgtagtaatattgtactattataatatgtagccactgcctattgctactgcagtgagccccttaaaatgccatgtgacgctaatcatcttcacatgaacagtttatctctccagtaaattgcatgtcagtaaaaagaacttgtagtacacaggtattgtggtttagtgcaatactgtaagtcttcaatagcaccatgggacccatgcaaagtggcgctagtgatgctgagaaaagtcatggcattgtaagaaaaagttcagttgctcgatatgtgctatagatgaggtctacagctggaattacctttcagacagatgtacacttaccgtatcgataagtgcagtactgtacatgtattttctcttacaactttcttagcattttcttttctgtagctttattgcaagaatacagtatataatacatataagacagaaaatgtgt

SEQ ID NO: 205151 - DNA, 315 bp, Homo sapiens
caaataacaaactgagtcaggatccacctttctatgtatggaataaagagcatctatttgaaaattggctttctaatttataagctgtgagatattgaataactcccggattcattttgtcttaattccctaatctataagatgaaaataatactcattcatttgccccagatatattaattaagcaatcataatgtttcagacactgtgctagggttcaaacactgtagtaaagatatgggcttcaggacattaatagtttagggaatgagatgatgagtaaataaacaattagattacagggttaagagcaac

SEQ ID NO: 205152 - DNA, 745 bp, Homo sapiens
cccacttactcttctcctttaccataaactaagtcttggtctaatggaataataatgtgttttgatgccagtggaaccaaaactctgcaagtccacagatagtaatgtttactgttgctttacaggtaagaatggtacccccctactaagaaagtgtgtatggcaggtaaacactgagcacacatggatataaacacagggataatagacactgcagactactagggaaaggatggaaggagagagacatgggagaaaaactacctattgggtgctatgctcactacgtgggtctaatacactatgtaacaattctacacatgtacccccgtatctaaaataaaagctgtttttttaaaagaaaaattgctgtaaataatggaaagaaaatgacagggctaatattttgggaatcttagaaaagaattatattcaaattacataagaagaaagacagagtcgggtgcggtggctcacgcctgtaatcctagcactttaggaggccgaggcagacggatcacgaggtcaggagctcgagaccatcctggctaacaaggtgaaaccccgtctctactaaaaatacaaaaaaaaaattatccgggtatggtggcgggcgcctgtagttccagctactcgaaaggctgaggctggagaatggcatgaacctgggaggcggagcttgcagtgagccgggaccatgccactgcactccagccttggcgacagagtgagactccgtctcaaa

SEQ ID NO: 205153 - DNA, 397 bp, Homo sapiens
ccaggtctatgaaattctcagtcattaaactttccagaggctctttaaattatttgtgtaatcagagaacaaaagaaggaatcccctgctctgggatccaggaacaggcataaaagacataagagagaaagtggcctctattctccctctaaacaagagactctgaatttgggctgtttcagaatcaactggaaacaccctgcctagagtgcgtctctagcacttttattttattttattttattttattttattttattttgagaccaagtctcgctctgtcaccaggctggagtgcggtggcgcaatcttgactcactgcaacctccgcctcccgggttcaagcaattctcctgcctcagcctcccgagtagctgggattacaggcgtgcaccac

SEQ ID NO: 205154 - DNA, 584 bp, Homo sapiens
ttgcacactatttacctacaaggtcaaagcagattccaggttgaattcaagctcacttacagacttcagtccaaaatccttagggtcagtaatgaaagtcaaaggtagagccagaatttttaccagggtgtacctttcagcagccttagatatggttgattataagttgctgatagatatggccaattacattgtcatcactgtgttgataattttgatttctatgtgtctaaccagcatagacctgcccctagacgaatgtttagataagatgccctgaaactaaccaatccctacccttgttgggatctactcatacaagagaatgatcactgagggatgtttaggaaaagagttcagcttagaaatttagtgttgcctctcaccatgccctttccattagatgtcatgggtttcaagcaaaatttgagataaagagttttccaaatcagtattttgttcaaacggttcccaattcatgacatgataatagttccacataaaaccaaaggatctgatataattaacaggcttcatttcagaaaatcttgtttgacaagatttctctgataattacaggttaa

SEQ ID NO: 205155 - DNA, 378 bp, Homo sapiens
tctgtaccacagaacttaagctctaatgagggcttcagaaaataaataatttcagaacatgacaagtttaattaaaaaaaaaaaatgcacagaaggacagagtgtaaccagggtgaatgttttcaagtgtttggtcaatgggcactgtaagaatcaatgccgggggtagctgaacagcgatgaagccaagaacttgagacacaaaaggcattttccctgtttccaggacagctggatgtgtttgggccaaataattttgttctgattcatttgaagattcactggtctataaatacaagcctacaatgtgacaataggatgttcctaactgcatcagtaccaggaagcatgaattagtacagtgatccaataacttct

SEQ ID NO: 205156 - DNA, 399 bp, Homo sapiens
agactccgtctcaaaaaacaaacaaacaaaaaagtacatacctctgctgagacgtcaccttcgctcactctctcccctcctgaaatctgagtgccctatatcctgcctcattatggcaaatgaatgttaaatgtggctttttttgggtgaggatgcttccagaattgatttgccctgaaaatgcatcgccactgcacacgtttggacaaaatactattagaaatcctccctgattacagtaactcaaggttttattaactatttcatacctactgttgcatgggacaaaaatgcttttgaaaagtttaatttctacaatgaaatgagtttttttgggggggttttattgtttttgttttttaaagtccttaaatcatttcagctttgactcagggccta

SEQ ID NO: 205157 - DNA, 495 bp, Homo sapiens
agatcaacagaaagttagttctttgagaagataacaaaatcaacaaaacgttagtgaaactcagaaaaaaagaaaaaaagagactcaaatttgaaaaaatcataaacggaagaggatatgtcacaatggacaccatagaaatataaaggatcattagagagtactatgaacaacaatatgccaataaatttgaaaatttaaaggaaatgaataaattcctggacacatacaacctataaagattgaacccagaaggaaaagaaaacacaaatagaccaattacaagtcatgagagagaatcagtagtaaaaggtctttcaacaacaaaaaaatccaaaaccagacggctttactgctgaattctaccaaacctttaaagaagaattaataccaattctttccaaactatcccagaaaataaaagaggagggaattcttcctaattcattctacaaggccagcagaaccctgataccaaaactagttgatcgatac

SEQ ID NO: 205158 - DNA, 340 bp, Homo sapiens
gggtactgaagcaggactcagcatgtcagcaacaggctcagaagagagatgagttttcagtgggacagagtcagggcatctgagccagggaaagtgatgaattgtacaataaagcccttttgaatctgctctcctctggcttatttcccctagggcatgtgagtacactgtggatctgtttatttttcttatttattttctgcattgagtaatacaatttttgagactcctatgaagagggtatctaatgtagatgactctgtaagtacaatattatgatctggagtgtgaagattgtccttctgatggcttgagtctgaaatcagtgattcaacagttc

SEQ ID NO: 205159 - DNA, 900 bp, Homo sapiens
gtttaatggcaaattaaaaccacaaattaaagttggcccatatttatggagactttaaacgctccataggaaatgttaactttcgttttttagggaatgggaaactaatgaagattctttttctgagctagagaatgacacaattactgagtgcttgagtaaaattaatatgaaactgctattttaagaaagtgctggaaggagaaagactgaaggcatcaggtagagcagcattggggggctattgaaatggtctaatttttgaacaattaaagcctagagtttgtggcagtgaaaatagaaagtatgtgtgaaagagttctttggaaattattcagttggatttgacgaggaaccaagtgctggcagcagaggagaggatgaagtccaagatgactctgtggtgttaagtttagtttattgggaaaataaggtactattttagaaatatgaaagttattgggtaaagaatgattaatttgaggtagcatttgagtggcagtgtccaacaaggagttggtaaggccagtcttatgagatggttcaaacctaaatagtgggaaaatagaccagggtaccagttgaatttaaggatagaattgagactgggcatggtagctcatgcctgtaataccagcactttgggaattcgaggcaggaggatcacttgaggccatcagttcaagaccagcttgggcaccatgaaaatactccgtctctataaaaaaattttaaagcaatagtctggtgtggtggcacacgcctgtcattctagctacatgggaggcttaggcaggaggttcacttgagcccagattttgaggctacagtgagccaagactgtcccattctactacagcctgggcaatagactgagaccccatctctttaaaaagtaaa

SEQ ID NO: 205160 - DNA, 292 bp, Homo sapiens
gcaggtcgcggcgcggcgcggggacccgggacgcagcccggccggcctcccggtctctcctcccacccgcagccggcgcccccgccccccgccctcccgcggctctccctcgctctctcgaatgttttccttcctggaagagagaaactgaaaggcagaactgagaaagctctttgctcattgatcttgagagtttcagtgcagaaactgacgtgaattcccagcactgagctctgcctcttaaaggagccaccaggaaataaaagctcgggttacagcccggcatcgggga

SEQ ID NO: 205161 - DNA, 1691 bp, Homo sapiens
tcccagctactcagggagctgagggatgagaatcacttgaacctgggaggcagaggttacagtgagccgagatcgcaacactgcattccagcctgggtgacagctcaaaaaaaaccaaaaaaaaaaggggtgggagatggctcagagactaaacgagatgcttttacagtattctggggaaaaaaagatgatgagggcctgaaccaggacagtgggaacgggaaactggatatgaagaatgtggtagacatatttgttgactagtttttcaaaaattaaagatgatgagaggagcagcagtttagggttaggatttggggttgtattggcttttggaaatagtttcaggtgcctgtgatagtagcagcagccaggtgatagtaggcagctgggaatctggagctcagattgttgacaggaatttgaattttcaaccctcaggataggtaaaggcatggaagagtttgacttttcaaagattcttgtaataagaatggctaacagttattgaatgctctgtacagtgtctagcatacagttgtcttgaatatatatttaaatgtatgttcatttaattcttgtatccttgtgaggtaggtataagtagctcagttttactgatgaaaacattaaaacacagaaaagagtaaataactttgcaaaggcacatgagatacgaaagtaaagctggtgttctaattctgcagcgtggttctagagccaacacgagtgagagaaaaggactatggaaaaagttccccagaaataacaaaatttgaagaataaagagggagcaagtgaaagagattgagagagaatagtttgagtttcagaaagagaacaaggaaggggctattcaggttgagtattcctaatttgaaaatctgaaatgccccaaagtctgaaactgagtgcacacatgacactgaagaaaatgttcattggagcatttcctattttggattttcagattagggttgctcaaccagtatgtatctacaaatattcaaaaaatctgaaatccaaaacatttcttaccccaagaatttcagataggggatacacagcctgtatggaacttcaagcagtatggtagagtacacttaactcagaggctgcagagaggtaacagatgactgcagatgccagtgatgtctgttgaataaaaagttgctttgctattagagacttgaaagttttgatctccgtacttcattcaaaagactctgcatgtttctttatctttgtgtttgcagagtcggtatctttcaacctctgttccaagccttaaagagctattataaagctcttttgtttgcctagtatgggctgttttggtgaaatagactatgtaaaaatgtctgaaatacagagttgaatatgaagaatggcagcattttgattttgatgtggctaaagattgatccagggaggactgctatttttccatgcttaaacatttgtgggacaagggctagttggcaatgctagaatcgtttagtatatcttgaatagtttaaaccaagaatcactcaagtatgagccattctgcttacctaccagaagtaaagattactcctctaacagtttttagcattggaattctttttttccctgcaaacaaaacttttcttggaacctcatgaatgatttttacatgttcaaggtatggagagacactgggatcctct

SEQ ID NO: 205162 - DNA, 1637 bp, Homo sapiens
gctgagctgactctagaggatacactctccctactgtatcctactattgggtatctacccaaaggaaaagaaatcattcaaccaaaaagacacctgcactcgtgtgtttactgcagcactattcacaacagcaaagtcatggaatcaacctaagtgcccatcaatggtggactggatatgaagaatgtggtagacatatttgttgactagtttttcaaaaattaaagatgatgagaggagcagcagtttagggttaggatttggggttgtattggcttttggaaatagtttcaggtgcctgtgatagtagcagcagccaggtgatagtaggcagctgggaatctggagctcagattgttgacaggaatttgaattttcaaccctcaggataggtaaaggcatggaagagtttgacttttcaaagattcttgtaataagaatggctaacagttattgaatgctctgtacagtgtctagcatacagttgtcttgaatatatatttaaatgtatgttcatttaattcttgtatccttgtgaggtaggtataagtagctcagttttactgatgaaaacattaaaacacagaaaagagtaaataactttgcaaaggcacatgagatacgaaagtaaagctggtgttctaattctgcagcgtggttctagagccaacacgagtgagagaaaaggactatggaaaaagttccccagaaataacaaaatttgaagaataaagagggagcaagtgaaagagattgagagagaatagtttgagtttcagaaagagaacaaggaaggggctattcaggttgagtattcctaatttgaaaatctgaaatgccccaaagtctgaaactgagtgcacacatgacactgaagaaaatgttcattggagcatttcctattttggattttcagattagggttgctcaaccagtatgtatctacaaatattcaaaaaatctgaaatccaaaacatttcttaccccaagaatttcagataggggatacacagcctgtatggaacttcaagcagtatggtagagtacacttaactcagaggctgcagagaggtaacagatgactgcagatgccagtgatgtctgttgaataaaaagttgctttgctattagagacttgaaagttttgatctccgtacttcattcaaaagactctgcatgtttctttatctttgtgtttgcagagtcggtatctttcaacctctgttccaagccttaaagagctattataaagctcttttgtttgcctagtatgggctgttttggtgaaatagactatgtaaaaatgtctgaaatacagagttgaatatgaagaatggcagcattttgattttgatgtggctaaagattgatccagggaggactgctatttttccatgcttaaacatttgtgggacaagggctagttggcaatgctagaatcgtttagtatatcttgaatagtttaaaccaagaatcactcaagtatgagccattctgcttacctaccagaagtaaagattactcctctaacagtttttagcattggaattctttttttccctgcaaacaaaacttttcttggaacctcatgaatgatttttacatgttcaaggtatggagagacactgggatcctct

SEQ ID NO: 205163 - DNA, 334 bp, Homo sapiens
atcaacaaccacacaacgctatgacagggatacccagagggcatctgactcagtccggggcttaagaacagctttccaagttaagtctaggggggcaggacatcctaggagaagcgacgtttgcaatgacagggaaccacgagaacccagggaggttgtgggaaactgccaagtagatgggagtagagggtgcctgtgggagtgacagatcatggatacagggtcttgtgtgtctaaggggtccagcctctatcctgaggcagtagggatatatgggaatttgggcacgggaatggcatgatcagatttttttccccgtgagttaacatcagat

SEQ ID NO: 205164 - DNA, 182 bp, Homo sapiens
aacaacgaagacgtgatcatgagtccacgatctaggtgcaactctcaaatcctgctttgcagaatcaaacaatgcaggtgatttcccacaactgtgatacgtttgcttctcacctgcttgactactggtaaagttcaactgaaatacagcaaaagatgcatccaatttataaatattttgtg

SEQ ID NO: 205165 - DNA, 529 bp, Homo sapiens
gagccaaagaacaagataattaaaaaatgagttatccagtgcttcatttgtggtttcagtgtgggtagtaagacataggttttggttccaaattaagttttcaatcttaggagggtcaaggcagacataaaaagattattccaaatatcactgcaaaacattatgaaacagatgctatagaaagaaaaggagtgaatgagccagggagaggcaaagagagaaagagagaagatggacagggagcaagtgaaagggagagaattagctgattcgcagagggagagacacaatagcagacaaaggggcagccatgggcagcgatgtgatttggtgggcaggactgactggaggtgggagggtcttgtgctacccccttgatatttggctggtgttttcatggtcatagaggagagggggttgcagcaaaggaggaagccacagtggtttgatgcccagctagtaatatgctgcacgtgtgacctttccgcctacctaagcctttccgcttttataactggctcattccctg

SEQ ID NO: 205166 - DNA, 550 bp, Homo sapiens
tagtataggaggatagatagaagtggttgggacaaaaacaaagattgtcttaccaatgccttaaaaaagagcagttcagaggtgagattggttgtcaggaattctctattttgtttcagaattattatgtttaaaataatacttaaaacgtagtgatattaaaagttattttacattttaaaattcattttgaataagttgtgtatacatttcatagaaaatcctgagaatatactaaagtggacagaaaaaaaatacatttcccatgaattttcacacccaaaaattgttattgttaatatttgttttattttttctggcttttgttttttttgcaaaggtttcaagatgtttagccaaatataaatacataaatgtcaagttcaggtcttttaattccaaaagttggggacaaataaataactgtaaagggtggatgttcttttttcctctacaaaaacatggtcttcttaaataatgttcttacattttcttttacctgttcattacatgattctcagacttttagatttcaaggaaagtaatatcc

SEQ ID NO: 205167 - DNA, 361 bp, Homo sapiens
acctctgaactgttaactgaggcagaaataaacttctattctgtttgcgtcactgtacagcagtgagccaaaaccctaagtgaccactcacttggctgccccacagagaagggactaaggaggcaagaggaacatggggaggttggtccggaggcttttgccgtggaccaggggagagctaaagatggcctgaactaaggtggtggcagtagggagaaaaagagagaagcaatacattccaggtattttagagacagattcaactggacatactggtcaaggataaacaagaacagagcatggtttgtacaggggggagaatggtggtgctatctctgtgacagacaggtggtagggcagg

SEQ ID NO: 205168 - DNA, 183 bp, Homo sapiens
atctgcaaatcaccaggagaccagtcacccagtagaaaaagagaaatagataggaagagtttccagaaaggatatgtaaatgattcttgaacgtatgaagaactgaacctcataagaaaaaaaaaaaatggagtttcagctagattaggaaaaataaaaaaccgtggtaatctactgtgtgtg

SEQ ID NO: 205169 - DNA, 471 bp, Homo sapiens
ctcgctctgtcgcccaagctggagtgcagtggtgctatctcggctcactgcaacctcggcctcccaggttcaagtgattctcctgcctcagcctcctgagtagctgggattacaggtgcgtgccaccacgcctggctaatttttgcatttttagtagaggcaggatttcaccatgttggtcaggctggtctcgaacaccggacctcgtgatccacccacttaggccttccaaagtgctgggattacaggtgttagccgccgcacctggccaaaattttattaatgataatgtatacacattgaaataaagcatgaataacttatataaaagtaacttattaaatgtaaatatagtaagtgaaaatttatcaaaattttctgttttataaagaaattgtggatagttgatatatgccacattatgctattagtgtttaaattaaaatttgatgttttgttgaggaaataagt

SEQ ID NO: 205170 - DNA, 625 bp, Homo sapiens
atgtattgtggacttaatatgtaacaggctctctggtaggatgggaaacagatcctgccctgagccagtttacaaccctgtggggagggcaccaagggaacaggctatttcagtctagtgtgataagggccatgacgggagaaacctcaatacagtgtgctcagaacctgcagaggcagcgcaaggggtcccgaggccacacatgagaggatgctacatgaccagaggaaccaaacttggtaacgctggaggtggattcagaagaaagagaaaatcccagcactttgggaggccaaggcaggaggattgcttatggccaggagttcaagaccagactgggcaacatagtgagaccctatctctaagaaaagaaaagaaacgaaacaaaacgaaaagaggactggccagctgcggtgtttcatgcctgtaattccaacactttgggaggccgaggcggcagatcacctgaggtaaggagttcgagaccagcctggccaacgtggtgaaaccatgtcgctattaaaaatacaaaaattatctgggtatggaggtacatgtctgtaatcccagctactcaggaggctgaggcagaagaatcgcttgaacccaggaggcagaggttgca

SEQ ID NO: 205171 - DNA, 507 bp, Homo sapiens
agtgaataatagcatttgcccttctttctcaaaaaagcagcatttgctttcttctggcaaggaataattaagctaatttctccatgaaccttggaaaaagtggcaacgaataatggatttgtccctcaaagaacatttcaagcaaacatcttatcagctacaaattcatttgaggcagttccaggtcagccacaggcaatttttctcattaaaatactgtttaaactgttgtatccagatgacacaggagacatatcagacaaacaacacctgcaagaagaattggtgaagtattgacttttcatcaatcaaaaagtttactaagcagatgaaaataatttgccttcacagtgacattttcctgacgtcttgctagtacttaaaggcattgttttttctttaacacccaaactttaattaccagaaaaggttagcatcaaaacaaaggacatgttggtaatttagaggccatatcagaaaaataaattcattttggtttgaatgaat

SEQ ID NO: 205172 - DNA, 264 bp, Homo sapiens
ggctcggaagatttagcagcttgctcagggtcacaccttaataagtggcagaaccagaattcaggacagactatgtgacttttctctccagcttttaatattagtcattctgcttctctggatacataaaggtgcccaggtaaaagtcattcttctcaaatgcaaagaattaaccaggcatcaggccaatacttgtcatgcagacttaagccaatactttgttatgcagtacttgtcactggtgccttatcttcctatttctca

SEQ ID NO: 205173 - DNA, 470 bp, Homo sapiens
tcatattatatcactggactgttgaaataattgtcatgtcatgagggttcgaatcagtataaaaaagtttatttgggcttcatttttcaccatatactttccctgtatgtaatgcttattataaaaacatatttaaattacattaattttgggggggataaggtgggtatgaaaaaaatgcttatcttgcagctttttcttatagtaagcagaataatggcccacaaagatattcatgccctaattcccagtttgtgaagatgtggcaaaaggaatgtagttgttcatttgtataatagctaatgtatgaactactctcacccaacacgctacttacaacacagtatcaccaacaccatttttaagtacttcactctaattctctttaaaataaaccacattaaattatactcacaaaacttaagtggtatgtttcaagctgagtttcaatattaaatgggtatgagact

SEQ ID NO: 205174 - DNA, 318 bp, Homo sapiens
taggcatctgtcttgttcatgagccacattacaacctcgtgtgttataggcaaaaaggcaatctaagaacggcctgacattcggacgcctaaggggacttccctagtgagggcacaagacagacaaatcccagaatattttctatatgcagaggaaacttctctggcatcttagaaagacaaagacagcaagactgaagatagaaacaggaggatagcaaccttttaaacaacttgtttttgtgaaatttgtttctgtttgctttgagaatgggggaaaagagaactctaattacaaactccacgtttctttcaacta

SEQ ID NO: 205175 - DNA, 512 bp, Homo sapiens
ggttttatatttgtctttgcaagatattttaaggtgtcagtgtttggcacagaaggttataaaggtattaacccagccaaaacaaaaaatggtcctggtttgtatgctttctttgacaaatgagactagtttggccgggcatggtggctagtgcctgcaatcccagcactttgggaggccaaggtgggcagatcacccgaggtcaggagttcgagaccagcttgggcaacagagcaagactgtctcaaaaaaaaaaaatatacgggccatggcactgggcccttcctggtttatccttattcttctggccctctattgggggactagggtacacttagtcacttcttaataatgagtagggctagtattgggcacttaaccacggataccatgtgggcggatccatccctccttttcacagccgtgcataacgggataacggttggtagtggggaaacaaaccaggagacacttccatttaaacggtggtctctttaattctccccttcccc

SEQ ID NO: 205176 - DNA, 416 bp, Homo sapiens
tctcacaagggattaatggtcttaaaatttgtttcatttgtatagcatttctcttacttttccagtgtgagcttgagtccacctttagagaacaataaggtttcacatgatcacagtaaaaatttagaagtaattgaccaggcacagtggctcacgcctgtaatcctagcactttgggaggccgaggcgggcaaattgcctgagctcaggagttcgagaccagcctggccaacatggtgaaaccccgtctctactaaaaatacaaaaaattagataggtatggtacacacctgtagtcccagctacttaggaggctggggcacgagaatcatttgagctccagaggcagaggttgcagtgagccaagatcgcaccactgaactccagcctgggcaataaagcaagactctgtctca

SEQ ID NO: 205177 - DNA, 614 bp, Homo sapiens
agcaggaaaatctgcagaacagatccagccctctgttacctggccaggtacaaatgaatattcataatagccatctcagtcatcaacacagcattgtgatatgttctgtgtcattggtaggcttcagaatggcaccacactgactggaccatttacatctgaagtactcaaaatcttaatggaatttttctttcttttctttttttttttttttttttgagacggagtctcactctgtcactcaggcaggagtgcagcatcatgatcttcactcatgtcaacctctgtctcccagttttaaaatgattgtcctgcgtcagcttcccaagtagctgggcttacaggtgaccatcaccatgcccagctaatttttctatttttagtagagatggttttttaccatattggccaagctggtctcaaacttcttgacctgatgtgatccgcctgcctcagcctctggaattgttatttattaaagttatcagctgggtaaggtggctcatgcctgttatcccagcagtttgggaagctgagtggggagtatggcttgagcccaggagtttgagcccagcctgtgcaacttagtgagaccacatttatacaaaaataaa

SEQ ID NO: 205178 - DNA, 400 bp, Homo sapiens
gttcagttcctgtcaaagaccagttctacctccagatcccaatccagatttcagacctaccctggaaacaagtgcacgatactataccaaatctagtccttgtcagaccaagtctcacctgcagaataaaacttgctcaaatacagttggagagctaatttcatttaacacttacatgtattgatttgcctgtttgtgtttatttatatgtataagtaaatttgtaagtaaaggtgtaaattatgtgtataatttacttatataacattcacttatatgtgttttcttaaacatttatatgtatgtcaaaaactattgctacaaatttgtggtttttctttttaaacttcaaaacatattttcaggggctaaatcgtgtgagtttaaaatttaagagaaa

SEQ ID NO: 205179 - DNA, 705 bp, Homo sapiens
aagctcctgcttttttttgtttgttttcagcctcatttctgttcaatttattttaggctatttaatctttaaaacatattggtacagatagtgtcagacctgagtgtacttaactgtctcctttactcacttcctgtataattctgtgcaaactatctgacatctctcagcctcagtttttccatctgtaaagtgagcataatcttggaatctgattaaggagaggaccaaccacacacctgccttacaacatcactggtataatggatatatgctcccatttaactcattttttaaatgaagaatcatataactgtcaaatgtaaatggattctgctttggccaaggaagttgatctcacttactgaaaagttataaatactccttgttgagcttgtgtaatgactgaggtattctttttcagtgagcataatgtcattgctcaaggcctaacaaggcaacgccaccagcctatagactagttggctttggttggtgagtagtgacatttctgaaaccagatcacgcatggggtgttgctgggtctgggcaatgtgattttatccatgtatgtgctttacctctctccttagtgtgttggaaaaattatgagtgtcagaaaataaacacaactacaatttgtcaatttacaatttacaaaataatttttaaagtatcagaaaaattcctaattgagataattcg

SEQ ID NO: 205180 - DNA, 242 bp, Homo sapiens
actgaatctctttctctcaagacactcctcctcccacaagctaagcaattccatggtgtcctgccgcagacacacagcaatcaaactccaagaagaaagcgatgaggatgggcgggcgtggaagtcaagggttcagcaaaaacatccaacagcaagtgtggagggtgagtgggagccgggtggcccgggcgggggtgccggaagctggggatggtcaaccatgctcagggaccacaggtgat

SEQ ID NO: 205181 - DNA, 447 bp, Homo sapiens
gtcaggtttgtcgaagatcagatggttgtagatgtgtggtgttgtttctgagacctctgttttcttcctttgatctatgtatctgttttggtaccagtaccatgcggttttagttactgtagccttgtagtatagtttgaagtcagcgtgatgcctccagctatgttgtttttgctttggattgtcttggctatacgggctcttttctggttccatatgaaatttaaagtagttttttctaattctgtgaagaaagttgatggtagcttgatgggaatagcattgaatccataaattactttggacagtatggaaaatggcttttttctaaaacaaaaaaaataacagattctgggaaggatacagagaaaggggaacccttgtgcactgttggtgggaatgtacattagtaaagccacaatggaaaacagtagtatagaggttcac

SEQ ID NO: 205182 - DNA, 489 bp, Homo sapiens
tcagtttcagagcaggttttcccatggtctgtgccagtatcctcagtcttgatgctctcaagtcaacgggattagaatgtgtttgcgcagttctgggtttcccttcatcggcatccagtcattttcagtgagcagaattgcggtcagctggcacatcaccagcaagggccaaattagacataattgcacatcagtttcacgttaaggtctgtggcttaatgtgctctgcaaaagcatgccaggcctggagctttgttctccctgggaacagcgtgccccagaagaaaggttacagtataaatcatcatccaaacctagacacctaggaaagggggattctgttagtttttccaaggcaaccatataaattgtgccagccctgggcaagccaggacttatggtcaccctgcccataaggatgggtctgtgcaatgacattcactttcctagacagcctttacagcaacctttggagcagaagggaaacca

SEQ ID NO: 205183 - DNA, 277 bp, Homo sapiens
agggctgggtgaggggctgggaggctcagggggcctctgctcaaccaaggagcagtccccagtgcccaagccctgggctggctgctggggaggtgaagagaaacaggatcccagctgccgctgcccctgcccctgggcccatctgagtaggggggacagacatggagagagaggagaactatgttttgtgagccagcccctctccctttgtcagacacacactgttgtcttgggcagccggttctctctgctcagctccattaaaacgcagaatgga

SEQ ID NO: 205184 - DNA, 497 bp, Homo sapiens
cagaggcaatgcttattttaaagaaaaagaaaggtgaaatgtgataaagagaaagagagaagagttgctattctaccaaggctgggtcagggaagacttcattaaaaagtggcatttaaacaaagatctgaaggctgtgaggggccatgaggctttctggggatccaggcagagggagtggtatgtgcaaccctggggcaggggtgcagcttcagagtttggggaccagcagggctagcatggctgcagctcagagactatgggacggctggtaagagttgagctcagagaggtaatggacaggtgttccaaggcaggtcttccagacttgcaggtcattataaaaactttgtcttttgctcccagtaaaattatagtcactgtgggattttgaacggatgagtaagatgactgatctgtattttaataacattaatctggttgctgtattcagagacaactgaagcagggcaaagattaaaagtaaaggaaaagga

SEQ ID NO: 205185 - DNA, 503 bp, Homo sapiens
tacatagaactatttagaaaaagtataacacttatgtattggacttatatattgattatatatacatggcaatagctcagaaggtggggtggggtgggggaatttattggagttatattgctgcaagtttaccatattttacctgaaacaacttagattattacccctaagtggactgcaatgagatttatagtgtaatcccactaaaatataatgtgagaggattgcctgaggccaggagtttgagactagcctaggcaacatagtgagaacctgtcgctacaaataataataataataatcaaagctctcacctcaataacctaggaaaaaaatagcaaaataaatccaaagcaagcagaaggaaggaaataataaagataagaacagaaatccatgaaattagaaaccgaaaaacaatagagcaagccaatgaaacaaagggctggttctttgaaaagatcaataaaattacaaacctctagcaagactgacaaagaaaa

SEQ ID NO: 205186 - DNA, 1149 bp, Homo sapiens
tgtcacccaggctggagtgcagtagtgcaatcagggctcactgcagctttgacttcccaggctcaagcaatccttgtgcctcagcctcctgagtagctgggactacagttgtgccaccacgtccagctaattttttctattttttgtaaagacccaaagcgttgggattacaggcatgagccacctcaacgggcctttattttttttattttaatttttattattattatttttgaaacggagtctcgctctgtcacccaggctggagtgcagtggcgcaatcttggctcactacatgctccactgcctcccaggttcatgccattctcctgcctcagcctcccaagtagctgggactacaggcgcccgccaccacatctggctaactttttgtatttttagtagagatggggtttcaccgtgttagccaggatggtctcgatctcctgaccttgtgatccccgcctcagcctcccaaagtgctgggattataggcgtgagccaccgcgcctggccccgggcctttatttttatttttaaccttttgacaagacacgctttctattagagctgctttttgtctccctggttcgatttcctgatgtagaatcattgtgttgctgatttttcagttgaaaatgtttaaactgcttcctttgagaacaagtttgagttttagtaagctgtaaagctgttttatttgattcactgtgaataagacaagtacaaaaaaaaaagtgaaaacacagcacatttcaagtgtaatcccctttggaatttttccaaagtcttagtatatgtctttgtgacagaaaaacatagatgggacaggtaaatgaaatgttcctagttgcatagctgttaaccatgcttcaaaaataaatcattttttaccacacctggattctttattgtcaaattgtctattagtttctcctactggctttcccctagattggtctgttctgttaaaaattgtgggtttagactgggcacgatggctcatgtctgtaatcccagcactttggtgggcttcatgagttcaggagttcgagaccagcctggtcaacctggtgagaccctgtctctactaaaaatacaaaaattagctgggtccgtggtggggcacacctgtaatcccagttgctc

SEQ ID NO: 205187 - DNA, 1297 bp, Homo sapiens
cctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagattttgaacaactggatggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgc

SEQ ID NO: 205188 - DNA, 1006 bp, Homo sapiens
cctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagattttgaacaactggatggaagcacaagaagagagactgaaaactttacaaaaacctgaaagtgtgatctcagtgcagaagctgctcctggactgtcaggatatagaaaaaggactagtataggaatggagcttatcactgatccttccatcttgttcttggatgagcctacaactggcttagactcaagcacagcaatgctgtccttttgctcctgaaaagatgtctaagcgggacgacatcatc

SEQ ID NO: 205189 - DNA, 598 bp, Homo sapiens
aaaaaagattgcgggaatcacgtgcattaagttgttaactcccttagaatgtttaagccaccggtttactctgagttttttcctttgtgcacatgtggcttaatttccgtaagtaaacatgaattatgatatctgcctagggtgttacatggtgaccagcgtactgttttttgctgatcaggtaggtgagttgttgaattccttgccttccttcaggtgaagtggatgtagcccaggagaacatgcttttaatgcaggcatcttaatctttccatcttggggaaatatacattttaaagaagcagtgttttctgaaggcataccttatcataaatcctacttacagaaaacagtataatgaaaaacttatgaaatgtgttttctgttgtcttaatcaaaaggaataatttagttattcataaatacataccctactgtcttctgatgaatacttgagattaagattaaatggaataaattaaaacctagtttcaatattgaatcaaagctaagtggcctccctctccctctcaaaggttaataagtttttcaaaccagagtgcgtgaataatttaaaagatagcatatggaataattt

SEQ ID NO: 205190 - DNA, 615 bp, Homo sapiens
taatcacttaaaataggtagaaaagggatgtggccattttctaacccatactttttatgttaatgtagctcttttttaattacaaacctaatttaaaatttttaaattttgtgactacataatagttgtatgtatttatgggatatataagatgttatgacacatacatacaatgtgtagttatgaaatctgtaactgaagtatccaacagtttaaacatttattatttctttgtggtgtaactttccaattccactctcttgttttataatatacaacaaagtactttaaactatagtcacccaattgtgctatcaaacactagaccttatttcttctctttttatactcaataatcatccccacttctcttgcagtttcttgtgcatttgcactataacatttatttctttttatactatctcttaaaaaatggttgtagttattatcatagtcatatcttcaagaacaaaattccacattcaatgaaagtaaattcaaaaataagaacaatcccctattcccctggttgctcagaaatcaacgtatagatgcagaaagcctgaaaaagaaatgtactataacactctcaaattaaaacaataattcttcagc

SEQ ID NO: 205191 - DNA, 207 bp, Homo sapiens
gttggtgaatagaagtgttcctttacaaagtactgttttgatcatctcataagaaagtcacatggtacctgggtggcctgagggaaaagcaaggcaggtctccagggttgagtttagcatgcctgatctttgctgagattcaggatttccaattgcactggagaggattgtgtaggtagtagcaagagggtggctacatttagctga

SEQ ID NO: 205192 - DNA, 151 bp, Homo sapiens
agctcaaaaacagaagacctgctgaatagaaatgaatatctggcatgccccctccatctccaattattcatcttattcctactcatccctcacaactcagctcaagtgttgcctcctcttctgacttccacctcctgctggatttaagtga

SEQ ID NO: 205193 - DNA, 621 bp, Homo sapiens
caccgtgaggaacaggcagcttcctctgatgggcacaggcaccacttggcttgttcagggctccagaagcagctggtctctctcttctaaacctgcacaggacccggcctaggacgcagctcagagggcatctggtgcattcacggggacacaggaacgactcggtcttttccaccccagatggtgagcctggcctctgtcctcattgcttgggtgccctctgggtctagaggagacactctcaagggggcctctgccacgctgaaaatgtgccagtgtcaaacccatcaggggacagggacagctgggccactcctgccaaaagcttatcaaacggcctgccctggacatagtgagtcctgtctggagtgaatactcatggctgttcccgaatactcgactacaaaggcattcggagagcattgcctagaaaagtttaaaaaccagaagtaatccacatactcaacaataggggccacgcacagccttgagaaaggacgtcaaggaatagtttaatgacttgaaaagaatgtgcggaaacaggctgctcgaaaagggtatgcagcatgccacgtttaaaaggcgcatacacgaacagctataaaggtgcatcacaatgtt

SEQ ID NO: 205194 - DNA, 651 bp, Homo sapiens
ctagaggttcccttcggatattggaagcaagaattacgctgaggcccaagagccagagtgggcagcaggtgacttcacgctcccaacccaaagttcaacccatgtgcaggcagcgtctgattgtggccagtgcgagagggctaaatccaacagctggtctaaatttgccaaagtaaactacctatgctaatccactgccagtctccattggcagcaaggactggcctggtggtcaaatagacaagctctagaaataccagcagaatgttgcaggaagtatatggatattgttcgttcttgcaagaaggcccgtacaaattcagggtaattttatcatcaccaaatctttcaatcctgtgatgacaatagcgaaactacaagcagctccaggccttctgcctcaggagctaactctggtctttcagatgcagaataaggttgcaaagtaaagtacaaacttctccttatgggaacaccaaacaggacccagtaacctggacaactgtttacctcctaccctggagcacaaaggatatgacacagcccctggctgaaaccagaggcagtgtggctccgggattatgtgagcaggctctggagttagggtctcagcaccacgcagttcagaccagcagcctaaccactctgtgc

SEQ ID NO: 205195 - DNA, 355 bp, Homo sapiens
tgagaaatatgtcaaaattaaaatacacttaaacaacctcaaatctctccctaaaatgcaaaaatcatatggaatattaactacattctttttgtatttattgtcttattaattttataatatgatgagtataatatgatttattagctatagtctcatgctgcttgttttctatgattccattatctttgctcttaattatgactttattcattatttttctatcatttcaataagtaattagatttacttccctgcaagtctgaaggctcattcattccaagtgaattctttgaagaattatttgtggattaactatcctacaattatagtattaacctaccttcttcctata

SEQ ID NO: 205196 - DNA, 359 bp, Homo sapiens
atagcagtgtgaaaacagactaatacaggctctaacaaagatattctagtctgtgattggttgagaaatttggtgtttctcttgaaggcgatatgggttggaacctcttattccaccatcttgctaacatcctatattgctttcttcttagtcttcccccttccccacccattgtgtaacttggtggaaccatttgggttacatagttatcccactgtattctcaccactgttcaaatctatagctttaagccatatttaatctccacatctcttgaattagtcaccaattactatataggttgattttgtagaatatatctctgctctattcttgctgagtctttttctttatccttt

SEQ ID NO: 205197 - DNA, 509 bp, Homo sapiens
tcgtgtgcccttgagcaggagcccagcagagagaccctttttcctcctgtagcagcagaagagaaggcagcagggtgcaggactgaaggagggctgggctgggctgggatgggagcctggctggttttcccctggtggccctatgactggttaagggcagggcagaggcacggcaggttggaggcacagaaggcccaagatagttatctgggctggatgtggggcggtattctcgcctctctggggacatcccttaagtggacaggaagactgggtggttcaggtgtatgtccactcaccaagaacacaggatgaaggtggggcctagacagtggctgttttgaccagggcagaacagttgagggcatgtgagagggcccatgctgacgccagacctcagtggggagaggggagagtccagggaccagaggtccccctaggcttaaagtggacccttggcccaatggtcccttaagccttaagaactcactggttaaaagcaagaaaaa

SEQ ID NO: 205198 - DNA, 762 bp, Homo sapiens
tcgtgtgcccttgagcaggagcccagcagagagaccctttttcctcctgtagcagcagaagagaaggcagcagggtgcaggactgaaggagggctgggctgggctgggatgggagcctggctggttttcccctggtggccctatgactggttaagggcagggcagaggcacggcaggttggaggcacagaaggcccaagatagttatctgggctggatgtggggcggtattctcgcctctctggggacatcccttaagtggacaggaagactgggtggttcaggtgtatgtccactcaccaagaacacaggatgaaggtggggcctagacagtggctgttttgaccagggcagaacagttgagggcatgtgagagggcccatgctgacgccagacctcagtggggagaggggagagtccagggaccagaggtccccctaggcttaaaggacaaaccacaaggagaagaggaagaagtctctatgtcattaaagtttcattatcagggctgctataatgcttctcattgcttattataaaacccaattctgcaagaccagcctagccaacatggtgaaactctgtctactaaaaatacaaaaattagctgggcgtggtggcatgtgcctgtaatctcagctactcaggaggctgaggcaggagaattgcttaaacctgggaggcagaggttgcagtgagccaagatcgtgccactgtactccagcctgggagacagagggagactccatctcaaaaacgaaac

SEQ ID NO: 205199 - DNA, 342 bp, Homo sapiens
tgtttttgtctttagcacccagaacagtgactgacccatggcaagagctagtaaatgcatattggatggatgtgaggggcagatagtgttaagaaggtctgtggtttcctctggctttttattttcctgccttggccttccctgcttgaagtcagttgaggctgttccctgtgacagcagaaaggagacaaaaatgagtcttcgttggcttttcagctttgaagatgagtttctcaggagattggaaaaaaatcatggcttagccaaaaaatgctggaggaggacatcatgagcaaaggctctccctgggggcctgtggaccaagagaacattcccaggctg

SEQ ID NO: 205200 - DNA, 471 bp, Homo sapiens
ggaggtggaggttgcagtgagctgaaagagtgccactgcatttcagcctgggcaacagagtgagactccatctcaaaaaaaaaaaaaagaaaaagaaaaagaaaaaaaaattatcataggtatgtataggaaaaaacagggtatatatagggtttgatactatgtgaggatttgggcatccatgggggccttggaacgtatctccccaggataagcacaaactactatataaaacatttctatcaccacaaggatccctcaaaatgcccttctatagccacacctatttccctcccacatcacctcctccttaacccctccaaaccattaatcagttctccatctctataattttgcattcaataatgttatatgtaagtggcattatagggtaggtaggcttttaggattagctttttttcattcagtatagttcttcggagattcatgcaggttgttgtgtgaatcagt

SEQ ID NO: 205201 - DNA, 241 bp, Homo sapiens
ttgatggacagtctgaagtgcacatttgagtgtgaaatatctactagcaggcagttaaataaagctacgtagaagtgagactttaaattaaggatatggatttacaagtcatcagtataaaagtggtaattgaaataactggctgaaattacctaaggagaataagtagagtgagagaagatgaaaattctgattcaagggaaatacactgactctatatattagcatctccttccactcg

SEQ ID NO: 205202 - DNA, 665 bp, Homo sapiens
aacccagtataccttagaaactttcagtttcttttaaggatttaataacttgcttataagtgtttaaaatgacttaatgggttctatcttttaagggaactttggatgaatccttgaatatcagttatctattgccaattaacaaatcaccccaaagctcattggcttaaaacaacaatctttcattagtttgcgttcttccaggtaattcttatagtctggatccagctcagcttatcttggctggacttgcccatgcagctgaggtcactagttgggttgttgaggctggctagtcctagatggtgtcactcatatgtctggtattgagtgactgtcacctggggcattagggggactgtgtctctcatcatccagcaagctaggcctggattcttcacatggctttaggatttcaagagtatgagattggggctgggcatgatgactcacacctgtaatcccagcactttgggaggccaaggttgggggatttcttgagcccaggagttcaagaccagcctgggcaacatagtgagagcccatctgtaaaaaaaaaaattttttgagatggagtttcgcccttgttgcccaggctggagtgcaatggcgcaatctcagcccaccagaacctttgcctcttgggttcaagcgattctcctgcc

SEQ ID NO: 205203 - DNA, 593 bp, Homo sapiens
aaagaaaaaaattaagaagaaatgctcctcaagtaagggagagggcccacctagcatcctgagaggacttggaagaacacacagtccaggctgggcacctgctgggtctctgtccaaaggccagccctctctttgtgtcagccgcagatccctcacctagggcatgactactggctgccagctcccactgtgcccagctctcatacctcgtcttgatgcagtagaagtagtggttaagcctggaatcagatcttggttttccctctctgagcctcagtttcctcatctgtagagtagacttccttcacgggtggttgtgaggatttaatgtatgtatagggataaggcccagaacgtaagtaaactctaagtacatggtaagtggcagtcactgcttacaagtggagccagggttcagggtcagagctagagacctacagggaagagtaggtgagctgtcggggctagtgatggagagagagaagagactggagatccagcttggggatccccttgcttcctggcccaggagccaccatggagagtgagaagctgccagagaagcaggaggaggatggagagaatgtgctacc

SEQ ID NO: 205204 - DNA, 318 bp, Homo sapiens
ccaaggcaggtagatttcttgagcccagaagttcatgaccagcctgagcaacatggcaaaaccctgtctctacaaaaaataccaaaaaaattagctggacatggtggcatgtgcttgtaatcccagctacttgggaggctgatatgggaaaagtgtttgatattggagagttcaaggctgcactgagctgtgaacccaccactgcactacatcctgggaaacaaagtaagatcctatgtgggtaaaaaagaagttagattgttaccttaagctagactttttaaactatgagatattttatggtcccttggaaattac

SEQ ID NO: 205205 - DNA, 421 bp, Homo sapiens
ctagactaaatggaaaccagtataacttaacaaaaaaaggagcaaatgacaaaagatacataaagtgaccacaaaacaatgttttcatatctggccagatcctgatgcttgcctaagtcttggagctgagctctggtttctctttgttgggacaagaggttaaaaagtgttagtgggatgttaaaaccttgaacttgaatttgaacttgacactttgagattttcttttttggagcatagaagaaaatttaaaacagccatctttcactttatagttctgtgttttttgttttttgcttgtattgctgcctctatggacctcctaaaagtttctctcatatatctaatgttctgcacctcatgctttagctaaggtgaagttgaaggattcattactatccaggtctgtaatgactgcaaa

SEQ ID NO: 205206 - DNA, 230 bp, Homo sapiens
aaaccatgcaccaaacttaatcagcctgtaatgcttactctaaatctaggcccatctaggccaggtgggctgagtcttgggatagtgggtgtctccttcctatgttgatacattaaggattccatatggacaattatttttagtcaaatttgtggtcctggagatagaaagaggagaagaagagagaagaaagacagaagagctttattgttcttttttttttttttttt

SEQ ID NO: 205207 - DNA, 174 bp, Homo sapiens
ggctggaagacagcttggaaatccttcatctaactatagggaaactatagttcagtgcagttaagtcacagagtttgtcagctaatgcattgtcagttaatgcattggacagattggaacttggcctctgatttactggttcagcgtgctcctcatttcaccttgtgtccaccc

SEQ ID NO: 205208 - DNA, 751 bp, Homo sapiens
taaaatggtattatctcaattgtacccacccttttggttgcttaggccaaaatcctctgtggtcatccttgaccattcacagttgattcaaactatatatatctggagtctaatcagttattaccatcttctgctatttgaaacaagccaccattactacttggattgttcctgcctaccttgtctatgtcctatcttgtggaagtcttttattttttataggcaggatctcactctgttgcccagaatggaatgcagtgagacaatcagctcactgcagctttgcattcctgggctcaagtgatcctcctgccttagcctcctgagtagctggggctacaggtgtgtgccaccatggctggctaattttaaaatatttcatgtggaaatggggtcttgctatattcccaaggctccaaggctggtctggaactcctggcctcaagtgatcctcccgattacgggtatgagccactataccaggccctgaaaatctgttttagacgattcattcaaagatcccatgtgatcttgcatctgacttgtctcttactcctattccccttgctcttccctgtgcttgaaatattctcctttacatggccacagtgtttatttcacctccttgaagtctctgctgtttgttgtttatttttaagcaacctgaatgaggaattgaagtttgttctaataatgtctcctccgtagaatctggtggtgccctctgacacttgtgatttttttccagttt

SEQ ID NO: 205209 - DNA, 138 bp, Homo sapiens
agcgatcctccagcttcagcctcccaaagtgctgggattacaggtatgagccactgtgctgggcctgtgagtgtcttaacagaggctggatgaggacttagaacctgcccagcatctgggtgctgtcatttctcattt

SEQ ID NO: 205210 - DNA, 589 bp, Homo sapiens
ttctgtttcaacaggagtatgtattatagaaaatttcgaaaatacaaagatacttaaaaataaagctacccacaaataataaccactgttaaattttcacgtgtttgtgatacggacatattcacttgtttgtgtatacggacatattcacgtgtttgtgtgtgcggacatattcacacgttcgtgtacggacatattcacgcgtttatgatacggacataatcatgtctttgtgtatatggacatgttcacgcgtttgtgatacggacatattcacgagtttgtgtgatacggacatattcacgtgtttgtgtgatacggacattcacgcgtttgtgtgatatggacacattcacgtgtttgtgtgtgggacatattcacgcgtttgtgtgatacggacatattcacgcgtttgtgtgatacggacatattcacgcgtttgtgatacggacatattcacgcgtttatgatatggacataatcacgtctttgtgtatatggacatgttcacgtgtttgtgtgtacggacatattcacgcgtttgtgatacggccatattcacgcgtttgtgtgatacggccatattcac

SEQ ID NO: 205211 - DNA, 560 bp, Homo sapiens
aagggagtgttgttaaatacctgatgcttggagaccatacactgaaggctaccctagggaacctaaaataaactgactatccctgggaatactgcccagcctcaaatcatctcagtacttaaaactggattaaggtgatacagaattactaatacccctatcttgtcttttacttctttgaaaatattgagcaggattattttcttcaggtttattgtgctataatgtcaaataaactgcacatatttaaagcgtacaattaaatgaggtttgacgtgtatatacactggtgaaaccatcatcacagtcaacataattaacacagccataaccccccaaagattctttaggcacctttgtaatccttgccttctacctgttcctaccctagtactccacattcctaaaccaccactgatcggccttctgtcactatagattggtttgtataattagtttagaattgcatgtaaataaatggtatgtactttgggagggggtcacttctattgtataagtagacctgaagttgttgatccattaatccactgaaagacatt

SEQ ID NO: 205212 - DNA, 201 bp, Homo sapiens
ataaaacctctgcattgaggaggggaaaagactggaaagaaatatacccaaagaataacagtgattgttttggggtgattaaaatatgattaaattttttcttatttttatttatctaaattttctatagcgattgtgtattacttttataataaacagtaacttataatactttaataaaaataaaattaaagatttttc

SEQ ID NO: 205213 - DNA, 440 bp, Homo sapiens
tcacagtttctacactagaaaacgttagactgaagcagacagtcagcttccacactatcttgtactctcacaggaaaaatgtttctgtctcaacccacaaaaatattgtaaggccaatagggatgaaaaattttgagggaagctagagacaaagaagggagatgtgactagcaaccccaacctggaaaattttgctctttatccgaaccaaaagggatgccaaataagagtggctttcagcagcaccatgctggaggaggcatgcatcatgggtactttgagcaacaacttctagccagccttcccacacaaccagggtatttcctttggaaacccctttatcttggatgaccagtgctccaaacgtgaccaagaattgaggcaatcctgggcttaaggtgctatctagtgccgaaaaggaggcaatgatctaggattaa

SEQ ID NO: 205214 - DNA, 322 bp, Homo sapiens
tttggagctgcggcagggccattctcgccctcttgctttccagtttgagttctagatccaaggctgtccaggagagccaactggtttactacaatggagtcttggagtcttctgccctgcctagctagggctggaagaggatcagcctcagccttgtgagtgggtggtacaggatgatttgacaacttaaggataacatgcaagccatagttgcaccctattactgggaagtgtctagtgtgctggcaaaaccaggagcaccaatcagtacccaagttataaaaaataaaatagccctctttgaggcccacgaaaaaaaaaa

SEQ ID NO: 205215 - DNA, 521 bp, Homo sapiens
catgtccaaattgtcccattgtgagtgagtgtgagtgtttatgtgtgtgaggggaccctgccaaggttggttcctgccttgccctctgatttgctaggatgagctctggccacctgcaaccctgaaccccagtaagtaggttggaagatgaatgcatgaataaatacaaattattgtaaaatgtaaatttgtaaagtgttagtgtattttcttatacactaattccttgcattgtgtattttcttagtcttttttcttcttgcgaatgcctataaaccattatacacagagtaccttggtttgttacatttgaaaacctaatacatattattatgaataatttccccatgtcactaaaacataattttttatggctatgtagtatttcactatatgttcatattttaaatttattaagccaaccttctgctattgtatgttatgttgactttgttgatattattgataacactgtgatatgaacatctttacatataaatgttatatggttgtaacatata

SEQ ID NO: 205216 - DNA, 417 bp, Homo sapiens
  misc_feature (14)..(14): n is a, c, g, or t
cccataatgacggntcgacccaggcgtgcggagagagcctcacaaatcctgcctctttctacttcccagcacagcgggcagagagagcaaactctgccacagggtcctggcaccaacgcagccccctctatcctgccaggtgcttcttctctttatttgtgtcctctgacatcctctcattcttctcccttcctttcccatatgtcatctccccatgacaaacaagggtagtttcttctgggtagaaactaggcgttttcatataatggaggctatgtctgtgttgatgcagagaaaaacacaaaagccctgtaaaatatttaaacctgagccaatgtgagtgaccatggcccaggcttatggtcttaggaagtcctgagaacgtgtgcccgaggcaactgggtcacaggttggttt

SEQ ID NO: 205217 - DNA, 526 bp, Homo sapiens
tccctaccccctacctccccagccctttaaaaaggcagacccagagtgttaccaacgatatgttaggaataaatctctatgaaaatacaacatcttctataaatttaacctgcaaattagcttcccaaaccaaaaaggaataaagtgaaaaacctaagtaggttttagggcaataaacactgaaaacaataccagagcacacacattacactttcatttgctgacagtccctgtcaccagatgcattctcatgattaaaagggaagaatgaagtcacgaaacccattttaaaaatcagtcctcctgaacctatgcaacaagatgactgcgtgcccttacaaatagtcactctgactgctgtgcctcaactgttttctgaaattattctagagaaaatgcttccatattatgcagactatgatttgagtactctcagtgatagctcatgttcctttgaggatgaatctgactgttgaaagcacctggaagtaagctttataataaatataaatggcaagcttaatag

SEQ ID NO: 205218 - DNA, 321 bp, Homo sapiens
cgtcgcgtggcatcctgggagtggcagatggccccgcgctctgactggctggaattaagaggagttgaggagacgggccaggaggagctggagatgttctgggtgtcctccttaagactttctctccgtttcttgctaaagttcttgattagtttgctccatgacgttttatgtggcgtttgtttttgtcttcttcccagacccccactttcctgcttttgaccagttcagagatctcttagttcagacagcttatctaaaattagaataaaacgatttccaggcttccgtggagttctgagactttgctcttctaggaaa

SEQ ID NO: 205219 - DNA, 285 bp, Homo sapiens
gggcagtggcctggcagcttttcaaatccttcccatttttattgaagctgaaagacccttgactaggacagactcggtcccaagcagagagctagatcttctataccagttgttctcaaacagtgtggcccaggaatcctgggggatccctgagtgtcctttcagggactctgcagtgtctgaactattttcataggagtcctaaaacgtgatctgccttgttcactctcacgctctcacaggcatccagtggagtcttccagaggcgacatgacacgtgacgat

SEQ ID NO: 205220 - DNA, 524 bp, Homo sapiens
gaggcatggagggtgtcctgcattccctcgcacacggtcagatgtgtcctaggccatcagttcacaaagttcccttgtcctgaccctcgtcaccaaagaagcacctccctgtgtgcctctcagcagaggcagctccccaggccacagcccatgttccctggcatttgggctctgcggcttggggactgggaaaggaagccagctgccctgagggcccagaatgacccacaaccaaaccttgtccaccttcctttcccaaaaagcatgggcaaactttgtttctcctggtggtgtttgttggggtagagaggttgttgttttgctcttgtgttttaagatcagattcttgggccacacagcatattactaggataatgaactcatgttgtagttaggattaatctgaattttcttgcatcatgtagatgtgtctggcagaaattggtgcttttatttccttctcaaacagttgatctgaaagttatgtgtaggctgggccatcctgctctggagtagagaggagc

SEQ ID NO: 205221 - DNA, 201 bp, Homo sapiens
gatggggcctgggtagtcctgaggagcttggtgcaagctgaggacagacaaagtaagtggaggaaggttggcagtggaaaaagagcagagaagaaagagagagaaacagaaatcccacaaggaaaacctgtgggatttagctttcttgaggcctgatttttctttttctttttttttccagatggagtttcgctcttgttg

SEQ ID NO: 205222 - DNA, 199 bp, Homo sapiens
gccccaggggatggcaaacccacaagctagaaggagcctggctccttgaattgccaaatagaacatgtcccactaaacacccactaaactgttacatgagcgagaaataaaacatatactgtgttaagccacggagggcttggcatcttttgttacagtggtaagcctattataaaccaacaatgagcctctccgaatg

SEQ ID NO: 205223 - DNA, 143 bp, Homo sapiens
tatagcacggtgactatagacaatgatactgtactatagtcatccctgggtatctgcctgggatttgtttcaggacccccacagacatcaaaatccacacatattcaagtctcgaggtgggccctgtgaaacccacctctagg

SEQ ID NO: 205224 - DNA, 526 bp, Homo sapiens
ctcctatggtctcaattttcatttctcagtattaaataatctgagcatcttttcatctttttaacctatgtttcttctgaagtgaaatgcctgtgagtggcagaaattaccaatatccacatgttgctccaaatgtctcatgcttagtcaggtgtggccaagtgattgggttctggccagaaggatatgagtgcaagaggtttaagtttctcccaagtctgggcattaaaaacactgtagactggcatggtagctcatgtctataatcccagcactttggaaggctgaggcgggcagatagatcacttgagcccaggaattcgagatcagcctgggcagcatgacaaaaccctgtctctactaaaaaatacaaaaaattagctgtgcatggtggtgtgtgcctgtagtcccagctacttgggaggctgaggtgggaggatcacctgagcccaggaagttgaggctgcagtgagctgtgattgcaccactgcactccagcctaggtgatgggagtgagaccctgtct

SEQ ID NO: 205225 - DNA, 439 bp, Homo sapiens
caaagaaacgcaaaagtgactgtgatgcagagatagaatcaaggagagatttgaggtttacttactatattaaatgtggagaatttgaagatgaatctaaaaaatatttgtctgttttctccgagggaatatttttatggttcatttataaagtcatctgtattgttttatgtgacaaaactggtttcattggttctttagattacttactgtcatttttggatttgaggtcataggagcccagaggggcaaaactctcagtaggaagcatcagtcgtgtcaatactgctgtgaggctgagtagaaagatgagaagtgagaactttttcttttggtgaccaacaagttattgatggccttgagaaaaatgcgactctggagatgtgtctgcagaagctggactgtagttggtgaaaaaatggacaggaaatgaaaaaat

SEQ ID NO: 205226 - DNA, 437 bp, Homo sapiens
tgagaaggttaagccccttccaatctctggagtctcaagatttaatcaataccatttagcctatttaaatcttgagctccgagttggaaggagaaaatgagaagttaaccccttgagccatgtggtctctttacaatcaagagactgtacatatgtgaaaaaatacaaattaaggacctgtgttcatagacaatctaaactgtgtttctgaagtttgtgcacatttttcttcactgtaatgttattttacagctgtttgttaaaatagtgaataatttaatgatcctaaaagtaacaggtttcgtgtgagtgtgcttgtatacgtgagatttgccttattttcaggttgttttatttaacgatggttccttggacagcattctggtgttcagcaaccaatatggaatatttgtcattaaatccatatcagtctttta

SEQ ID NO: 205227 - DNA, 538 bp, Homo sapiens
ctccggcccttggtggaaatggggggaggggagacagctggcctgctgcaagggagcagctgttcggtttcactgctttgttactgaactttcctgaggggaggataccttgtttatttccttttgcatgagagcccaaatctaaggaaagtggggcacacacctcaggtgaagggctatgggaagagcatttctcttactttgcagagttttggattaatactagatgcttaagcggtatactcctttcctccacccccctcttcttcatctgtaaaaacaaaaccaaaaaacaaaactgcaggctgcggctgtgggaggtgactttttttcatttctcagaaatccctcatgaggcaaagcagagaaacagaaagagggaaacaactttgtgtcaaaatgaggttgtgtgtgtgtgttttgaaatgaggtggcttgttgtcagctttaaggaacaacagctctgcagaggagcctggtgatggcggggaggagtgctgggctacctgcttccttgccccttgccccacttcaaagc

SEQ ID NO: 205228 - DNA, 482 bp, Homo sapiens
atgcagaggtaatatttaagccaagacctgaaggctaaggcggtaccagccatgtgaaaaacattttaggcaagaaatttcaggcaagagagaacagcaagcacaaaggatctgaggagacaaatgacttgttcaaggaactgaaaaaagatcagcagctggaaccatagtgcctaaaagggaaaatggccaggaatgaggttgaagaggtaggtagacagggcctggttagccttaaagaccctggtaaacaggtaaacaagcattatatcaaatatatagtttcaaattgtgataggtacttaattgacataaagggaaagaataagggagagtaacatgagggaaacctactttagattaggagacaaatgtcttgttcagtcaagagtttggtttttattcttaggaaacattgaatggtgattgcagctgtagaaaatggatagccagatctgtattaccagcccagttctcactta

SEQ ID NO: 205229 - DNA, 222 bp, Homo sapiens
  misc_feature (5)..(5): n is a, c, g, or t
  misc_feature (17)..(17): n is a, c, g, or t
  misc_feature (23)..(23): n is a, c, g, or t
agagncctacacactancacatnctttctaagcatgtttgcctgacatccagctcacccgtccgagtactggaatagcacagaaagccccgtcgctagccctgccacgtcgttaggagctggtccaggatgaaggtagcagggcatgagctcagtgccaggagagcagccgcactcgtggtgtatcacctgccataatgcttttatctaacttcccctttcc

SEQ ID NO: 205230 - DNA, 531 bp, Homo sapiens
aatgataagctctccagtttcaaatgaaggacgcctcaaattgagaactgacaccattgcattcctcaggatgggaaagttccttctccatcaattcttgggcactggagtaggactcttgctgcagatggtattgttctggttctcgagaaggaatccaagataaaggctgtctggggataaaagtggtaccctcttggaatatgggcaggaaggcatccctagtgaccatagccttggttgaaggtattaaggaggaatcttgaggtgcttgtctgggtgtcagttgacaatttcaatgaaattagcagcattaggtctataggtggctgcttaactaattatgaactcagctgcttaaatatatttgctccaggtttcacaattccttttatttacagtaattatcactggttagcacctatagtcaggggagaagatcttctcccctgacagcccttttgatattttgatattcaaagggaatgatcatcttcttagagtcttcggatctttaggcagaacatcctt

SEQ ID NO: 205231 - DNA, 278 bp, Homo sapiens
atttcatgtccctggattttattggaatgctcttgccccactcttttacctggttaaggccttctagatttttcaaggcttaaccttctgaacgtttcctaagcggagacctggctgcacagcatgcccttcctgtggtccccctagctatttctgttatcatctgtagtcagggctagaagccatttcccagtaccctccctcccgcagtggggcaggcttcgtttcatttatttatttatttagagacagggtctcgctctgtcacccaggctgga

SEQ ID NO: 205232 - DNA, 286 bp, Homo sapiens
taatttcctggagggaaaacaaaggccccaccttgaacaaatcccaaggccaagggaaatccttgcttcccacatttctacagctgccccacctccaagtgtggctcatacccccacctgtgaacccagtacacccggctggatttcacggtgggaggatggcctttttccctgagtatcaatgttttgggctctgaaagattctcaaagtgtccaccaagaagccctgtcttatagacctactgcaggcctgctctggataaacttgtgaatgagatgaaatcca

SEQ ID NO: 205233 - DNA, 522 bp, Homo sapiens
ggctgtccgaggtccccctcctatcggatcaggaatccagataggaggtctgaatccagataggaggctcctatctaatatccagattgttgatttaatttacatgtaacacattcctttaaaacagagacaactttttaaaaactcaattatccccttaataaggctgtatcttaatctgaactactatgattaaaacatgaaagagcagcataaaactaaacacttttaaatattatccttaaaatggtttaatgcttgtacacagcatgagttagcttcttacttaagactaataaaaacttaagagtatttcaggattattaacttttgtttttccaatagggtattctgtctgttttagaacaactcaagatatatattttctggattttatattcctaaaggataggcaaaaactgtctacctaaacttgctgtactcagattttatcaaacaggagatgaatgagtcggctttaacattaaaaataaaataaggctgggccatgatggctcacgc

SEQ ID NO: 205234 - DNA, 703 bp, Homo sapiens
ctgagatgatggccactgatgctggtccggggctgttttggcaagccacacatgaccttgctctaggtgctgcctctgtgtgtgcccagagcttctggagaagggctggaaattgggctactatagtgttaggccaaggaatgtttttacaaggcgtgtaaccctcttattgtgcctctgagataattcagagatcccagcacagtcatcttgctgattctcagatccatcctgcatggcttacagaggctgcagaggctgtggggcatactggagaaatactctgtgtgtcagtgaaggacctgctcattctttttctctctgactctaagagcagggagctcctgatcacatttagtctgctcttaaagggatccgaggctcagttctgaaaatgaaatcaggtacatgaaagatgttcactcttctacatctgtgccagcatcctgcggcacatgggacaactgagctgaaaggtttcacttcctagcatccgttaagaggacacagaaaagacaaagagtcctcagaagtaaaataattttataaattggagcccatggttcacatgatgtacactttgcacactcacattttaaatgtctttgctgtcctttttcggcatacaggccataatttccatccatgaaaatgaaaaatggcgatgcaagctatactttgtctacaatcaccaactaggtga

SEQ ID NO: 205235 - DNA, 349 bp, Homo sapiens
aggttcactcatttaaaagaactaacagttccattgctcttggcagaatacaactgtgattgcagcttttctattcagtgcactggaaatatcagtgaatttctccaactgagagtgagacattggcagtatttcccgatagtatgtgtctgttgttattatttttctcctctacctgttgacagtttgattttgataaacttttcaagaatacctaaataatataataatctaaatcattgtcacaaaagaatatagaaacagataaatacattaattcagcagcctcagagtctgatgagttgcattaatcacaccaatgagcgcttaatgtggttaatttcaaaag

SEQ ID NO: 205236 - DNA, 635 bp, Homo sapiens
cacacgttaattgttccaactcaggtcttctaactccaggtggccctgtgcttgcccactaccgcttcttgagttcaaccaagtcagggaaaaaagtatgactctaacgtaatgtggctttttttttttcttcactcagtcataccagatctttacttgcgttatagctaagtttgtatcctctcaaataaagtgtaagttatgtttaacaccaaatggttacaaactcaagtttgctcacttgaattactgataggacctgttccacatgccctggggctagttaggaaaatcagattcacactcagaagtttgctatcactgatagtattccactgagtatgtcttcacttctgaaggaagttccaaagagagttttaaacatgttctttaacagtattagattaaaaaatagtaataaatgtaaaatttcccatgagcacaacactcagagttatgtacaataacacatatattggtgtcagaaagagttcaccatactcgtacgtggttaatgcagattttctgggccagataaaattgtgggttttgtaaagcatctgtaatgttgtgttacattttgaaattaagatcagaactttaagaacatttgcttctcacaatatttttcaaac

SEQ ID NO: 205237 - DNA, 621 bp, Homo sapiens
aatgctgacacatgctacaatagggctgaaacttgaggacgttacgctgagataagacagtcacaaaaggacacatactgtctgatttgacttatgtgaggtactcagaaaagtcaaatcatacagacagaaaacagaaagccagttaccaggtctgggggtgctggagaatgaaaagttagcgtttaatggggacagagtttcagtgtgggaagatgtaaaagttctagagaaggatggtggtaatggttgcacaataatgtgaatgtacttaacaccactgaactgtacatttaaaaatggttaggaaggcaattttatgttatgtgtattttgctgcaattaaagataaacagtgtgcaagagaggagaggaagtagcagcttgtcttgttcatgctgtctgaggtgcatgtcggagggatgggtccaacattaatgtcggtcccatcccacataatttctgtttgattttgccattcacccataaaatggtgggatctacctcccctccttgcaaatttgagctggccctctgatcctgtctaagatctgaagccagatattaaggtacttcattaatttccatgtttgtcctctatgcaacctagcaatcaagcag

SEQ ID NO: 205238 - DNA, 972 bp, Homo sapiens
actgcactccagtctgagcaacagagctagactccttctcaaaaaaataaaataaattaaaaaaaaataataaagatgtaatgacagggaaatagacagatgttgatacaccctgaagcaggtagtgaagctggcagttggccactggttcccacagaaaattgctctagtgatgctagcaaatcccaaaattggggctcaatccaggaggattcctggcttcataaaggaaataattcaagagcaagccaagagtgtaaagtgaaggcaaagcaagtttatgagagcaagagaacaggaaaatggctgctccacagacagagcagggctactccacaggcaaagtagcacccgtggattgttggctagctatatttatagctactccttaattatgtgctaaataagaggtcggttattcatgaactttctagaaaaaggttggagagttcccagaaccaggggttccttctcttttaaactacatgaggtagcttctgggcattgccatagcatttgtaaacggccatggtgctggtgggagtgtcttttagcatgctaatacattataatgagcatataatgagcaatgagggcaactagaattgatgttcattgccatctcagtttcactgctttcagctggtttctttagtgcatcctgttttgaccagatcctgtttcatcatgagcagggtcatgaccactgctcagaaacaagtcctgctgacctatgtcactgtttgaaatgcttattcttcagtgccataaagaaatagcacttgaggccaggcatggtggctcacgcctgtaatcccgcactttgggaggccgaggccgggagtttgagaccaacctggccaacatggagaaaccacgtctctactgaaaatacaaaatcagctgggcatggtggctcacgcctgtgataccagcactttgggaggccgaagcgggcgggtaacgaggtta

SEQ ID NO: 205239 - DNA, 341 bp, Homo sapiens
gggatggagtgtctggaattccatggctgaggtgcaacaggtcccacagcctctccagcctctgtgggaagaaggatcatctgatgcctatgtaatagagttgctgaaggagtggaagcagctttgacattatcagtggaacccaccagtgcagactgcttcaccaagggcacctgaggcagcagatctgaggattagggacgtagggagctgaagcctggctggagaggtggtgcgcacaagaacccccacattccccgacaggagcctgaaaaagcaagacgccatgttgggaggacacggaagcagttctagggagaggagcacatggcaagaagcca

SEQ ID NO: 205240 - DNA, 219 bp, Homo sapiens
aaacgttaatactgagtcaacatagagtgatttctgtgtctaggagacagctggagaaataacaggagcttccaaatggagatgggcagattcccagagccctgctttattcacttggagtcgaaactgggaattgagagaatggaccctcgttttgtctctgtcattcatagctctccagaatgtttgaattgttatcctttctttctgagtcttatt

SEQ ID NO: 205241 - DNA, 585 bp, Homo sapiens
gagtcacttgtgttcaagaaacaaaaaaacaacccgaacaaatagagtagggtttgcagtcttgcgatggtgaagggtctcatgctggtatgcccaataacgaaattatcacaaaagattgcaaaaaccacagccttgcacaaaaagcatcacagccttatgcaaaaaatacttcaaggacatctacccagcaacagcctgtccagctgtggacttgcatcgcccttgttatggatctttgtagccacaggtggtaatctcaaaacagttatgtaatcttcatttatcctttaaaaaccattctcggccacgcgtggtggctcacgcctgtaataacagcactttgggaggccgaggagggtggatcacctgaggttgggagtttgagaccagcctgaccaatgtggcgaaacctcatctctactaaaaatacaaaaacttagccaggtggggtggtgcatgcctgtaatcccagctactcggctgaggcaggagaatcgcttgaacctgggaggtggatgttgcagtgagccgagatcgtgctactgtgctccagcctgggcgacagagtgagactccatctca

SEQ ID NO: 205242 - DNA, 607 bp, Homo sapiens
cgggccgcagcatggccgagccgctactcaggaaaaccttctcccgcctgcggggccgggagaaacttccccggaaaaagtcggacgccaaggagcgcggccacccagcccagcgcccagagcccagccctccagagccagagccccaggctcccgaagggtcccaggccggagcagaggggccctccagccccgaggcatcaaggagccctgcacggggagcctacctgcaaagcctggagcccagtagccgccgatgggtgctgggtggggccaagccagctgaggacacctctttagggcctggggtacctggcactggggagcccgccggcgagatctggtacaaccccatccctgaggaagaccccagacctccagcacctgagcccccggggccacagcctggctcagctgagtcagagggcctggccccccaaggtaagaacaagcttcccatccccttccccaaggtgagcaccagctccacatcccttcccttcagggtagcaccagcctcacactccctcctcccagaggagcaccaacctcacactccttcccttcaggggagcaccagcctcacatccccaccccgtcagatgct

SEQ ID NO: 205243 - DNA, 406 bp, Homo sapiens
cgggccgcagcatggccgagccgctactcaggaaaaccttctcccgcctgcggggccgggagaaacttccccggaaaaagtcggacgccaaggagcgcgggcctggggtacctggcactggggagcccgccggcgagatctggtacaaccccatccctgaggaagaccccagacctccagcacctgagcccccggggccacagcctggctcagctgagtcagagggcctggccccccaaggtaagaacaagcttcccatccccttccccaaggtgagcaccagctccacatcccttcccttcagggtagcaccagcctcacactccctcctcccagaggagcaccaacctcacactccttcccttcaggggagcaccagcctcacatccccaccccgtcagatgct

SEQ ID NO: 205244 - DNA, 290 bp, Homo sapiens
tgctagatctgtataacatctgtgcatggatgatggtagttctctcgagcggaagcggctttacgccaagtgccgtacaattcatctaacttccggaaagcactttcagtacaaatgcagttatactgggtgtgccagtttcctgcatttgacagtcagttttcacttattaatgacattagaaaaacgaataacaattccctaagatttcctatataacccgagtagagaagatataagtgagcaattcagatgtaaatattaatataacaaaatttatctccagctta

SEQ ID NO: 205245 - DNA, 253 bp, Homo sapiens
ccactgtacccagctaaattttttttgtattttttgtagagttggggttttgccatgttgcccagactggtctccaactcttgagctcaagtgatccacctgcctcggcctcctaaagtgctgggattacaggaacgagtcactgtgcctggcctttcttggatttcttatgagagcaatgatagcatgcaaataatgacatttttgatatttcttttttaattcttgtgccttttatttttcttcttgcttt

SEQ ID NO: 205246 - DNA, 482 bp, Homo sapiens
cctgagcacagagtgctgtgagctttgagaaataagctagagatggtcatcacagaactggatcttgaatgataaagaggagttttgttctgtggtggagacaaggaatgatcttctaggctatcaaagcagggtgagtgaagttggagagatgtagaaatgagttttgtgtttggatgtcattgagtgattttgatttggctgctagagcacaggtacatgggaaagcatgacaaaggggcctgagaggtagggttggggaggacatgtgaaacatatgttgagatctgattggtaaagttattgataggcgtttggaccttgtcttttgggaagcagggaagtagcaatatccaaaagagagtgttaaggatggattggaagagggaaggttatagaggggatagagagcaaagcaggatgtgactttcccagccttgaaatgcatgagaaagtttgggatcctcacaatgaagggcaaa

SEQ ID NO: 205247 - DNA, 297 bp, Homo sapiens
gcagggtgtgagtttcagtttctgcacattgtggccaacactgggtatgatcattctgtgtaattttattaccactccaataggtaggaatggtatctcattgttttaatttgaattgtctcaattactatgatgttgagtatcttttcatgtgcctgtcatctgtgtagcttctttgctcacagatgtaattttttcctgcatctattgaaatgatcgtatagttttctttttcagtttgttaatgtggttaattaaactggttgatatttgaatattaagccacatatgagaaaa

SEQ ID NO: 205248 - DNA, 415 bp, Homo sapiens
ggctgaggagaaattgctccatgagataaggcaagacatttatccctgaatgctgtctctccaaatgcacagaaacatgtcataaagtgtgggactagggtctctaaaggacatgtaatacctcatttctggagatatggtctaacatgaaagggtcataatcgatggtcaagtcacaaaatttatttctagagtcattttactaaatatggagagatctgcaaaaattgtatgcctggggaaaatcccaatcagaccaactgacccagaccaatcaatgacaactcagagtagtaatgaaaaattcatttagactaactcccataatttgctaagaggcactgtactaagtatataacacaatatctcattgtgtgatccttataatagctctatgaggtacatgtcattcttc

SEQ ID NO: 205249 - DNA, 441 bp, Homo sapiens
gatttgtttctttgacggtttatccttacccctttcctgctactggttggttaatgaggcactgagctaggaaccctgtaagtgttcaagtgttaaaattgtgttgttgtacctttaaatataaggagaagaaattgggagagatcagattaaaatattaaatacttatatggtttagaaaagtgacagcataagggagatcaaccaggtttaagggtaaatacttaggtgaccagaagatctacagtaaacttgaggacatatcccaccaagacccacaactcagctccagctgattgtttccacaataggactgaatgcctgcccagggtgacacagatttccagtttcttgggtaaaaaacaaaaaatgtgttttgggttttttgaggttgcttttttattatgaattttttattaaagagttggcttaaaaacaaaa

SEQ ID NO: 205250 - DNA, 560 bp, Homo sapiens
gaaaagaaagggttctaacccattggctcaccaatttctttttacttaagcagatgctatggtctgaatatgtttgtccctctcaaattcatgtgttgaaacctaaccctcaaagtgatggtactaagaagtggggcctttgagaggtgattacatcatggggatggagttctaatgatgggattagtgctcttgtaaaacaaggtcaaaggaaatgccttgcctatccactatgtgagtgtagaggtactgtctatgaggaagccggctatcatcagacactaaatttgtctgagccttgatcttggacttctggcctccaaaactgtgaggaatacagatgatcctcaacttacaatggggttatttcccaacaaacccatcagtaagttgaaaaatattgtaagtcaaaaatgcatttaatacacctaacctattgagccttatagcttatcctagactactgtaaacatagtcataacacttaggctacaattgggcaaagtcatgtaacacaaagcctatgtcagaataaagttataaagaatttttgaatcaaa

SEQ ID NO: 205251 - DNA, 562 bp, Homo sapiens
gcaccagcaggtaaccagtggtggcctggccacgaaagagtatttgaaattcaacagtgagcaagtgcagaaacagcatcccaaaccgcaggccccaccacacgcaggaaccagaaagctgaagtttcaccaaggagtttacttagtatttctcgctgggaatggggatgggtagcaaaaagcccctttcatgtacataatggttggtcctatgtcctacttttattttctctaagagttttagaagaaaggctgttttaatttttttttctccttaagagcaacttcctttttaaaatgctttcctcttcttgtcctgcttgagtaatgcaggcatcattctgaaatcattctgaaacagctaggcagtcgccttttgccaaaattacttctctaagaaaatagagtgttcttttttttaggacttagaacccacaaggggtgagtggaagttttgtagcccatcaaaggtgaatatgtgttctgcagtatcaactaaaacagtgtacaaaatcattaaactgggccgggcgcagtggctcatgcctgtaatcccagcact

SEQ ID NO: 205252 - DNA, 326 bp, Homo sapiens
gggtccctcccgcagaccctgacccaacgacagataaataatgtacactgacacagcatattatgcttttcagtctgctgagggtccaggcagcttacagactcccaggagagtgccataaacagttgcaactggggctgtactcgctggccttccgggcatttattcagcacacgttaaatgacaaaagtttcaagtaaacatcacgggaaggtaatcaccgttgccgaccctccccgctcctcccaccaagtagagagcaatcatgcatccgtggatggtcaaaggttagtcttaggaccacatgagtctgtattaactgcttg

SEQ ID NO: 205253 - DNA, 358 bp, Homo sapiens
actgtcttgatggatattccatgggtgcatgaaacgtgtataccactacggttgtgtggagtgttctttgtatggcaattgcatcatgttgattaattgagttattcagctcttctgtttccatgctgattttctgtctagcagttctatcacttgatgagaggggcatggaagtccccagctgtaattgtggatttgtctatttctccttccaacactgtcagtttttcttgatttcttctgggcctcttgtttgatactcacatgtatattagggtctttgtgtctccctagtggattgatctttttatcataatgtaatacctctctttctaataattttccttgctctggagta

SEQ ID NO: 205254 - DNA, 378 bp, Homo sapiens
tagatgtggagagattgggatgagctgtgaatatcattaagaacatgtttgacgtcaatttcttaaattgcaaaagcatcaaagccttctgaacaggagataggtattttattgacattttggaggaatggggtggcagacactaaaggctgggaaaccaattatgagtttactgaattgtccaaatgagagataagagatggaactagaatggcatcaatgggcctggggaagacagcgtgaatttcagagaaaagagtactctttgactcaacaatctgcctcccacaaataaaaaggcctgtgctaaagtctgttaagctaagctattagatcgtgagaacttcagcaactaaaattaatcttatactaggtcac

SEQ ID NO: 205255 - DNA, 358 bp, Homo sapiens
attactggggatatcagtatggccgctgtcctagaagaaactgcaatctaattgtacagacaaagtatacaattgcctgactatatagacaaagaaacatcaagtataaatccaaataatatattcagggaagaaagcatgagagaaatgagatcagtgcaagcttgaaaaaagctttttgaaggaggtggggccagggagggccttgagtgatggcaattaagatgccttgcgtctctgcttacatcagtcattgtgggaaacccaaactcccagcccaggccaaccccatcctctttccagcactgtctacccttatgctgacccattctcaccctcttcctaatctaccaagccc

SEQ ID NO: 205256 - DNA, 482 bp, Homo sapiens
caagtggttattttctctgctgctttaggatccgttttttctaatgccttgtctacatagaaccgctatagattgattattccaacatagaacaaagatcatttatgatagtcttgtattagtggatttttttttctctttcaaggcaagagtgttgctctttcacccaggctggtgtgcagtggtgcaatcatgactcagtgcagccttggcctactgggctcaagcaatcctcccacctcaggctcccaagtaaatgggactccaggcatatgtcaccatgcccagctaatttttttagttttttgtacagacagggtctcactatgttgcccagtctggtcttgaactcctggtctcaagcaatcctctcacctcggcctcccaaagtactgggattacaggcacccgccaccacacccagctaatttttattttttatttatttatttatttttatttttagtagacaaagggaaaca

SEQ ID NO: 205257 - DNA, 590 bp, Homo sapiens
gccagaattcaacccatgccaataacctccaactcccaaactgttctgattttatctctttgctttacaaagacagaacactgaagattctgctctcagggtgttgattgacgtctggaaggcagagactcgtggattagcaagcatgtgtaagaaagtgctctggatgccacagggtggtaatttgtgcatggaaaatggctggggtgaagaggagactagggtaagttccacctgaggatggagaatgtgaaagaaagttttcctagggggctggtctttgagtggaatctcgaaagttggaggaaggggaaggaaagggtgtgctgggctgagggagtagagggacaaaggcctgaaggttggtaaggtgatggtgagcttggggttttacatgcagttcaataagattggaacagattttccaggggtggggtgagggtacagaagtgtgagcagtgtcagcagtttggaagggtcttggaaagggatatccagaaaataacttcagatctttgtacaaatgagaaaacagaggttcagaaggttgatggatgagccaacagcctcaaggagactgctgagtatgt

SEQ ID NO: 205258 - DNA, 504 bp, Homo sapiens
gctctcaatacctacctcagacatactgaatcagaatgtgtattttaacacaatccccaaatgattcatttgcatattaaagttggagaagtgctcttgcatctctaacaagcttcaggtgatgctaatgcagctagaccacgccattttgagtagcaaagaggtagaacagtagttatatattgctgtagttagaatcacctgggaagttttaaaaaattctggtgtccagactgcaccccataataagtgtctctggggatgaggcacaaacatctgtatttttaaaaattctccaagtgattccagtgtgccctcaagtttgtaaactgagaatctacacaggtaagtttcaggaagtctttctttaatttgtaaaacagataaatacgaagtgaattaatgaggttaaataggaaagtagaagatgttaggaaacccagagtccatttcttatccctgaaagcctttggatctctttaaagtatctggggtgccttggat

SEQ ID NO: 205259 - DNA, 496 bp, Homo sapiens
ttaatttggctgttgaatcatctgctgatttattttgatacttgtggagtgtaattttatcccttgcttgaagctcattgttttagtaattactcatggtttagaaaattatttcttacattttgatactgttgaagccacacgttcatctcattttcttatccaaaggcatgccctttattagaaaaaatggaaaatgcctctaagtatccctaaaattttccattcagaattttagatttactgaggttttgtgtatatgtttttgatcttaacagtattattcatttccaagtacgttgtcagagttgggaagtaactagttgatttgacaagtcaatttattgtttgagcattggccttctctcttatttcagatctgtgttctaggagagcaatttgttttttgacttgccatatcagatgcatgtacagctgtcaatataatcttcaatgaaaagtaagggacccatgggaaatggtgtagcactcagaa

SEQ ID NO: 205260 - DNA, 436 bp, Homo sapiens
cagagttttgagactccatctcaaaaacaaaaacaaaaacaaaaacaaaacataagctgccatgtcgttgataacctaatctcaaaagtgacatacaatcacttctgatatattttattggccactctgatgaccaggacccctgcttcattgtgagacgtgactatacgagggtatgaccaccaggcagtcaggatcaccggtggccatctcagaggctggctaccacaggtcccatcccaaagaaggaacaaacgcatgggtatctaccgtgtccactgtgctccaggccttgatgttaggtagatgtgattatctccattttgcaggtgaggaaataggcccagaaatgttgacttacttgctcaaggtcacacaagtaaatggcagaactgtaatttgaaaggaagtagtctgcttccctgattacttaaaa

SEQ ID NO: 205261 - DNA, 1083 bp, Homo sapiens
aggtagtattccactgcaaaaatgtaaaataatttgtttatgcatttaatatgtagatgggtatttatttctgggtttgggttattatgaatgagactgttataaatacttgtgtataagtctttaggtggatgtatgtttttattttttctcttgagtatatgcctaggaatggggtgcatgtttgactataaaaaactgccaagttgtttactaaagcagtcatatcatttttacattcccatcagcaaagtatgagagctcaaattgcttcgcatgttaacacttggtattgtcagtatttttaattttagtcattgctgaaaagaaaaagcagaaaccaatgctttaagaatgttaatcacagaggcatctcagtacataagcacttgtatatatcattcaagaagtcaatcaatctgtgattccagtgagaaacactcaaatcctatcccaagacaccataatgaactggagagattatttttctccttatagaattaaacctaaataacccaagaaagatcatcttatttatcccactccagcacctttttcggatacctccagaggatatttaaaccgctctgaaaatagtaagtcttatgatcacagacctctaactctgatcataaaatgtactagatattgggaaaaaaatcacacaaagaaaagttagtaagagacattggatatatatgaaacacccatgtctagatgcatattttggcaagcttttaaagtagtgatacttctcccttttttaaaatttgatgcttcatgctgtttcaagaatggttaaaaattatttgcagacattgtcctaatttggacaaagtttgccagttcaaaatgaatagctggttttcatcaaccaaaccacaatagttgaagggcctggcctcccagaaggtgtaggcagttcacactaatagcaggaagaatattttcattccagggctcagctttcacttcacagactcctatgagagctgagctacaaagaggtcctagactgaataggagaataggagaaattcaaaatcctgcttagttttttaatgaacctgccattccctctgc

SEQ ID NO: 205262 - DNA, 287 bp, Homo sapiens
ggcaaagttcctccctgaccctgcacactgccccgccacctgctttactcaggacgctgcacgcctgcaattaatggccgcagactgtcggcgctgcccaggttctcggactacgtgggttttgagtgcattctcctctcctctggctcttggcagcctcgccagctctccctgagggctcagcggcagcgaacagtgagctcttttgctccagtacaaatctctatgttactcaagctgctagctttattcctgctgcgtgtttttacttggcctgtcccttccaa

SEQ ID NO: 205263 - DNA, 419 bp, Homo sapiens
cagaagccaagataagtgagagtgtcatgatggactgaggggtcagcagtgtttgatgctgccaagagggtccaggaagggaaggcctgagcaggtcctattggatttagcagcaggggtccctgcaatttcagggagcagtcagagagggggccatgtgtgcctggcacagtacacactgagtgaggtctcagtaaatccttgttgaaagaattcagtgactaggctatgacatgtactctggggctcaagcaatcctccccctcggcctgccgagtaactggaactataggcatgcaccaccacgccaagctaatttatttttattttttgtagagacaaggtcatgctgtgttgctcgggatgaccttgaactcctggcttcaggcagtcctcccaccttggcctcccaaagctct

SEQ ID NO: 205264 - DNA, 759 bp, Homo sapiens
tagctcgatcacacacacacacacacacacacacacacacacacacacacacgcacacatatggtatcttcatcatgggatgttgcaaagatgcaatgagctaacatatttaaaatgcttatggccgggcctgggggctcatgcctgtagtctcagcactttggaaggcaggtggatcgcttgggcacaggagtttgagaccaagctgggcaactggctaatttttgtatcttttgtagagacaacatttcgccttgttgcccaggattgtctccaacttctgagctcaagcaaggtgcctgcctcagcctctcaaagtcttggtattacaggcgtgatcccaactgcaactgtccagcagatgcattcttatcacttaagttgcttgacctagaattgctctctgccagtattggtggtacaatgagttggaacagaagccattttagtgaatgactgcagtgaaaaaaatgcaagaaatgtgtgtttaagacagagacagcaggagaagaagaatgacacagaataggggtgactttccaggccaaaaggggttgacttgatggaaagtacaagtcattgctaacctctttttatctgttttattgtcctgataaagagacaatatttcttttcaggaacatttaacctattctttattctgttgtttcttttccatatactaccgcagacctgcagtttttttctctttgtactgtatccaaatgtacctagttgatcgagctacgctaccgtgcc

SEQ ID NO: 205265 - DNA, 290 bp, Homo sapiens
ttcctctccccgccccggcctgcgcggtgggcaacagccccggcccggcgcctccgccgaggccctcccgctcctgggcactgcgcgcccagccagcagctggagtcccacgaggcgcgtgtgtcccccactcccggaacaagcaccacactggcgcaccgagggtgccttgtggggtccccaagtcatcccaagacatacgagtaatcatcatcatcctatttcgtggtgctcttggaggttttctccatctcatttgaagtcccaataaaagcagcttgagaaacttt

SEQ ID NO: 205266 - DNA, 366 bp, Homo sapiens
agggactgtggttgggtgtggaggggaggagcggggggctgtggggtgagacccctcccggctgactgggtgctgtgggcactgccggccgcatgccagggttcctgcctcgtggggactccggcctgggcgagtgcaggtctcagagcgcaggtgcggcagtgaccccaggcctcagtcctctcccctcctgggggtgggaagggaggggagagaggcccggaaggccggggactcccgccaggggactgagggaggcctcggaggggtgggtggcctgtctgggaagctgctctggatccggcgtctggcctggcccggtccccgtctgcacagcacacaccacggaggagaaggaggaatcgc

SEQ ID NO: 205267 - DNA, 525 bp, Homo sapiens
agtttccctgttctcatgacagtgagtgaattctcacgagatttgatggcttaaaattgtgacatttcccccctccctcttgctcactctctcctgccaccttgtggaggtgcttaaatctcctttgccttctgcaatgaatttaagtttcctgaggcctccccagccatgtggaactggggattagacctctttcctttataagttacccagtctcgaatatttctttttttctttttcttttttctagacaaaatttcactcttgttgcccaggctggagtgcaatggcgcaatcttggcccaccgcaacctccgcctcctgggttcaagcgattctcctgcttcagcttcctgagtagctgggattacaggcatgagccaccacacccggctaattttgtagttttagtagagatggggtttctccatgttggtcaggctggtttcgaactcccgacctcaggtgatccacccaccttcacctcccaaagtgctgggattacaggtgtgagccaccgcgccc

SEQ ID NO: 205268 - DNA, 755 bp, Homo sapiens
ccacctgacccagcagccactattcaaaacttcattttcttgttcagcttctctgtcttttgccgactgctatggtctgaatgtttgtgtccctccaaaattcatatgttgaaatctaatccccaacctgatagtgttaagaggtgtggggcctttcaggcctctgattaaatcagagggaggagcccttgtgaatggggttcatgcccttataaaagaagctgcagggattttgtttgctccttctgccatttgagtacacagctagaaatggcatctatgaagcagacagtaggcccttaccagatgccaaatttgttggcgccttgatcttggatgttccagcctccagagctatgagcagtaaatttctgttgttcacaaattgcgcagtctaaagtgtttcgttttactaggctgaacagactgaggcactggcccagggtttagcattcagaagtgttgccccaggcatcagcctctggctgccagcctctacagcccagctcactttgtggggatgggtggggtaggaatgtccttagggacttgtgagataagcagtgtcttcagagcatgttttagccaggatctttttaaagacattctttaatcctatacggccaattgtctccttttaaccactattttctaatgctatctttaccgtgcagaatgcaagtcacagataatgtaacccaacaacaaacacaattctcccccaaaaaatcaatgcaatttcctaactgtaatgt

SEQ ID NO: 205269 - DNA, 459 bp, Homo sapiens
caatcaccacctgcagtcacatagcgttgcagggaaagctgagtgaaatgtcgtatagaaggtgcctaacatagagtgacattcagtagataatcaataaggggtaataactaaatctgattacatacttaccagagttatccttcactatccctcaggactcaatctaacaaataatcctgtcagcatgttctaaatccaatcattcagatataaccctagagatttttgctatttctgcattcaagtctgcactacactcaatactttttcctcattccaagtaataactgtaaaatcatagttttcacatgcaagttttatatatttctaatccaaattaaaatcatcagtaactattaaaatttaaaagttcatgcatgtgacatagcacctaaaagtaactgagatgtcaccggaagtctgttgggtctactttgggaggactcaggtggtgtg

SEQ ID NO: 205270 - DNA, 291 bp, Homo sapiens
ttcatcgctaaatcctcataactaatactagagtctactaattatgactcagaatgagaaaaagagataagagcatgagtaaaattggtgctgccagaaccaccaaaaaaagaattccaaataacaaaagattttgactctatgtgaagaagagagttttaaaacattcctaaactggcaagagattagtagctaaaacccacaaagcacttttgtaaatcgacagcaaaaaacagggaaatcagtagaagatggacaacaaatagtttgcagaaaacttggtggtaataa

SEQ ID NO: 205271 - DNA, 194 bp, Homo sapiens
aaggagaacaggtttccctgtgtgctctgagcgctgctcagaaagaaaacctcactgataggacctccacccagacctcttccatctcctgtggccactggctagagaattcaccagcaaagcaaaactgttatgctgtaaattccagacagagggtactacccagcatgccaccttctctttgatctccccac

SEQ ID NO: 205272 - DNA, 307 bp, Homo sapiens
agaactcccttttgcatttcttgtaacacaagtctaatagtgatgaactccctcagttttgtttgtctggaaaagtctttgtccctcattggtgaaggatagctttgctgcataaagtatttttggttggcattttttttttctttcacaaactcttcccacttactcctggtctgcaagatttttgctgagaaattcatcagtggtcttatttagcttcccttgtatgtgatatgctgcttctctcttgctgctttaaaaattctctgtctttgatttttgaaaatttgattataatgtgtcttgg

SEQ ID NO: 205273 - DNA, 413 bp, Homo sapiens
tataaaaatgataagcaaattaaaaaataatacagtgtatcagaaagttaccctatggcagggtagtggcaattttgagtgacaggtgggttggtggcttggaatgcacaggccaattctgttgaaaaagtgtaaggactttatgtaaggacttgtagttaatggaagagtgaatttctgtgtatttgagtgaagagcgcagtagtcatagggaacagagatttaaaggcccaaagatggaaatatgtctgatgtgtaggaagaatagcaacgagactggtgttgctggagtggaataaatgagagagggaagtaggagatacaggttagagagactataggtggccagatcatgttaagctttgaaagtcatggtaaggaggtggacttttttttctgactgaggtggtgag

SEQ ID NO: 205274 - DNA, 500 bp, Homo sapiens
aggctcccctacctcccatgaccgtctgtgagcttcacctgtgagtggcaggtgcgcgtggagtcagttcccctccatgcccgcctgcattcctacccggagacctccggccgcggtgggaattgccctgctgttttcattactgcaggtttttcttctgtatttctgaacccctcatatctcagggaaggaaatccagggagaagtatctgttgcgtccccatctgttgcattttctgagtctccacgttaatgaaagagcagccatccagtttcctgcagtgccgagagtcctcgggacctgtcgttgttctaaaggacagaggacactgttcagatgtgacgtctgtcgccatttctgtctcctcttagcaaactttaaagcccggaaaaccttctattttcaaagtcggaaaattagattacagcaaagccataaccctgtatctctcctaaccttgctccctaatcaggaataaaagggaaattatctgaagaat

SEQ ID NO: 205275 - DNA, 433 bp, Homo sapiens
tgcaggttccttatgagacctgaaactatcacctgcccctgaattttttgtggaaaaattgtcttccatgaaaccggtcccttatgccaaaaaggttggggagtgctggagtagaaggtcataactgataagtacttcagagattttggacaattactgttcaattttttgccattcagacatacctgatgctttcagaaggttttcttttttttttcttagtatgagtatgttgactgtggcactgctattactaggaaaaaagtgttcctaatttaccagtgttaatcatttcatgttttcattgctagctcttatcttttttttctgtcatcttccttaatgtggtttatttaaaaaatttctttgactggtcctgtttcaaattgaatgattatgctgttgaaaagatcagaaatggtcctggctctca

SEQ ID NO: 205276 - DNA, 439 bp, Homo sapiens
acatttagaattcagacccacaaaaaaatcttcttaggaaagagtctctcattaccgacatgttttaaatttttgcctctgataatagtcatacattattcctacagtcaatgtattcccttactgcttaaaaagatgtggtggtgaaggtaacttaaatttcactagcattgaaaagtatagatgttgtaatgttagtaaacagaggtaacttaaatttcactagcattgaaaagtatagttgttgtaatgttagtaaacagaggaagattatgaaagaaaacataataagtatttttgttttgcttttttgtttaaataatgttattaagggctgttattaaagtgtttattttacagagggctaataaacttactttttcagaaaatctattttgtttttccggtgacccatttgaattggacttttaaatagaaa

SEQ ID NO: 205277 - DNA, 132 bp, Homo sapiens
ggacactttagaagtgcagtctctcccccttgctgacttaccatgatgtcggacacccctcacaagacactggcccaatgtgggttgtcttgtccgatatgtgtttgtagatttttgtgctggtgaagggag

SEQ ID NO: 205278 - DNA, 972 bp, Homo sapiens
cgacctagaggaccctccacacctagtcaaagcaaacaacaacaaaacacactaggttttatcaacagcatcgaactgattaaaatattccatttttccctggccaacattaagacattcagacttcatgatttaacagttaagacctttcattaactggctcagacttggttgtgtgtcataatccaactgcaccacacattctaggttcctaatcacaccgcaccatttgcaaaccttaagatataaaacgatgttcaggactttgcttttgaacatacctttctctcatttagaaagctattttctcaactgcttgactatttcttcacttataatgttctatccctgggccattcaaactaaattcatcttcttgtcactactttatttcctggataagtttattactcattttttcttcagtactgatttgttaaacacctacattgatttagacacaagagtaaacaaaaacaaaccaaaagcagcctttatgtagcttagattgtatatgaggattgaagatgagatagaaaaaataaactatatatatcaggcggtaaaaggatccaccatgagaaaacaaaagagagacaaggaagggaaggagtatcaggcagtggggctgggtttgcaattacatgtgaggtaattagggaagaaatcactgagagggcagtaagtgagcaaagactttggaggaggtgtgggtatctaggtgaataatgtttccaggcagaagaaagagcaaatgcaaaggcccagaatcgggagtatgccttcttccagtgttttgtttatttttttattttttatttttgagacgtagtctcactctgtcaccaaggctagagggcagtggcacaacctcagctcactcactgcaacctccacctcccaggttccagtgattgtcctgcctcagcctcccaagtagctgcgattacaggcgcccaccacgacgcccag

SEQ ID NO: 205279 - DNA, 773 bp, Homo sapiens
tagttggtatatgtttagtgtatgtttaactttttaaaaaactgccagatgttttccaaagcggctgtaccatttaacattcctatgagacagtgtatgaaagttccagttcctcctattaagtcttgaccatcaggtaatgttagccccaagtttgttctcttttaaagttgtggtattcttgtcctttgcttttctatataaattttagaattggtttgtcagtttctcccccttccctccaaaaaagtctcagatcttgactgagattttattgaatagagattattggaggaagacagtattgagtcatgtaacccataataaggtatatctccatgtattcgatattttctctatcatatttaggggggttcgggatacaggtttattcacatcttttgtcagatttatctctgagtgtttcattaaaatttcaagttccaattgctcgttgctttaatatatacatatatacacacacacatatacacacatatatatgcacacacagttgaattttatattgatcttgtatctagcaagacagttaatcctgtaccgaatgattattcagtatgactttccagatgactgtagccttttggattttctatataggcaatcatgtgcagataaagacagtttcacctctttatttaatttttttttcctgcctgattgccctggccagaacctccagtatggtgctgaatagaagtggtgagagcagacatccttatcttggttctgatcttaggggaaagcattca

SEQ ID NO: 205280 - DNA, 471 bp, Homo sapiens
taacactttcatcccattttagatcctaggataaggcaatagtccagagccctggaaagcctccacctccagcagttcaccaggccactgaagccccaggatggagtttctctccaagacacccttctggtaatatacatgttacgtgcatttcacttatcttctccaagttacattccagtaactaagcttcagaagcttcttatgaattgtttattctgtgttttaaagctccatcagctgttaggatgatttgcaatatttttctttttggttaagcaggattggtgagcattactgggccttttggtggaatccttgctatttaaaattcctgctgctgggattaatggagataatgtctttgaaagccttttgtaaactgtaaagtcctagtcaaatgtagtgtgctgttatcacattaaccatcatagcaataaccataaaccagctgtaatgggggctttaaaa

SEQ ID NO: 205281 - DNA, 514 bp, Homo sapiens
tgagccaccgcacccagccagaacttcaaagttttaaaaatatatacatagccatttctgctatatagccaggacttttacccaaaatatttatttctacagagggcactttgtttcatagcaaggcatttatgaactagaactttggcttaggaaaccgttctggttttcacagttacccagttgtcaacagttatactaacctctctttatggaacatgggggacaaaggaagaattgcttgatgctttcattttatcttccttctttttaggaattatatctctctagtggattgttgggtatgactttgttaatttttaataatgaatgtgtgtgtgcaactaggggaaaagttagagattacagaactgaattatgagagtttatagaaagtagcttttgtttaattagaaaaggtgaatattttattcatgggaaggatagagcttaggaatggttaaattcctccattctcaattttgagattttgaaccgcgtgcggcgtagaata

SEQ ID NO: 205282 - DNA, 114 bp, Homo sapiens
acattcacttcaccaagaagacgtaacaattctaattcatattcactttaacagcataacttcaagacatacaaagcaggccgggtgcagaggctcacacccataatcccagca

SEQ ID NO: 205283 - DNA, 370 bp, Homo sapiens
actttttaatttaacgtttttaacacgttaaatactataatgcttcattgaatgcacaatagtatttaacgtgttaaaaacgttaaattaaaaagttaagtctacacataatttcaaagttttaaaatgtactggattgtatcacataaaagtacaattagtaaaataatacactattaaattttaactaaaattaaaaatatttttctctcataatgtagagtattaaactgaacacctacttcatgcattgctcaatattataagttaatcacaaagagcatccctacttagattttcatcatacatcttacattttaatgtctttactctttcatagaagagagaatatataacgcccacctaataa

SEQ ID NO: 205284 - DNA, 583 bp, Homo sapiens
tgtgcacacacaaatgttataagcaatttttaagaattaggtttgagagaaaaagaaacccatggccccttttcataatatacggcgaccttctacatttctacaatagttctgttaaaaaatgctgttacccttgggaaaatcattctctcccttacgttcctgcaggatcttatgttcctaatgtttatctcaaagtattagagatagtttttatctgcctttctcttaacagtgagttcccttagagtaggaaccattcataaacatgaattcatgtttataaccccacactgaagaggaagcaacagtgaggaaaagccaaaacgacttgcaatttcacatttagatgtgctatgggtctgtttactatcagggaaatcactaacacctccctcagagtaatgccttcccatttctcaagccaggtaactgacaagagcttcattttccttttacaacacagatagttttaagtggtgggtcaggaggaaactgtatttttatttgaaaggtactcattgctactaaatagaataggctgccaatacagttggagcactattgaaaaaaaattaaaata

SEQ ID NO: 205285 - DNA, 399 bp, Homo sapiens
atcctaggatgagaaaggggttgctaaataggttttcttggacagtgggcaagctttcaaatatttaccagtcacatgtaccgtggcatgctgggtataagtctttctaaggcggagaccatacaatctatttcttttgagtctctctcatagtacaattatagtacttcttacacagtgggatgatgaaatatttgtggattgacaggaacatactttgataactgagtcctttccgtagcagtttgacgggtctaagacatggttgtgccgaaatgtgcatgagagtgtcgggtgtgtgtgcctggcgatagggggccttgagtttccaaaggctcttggctgctgctgcctcacagattctccatgctgtgtggctgtctgctgaggggcacatgt

SEQ ID NO: 205286 - DNA, 478 bp, Homo sapiens
cctcagcctcccaagtagctgggaccacagttgtgtgccagcatgcccagcgaatttctttttctttttttttgtagagatggggtttcaccatgttggccaggctggtctcaaactcctcacgtcaagtgatccacccgcctcggcctccccacagtgctgggattactggtgtgagccagtatgcccaacctccccacctgctgtacttctgacatggtctgttatttaaaaggaagattataagtgaagaagcagacttaggagactcatcctaatgtgtgtgcttatgggaaagccagccttttaaaacaggaatcccatcaataagcagacccccaggacagcgcgtgagtgttgatgttggtgaaagcagatgtcttctattttgcagggacagcctgacaggcatgtttacgttaagtgtctggatcctccctgcaggcacatataaatttcacccttttctactcagagg

SEQ ID NO: 205287 - DNA, 264 bp, Homo sapiens
tctactccagttttagccttcggaataaagattgttgtataactccactccttatcctcccctcctaaccaaagtattctccaatatttcttaaattcttggggtattttctaaactttggtagtgtattgaaaaacactgcaatttctatttatgtctgaagttgtgggaaaatgttttatttctgtaattttaattttgaaatgtgtatttgagctatttgtagtaaatcattacttaataaagtttgttgaggtttatata

SEQ ID NO: 205288 - DNA, 695 bp, Homo sapiens
gaacaatctgacagctgagaacaaaatactcaattctgaactggagaatgggaaacagaaccaagaaagactagaaatagaaatggaatcataccgttgtagactggctgctgctgtacgtgactgtgatcaaagtcagacagcaagagacctaaaacttgatttccagagaacaagacaagagtgggttcgtttacatgacaaaatgaaggttgatatgtctggcctacaagctaagaatgagattctttctgaaaaactttctaatgctgaaagtaaaattaacagcctacaaattcagctccataacacaagagatgctcttggaagagagagtttgattttggaacgtgtgcaaagagacctcagccaaacacagtgtcagaagaaagaaactgaacaaatgtaccaaattgaacaaagcaaactgaagaaatacattgccaagcaggaatctgtagaggagagattatctcaactacaaagtgaaaatacgttgcttcgacagcaactggatgatgctcacaagaaagctaacagtcaagaaaagacaagcagtactatccaagaccagtttcattctgctgccaaaaatcttcaagctgagagtgaaaagcagattctttcactacaagagaagaacaaggagctgatggatgaatataatcatttaaaagaaagaatggatcaatgtg

SEQ ID NO: 205289 - DNA, 319 bp, Homo sapiens
ctgatgatccgcttaagaggaagacctctcctgacactgcttctctggcctaatagatctgaggtgtgtcccttgcttgtgtctgggggttatatgaggatgagtcactcctagtgtccgaagagtagacagggagagacagaagatgacataatggagtctagagagaactgacaactgggagcttctgggcactctctgacaatggtcctctgctataatttaattgttcattatgacctgtttccctcacaagaccacagtctccatgacgacaagatctttatctcattcactactgaatgccccacacttaagc

SEQ ID NO: 205290 - DNA, 279 bp, Homo sapiens
agttcttccctgccctccaagatcagccatacgcaatggaggtggacaaggatttacactccccatataactacagatgacaatggagagaatcgcttcaccagccctctgaaatcatgcaggctggcaatgggacactagccactttacaggaaggcactactgttagtgtgatcataaaaccctgtccagtcatcacggcagaaggcagtgccacgtgacaaaatggctttcatttccagtccttggatccatcccaaatgggctttttaaaaaaga

SEQ ID NO: 205291 - DNA, 396 bp, Homo sapiens
tggtttcctagggatgggatgtgggcaaagagagacaaaggaaggagggattaccaaggagcacagggaaacttcgggatgagggatatgctcattatcttgactggtgatggttttgcaggtgggccaaaactaatcaaactttacacttcatctatatgaccagctatcatatgtcaattatccctcaataaagctgttttaaaaacatttagggtatatctactggaaagtaaaactgcttttaattacagactatatcatcatgtacatagaaaaatccaaaggattctgcaaaaaagctactagaaccactgacttcatcaagatgcaggtacaaagttaatattcaaaatcaactatatttctatacgagagcaacaaaaaatggaaaaa

SEQ ID NO: 205292 - DNA, 534 bp, Homo sapiens
gctcaagtgattctcctgcctcagcctcctgagtagctgggattacaggcatgcgccaccacacctggataatttttgtattttttatagacatggggtttcatcatgtcggccagactggtcttgaactcctgacctcgtgcaatccacctgcctcagcctcccgaagtgttgggattgcaggagtgagccactgtgcctggccctcaatttttaacatgtatgtttccattcattgctgagctgtttaaccttatataatgttaaagaaaacagacggcagctaggtaacaagagccctgtcaatgggcatccccttctcctatgttccgtttctgggaatcaacttaaagagaccattaaaaaccagatttgcacaaaatcaaacaaacatattggttgaagcatttaaaagaatgaaagtttggaaataatctcattattcaatagttattcagtagttgcttaataaaatgtggcatatccatttgatggaatattatatagcaattaaaatgatatttcttaaaacta

SEQ ID NO: 205293 - DNA, 497 bp, Homo sapiens
  misc_feature (7)..(7): n is a, c, g, or t
  misc_feature (26)..(26): n is a, c, g, or t
  misc_feature (49)..(49): n is a, c, g, or t
  misc_feature (59)..(59): n is a, c, g, or t
  misc_feature (90)..(90): n is a, c, g, or t
  misc_feature (92)..(92): n is a, c, g, or t
  misc_feature (96)..(96): n is a, c, g, or t
  misc_feature (101)..(101): n is a, c, g, or t
  misc_feature (116)..(116): n is a, c, g, or t
  misc_feature (125)..(125): n is a, c, g, or t
gagtaanaaaatctatagctatgaanagcgtaaacagttgagtctctanctgtcaattnagtggttttcagtatatccacatatatgtgnanccgncaccncttttaacttcagancattttatnacccccaaaagaaaccccagatccatttcttactctagctgttttgataggtgtgcagtgctatctcattatggttttaaggttttgctttttaaaaagttaagatacgatttatatgccacaaactcaccctggataagagtagatttcatattttttgttctttaccataatttaaaaaaaatctatagctttaaaagtttttgggtagagtaaaaaaaatctatagctatgaatagcgtaaacagttgagtctctaactgtacaattaagtggttttcagtatatccacatatatgtgtaaccgtcaccacttttaacttcagaacattttataacccccaaaagaaaccccagatccattttactgat

SEQ ID NO: 205294 - DNA, 376 bp, Homo sapiens
atttctacatttaactcagtactgggatctgggccatcctggatgggttaacgctggtggccgatgtgcattacaggattctttgttaagactctttcttttcctctgtccaaacaagcagtgaaatcacaggagatagaaggaaaacactgctgtgatcatcacccaattaggggcttttagcaaactattaataattccccaatgttgagctatgtatgcacaacaccaaaacaatccagtccttgcaataggtacagctagcagtcggctgtcaggtcgacaaaactttaaaaagccacctgcaaagttattaaccttaaattacaagaaaaaatgaggctcaatctactcttatcaaactggagtagaggaa

SEQ ID NO: 205295 - DNA, 969 bp, Homo sapiens
  misc_feature (862)..(862): n is a, c, g, or t
taatggttgttgtagtctgatgacatcatttcaaacctgggtgtttttatggagaacagagggagaatgcctgaagatgaaatgagccagcaggatgtctaccccacctctaggtctagtggtacaaagggcatgtgaaatccaacagccatcatttgagagagctgccaaggaagctgcatccacaggggacagtcaagttgcaacctgttcagggtatgttaagggctgtactaaatgtgtgtccagggtgcttgggagtacaaaagtaaagatttgtaacccaagctagtcattaagcaaggtgttctttttggaggtagctcattgaatgaggtagaaagctcattctaagatccgtatgaaatagaattatatgattaggaaattaacagtccacagcattatagttgcctggatacgatggctcactcctgtaattccaacactttgggaggccaaggtgggaggatcacttgaggtcaggagtttgagactagcctaggcaatatagtgagtccctgtctctccaaaaaaaaaaaaaaaaaaaaaaaacaaaaaaagggggggggggcaaaaaaaaccccaggggggccccattctacacccgtttttttggacaagggggcccataggagagcagaaaaaaggaaggaagggccgcgcgttgaaacacggctgcgcggggacacgtcctcggcggatctggggaaggaccccacgccggggcgtggcctcgtccgacccacccccaggaatttagaccgagggaaaataacttcacggcgttggtcgacacccagccatgctgcggctgagatgtgctcgcaatcatgaaattagcgcgcgatgatcagataancgggaagacacgactgagcgcaggcagagcaggcagcgagcacgacgcatacgaccacaagaaaggcactgcagccagaagacatgctcgcccgtcgctacggacta

SEQ ID NO: 205296 - DNA, 512 bp, Homo sapiens
gtgaatgataacttcattaaagggggaaaggtagaactgactgcatttgaaatagttggttcagatatgaggccacgtttggaaacagtacctaatatcttgtctcttggaacaagtcccaaggatagcaaaatcttcttggaatgagtaagaaagggttattaattttcttttaaaggttgttgatctatagagtttatcctatatgagtacctttttttttttggggttggacaccatggctcgtgagcttttgggaggccaaggcgggtggattgcttgaggcaggagtttgagaccagccttgacaacatagtgagaaccctgtctttacagaaaataaattaaaaattagctgggtgcagtggcacgtgcctacagtcccagcaacctgggaggctgaggcaggaggatcacttgcgcccaataagtttgagattgcagcgagctttggtcacatcactgcactgcagcctgagtgacagagcgagaccttgtctcaaaaataaacc

SEQ ID NO: 205297 - DNA, 973 bp, Homo sapiens
caggatggcctcaatctcctgacctcgtgatctacccgtctcggcctcccaaagtgctgggattacaggcgtgagccactgtgcccggcctttttatttatttatttatttattttttgagacgaagttttgctcttgttgcccaggctggagcacaatggcgtgatctcagctcactgcaacctctgtctcgcgggttcaagcgattttcctgcctcagctttctgagtagctgggattataggcgcctgccaccacacctggctaattttggtgtatttagtagagacggggtttcaccatgttggccaggctggtcttgaactcctgacttcaggtgatccacctgcctcggcctcccaaagaagataatgacttctacagaactgctgaatgggtacatatatgtaaatattctcacctgacttctgcttttccctttatttcactgggaggtattatatttttagtgtatcttacggcctttgaggacttcttagtttgagtatattttagctgtgtgcctaaatgtctttacagtgtacttaaggagttggatttttagaaacttgccatatttagaaatctattggattgaacatagtttgaaaagcaaagtataagttaattcctttactatatacttgtactattcttttcatggactttctgatgcttgctgtttgtgcacataggctttgctttttgtatttatttatattgtatgaatctaagaataaaagagagtgtgaacaattcagaagactacagatatatcttgttaggttgctttccaaaaggttcccagttgtagtcataccagcagtgtaacaagcaggttttttgtttaaccacactccaattagcatggaggatcctttaaaaatatttgctaaactgataaataaaaaatactatctttacttaaatttgcattgggaaagtattagtgaagttgaacattctcatatgt

SEQ ID NO: 205298 - DNA, 652 bp, Homo sapiens
caggatggcctcaatctcctgacctcgtgatctacccgtctcggcctcccaaagtgctgggattacaggcgtgagccactgtgcccggcctttttatttatttatttatttattttttgagacgaagttttgctcttgttgcccaggctggagcacaatggcgtgatctcagctcactgcaacctctgtctcgcgggttcaagcgattttcctgcctcagctttctgagtagctgggattataggcgcctgccaccacacctggctaattttggtgtatttagtagagacggggtttcaccatgttggccaggctggtcttgaactcctgacttcaggtgatccacctgcctcggcctcccaaagaagataatgacttctacagaactgctgaatgggtacatatatgtaaatattctcacctgacttctgcttttccctttatttcactgggaggtattatatttttagtgtatcttacggcctttgaggacttcttagtttgagtatattttagctgtgtgcctaaatgtctttacagtgtacttaaggagttggatttttagaaacttgccatatttagaaatctattggattgaccggtagttgccgcaagctatccgttcatacaccgcggttgccaacaattgacc

SEQ ID NO: 205299 - DNA, 270 bp, Homo sapiens
gtttccctttagctgcataccgtaaaatatgatctatattgtttttatttttttttcgttcgagacattttaaaaatttttcctgtggtttcttctttgctcctgggttgcataggagtatgttgtttcctttccaaatgtttggggatttcccccaaatttctttcttttattgatttataatttaatttctttggcgcttcacatgatctcaattttttttaatttattgagacttgttttatggtttactagacagtctttccaaca

SEQ ID NO: 205300 - DNA, 461 bp, Homo sapiens
tgatagtgtcatacaaaaaggtgagtaaggctgggcgcagtggctcatgcttataatcccagcaatttggcaggtccaggtgggaggctcacttgaggcaaggagttcaagagcagcctgagcaacacagcaagaccccatctttacgaacagagtttgttatttttttaattagccgaacatggtggcaggtgcctgtagtccagctactcagaaggctgaggtgagaggattgcttaagcccaggagttcaaagctgcaatgagctctcatcgtaccactgtactccagcctgagcaacagaacagaaccctaagtctcaaaaaaataaaaatttaaaaataggccaggcatagtggctcacacctggaatcccagtgctttgggaggccgagataggtaaattgcttgagtccaggagttcaagaccagcctggggaatgttgcaaaaccctgcctct

SEQ ID NO: 205301 - DNA, 397 bp, Homo sapiens
tgatcgccaacctttcccccaccagctaaggacatttcccctcctatccctaccataaaaatcactagtgttccttcaaaagtccctaatcatgtctccagaaaaagaaaggggctgggcttggtggcccacacatgtaatccgaggctttgggagacaaaggcaggaggatcacttgagcccggagtttgagaccagcctggccaacatggcgagaccctgtctctccaaaaaattaaaaaattagctgaatatggtggtgcacacctgtgtcctagcctcaggaggctgaaatgggaggatcccctgagcctgggaggtcagagctgcagtgagctgtgatcacaccactgcattccagcctgggtgacagaaagagaccctatctcaccaaaaa

SEQ ID NO: 205302 - DNA, 416 bp, Homo sapiens
ggtaattgaatcatgagggtgggtctttcccatgctgttcttgtgatggtgaaaatgtctcatgagatctgatggttttataaaggggagttcccctgcacatgctctctctcttgcctgccaccatttaagacgtgactttgctcctcctttgccttctgccatgactgtgaggcctccccagccaggtggaactgtgagtccattaatcctctttataaattactcagtctcgggtatgtctttattagtagtgtgagaagagactaatacagttccacagcactgactggaaaaaattatcttggccaagaaatggctgaagaaaaagattagtatttgaaagtgctggatttatgctttgtgttttttctaacaaaatgcccctacttgtgagccactggtgccttagaagg

SEQ ID NO: 205303 - DNA, 447 bp, Homo sapiens
caggagcatgttgtttaatttacatgtgtttgtatatttttgagagtttctcttcagattgatttttagttttattccattgtgtgaagatacttgatatgattttgatttttttttaaatttattgagacttgttttgtggcctgacgtttggtctgtcttggagaatgtcccatgtgctaatgagaaaaatgtatcttttgtggttgttgggtagaatgttctgtaaatgtctgttaggtccatttggttttaagttcagtgtttctttgttgactttgtctgtctcagtgttgaagtcccacattttgtattgctatctgtctcttttcttaggcctagtagtatttgttttattaatctggtactccagttttgggagtatatacttaggattgttatatcttcttgttgaattgatccctatgtcattatatactggccttt

SEQ ID NO: 205304 - DNA, 350 bp, Homo sapiens
gtcatacagtataccatgcagaacatagaacaaacattttgttctaagaaacattaggagaaaaagggtaagaaccctataggaaggcaggaggaatgagtcaaggacacattcttctcctcagttgtgcccaggaccatgacattacctatacttatgtcatcatatgcccatatccctaattcctcttagttagcatctgctttagtttttattatatttttatatgctttcagatttttccagctaatacatagcatatcagggtggaaatcaatgctgaagagtcctacttcctttttttttttttttgagactgagtctcactctgttgcccaggctggagtgca

SEQ ID NO: 205305 - DNA, 736 bp, Homo sapiens
ctactttcacatatataaataggaagcttgcctctgacattgatcagaagctgtaaagagaaaggcttttctctgaaaaacacggaattatctccagaaactgggatcctgatgttggcctctcttctttcgttccttcctttctctctctctcttcctccttttctttctttctctcccctcccccattctactacttcatttccctttcagccttttcttcctccctctctttttaaaattgaaaactttcagttattcatagttaatagtcctttagatataacagtaataagtataatacctccttagagctcatttgagtcatctctagtgtatccagccagtattccctttcatgtccatcctttaagctggaaacttatactttagtttgcagaaagaattcatttcagacttcagaggttaataaattaaattgcttgctagcatggcagctcatgtctgtgatcccagaactttgggaggctgaagtgggaggattgcttgagcccaggagtttgaaaccagactgggcagtatagggagacttcttctctacaaaaaatttaaacaactagccaggaggcccaggtaggttgatcacttgagctcagaagttttagaacagcctgggcaacatggagaaaccctgtctctccaaaaaatacaaaaaattagctgggcatggtgacacctacctgtagtcccagctacttgggaggctgaggtggga

SEQ ID NO: 205306 - DNA, 436 bp, Homo sapiens
ttcaagaaatggagcaactggccactggcgatgggaaggcccatggcagattctgcaaatctctctggagtttctgcttgagttcctgttcgccgctgtgagcccctcactctttcgttgctgagacaccttcaccatggctcaggaggccacatgctattcctcaggtggcggagggcagagaccgagggagtcggtaaaaaggagagggctggaaaattcctcttagcataagaataaacagtgatttgaatattcagttgtgagggttataaataactgtgagttttcattgacgtgtaagcggtgatacattttgtacaataattagttatttgattacttttgttttagcctgaagtagaggacaattgacaaatgtgaatacctctgagactgatggggcgcagtaaactaactttatttattacaaaat

SEQ ID NO: 205307 - DNA, 499 bp, Homo sapiens
ctagaggtcacgctgatcgcttagatctctgttgtatgttatgctggtcagttgtgtctggattccagagggaggaaggtagaatgaggcatgttgacacctccccttcccatcatggcctaagctggtcttttcagtttactttggaatgtccttgctcaacaggaagggtccattcagtcggattgggtggcttagaattttatttttggtttaaatctcaactatcacagcagctgggcatggtggctcatgcctataatcccagcacattgggaggcggaggcaggaggattacttgagcccaggagttccagggtgcagtgaaccatgatcatgccactgcactctaccctgggcgatagagcgaggccctgtctcagaactaaaaaacaacaaaagaatatgtcataggtgctgtattctttttgtatttcatcatgaggaacataataccagctaccagcttgtctcatttgtaatcctaatactgagattg

SEQ ID NO: 205308 - DNA, 543 bp, Homo sapiens
taagaagtcaaaactataatcggcttgagttgaagaatccaaggatctttacagttttgtgacctgtccaaggttacacagctcaccttttcattttgcactgggcccaagttatgtagccagcctgcttagagatctctacttaccccagttttctgatttataaaacaaaaataataataatattgttaaattaaatgaagcctaaagctgcctccctatgtatttttaatttggcctaaaggtttcttcgtacagagtgaactataacctgactagatgtgtgatctactcttgtgccaatcatcaagttttaaccaatcgaagggagccaactgcttaaaccatgttcaaataaggcaaatgtccagctgtaaccacttcagctgtttctgtgcctcacttctgtcttctacacatcactttcctttttctatccataaatgttttttgatcatgcagcagcatgaagttgatctgaacctactttggtttgggagactgcccaattcgtgaatcaattaaactgttaaatttaatttg

SEQ ID NO: 205309 - DNA, 443 bp, Homo sapiens
aaaacagttttggagactggtcacacaacaacgtgaatgtatcagaactgtacactcagaaatggttaagatgctaaattttctgttatgtattttttaacacaattttttaaaaaccatgcaaactatgagaatttcacagaaggagacaacaacaaaaaaacccacatagaacattccaagaagagaagcatgccctgggtggaaccacagccaggcatggacatacacggatgtgtttcccttcatgactgcatgtggccttgcgtatgggtccttggggggcccacagccctacgtgggcgtacacacagatgtgcctccctcatgacagcatgtggccttgtgcataaaaccgacagcttatactttccagggaccttcagtcattttcaagaattgctttgactgtgcaagtcctgcttcatggtagaccttacaat

SEQ ID NO: 205310 - DNA, 612 bp, Homo sapiens
acagagcgagaccctgtctcaaaataagtaaagttctacagtggtttatccagagataatcactgttaccagttggttgtattatattttcagatgttttcttgactgatataatgaataaattaagtatctaattggaacattataacttgacctcttcaacttcgtagtttagtttggtaagataatatggatttatagtatttgaatgatcagtttattgcttaattatgtaaaaacctttctattgtcaacagtcctacagagaacattctcagacataagatattatgcaattgtccaaacattaatttatttaaatattttaatgtttaatcaccagattattaggtatgtttaattttaaggttttaatgccccctgatttccaaccccagacgataactgtttatcttctcaacaatagaatatataagccaattttcccatattcttattactcttagatacattgaccatttcccaaaattctaagcaatcacaagttttaggtcctgtgtaattacacagaaagtataacattcctaaaagtcatatcacagattctaggaaagttgttaaggagccttgttattttaggacacatcaaaa

SEQ ID NO: 205311 - DNA, 348 bp, Homo sapiens
cggtggccaaatgggaattctttcctctgccaaaatcttgcttctgcaactcaggacagtgggtgttcagtccacagggtgggggtgtgctccagcacctgccagcctgtcaagactgacagcatcaagaccctccctgctgcccgtggagctcctgcagtcactgagatgagctgtcctggtttactggctgccaactttgagagatgacttaattaagggcatgaagtttttcatctcaagacagtgagggagctggacaagagaatacccaaggttttttttgttttgttttgtttttgagacagagtcttgctctgtccccaggctggagtgcagtggtgcgat

SEQ ID NO: 205312 - DNA, 279 bp, Homo sapiens
ctgagaagaaataactataaacaaggtgtccattttatgaataatacaatttatggtatgacagaagaccaagggacataacacaaatttggagttaaagaaattaacagacattctcaataattcctcagctattatggcagagatgctgggacaatggatgtccatgtagcagtacttttttttttttttttttttttttgggagacggagtctcactctgtaaccaggctgccctgcaatggcgcaatcttggctcaccgcaacctctgcctcccg

SEQ ID NO: 205313 - DNA, 445 bp, Homo sapiens
tcatttctccctgacacagtgcaatggtcattacacagaatagcccataagtcagtgttagaaaaatattcaaaggagagaagagaataaagcggccattaaactactttggctgaatctctgagtgcttttgacatgaaaataatcatgaagaaaagaagaggtagtgtcaggtgatgacactagtagataatttgaaagaaaggaattgctatgttcattaaaagtaattctagatggctgttggaaatatctaatgtgctgcaattaaagtgaatcaagtcataactgagaacaggctttgggaagtggtttgaccctttcacaggtgggtgcccctaagtgtgatccttttggccactggtcccaccttcaccctgaggcgtagaacttgatcctaaacatggcaacatagagcctttcttgtcagaatatcatgagaact

SEQ ID NO: 205314 - DNA, 650 bp, Homo sapiens
gcacttctaaaagtgtttcatagaacattaatttaatgttacgttgagacattacttgaaaaaaacatgttaggcactcaaataaatatggaaatgttagactaaacaaagttaaaatatgtttgctttactgcaggactttttagagcatttaatccacattgctgccttctaaaaagtggttgtaatacgtatgttaatgctttactggcttatttaaccacagaaccttttaaattttcctcatgagggttttaattgctaaatattaaaagttttcttctgaaggaataggtagacctggaggattcctgtgatgcaggagattactatgatgaaaatggtgtttgggggatggttttaggaggtgtatagaaggtaaccctgaggtaggagggagtgaaagaagagagatttttagtaatggacacaggaaagctggctacatactgggccagagagacatgaacctgagagaacatgaaaggaggtcattgatgaaattaggggatgcttggggtgggaggcaaatctgagtccagtatgtctcccaggtctgggtggctgtgagcacaaatgtgagcataatgaatgaactgggaaagcttagctgaaacaatgtgtcagcacatcaagtacatacagacaag

SEQ ID NO: 205315 - DNA, 884 bp, Homo sapiens
aaaagctttgtttcacagattcttgtaatgttttctcaactcaataaagactagcatttcttcataggaagaaataagaagagttggagccaataaaaggagttcagtccagcagttctcaacctgaggacctctctgaattaccaatgggaactttgtaagagggacacaggacaggttcctcaaaatcctcattgtaaggggcttctgtttcaaaagggagtaaaaataagacactactggcttaaagtgactttaaaaataaacttaatggatgttttattacaattacagatttttaatgtggattgctgccttaagcattgtcaactaatctttcataatttatgaagatacattaaaaaggaaaaggaaattggaaaagacagccaaaaggctaagaggctatggaatggcaaaaagtaatgttccctgagggggtatcagaagactcatatattttccaccatatattttaggttttgaacgattcatttttcaaaaatttttatactcttaaaaatactggagtgcctaccatgtaccagtaattgtagatatcatggatactatgaataagacagcctgggcactcacaaagctactttattttctctaaagcagggaatcttttttatttttatttttatgcccatttcttaaagctgaaaggtgcaagacccaaatagcaaaagatttttatgttagcgctgagctagatagatttttgtgcgaccttggtataatagcaaaagtttgtcttgaatttagtccagaagcgtctctgttcttgggatcagatgatcaggatttgaagcattgattctgtatttagttatttcaagagtggcattgactaaattacttaatatcatgcagtcctt

SEQ ID NO: 205316 - DNA, 1141 bp, Homo sapiens
ctcttgccactgccatgtaagaagtgcctttcaccacccccacaccctgccatgactctgaggcctccccagccacgtggaactgaggcagctgtatggaggccaatatgcagacaagggaagtaactcaggcattttgggggagaggtacagaaagaagagaaaagactgaactgactgctgttctgaacaagaactgtgactatatgtggtactcccagaatggctggtttcctttcagacccatcaagtggccatcctattggcttggactgaagacccccactggagaactgtctctgcagcctatactgatgacactggccactgtccagggctccaccccaaggagtccaagccccagacatttagccttagagagaatccagattttgcatttccagtgcagggattgatggagccttgtgtatcaaagtgccaatttctttctaacaagctagggaggataccgttgacagcagcagaaaggggtagcagtggtttgctttccaaatggtaataagaagggcctggcagtggcaacctgtccacgtatcattaaaaatggactctcctgcttcgtttggaattcaacccaatgaacttgaataaactctggacaatgaccagcacagagccctaagcaggatacagcaagattatttgctttactcatccactgagtacctaccatgtgccaaatactatgctatatgccgagtatacactggcaaataaaacacatatggtccctggagcctatgaatcttaccccatctagccacaaataataaaaataagaagaatctgaaggacaagtgggacagaaatactcaagcagaatgagggtgagattgaagtccctgaacatacagtgccctttacacttgatcttagccaaaaggccgagaagagattacagtgctttttaaaggtagcatttcacccagccaataatcaatccctttggccttcttgaggtgcaaggccacacactcaaattctttaatcaaacaataggctagtgcaaatggagctatttcttaaacccagctgtttacacagcagctacaaatctgttcagaaggaatcccccaccatccacaactgtctatcgagcagatgtgcaagagtatttgtc

SEQ ID NO: 205317 - DNA, 1033 bp, Homo sapiens
ctcttgccactgccatgtaagaagtgcctttcaccacccccacaccctgccatgactctgaggcctccccagccacgtggaactgaggcagctgtatggaggccaatatgcagacaagggaagtaactcaggcattttgggggagaggtacagaaagaagagaaaagactgaactgactgctgttctgaacaagaactgtgactatatgtggtactcccagaatggttggactgaagacccccactggagaactgtctctgcagccttagagagaatccagattttgcatttccagtgcagggattgatggagccttgtgtatcaaagtgccaatttctttctaacaagctagggaggataccgttgacagcagcagaaaggggtagcagtggtttgctttccaaatggtaataagaagggcctggcagtggcaacctgtccacgtatcattaaaaatggactctcctgcttcgtttggaattcaacccaatgaacttgaataaactctggacaatgaccagcacagagccctaagcaggatacagcaagattatttgctttactcatccactgagtacctaccatgtgccaaatactatgctatatgccgagtatacactggcaaataaaacacatatggtccctggagcctatgaatcttaccccatctagccacaaataataaaaataagaagaatctgaaggacaagtgggacagaaatactcaagcagaatgagggtgagattgaagtccctgaacatacagtgccctttacacttgatcttagccaaaaggccgagaagagattacagtgctttttaaaggtagcatttcacccagccaataatcaatccctttggccttcttgaggtgcaaggccacacactcaaattctttaatcaaacaataggctagtgcaaatggagctatttcttaaacccagctgtttacacagcagctacaaatctgttcagaaggaatcccccaccatccacaactgtctatcgagcagatgtgcaagagtatttgtc

SEQ ID NO: 205318 - DNA, 670 bp, Homo sapiens
cccttccacaaagacatactgagcaccactgcgtgctgggcaaggcttggcactggggatacagtcaagaacaaaacagacactgcttcttttctcaagaagctcagagtttgatggggaagacagaacataagcaaacacttgcatgttcaatgagtgttagtgaaaaaaatgcccagtgctgtcaagtatagagcagaggcctgtcctgataaaagaatgggtcagtcagagcagcttccctgagaaactgatatttaacagattcaaagcatgaaaagaattaagcaggaaaatgaattgccagccatacacaagtgtcagagacccaaagatgtgaactcttgcccagaaaggggaagaaggccaaggagactgggacacagactgagggaaaagggtgatatgtgagagtgggagactcagagagggacttcaggcagctcataacatttcggtctaattcaaattgtcatacaacagcagaaaatacataacctaagacacattgcaaattgaataaaatctcaggtcccctgcccctcccctctgcctgggcaaacagactggctcctgaatccttagctgatattaagagcagcaaagtattattcaccacctcattcccaaaggaaaataatccccagcctctctcacccccactagagat

SEQ ID NO: 205319 - DNA, 506 bp, Homo sapiens
aacaggcagcatgaacaggctaagagagtgtcagaataccaacttggaaatgatgaggttgagatggcattggaacaaaccccaccctatacattcctctctcttccttgagttccgagtgcacagtttgtattccacatcttcagacttaatcctagctcacagtgttagtttgtctaattattacacatttcttgggagcttctaaaatagatgtcttcttctattttggtacccctttcttcacagagcctaagccaatgtagggctcaaaataggtgtttaataaatgataactgaacacattagagctgaaaaacaaaaaggacttatttacactggagccaactaacatttcaaagacaaatgtttaaaattggctttcagcaaaatattaagaaattcgccaggtgtggtagcttgcctgtaatcccagcaacccaagagactgaggcaggaggactgcttgagcccatgagtctgtattaactgcttggggtacccga

SEQ ID NO: 205320 - DNA, 543 bp, Homo sapiens
gcacagtggctcatgcctgtgatccctgcacttttgggggccgagtcgggtggatcacttgaggtgaggagttcgagaccagtctggccagcatggtgaaacctcttctctactaaaaatataaaaattagccggtcttgggtggcatatgcctgtagttccagcttactctggaggctcagacaggagaaagatttataaaacaagtcaagctggagttggttcatggggtatatgtagtttgcttacctttgccccagaacaattagtatgcattaagtgcccaactccagtaaacataatgtagcagctttaataagaagccctttttaaaggtttattttattattttttttggagtctgagtcctgcgctgtcacccaggctggagtgcgatagctcactgcaacctctgcctcccaggttcaagcaattcttctacagctacttaagaggctgaggcaggagagtcacttgaacccgggtggcagagattgcagtgagccgagatcacccctggataacagagccagagtgtctccg

SEQ ID NO: 205321 - DNA, 405 bp, Homo sapiens
aaactctgcgcggcctgttacctttgagtttttatctccacatacttatattaaaccgtgtagttcttcttcccatctgacatctacaatctcttcactgggtctgtactccatagctattttaccactttctgaaataaagttagcaaggatgaattcagaatctttttcattccaaaacttcctgcatataatggtagcaacccacaatgagacattcttttagtttctaaaagcaggaaataagcattttcctgaaagtttcctcatctcttcatcatacacttcgatttttgtttttcttttttcttttagacagggtctcactctgtcacccaggctggagtacagtggcactatcatagctcactgtagcctggaattcctgggctcaagtcatcctcc

SEQ ID NO: 205322 - DNA, 434 bp, Homo sapiens
tgatttattaaatgttaaaattctgaacattaaccttttattctcaatgtagaaagtcattatttgtatgtgtaaatgtgtgtgtgtttgcatgcacacagacacacccattaagcaacttgaggcagagactgcagcacgtgcatagcatgttttgatgccgggcgcggtggctcacgcctgtaatcccaacactttgggaggccgaggcgggcggatcacgaggtcaggagctcgagaccacggtgaaaccccgtctctactaaaaaaaggacaaaaaattagccaggcgcagtggcgggcgcctgtagtcccagctactgtactcagaaggctgaggcaggagaatggcgtgaacctgggaggcggagcttgcagtgagccttgatcgtgccactgcagtccagcctgggcgacagagcgagactccgttt

SEQ ID NO: 205323 - DNA, 209 bp, Homo sapiens
gattaatgcagttgcctccaactggtctccctgcttctgatcttactccttacagatgattcccgccatggcagctcttttggaatgcaccttaggttatgccacttctctgctcagcaccctttaggggctttgccccggctcccatttctcgctgccttgttggccctagtgacactggcttacttcaggctcatctcctctcaggg

SEQ ID NO: 205324 - DNA, 362 bp, Homo sapiens
ggacgagcatggttgtatcgactataagagctcgtacgcatgtgtagaatggctgaggacttcccagtctccccagagtccgtgcctttccctgtgtgaattttgtatctagcctaaagtttccctaggctttcttgtctcagcaactttcccatctcgtctcttctcttgtaacaagagaagagacgagatgtacaagagaagagacgagatgagccaggatggtctcgatctcctgaccttgtgatccgcccgcctcaggctcccaaagtgctggggttacaggcatgagccaccgcacccggcctctctgccttcttagacgcccctcaaccctgccttccattatggcctgtccagcc

SEQ ID NO: 205325 - DNA, 416 bp, Homo sapiens
ctcaagagttgttcagacaacttcagttaatatttatttgaagagaaacttctatggagagaaaagttaggaaaccacttcatttttcatgagaacagtgggattttgaagttagccaatgacagaatcaaaaaaagaaatcaaaaatagaaataatattagatggccaggtaacattcttttcagtgcattttggttgttgatattgcaacttgctttgcattttgtatattatatatcatatgcattttgtttatattgatagaatggctgaaagtttaaataaggcaaaaaattgtgtttagggaaaggctgctaggaaattgatcctttgaacccaaagaagataattcactttgttctcctggattaatacaattaaatcatatttgatagtgctctctcaagaatgtgaa

SEQ ID NO: 205326 - DNA, 158 bp, Homo sapiens
ctcatacacatttttaaattactgacaaatacagaccttttttcatgggcatttgacttgctttattcattctttttccatgcgtatgacgtgagaatagctgaatctaaaaacactaattcactgagtacagttggctgtgcaggttcgtgcagatt

SEQ ID NO: 205327 - DNA, 303 bp, Homo sapiens
aaagaagccagacacagaagtgtacatattataagattccatttatataaaaactaaaaacaggcaaaatgaatctgtgctgttagacaattactctagtagttatcacgtggcagaggtgagaggagagtgacaggaagggagtgtgaaggcaactcggttgctggtgagtttctctttattgatggtggggattgtcacatgggtgtggtctgcgagcacttgtgctgtatgcttgtgatatgtgtccttttctatatgtatataatattaaaataaaacattaaaaatgttcattcctat

SEQ ID NO: 205328 - DNA, 636 bp, Homo sapiens
ttcctttatgtctgtggcttgatcattgtctactggcaactgaaatagtagcattgacttaaaagctttggcgaggaatctaagtgtccaggccactagtcagttgagtggaatctcctgtttaatactattcatcgcccatgcgtctggtcttctcctcctccctttttaaacaataatcttcatacaggctcctgcaagtatcagtatctctattgatgtgctgtacctcagagcgcctggttattaagcgaattagatggaggttcagtgacccgaatggtaggccagcaggtcaagaggcctgagcactctctggcttaggccctggcctgggactccttggccatttgttggaacagcgtctgtccttgtgcccccaattaatttagcaagcgctgctttgtaaagtgccagtgtgctgcagacgccggcaatgcgttaatgtcctacggacattacggagccattcgttctttccctgacagttccaaatccagatccttccgccaaacacagcaaaagggaagtgagttttttgcttggtaacactgtaggtctaactttggatctggaaatttcttaggttttttggtgtgcaaatatgggagatagcgtagaaagaggagaggtgag

SEQ ID NO: 205329 - DNA, 522 bp, Homo sapiens
tactcatgtgaattgtaatctctgtaaaatcactgttaatttagttatgttaatatatgtaaaaatcacatcttatttacataatatgttaatttcaaaatgctgcttttcctactttctctttatgccaggtttattgacactaaggccactttttgaatctaacacattttccggaacacgttgtcttcactactaagctgtgataaagcgtgtttaaaaataagagtccctggccgggcgcggtggctcacgcctgtaatcccagcattttgggaggccgaggcaggcggatcacgaggtcaagagattgaggccatcctggctaagacggtgaaaccccgtctgtactaaaaatacaaaaaattagctgggtgtggtggcgggtgtctgtagtcccagctactcgggaggctgaggctggagaatggcatgaacccaggaggcggagcttgcagtgagccgagatcgtgccactgcagtccaatctgggcgacggagcgagactgcatctcaaaaaaa

SEQ ID NO: 205330 - DNA, 213 bp, Homo sapiens
atggaggctgcagtgagctgagatcacgccacagcactccagcctgagtgacagagcgagaccccatctcaaaaaacaaacaaacaaataaaacaacatgcaaaactcccttcctctccaggaaagaggcctaaaggagaaacaggcacacacacatcttgatatatttaaagtacgagagacattatagacacaaaacaggtttctatgaaa

SEQ ID NO: 205331 - DNA, 444 bp, Homo sapiens
acttgtagctcgatcaaacaaatctatagtgacagaaagcagattagtggttgccagaaagaaagaatggaggggtattaacttcaaaggggcataagaaaactatctagagtgatagaaatgttctaaatcttgattggcatggtggttacacaggtacacatttccaaaacttgctgaattatacaactaaaatgcatgtattgtaggtaaaatatacttcagcaaagtaaaagaatcagaaagttctaattagaaaatcaaatatattgcatattgttaaaacattttggtactgatcaacttcctgctttaaaaatatgtataagctaggacctgtggcacatgcctatactgagacgggagggtcacttgactccaggagttcaaggctatgatcatgccacagcactctagtctgggtgacatatagaatctcctctc

SEQ ID NO: 205332 - DNA, 209 bp, Homo sapiens
tgtcttctcagcgaggttcttatgtaggtatgaaggaaggaagcctgttgtgatccccgggggagctgtgagtgtagagctggctctgaaagccttggcatctctcctgcaggaagaatcccaggagcaggtgaatcccacctgcattgagcattttttcagtttaaagcaaatccttactgctagagtatatttagaaagaggcaggg

SEQ ID NO: 205333 - DNA, 319 bp, Homo sapiens
gaagtcgtttttacattatatttatttaatgacatattactgaaaagttgtattttttaaagttatgcacacccagaataaaaatgcttaatagaataattctgtcacagaaactatggtttaacctcctttaacagaagcagctggaaaccctgaccctaaactgtgagccccctaccaaatcttaggcataaatttgacaacgaaagttatcaaatcttctaacaaaagcaatcctcccgcctcagccccccaagtagctgcaactacaggtatgtgccaccatgcctggctaacttttgtatttttttgtagagac

SEQ ID NO: 205334 - DNA, 545 bp, Homo sapiens
gttctaagcatttttataaaatttttaatgataaagtagaatgttcacagacttactgcttttgttgagtcttactgaaaagttagatagcagacaaaaagcaatttgttttctttttcaaacttgtgttaaagatcaactttctgagggctctgttctgttccattgatctatatctctgttttggtaccggtaccatgctgttttggttactctagccttgtagttgagtttgaagtcaggtagcgtgatgcctccggctttgttcttttggcttaggattgacttggcaatgcgggctcttttttggttccatatgaactttaaagtaatgttttccaattctgtgaagaaagtcattggtagcttgatggggatggcattgaatctataaattaccttgggcagtatggccattttcatgatattgattcttcctgcccatgagcattgaacgttcttccatttgtttgtatcgtcttttatttcattgcacagtggtttgtagttctccttgaagaggtccttcacatcccttgtaagtt

SEQ ID NO: 205335 - DNA, 620 bp, Homo sapiens
gaaattactaatctgaggcttgagaaggggcagtgtagccttccattatctcaccagcaagctctgtacaggattattttcaaattttctgctgccattacaatgtgctattagagtggccaaggtggtgagggaggggatgttattgaaacttggttaccagggtagataagataaacttcatcactttcttggcatccacatttgtagccaagggtggaaattttgatgaaagaagtacatttggtcaaagatattaaggtgtaaagctggatattttctaactgcattctacagagtctgtctcttccccattgatgctcatctgaaatagtctgcttgattgtttcaataaacacactttctttcaatgtattgtaaacttgtaaataccagataaccaacttaaaatccccctcccatcccagtctcaagaaataacactggttatgtgcagacataactttcttgagtaagtcaccattttctgtcactttctatttgcggctggtaaaatgacagctcaggcttaacttttacataagctatttttagatttttctcagacatcctttaactatttcttttatacaggatcctaccctaaggatcattttatt

SEQ ID NO: 205336 - DNA, 434 bp, Homo sapiens
acatttctgggcccccaccagagcagctgacgctggaagcctgttgtgggtgaacagtggagtcttactctagaaagataggaggagactcagcagatgtgtgtgatatggtttggctctgtgtccccacccaaatttcatctcaaattataatcctcatatgtggagggagaagcctgtaatccccatgtgtccagggagggaggtgattggatcatgggggtagtttcccccatgctgttctcatgatagtgagttctcatgagatctgatggttttataattgtttgacatttcctcctgtacacactgtccctctcatctgctgccagtaaaatgtgtctgcttccccttccgccatgattgtaagtttcctgaggcctccccagccatgtggaaccattagtcaattaaacctcctttgtttataaatt

SEQ ID NO: 205337 - DNA, 435 bp, Homo sapiens
gggcatagtagtacacacctgtaatcccagcaacttgggaggctgaggcgggagaatcacttgaacccaggaagtggaggttgcagtgagctgagatcgtgccactgcactccagcctgggcaacagagtgacactctatctcaaataaataaataaataaataaataaataaataaataaataaataaaagagttagggcctttaggaggtgattaactcatgagaacagagccctcacagatgggattagcacccttacaacagaggtgtgagggagctgttggtccctgttgccatgtgaggatgcatcaagaggcaccatcttggaagcagacaacagcccttaccagacaccgaatccaccagtgccttgatcttggacttcccagcctccagaaccatgagaaaataaatcactgtttttataaatgac

SEQ ID NO: 205338 - DNA, 532 bp, Homo sapiens
aactggaggtattggagcagcactgtttctctcgcctctgacattgttcaatccagatgtttgttgggacagaaagactaacccagagccctgaacaaactgggtcccaatgatcaatacaagttctactcagtgaatgtggattacagcaaattgaagaaagaaggttcagatttctaaatgaaatgttttactataaagctcctttagaatgaaggtcttccagaagccatccgcacaattttccacttaacaggaaatatttctcctctaaatgcatgaaatcatgttgaggtaatctactggagattacactgattaataaataactgaaagttgaaaaaaaacccaaaaaacccagcatcttgctatgttgcctaggctgttcttagacttctggccccaagtgatcctcttgtcttggcctcccaaagtgctgggattacaggcatgagctacccgcgcgcggcaacccctttcttataaagcttttttttccaacagcctttgcacatccagacaaagggaaaca

SEQ ID NO: 205339 - DNA, 384 bp, Homo sapiens
cgctaccaactctgtaagaactctgcacatttagggacatatttcaggcaaactggaaagtatgcttgggtggtggtgcgaggaggggcatgaaacaggaagaagagtagaactggggaatgaagataaagaaagtaaaatgagtgaaacagcagaggtgtcttgtcttcctggtactagtaagagtggtggggcatgaactgaggaatagaacagactcaaccatgtacatcagatgatcaaacataccatcaccactcgccatcacaccccgcccctaaaaaaagagaaagggggagaaagaattgggatcaagttagaaagaaacagaagtaggatcaagtaaaaaggaaagggaacttggaatcgtaagataaaaatccc

SEQ ID NO: 205340 - DNA, 543 bp, Homo sapiens
ctcattatgaaggagttaatacagaagaagtttttgaaacattattagcatttaataagaggtgagtaaactattttcaaggctgttggcatggatttcgtattcattttgctacccccagcacttcagagaatgtcctgtacatagtaggtgtccactaaatgctttagaaccacttggtgagcattattgactccccagggaagtcccacgtgggtcttcttgttgccgagaaagtcccacataggtctttctcgttgccaaagaggacatctcaaagaaaataacaaaaatatactgagccaaagaaaaatgcaaacacaacatatcaaaatttgtgagatgcggccaaagcagtgctgagaggaaattttatagcactaagaggcctacattagaaaacaagaaagatctcaatcaatgatcaaagccatgccctcagaaaaagaaaagtgaaataagcccaaagcaagaagaagaaaggaagtaataaagataaaagcagaagtcaatgatattgaaaacagaaaaagaaataaaaat

SEQ ID NO: 205341 - DNA, 491 bp, Homo sapiens
ctctacacaaaattaaaaaattagctgggtgtaatggtgtgcccctttggtcccagctacgtgggagcccgaggcaggaagattatttgagaccaggaggtcgaggctgcagtgagccaagatcatgacactgcactccagcctgtgttgacagagtgagattctttctcaaaaaataacaacaataataaataaataaataaataaataaataaataaataaataaaagatgttccataacggtgaaatctcagcaaaacctgaaggaagtaagccatgagaatatttggaaaaaaggcttgccagatagagagaacagtcagtgcaaaggctgcaagatgagagcatgcttggtgagttcaaggaactccaaggaagccaatagatctgaagtggagagagcaggaggaagagccatgggaaatgaggtcttagaggtaacaatggtctgcttatgtaggggttttgtgaggcactgaatggatggatg

SEQ ID NO: 205342 - DNA, 701 bp, Homo sapiens
aagctaggaatgattaagcttattgagaaaggcatgtagaaagccaagataggctgaaaactatgcctctcactcaagttgtgaatgcaaaggaaaagttcttgaaggaaattaaaggtgcttctccagtgaacacacaaatgataaagcaaaacagctctattgctgaatggagaaagtttttgtggtctggatagaacaccaaaccagttacaataatgccttaatccaaagcctaatccagaggccctaactcttcaatgctatgaatgctgagaagtgaggaagctgctgaaaacagttggagaactgcagcggaagttggttcataagatttgaggaaagaagccatctctgtaacataaaagtgcaaggtgaagcacaagtgctgatagaagaaagaagctgcagcgagttatccagaagatctagctaagataactgattaacatggctacactgagcaacagattttcaatgtagatgaaacagccttctattggaagatgccatgtaggactttgatagctagagaggagaagtcaatgcctggcttcaaagcttcaaagctttgactcccttgttagctggtgattttaagttgaaaccaatgctcattgaccattctgaaaatcctagggttgttaagaattatgctaaatctactttgcctgtgctctataaattgtaccacaaatcct

SEQ ID NO: 205343 - DNA, 303 bp, Homo sapiens
gccaccacacctagcctctaagcttccttcttgctccattagtacccagcccaaagccttttacatcgaagctaaatagggatctgttgattatttgatatttttaagcagttgtcactaatatgcaaaattcagttgataaagatgcccacttaactcttaattgaaatgtccaagagtgagttaaggatgaagaaagttgccaggataaatacaaggctttgaatattgatacccttcagaaggctttggcattcaaaacttcataatggaagttgtatcagagtctcattcctgtggtct

SEQ ID NO: 205344 - DNA, 955 bp, Homo sapiens
cacttgatagttcgtctgtgcttatgttttcctccaccttcttactacctgtttttaattccttgatattttcttctgatttataatagctttctgagtagcacatggtacttcaccccccatgctctccacctgctccctcagaaagcacatttccttggtatgcagaatgctcggatcctgcttatacattttcacgaagtcccgaagctcgttcactttgcgaaggtccagggtcggaaggcagtgggcgaagctgaggggctgcaggccagtttcaggcccaggcactggcttggcgtaacctcgaagaaggggtgtgtctagtttaatttcataacttgtgttggctctttgtttgataagaaggtatatcactaaaactattctttttagtgcctagggttggtttctaattatatatgcataaaagagcaagaagaggtttgtctatagtaactatacaataattcggaaagagatgaagattaatgaggttaaggtaatatttatatgtatgagaaagattttctgccactgtaaaaagggtggggaagtaccctctgacagccactaggtggcaccccaatcctggacatcatcattacttttgtcagaagagagaaggtagtgtgggaagagcagctgtagtttgtgcctaaggctggagtttgtggcttgggcaattgtgggcaactgcctccatatatggcatcttattttaaattttaaatttacataaattataagtttctgcaaaagggaacaacttctatacccactccctacagacccacagtgaacaacacgtagcatgactaagaaataaagctttgttgtttttagccattgagattccagaatgtttgttctagcagcatcatctagaacaacatgactgatacacctggtacttgtaggagtatgaggcaagggaagacagacagagggagaa

SEQ ID NO: 205345 - DNA, 707 bp, Homo sapiens
ttgatttgaatcagaagactcacatgatccagccaccaaacatttcctcctatcccacatcaagactaaaccaaacatttcctcctatcccacatcaagactaataaataagattttatagtttaattacaatcacacatgaattttaagaagtgacttgtgacaaatttactctgctaatgttacaagaagtgtgccctttgattaggatttaaaacctcatatgtttgaagcatgaatgaatggtatatcgtaactgtatattgttcttgtataacttcatgaataacttgaataacattcaaatggaaataaatcctcttatcatccaatcaaagcttagatctatagtcaaattcttccatgaaataacatgaaacatccaaccctaatgaaaataaatttttgaaaacctctcaaatatacttacatatacttactttcatctttaatgtaattagattcaggcttgtagaatattctagagtattagaatgaactgtgaaaggctccaagcatgacaaggaggccatctctagagttgtgacactaaacactttggtagacccaatggtgaataaaagctaaaacactcaagtaactagtctgagttactgtagttgatatgtttggctgtgtccttacccaaatctcatcttgaattgtagctttcataattcccatgtgttgtgggagggacccggtgg

SEQ ID NO: 205346 - DNA, 608 bp, Homo sapiens
gagtcacgggttgttcaggtgaggcccaggttccctgggcagccacctgaggccgcctggggttgctcacccaaccctacctgttcccaccactcggtctatttccccctcctcagacaggacactaataacaaggagcttgccctgcaggctcccaaccctcccgctcttccctaccccacagggttctggttccatcatttcctctgttcacaaactatcactggacagttgtgttgtctcttgtacaatgttccattcttcaacatctatcattgctgctgctcccagcaccaaatgttcaccctctgcctcctgctctgcacacattcccctccctcaagatagcctccatgagacagggggtctgcagcttggcaggctggctgggttactgactatcccagtcccagggaagatagggccctgtctctaggatgctgcagcagagtgaggaggggcactcaaattgaccctaaagggtggaggggccaccttctccccctgtttggttggggaatgggtagttattatttgtctcagcttggggctctgcctctagcttcctacttgcagttacttaagttaaaaaagaaaatcctgttcta

SEQ ID NO: 205347 - DNA, 544 bp, Homo sapiens
cagcaaaacataagactcacttgaggttaaagggcatgaatgtaagggaagtctacttagcatggttttatgtttttcttccatcatgttcagttgcgtaggtacacacatggagtataaatagtactgcattttaacaggatggttaggccaaagaaattgaggatgtatgaataaagcggtatggtgatgtaccatggaatttatgctgtgcaaagagggaaggaagacaggtaataggtaagaaccactgaaacaactgatttcatcaatgaattgtagctctcttcaaggtagaaaaattattgcaatctggaacctctgataatgagcatgtcaacactggaatgtctgaaattgcagtatttgcatgagttgcagttatgaaaacaagatccaaattttactgatttcatagtattttgtctttttctctcgattagaatgcagaatatgttagggcaggtatttttgtccctcctccccatctgctgcattctcagtgcttgattgattcagagaagctgcacaatggatctttgct

SEQ ID NO: 205348 - DNA, 501 bp, Homo sapiens
gagattccagctggtaacatgttcaaacattacagggatcatgcagtctgttgttcttaaaactaaactaaaagaccatggcaataaaatcatacattccaaataagactcatatctcaagggatatctttaggctaaaaaaaccaaacccaacccggactcaaagactgactagctataaaatactatctcaaagttggttgagactctcctctttggagcttgcccctccccttcttagaattccttcttactctcttgctctaagctaactctctttttccaaaactcctcagctaggctggcatgctgacaatttaagtaaaaaacacgtaaaaactagcagatattttaaaaaatattattttgaccttcgtgctgtttcttaaaagcaaaaaataaaattctcatataaaagaccccctttccatactaaaaggaatgaggagattcttatcttaaagggcaaaaaattgagaccaagacaatactttacagaca

SEQ ID NO: 205349 - DNA, 382 bp, Homo sapiens
tggttattggctcagaagcctggaaacaggagcttctgcggaccttcacgcacgtgttattcccaaaatgccactagatggcagcagagaagaacttttccctgatttaagcgctctgcgagcagccactcagcattacactaagaattcagacccctggtactcaggggtcttcgagataaatcctgtttgggccctttgcaggccctatctcacctactgcccccgttcaccagatgaagaaggaacaatgattattctcactttataggcatttaaactgaagactgattctaaccaattctgagtccagaaccaaggcctgaaatgggccagagagcatgcacacggtgtcctggttaaataaagtcatcccaacatt

SEQ ID NO: 205350 - DNA, 1634 bp, Homo sapiens
aagtaatgacaaaggtgctgcacacagggccatgcccaaccagcaggctctcagaggactcttgaggtggaaatgaaaacaggtactttgttaaccagtggaagcacaaagatgaacaaaccatactcctcccctcaagacaactctttcgtgagggagataacccaggaaataggagtctattcatgagaccgctgctctaactagaagaataggaagtaccagaaggtcacaaaagaggagctgattagctcaacctgagaaagtctcccaaagcttcacagcggaaggaatgctgaagtggggatgaagaggtgttgatcagaaaaaaaagacagtctcactgtgtcacccaggttggagtacaatggcatgctcactgctcactgcagcctcaacttccctaactcaagtgattctcccacctcagcctgttagctgggattacagggttctgtcaaagcagatgactcccaaaggtttcataaatcttccggaaaataagctccttcagctatataatcatggcacccacggcttaaaagttgacagtgagaacagcattgaacagcctgctgcattcagcaaaagatgggagaaaaatgagttcaatcagtagactcccatgaccccttcaagtgacgcaatcatctcttccaagaagtgcagctacttatttgggataagcgacgacagacgagaaaccacaaagaatctgcagacgcgagactccctgacctgcagatatacagccatctccaataagtctacatttaaactaaaacttctcctgttgagcaagcataatgtggaattatgttagcaagaccttatgcattcccacaaattttctcccaataaaaaaaactgttatcaaaggattgtcacccccccagacatacagcactgcagggaaaaaggagcccagacagccgttgggagttgacctctggccgcacgcctggggtcagtggagatctatgttgactttatctgtgtgccctttaaggaggcctcttgcttaaaataactaaggagccactaaattacacttacttgtaatgctgcattaatggattcttctacaaaggctgaaatacctgggcttttgcccttcatgaccctaattttaactacaatgaagcttctgaatctctacccatttcgggttaactccattttggagaaagaatgagttctatcaatagcctttatgagcattaattaaaaatctgtacagagagaatagtcatatatttaaaactagtcattaagaaataaaagaatatccttggtataagctgaaaaattattaaagattctgtttcataaagtgatagaatcataatttctaaccataattttcttaaccaaaatatcgttgtacttagttttgttgtgtttctgaaataatttattttctgattttgcctgaaatctactaccttttccaacaacaaccacaacaacaaaaatctaattttattttggttcagaaaaggagcagcatttttacacatatctattttgttcctacagttcatgatctgaagcagaagacagtccttctacatatttctttccttctctgatggatggctgatatacagcgtgttgtttcaaaaatttaaaaa

SEQ ID NO: 205351 - DNA, 890 bp, Homo sapiens
aagtaatgacaaaggtgctgcacacagggccatgcccaaccagcaggctctcagaggactcttgaggtggaaatgaaaacagggtcccactctgtggcctaagctggagtgcagtggcagtatcagggcccgctacatccttgacctcctgggctcaaacaatctctcatctcagcctcccaagtagctggcactatagggatggaggcctcactttgttgccagctggtctcgagctcctggcttcaggtgatcctcccatctcagcctcccaaaatgctgagagggcagctgtgagccactgtgaccagccagcatgtctttttttgatctgcccagtaccaaccctcatttgggaatcgctctttctgttcctttaacctgatgattcctgtgggagcagctgtgctctgacatggcctggccctgcctagggctgattagagaaaaacagtaccaatgatcctcttctctgggatatttgaacctgattccaggggtgattatcaatatctgcaacaatcagggagatccgggtacccaccaattaggacagacattggctgaaaaacaattgatatgggtgcagcagtgcacgcaggctgaagagcacccttgtttgagaagaaggaacatagggattccctctttgggggcagaagttggaaactgtgcattggggagccctgttttcttcctgtagacaaatctcattgtggtgaataggaatgaggccaacggcaagatctggagatggaagaagctcctgaagatgttgaaacccctggtcccagctgttctgtgggccagctggattcctgcccttctatagctgtattgctcaatcctttcctgggatctgggagaaaataaatttcatttttggccca

SEQ ID NO: 205352 - DNA, 393 bp, Homo sapiens
aatgatttatttataagctttcctctcccataagccttaggaattcagacaaggattgatctcttttttttttttaacccttataggagtaaaggctaatggtttatcttattcttatgtgtattttagtatctagcagcttctaatataccactcaacagatgtttgctaaattaaacaagtcctttctattcagcattattataaacactgtaaacctacacacaaaaattaaaggcaagatctttaaccaaaaatatttcacaaactgaaaaaatttgtagattataacaaaagtagtttgtagttcagtgttttgtttaagtgggtatagacaccatagatcagtgctcttcaaactgttggtcatgacctattaacagactgtgaaat

SEQ ID NO: 205353 - DNA, 610 bp, Homo sapiens
aggcctaggttttaacgctactgtgaatccccagcatggccacagagctggaaccagggaatcagataagcaagacaaggaggtaagattgaaccctcgcccaaaattagcctaaatgatcaggtcactactgtgtaacctagtatttgaaatacagagatttagacagaatgacaggaaaaagtcaaacataaactaaaagtccgaaagagcttaggttctcacagtcactttttgaggctacaaaaggaaagatattgcataaaccttaaaaaaaatggaccagttaagaagtgtaactggtttagcaagcttcccttctaaaatcctggtgccgatttcatgttagaacacaggtttaatgagaacgtatccctctccccaagttgtaatacacagaagagggcaaaggggagaatgttaccttgcccaagctctggtcttatctcaacccacagacttggagaaaatgtctatagtccatttcagtatttacttagctttttaatttttaattttttttttgacacagactctcgctgtgtcccccaggctggagtgcaatggtatcatcttagctcactgcaacttccgcttcccaggttcaagc

SEQ ID NO: 205354 - DNA, 130 bp, Homo sapiens
ttagagtctatcactattaaaactgtagaagttatatcaaagtaggtcagagaagagttgagtgtagcaaagttaaaaagaggagcagccaataataccctaagttaattgagggtaatgtgataaggat

SEQ ID NO: 205355 - DNA, 583 bp, Homo sapiens
gataaatagtgtctatttcattcaaagtataatggaaagacactggagggttaaagcaaggaagtaaaatcatccaatttacttttttcttttttaattcatgaagctatactgtggagaatggattatagacgggttaaagaaaaacaatgaggccgggcacagtggctcacacctataatcccagcactttgggaggaggagaagaatttgtttggctagcaatgcaggtcgatttccagcttccaagtatctaagggatctggaaaagctatgtaatattactgtaactcacagaaagcaaggtacatcctccctaaagtcagcataattggccttataatctctacagattctttacctgcatcatgattcttctatagcaaaagagaatggataaatatacttatcaggccactgagtagtcaactgagagccttgcactatataatcctactaaatgtagtagttatttattatggcctaaattaatccctgtcctccccaatcgaattcctgcagcccgggggatccactagttctagagcggacgccaccgcggttgagctccagcttttgttcc

SEQ ID NO: 205356 - DNA, 370 bp, Homo sapiens
gataaatagtgtctatttcattcaaagtataatggaaagacactggagggttaaagcaaggaagtaaaatcatccaatttacttttttcttttttaattcatgaagctatactgtggagaatggattatagacgggttaaagaaaaacaatgaggccgggcacagtggctcacacctataatcccagcactttgggaggccaaggcaggcagatcacgaggtcaggagaccaagaccatcctggccaacatggtgaaaccccgtctgtactaaaaatacaaaaattagctgggcatggtggcgggtgcctgtgatcccagctactcagaaggctgaggcaggagaatcatctgaaccagggagtcggaga

SEQ ID NO: 205357 - DNA, 462 bp, Homo sapiens
gcattttttaatcaagtagttttcttctagttaagttttaacagttctttatatgaatatgtctttttaaaatattttctcctactctgtggcttttcttttaattctcttgatagtatcctttgcaatggcatagtaggagataatatgggtgacttttctgttaaaaggtttatggaggccgggcgcagtggctcatgcctgtaatcccagcactttgggagaccgaggtaggcggatcacctgaggtcaggagttcaagaccagcctgaccaacatggagaaaccccatctctactaaaaatacaaaattagccaggtgtggtggtgcatgcctgtgatcccagctactcaggagactgaggcaggagaatcgcttgaactcgggaggcagtggttgccgtgagccgagattgcaccattgcactccagcctgggcaactagagaaaaactccatcaca

SEQ ID NO: 205358 - DNA, 300 bp, Homo sapiens
ctatgtgaagtgtctaagatgggagcatgcctagagtgttcaataaatcaccaggagagcagtgtagctgtaacggagtaaaagagttggagaagagtaagtataatatgaggtcagaaagatatggagccaatggggagagagcatgtaggacttcattgacttttatagtgagatagggagctatgggagggttttgagctgacgtgagacataaattgtcttgatatgcagccagctttctgtatttgtgggtttcgcatctgtggattcatccaatgtcagatggaaaatacttgg

SEQ ID NO: 205359 - DNA, 613 bp, Homo sapiens
caggttcacatggttggccaggctgtcacaaaaaaagcgatgcatgcacttcagcctcccaaagtgctgggattacaggcgtgagccaatgcgcccggccccaaatattattttatacatatctatcctgctactctatggaatgcactacctcctccattctctgaatgtgttaaagatatttagatgttttcttctccctgtacagacagtttgctccaagttgattctttggttttgacctctagccttcatcttaggggccgggtcatcttcagatgtttgatgatcctgatgcctccaggatcactgctgcctccttcctgttgtctttgcccttaagggttaaaacacacacacacatacacacacacacaacttttactgcccttacagtatggcttcagaaagaaaccataaatgaacacatacttcttagccctcaaatttttcactcacattttaggccacagtggtcggcttctcacctaactgaaactgatcagctaatgtcaactgaccttgatagtgctggttaaacacctgcccacccttgtttatttggtctatttactgcactggatgctgaagatccccttttcctgaactccct

SEQ ID NO: 205360 - DNA, 294 bp, Homo sapiens
aggtgggctccaaaggattcggccaccaaggtggagaaggaaatatacattttctagagcccaatctgccaggagagatctaagagattacaaaggaaaaaacttgaaattctgaggacagagaaaagaaaaaggaagagttaatgactagtgagacaccatcatgtagactggtgccacatggaatctggggcaacagaacatgatctatccagatggacatacagggaaagctggtgctgggaagcaccttaagctacatgattgcaataaattttgctcaccagtgattgt

SEQ ID NO: 205361 - DNA, 386 bp, Homo sapiens
tatagcagttaatataacccatggtttcagacatccactgggggtcttggaatgtatccgctgcagataaggggatactacttgtatttaaaaaaaacaaaagaaaaagaaagaggtaactgctctatgcatagagcccaaactcctgctggaggtggtcggaaggtctgattcttaaaagatgagtaggaatttagcaagggacaaataggaaggcattttcttgttcacagtgataggacagaggtgataaaacacaggcagagatgagagaatcttgtaagagggagacatgtcaaggatactacagaatgacaggttatcacagaataccaccaaaggaagcctggtctttggaaggggcagtgtttacattgtagtattag

SEQ ID NO: 205362 - DNA, 400 bp, Homo sapiens
tactatagacgacccccatgccaataactcttccctatgggctaacttgggcttgcccttaacgtggttgctaaactctagaatatatgttccatttaaagaagatggaagtgcatagcattgttatgaaccagactcagaagtcagattgcatcacttccactcttactctgctgtaggcagacacaaagatcctgcctaaattcaagtagagggcatatgggctccacttcttcatgggggaattgcaaagttctagaggagtacgtgggatgggagattgtaatggattgaatagtgcccccctacattatatgctcctaatccttggagcctgtgagtgttaccttatttggaaaaagggtctcatctaaattaaggattatgagatgaggagata

SEQ ID NO: 205363 - DNA, 206 bp, Homo sapiens
gaggaaagctgagaccctaacgtttgcccactgctggtttctgacgacttagccattttgatacagaaggtcaatatggattttggagggtggggtactagcacaactggcaacttagtagggaattagtaatctggccagggccactgacaatttaaaaagaagaaaactacatgtgcagcactccagaaatggcgaaacacctt

SEQ ID NO: 205364 - DNA, 463 bp, Homo sapiens
attgttctaaacccattacattatttaatcttcacgacaattctttaaggtagtcttattactatgctcattttatagatgagcaaacaagttttcaggggtcaagaaatttgagcaagttcacattaacttgtaaatcacgaaattgagcatcagatacaagcatctggctgcacttcctgagtttgtacgtcctactctcataaaatagatacattgaagactgagaaagaatactgttggccgattcctcaggcaataattttttcgatattgtattgttgtctcagaaacctccagcctctctcattgatggacggtaggaggggcacatggagtggaccaggagtgggcaggagtggggtgggggcgtgcttttagaagcgtttcgggggaacgacaaggcgcgggtcgtagaggtctaccctctctgcagtcccagcatggctcctggagctctctg

SEQ ID NO: 205365 - DNA, 483 bp, Homo sapiens
acatgaaatgcttgatgccctggtttcttccagttttcattagggaatagacaatggtttaagacacctattgcttcagttataataaggatgaacatgtaatttgttgtccaaactggtaccctttagagagtgaaagggggcacttgaatatacttacttaaaatttttatttatcagtcaataaattgacatcatattgatggacttataaaataatacaattaaaaactattttcttgggaggccaagacaggcagatcacttgaggtcaggagtttgagactagcctggccaagattgtgaaactctgtctctactaaaaatacaaaaaattagctgagtgtggtggtgcgtgcctgtagtcccagctacttgggaggatgaggctggagaattgcttgaacctgagaggtggaggttgcagtaagccaagattgtgccactgcattccagcctgggtaacagagtgagactctgtca

SEQ ID NO: 205366 - DNA, 384 bp, Homo sapiens
ggagccaacgcaacagcagctctacccagcagaggtcacagcagtgtcctcagcagatactccggtagcttgaaaattatgattttatcctgaaatgatcattcttataaatgtctcccccaaagcaattaaactttggggaagtcaaacacatgttgctaacaaacaaaccccaaccagaaaccaagccagagttggctctccatgtgaaatctagagacaactcaggaggaagtcagattctcaagctcgaggaaggagtcaaatgctttccttggtaattgataaagactctgccttggcaagaacttttgtagattatatctgagtttttgatgaataaagaatatgctgtgaaaattaaagagatggcatttatccagt

SEQ ID NO: 205367 - DNA, 372 bp, Homo sapiens
tggtcggtacccctcacggattactcaacaaaatactagcaaataaaatccagcagcacattaaaaagttaacacaccacaaatcaagtaagctttattcctgagatgtaaggctggttcaatcagcaactcaataaatgtgattcaccacataaacagaatcaaaagcaaattccatataaccatctaaatagatgcagtggaagcatttgataaaatccaacaccccttcatgatgaaaactttcaacagattaggcatcaaagaaacataactaaaaataaggccaggcatgagggctcacgtgagcctgtaatcccagcactttggaaggctgaggcaggtggatcacttgaggtaatccgtgaggga

SEQ ID NO: 205368 - DNA, 400 bp, Homo sapiens
ctggcgtcccagagcaagctggaggctcccacctcttcgggcagttcccccaagctaagcttcctgctttcctgacacctctggggaaaaggagttgagagagactccagaagcacttccaagtgacctgcctggaagtgaccaggggaaacggtccaagacgagtacaccgagtttctccacgaggcacagagctgagtaggcaacctggcacgggggcatgtggaaggagctgtgggaaacagccttgggccttctggggaggtctgtgcaggctcctctggcctgtaggccccgagttctggtctggaaggtcccctttcctggagcacaggggagcctgaagtccaggcctctgagatgatagtcataattaaagctgctgttgactgaaaactct

SEQ ID NO: 205369 - DNA, 645 bp, Homo sapiens
acactctggtttttccaggacttaggaaagctgcccagtgcagatggagatctgagagaccccagaatgctctgccctgcgattattcatcctggatataactacaaactcactgagctcaatcaaggattgcaaaacatcctgttcccagaggaatgaggactcattccagatggttctggacactttatccttttctaaggatgttgcattcttggaacattctgtggtttctaccaacaactgcaagaaaagggaaaaagccagaagtggccaaggccatctggggacctattctcctacacagagtgaacagtggtcagagacttgatttatcatcaagagcctataaaaaggctcaaggcccatctgagtttgctctggcttctgtgagaatatactatttacgaaatgatttaaacaatagatatttatttctcacagttcttgagtttggaagacatgtgaattttgaggggtgcacagttcagtccatagcaaggtttatgccagattgcctcttctaacactgagagattgaataatataataactgaaaagtataaccctggatttagcaactatgaggctagcagtaaatttggaattaagttttcagtggtgtgttgtaggcagaagtcagat

SEQ ID NO: 205370 - DNA, 310 bp, Homo sapiens
agggtgtttccattcttattatggtactgcaagaaacagccatagatatattttgagagttgttctaacgtctctgtagaataaatctaaaagtgaaagtgttgagtcaatggacatatgggttgagattttcctagatataacaaaattgcccacaccctgcggctacattaaattgcccctgactcacacttggatgggagcaaactcaggtctgaagatgtgtgagatggaatggacagtgtagtgaatggctgaaaatgaggagtctcagtgcatggtcaagggtcagtgaggcacaagggaaaaa

SEQ ID NO: 205371 - DNA, 670 bp, Homo sapiens
ctttctcattcttctgctgcttagcttctcatctactgcttcccagtccctaagtatttccatgtaccctctctaagatcaggcagctcgattgtttcatcaccttgtatgaaatcctgacacctgctcacacttagcctcagctcttgcttcaaaggcttaaaaaatccaactgccaccaacactcccaaaataacaggacaagataattggaacccttttaaccacagttgacccttgagaaaaggtccacttatacgtggcttttcttctacctctggcacccctgagtcagcaagaccaacctccccttttcttcctcctcctcaccctactcaacacgaaggtgaagatgaagacctttatgacgatccacttccacttaatgaaaagttctcttctttatgattttcttaatttcttttctctagctttctttgttgtaagaacacagtatatataatacataaaatgtgtacgaatcaactgtttataatatccataagactattggtagttaagttcttggggagtaaaaagttacatacaggtttctgactgcatgagggattggcaccccaagaccccaaattgttcaagggtcaactgtatatgattcataaaaattcataaaaattgaaagttttcaacaataaagagcaggtgtaag

SEQ ID NO: 205372 - DNA, 1153 bp, Homo sapiens
tctctttcctcttcacctatgcgggaacttgttctagttcccacagctcctcaccagtcaattcctcaggaatcacctctaggagctcctgttgtcctcatccacaccccggttaaagttgtttgccatctcaatcacagactttgtgatttatgcaaatccttttaagtcatggacaaacctcttgagtgtattcttccagatgccattcatacactccttgatgacatcaacccaagcccaagcaagattcttaatgcagtcacagatattgcaatccttccagaattgtatcagaatcttctcagtgtctccctaagctgcgacgacaggacaaaggcctttctcagatagtacgccttaaaagctgctgtaactccatcagttggatcaaagaggtggtgtttgatactgggatgaaaaacaccacttaaaggaggcatttgcttatcagcgacaataagcaaaagcttgaagggtatgttattctctcaatactacttctccacttcgcaggcatatctattcaggagggcatcttgaaagaggagcagggtcacccacgacttcttatatctcctgcagtgcactggccaagtgtgtgtgtattgatatgcttgaagcccctagggttctcaacatgccaaatcacaaaggggttcaatttgtggcctgcaacattgcccccaagcaagactgtcatccagtccctaaaagacttgaagcctggcattgctttggtctacctcatggatcaaagtcctttcaggcatctgtttccagaatagaaaggtttcatccatattgaaaatttgttctggcaagtgattttcctccagactcagcttatctagagtttcccaaaattcttccgctgcctttacatcagcactcacaaactcaccactttcccattatgtaatgaataacgattcttgaattgtttacaccacccagaactagcagtcaattcaacatcacagccaggtccagccttttctttcaacacctcaaacacactttttgctttgggatcatcatggtgctgagaggtacacagcaccgtgtgcacctgtgtctgctcttcaatccaggtcatcagaagcttgtgtgtgtctgataaaggcccttcttgaatttttgttagtctcat

SEQ ID NO: 205373 - DNA, 575 bp, Homo sapiens
tctctgagggacacaatgagggtggttttgggagtgtaaactgcaacctattgctactgtagtaccacctgtttctgccagggtgaagtatcattgctgggtgatgctgagagcaataggaattatacaggaagtagcaagttcttttctccctctttcttccctctagtctcctctgagtgctcctattgacagaatataacagggtgtttgatattccttttgtataggatcttggtttgaatcatctcaggccaacgtatctccatgggttccatattttgtcttcaggattccacatttttattagccattggaggggaatgcagttagttcccaaatgtagccctctccattctgctgccattatctgctttagttttctcaggagcaagttatgcaacaaaagactgtggttcccaatggcagggaatacatgagaaattttacaggcttttttttattctttcttaagtctctctaggcttggggtgaagcacagataccacctatactcctcttgcaatggctcgaaattataggacagctgtcttcatggaaatcctcttcacaaa

SEQ ID NO: 205374 - DNA, 914 bp, Homo sapiens
ctcggtaccgggactatccacctgcaagtctagggtgggtccccaaggcaggacagagagggagtgggtgtgccacgtggctcagctcactgccccagagcatctgggggacctagaaatgccaggcagggcgatggagctccccaggccccacctcccactcctggattctcattctccatcagacaccactgttttgtctgggcacccgatggccattacgggtctctagtcccttgttgccacgggttttggcttgggggtgaacatgtaggtgtccttggaaagaagagcaacgaaaagggaaagtcaggtctcacaagggtttgcacagctgtgtttaaagagttccttcggggtcattacacgggagacataaaaacagttcgaatctacgtttggcctctatgtgggcggctagctgaaagacagcagtccttgcaggtggctgaggagggtaagaattcaaatgcaggtgaaagagcctgtccagcatccttcatcaaccatctaggccctaatggatccagagagggtcactgaggagtgccaggctgcaggaagtgaggtgggttcaccaggggcctccaggaacatgggcaactgctcatctttgggttgagaccacttctaccatcacttccacaaacggccatccagagattccccacaggccacccacgaccctgtgtggccaccagggtatccacctgcacccaccgtgagaaggcttggccgtgagggagactagaagcacacctcagggagcaccctgagccaggctgccctactctaagctcctcctcttggagcacttccgaaatctcatcccagaaaatggagaggcagagccaaggaatgatcgcgtcccccaccgacactaccaaaacctttctcctccttccaccagagat

SEQ ID NO: 205375 - DNA, 417 bp, Homo sapiens
gaagactcgctgtgtgattccgcccaccccatggccattccctcctcctgagatgttcagagcaggattcctacctagtgccccgccaaacatggcccacaccccaagtcaccctggaccacacccgcccctccgtcatttcctacaggcttttcctgcagattgagagaggaaactgggcagggagcacaccactgatgggtgaaatgatgatctcacaggaaaccagacaagctagagttgtcaccacaccctggactcagagaacttgggtacttcaccgacggccacctcccatcgccctttcattcttcatgggcagggccttgcaagccttggtgatggattttattccatgagatggggcagctgttgcaggaacacgatttgagttgttttttgaaagattgctctggc

SEQ ID NO: 205376 - DNA, 728 bp, Homo sapiens
tgtctgactccaaggattgataatacttttttcatactcaaataaaatgacatcactgaaattccactataggtatagcttcagttacaacggctatagctactgcttacaatagatgtttatacacatttaatctagcattaaaaaaatattttttccttaatttttttgataagacaggatcttgctgtgttgcccaggctggtctcaaactccagacctaagacgatccacgcacctcggcctcccaaagtgttgggagtacaggcatgagccaccactcccagcctagacaagctgatttctcttggccccttcccattctagaattcagtattccttctgcctgttaattcaatggaaaagttggctcaagtgagtattaggttagcaaacactataaatattttatataccagacacttcctgtcccttctcaggtctctgtttgaatacagtactaaaaagttcatctggatcagcagcctaggctcccaccctgccatgagttgggttaccttttagatttcctggatgagtatgaagttaactgtagcctaattatactagacactctgaaaaaggtttttgtgtgatgtctgcaggaaaaactttcttttcttccctgtggtgtttcccatttcagaagcttgtattcaaacatgccagtcatgcttatatttttagttattcttatttctccaccccattgctcaagaggtgagtcc

SEQ ID NO: 205377 - DNA, 931 bp, Homo sapiens
  misc_feature (18)..(18): n is a, c, g, or t
gcagggctggtaccgccngggggtacgggatctaagaacattctctaataagctctttttttttgaagagttctaattttagttacgccgttgatgaactgtattgccttggaaacgtcactgtgccccagttttcttatctctaaaataaggagtttagagaagctgatttcttttttctcctctttttttttttttttttttttttggagatggagtctcactctgtcacccaggctagagggcagtgccacggtctcagctcactgcaacctccacctcccaggttcaggcaattctcctgcctcagcctcccgagtagttgggattacaggcacacgctaccactcctggctaattttttgtatttttagtagagactgggtttcaccttgttggccaggctggtctcaaactccagacctaagacgatccacgcacctcggcctcccaaagtgttgggagtacaggcatgagccaccactcccagcctagacaagctgatttctcttggccccttcccattctagaattcagtattccttctgcctgttaattcaatggaaaagttggctcaagtgagtattaggttagcaaacactataaatattttatataccagacacttcctgtcccttctcaggtctctgtttgaatacagtactaaaaagttcatctggatcagcagcctaggctcccaccctgccatgagttgggttaccttttagatttcctggatgagtatgaagttaactgtagcctaattatactagacactctgaaaaaggtttttgtgtgatgtctgcaggaaaaactttcttttcttccctgtggtgtttcccatttcagaagcttgtattcaaacatgccagtcatgcttatatttttagttattcttatttctccaccccattgctcaagaggtgagtcc

SEQ ID NO: 205378 - DNA, 219 bp, Homo sapiens
ggggaaatgcctctcatgagtatctagaaggaaatgagagactggaggttaggagagaaacgattttgttgggtcagctttcaggtagtaggataccagtactttctacagccatgtcgctgatttaaccgctttggctaactctgaattgaccactgaaatttaagagtttattttgtgtgattagactaggtttgatatcacatagttttcttaaga

SEQ ID NO: 205379 - DNA, 389 bp, Homo sapiens
agccccattcctaacaggccatggactggtaccagtcagtagcctgggtgttggggacccctgctttaatggatgctggactaagacaaagattcctggatcagagacaaaggactttatttttcatagcacagcaagcagcatgtttgcatcagtttccccttgttccctagtcccaccggggcaatgtggaagacccagatgggttctgctgaggtatactaagcttggagaatctttttgataccaagcagcaagcaaacttgctctttgtcttggagagagacatcatcttaccccttaaagctgctcactacaaatccaatcctgagaaatggctcagataaagagcagtcaggccttgccttcttggcatattcagcaaagtg

SEQ ID NO: 205380 - DNA, 479 bp, Homo sapiens
gacatcggcgagtgtgtacttttttaaaggcatttatatacatattgccaagttgccttccagaaaacctgtgccaatttatagtcccatgaatgacctaggagaaagttttgtttttttacaccaacaattggtattattagactctgtgattttccaatttaatagcttaacaatgttgccatgtggctggcgtggtggcttacgcttgtaatcccagcactttgggaggccaaggtgggcagatcacttgagttcaggagattgagaccattctggctaacatggtaaaacaccatctctactaaaaatacaaaaaattagccgggtgtggtggcacgcgcctgtagtcccagctactcgggaggctgaggcaagagaatcgtttgaacccaggaggcggaggttgcagtgagctgagatcgcgccacggcaccccagcctgggtgacagagcgagattccgtctcaaaaaaaaaa

SEQ ID NO: 205381 - DNA, 391 bp, Homo sapiens
  misc_feature (57)..(57): n is a, c, g, or t
caagcagttaatacagactcaacacacgacacaaataccacataccacaaacacatnatacccaccataccacacacacacacacacacacacaactttctgagtattcaatttggttccattgtaaaatcaacttttgccataaaaatgaaagcagagaagcccctcatatatttgaatcatgtagatgaaccagaataagagagagcaaggaggcggggggcaggcacagaaactaggtcataactaggtctcagtaacattatttgtcttggtaacattatttgtacctctgaatcaattagaagtcagaatcaatacctactcttttcttttatttacatttagttaaatgagtctgtattaactgcttggggtctctagagacgac

SEQ ID NO: 205382 - DNA, 111 bp, Homo sapiens
cctcaccttgtggaaaaatattgtcttctgcaaagctggtcccctgtgccaaaaaggttgtgaactgctggattaaagggctttactcaataaattatatctaactgggga

SEQ ID NO: 205383 - DNA, 388 bp, Homo sapiens
gagcctaacctgctgggttattaaagtctaaccttggagaatgaaaattactcagctctagtcagctttagccttccatataggaaaaaaaaagaaaaaaaagaaaaagaaacactctagtgactgagtcccaccaaagtggggaacagccctaagaaacacatgtgaagctcacagcctagaggtacaagctcaataaaagacagacccacttaaagatttatagaacactcccactctcccaggccttaccagtacatcactgaatgcctatttatagcctttctattacccagtacatcttatctagccatcaagaaaaaaattacaagacatattaaaaatattaaagagatagagcaaattaaattaaaaattaaataaaatt

SEQ ID NO: 205384 - DNA, 313 bp, Homo sapiens
atctaatgcctgatctgaagtgaaatagtttcatcccgaaaccaacccccgccccacacctgtggaaaaattgtctttcacaaaactggtccctggtgccaaaaaggttggggaccactgactaaatgacctctataaaacactgcacccaacaacagactacattctctttttttcttttttttttttttggaaagcctcattcgtcggcccaggttgtagtgcaggggggtgatcccggctcatggaaacttctgcctccggggtccaggtgttcctcctactccagccccccgagtggttgggataccag

SEQ ID NO: 205385 - DNA, 563 bp, Homo sapiens
tagcaggctgagtaatcgtacccttcctgtgtagagaccgtggtgcagtgatactgtctacactttattaccaggcagctctccaggcatcttgaacttgaagccaaggaaaagttgaagctccatgcttacacataccactgggtattttgtggccacccactggattctctttcagtactggtgcttgtgcctaccatctggggacctataggcaggcttgactcattcagcccctcccatcttggttcccatctagggactgaatagggagctcagaccactgtgcactccacagatcagcccattgcctgaggcaacagaaattctcccagtaaacaaggatgaagtatatatctcttttggccacagctgactcttacccataatgccatctactggcctgtaggttgaatacacagcccaatataaaacttgccaacaaaagtttatagggctatagaaacaaagccaaaagactttacccaacatcctctacagtcacataccctagggaggggggaaatggaaaacagtaatataaccaataatattatatgaaa

SEQ ID NO: 205386 - DNA, 662 bp, Homo sapiens
agaaggagcactgtttaggaacatatggagacaactataaactccctaaataacaaaagacaagtggctttggcctggaagggatttgggtggtggaagatgaacctgagaatttattcccacatctcactgaatgatcaaattgagcgtctgggttgacacggtctaggagtggtggtggacagcaccggtgtctccttcccagaaggaagttagggcagacccacagctcagaacaatagcagaccctgcctggaagcagtgtaccttgggagaagacagccacgcacagagttcactgttgaaggacatggtagttcggcactcctgcctgtccgcctctctgtgcagctcagccatgccatggccacaggagtgccgggctgttgcctgctgacctgggatgggggtgtctggcagcaagggaggccaagggctcccaaggcagtgaagcttctgcacctgaaggcttggggagagaaggcgggcgggggcgaggagaggcctaggaagccatggggggctccgcttgggcagtgtgcggcagggagcctgcccagcctgggcctggcgcaagcatctttggggctgacctgcaacctctcagggccaagggtcccctcgaatgagccaggtgctttgacccaagcccaccccaatac

SEQ ID NO: 205387 - DNA, 280 bp, Homo sapiens
gtggttgtcctgatagcattattcatctggtcttggccatggagacagtcatccaggatattgattttgcttttgtctgtagtccaagattgtcaagcaaacattttgacccttctggaaacaaaaggtacctttgttccagcatagaaagattctgtggcatctcataagccatcagcaccccttttcctcctcttccttctcacgatcttactgctgtctgaatgcacaattctcttgggatatcaaaaccatatataaagagaaatagaaacaataa

SEQ ID NO: 205388 - DNA, 271 bp, Homo sapiens
attcctctctcaaccttcaatttcacctcctttcttccctcattctaagcagataacctggctcatctcattccctgaaacccttcctatagacccacttgcatctgcaaccatctcttccttccttcttttatccactggaaagttaatctcccccaagggccctggatcccacttcctcctctcttctcttgaccctagctccatcaactgctatctctctttcatgtacctgcaacgtttccctccctttttgctgcttttcctcagc

SEQ ID NO: 205389 - DNA, 260 bp, Homo sapiens
attcctctctcaaccttcaatttcacctcctttcttccctcattctaagcagataacctggctcatctcattccctgaaacccttcctatagacccacttgcatctgcaaccatctcttccttccttcttttatccactggaaagttaatctcccccaagggccctggatcctttgtcaaatgagcctccttcacagtttttgccagatgctgtatcttctgttctcttaacccgagcgaaaccaggtccgagccgatga

SEQ ID NO: 205390 - DNA, 402 bp, Homo sapiens
tttttgtatctgaaagacaaaaataagaattgaaagagaaaacatctccaggtgaatatgtaaatgaagctattataactaagaggaaaaaacgatgatgattattcaaaagacttagcaataggccgggcgtggtggctcacacctgtaatcccagcactttgggaggccaaggcggacggatcactaggtcaggagatcgagaccatcctggctaacacagtgaaaccccgtctctactaaaaatacaaaaaattagccgggtgaggtggtgggcgcctgtggtcccagctactccggaggctgaggcaggagaatggcgtgaaccccgggggcggagcctcagtgagccgagattgtgccactgcactccagcctgggccacagcaagactccgtctca

SEQ ID NO: 205391 - DNA, 268 bp, Homo sapiens
cgcatttatagtgctctggataatgccatttatttttgctgattacccaactttcagtatttgctgtgttatcatctgtatttacttattttgaatcgtgcttaaatcaaatgtaccttcagcacctgcaagtttgccttttctttccaggaggaaaatccccacgttgctctccctggggagtctgagaattataccagtgctgtcagaaatgtaatcatgctgtcatttcagagccacagagtatttataaaataaaaacctttcc

SEQ ID NO: 205392 - DNA, 491 bp, Homo sapiens
actgaaattactcaaagttattgtgtaggtcaaatgaaaatctaaacttgaaaagcaagatgcttgaaagtatttaaatctttgggtaagaaccttcatttgtttgcactagcaatatccatcccagccccagtaccaagtggtgtgatatttggtgctttttacatgtttctttgggactgtttcctcttctgtaaacaggagttaccagccctttcatgggttaagatgagagctaacatatgtaatatccctcatccagtgggtggcacagaggagcttcattaggagctcaacagatggagggtgttacttgttcctaccagaagggaaagggaatgttctttctccagctttatgggatttcttgtagtccagtgaacttttcaaaggagaaggcaattgtgtttataatgtaattatactcctttccactgcactaagtcactttttgagatcatcttacaagttggtaacaataaacagttaaa

SEQ ID NO: 205393 - DNA, 394 bp, Homo sapiens
ctaaaattcaaaaatctaaaatctaaacaaaaacacgaatctgtacttcatgtttcaaacactattgccaaagtatctatctagccaaatagaataagaagaagcagaaaaaactttaaaagaccaatagcaccttgctagctcattgctaataagaactaataggtacttaaactgatgaaagtgattcggacaacaacatattaaccccctactgtgccctgttttaagctgttaatagacattagtcttttaaagaaagactaacacttctatatttgttttctaagcttttgatacattagtgagcagttatagacgcttgccatatctgattcttatagcacagtgcattttccagaatactttttaggaacgctaactgctctaaaag

SEQ ID NO: 205394 - DNA, 381 bp, Homo sapiens
aagtcctccgcttaaaaatacttgtttttacacctaggctaagtaaagctaccaaagaaaaatgtgtgtgtctgtgtgtgtgtgtgtgtgtgtgtgtgtgcacgcgtgcacgcacgcgcagagggggaagcagtttcctacaaaggaacaagaactgacgtgccaaaaatcagtgaagcaatgtcttcaaagttctgatagaaaaattatttcattccatcttgttctacttttgtgtgtgtgtacacactgctttccttacatatatacacacacattgctttcctaacaacactagtaacaaaagaagcctttgtttttaagcagtcaaatttcaaagcctctaaaaaaccctccacattcccgtgggcccccacaatt

SEQ ID NO: 205395 - DNA, 418 bp, Homo sapiens
caagcagttaatacagactcaagaatggagggaaaagtaggatggagactggttaggagattactagagtaatttaggcaagagatgacggtagcttggactgggatgctagtggtggagtggtgagcagtgatcagactcgatatattctgaaggtagagtcaacaggattggctgatggactggatgagggtgtgagaggagagtcaaggatggctctaaagtttctggcctaagtgacgggatagacagaagtgccatgaactgagatggaggacgctatgggagaagcaggttggcttttggtttttgttttttgagggtgggtgaaaacatcaggagttcaactgcgcaatgcttgttagccattcaaatggagatggagagttggctacatgagtctgtattaactgcttgg

SEQ ID NO: 205396 - DNA, 762 bp, Homo sapiens
gtatttttttgtttttgttttttttgacagttttgctctgttgcccaggctggagtgcagtggcatgactttggctcactgcagcccccacctcctgggttcaagtgattgtcaggcctcagcctcctgagtagctgggattacaggcatgtgccaccacacccggctaatttttgtagtcttattagaggcaggatttcaccatgttggccaggctggtcacaaactcctggtttcaaatgatccgcccacctcggcctcccaaagtgctaggattataggtgtgagccatcacacccagcctacaactttttgtatatattaattagaagatttacgtgttgctaatttattagagttaagtatttttttaggaccaggcataatttagtagattatgaactgttttgttttgtgcttggtaaagtgaagctggttggtccacaccactataattcaaggtactaccttataacagtcactcacgtggcaaaaatattatctgagtcagtaaaatagtttctgatttgctagccttgtaaacctagacttacagttaatgattttaaatgtgttgggataaggcggtggaggtgggtataataaacatttttaagtgttttataaggagcttgtatcatcaagaattttgggtcatttcagttatattatatccactcagagaaaatcatggtgtcctcttacaagatgttgaaactgatagtatgaaataaaaggaataaggcctttgcaattatttca

SEQ ID NO: 205397 - DNA, 206 bp, Homo sapiens
ttctttgctatacaacgtaaggataaatttacctggatgtctctgttcacctgatatgcagtacgcagctattcacttataccacagctcttcgtaatagaaggtagctataatcccctcaacaaaataaccactgagagacacagagagcgagagagagagagagagagagacagatcgaacacctatgatgcacctacttctaa

SEQ ID NO: 205398 - DNA, 343 bp, Homo sapiens
gtatttaaatacaaccgattcctgaaccctgacggatcagagaagaaagacttttacaaggatgggaaacggctgaagaattacaacatgccctggggggcggggcacaatcactgcctggggaggagttatgcggtcaacagcatcaaacagtgagtggggggccagggcagggccagggtggctcctgatcccctggttggcaggcgcccttctctcctgggactgagggctcagccaggagaatggtttggcagaggcttcacatggacagcccgtgagccatctcttatttgtggttttacaactgtgtgcttttataaatcagaagagctcgtgtaaa

SEQ ID NO: 205399 - DNA, 191 bp, Homo sapiens
cttggatagggagtcaggatgggaggtggccagggaagggatggggcagggccagcctgcatatgaagggccttcctggttaaggcaatagctttggatttttatgcagggataatggcaaactgttgaattctgggctggggattgatgtgactgctgttgctgtgtggagaaaagtgcgggggagagca

SEQ ID NO: 205400 - DNA, 395 bp, Homo sapiens
gatcacttgagtccaggagttcaggaccttcttgggcaacatggagagattccatctctacaaaacaaaacaaaaaaatcaaggatattttccaacgtaactacagtacagttgtcaaaatcaggaagttaacattgaaataactctattatctaatctatagtttttactcacattttcccagttcttcagtaatcttttaaccaaaaaaacaattttgttttgctttaataggatccattgtgctaccatgtgtcacatgttcacatttacttgtctctttggtctcttctaatctgggacagtccctcagcttttctttgtctttcaaaaccttgacgttttgaaataatagaacccggttattttgtagaatgctctttgattttggttta

SEQ ID NO: 205401 - DNA, 373 bp, Homo sapiens
cagtaaatctgaagattgctagacaaaattcctagaatcctctaggaatctatcccaaagatttactggcaaaatattttttatgaaatatgcgttttactattcattggcacactatttgtagtagcaaaaagctgcaatgactgaaatattcttcattagaggacagttgggtcagctgtggtgcttccatagggtggaaaactatgaagatgaaaaagaaatgggaaatatatcagtaatagagtgattgtcatgatatattaagtgaaagaacaagataccacttgtctaagaaataagagaatacgtattttctttgatatttgctttcttttaaaagaataaaccataagagaataataatagaaaa

SEQ ID NO: 205402 - DNA, 462 bp, Homo sapiens
ccaggctcaactgataacgtctgccttggcctcccaaagtgctgggattctgtaagccacctcacccagccatgtattgcttttttatgacagttaaaagaggaaagggcgggggacagtttacagaccagtgaaagtgctgagataaatatttttatacctaaggaaatagtgattttcccaagatgatagggaggcaggtgatgtagatagggctgaagattagatttctggctcctatctgtgattttctgctgtaccagtctgccttctattttatgggctcagtattccttacctgcctcttcccatgctaaagatggcccaccttcgttttgttatttaagcaacttcatcccctggcttgttttcacagtggttttctgagcctttgactctaagtcatctaattgaacattgtgttgtgatataaaaagtaagttaggcttgtgtttttcacca

SEQ ID NO: 205403 - DNA, 491 bp, Homo sapiens
cccacctaagtgtcccccatccccaggactgtgcggctgctgagaagtgctgcatcaacgtgtgtggactgcacagctgcgtggcagcacgcttccccggcagcccagctgcgccgacgacagcggcctcctgcgagggctttgtgtgcccacagcagggctcggactgcgacatctgggacgggcagcccgtgtgccgctgccgcgaccgctgtgagaaggagcccagcttcacctgcgcctcggacggcctcacctactacaaccgctgctatatggacgccgaggcctgcctgcggggcctgcacctccacatcgtgccctgcaagcacgtgctcagctggccgcccagcagcccggggccgccggagaccactgcccgccccacacctggggccgcgcccgtgcctcctgccctgtacagcagcccctccccacaggcggtgcaggttgggggtacggccagcctccactgcgacgtcagcggccgc

SEQ ID NO: 205404 - DNA, 594 bp, Homo sapiens
taagtaacattcctatgattattttgcaacaaagtggggaggctaaaaagtaaagtgattacttgttaaacaaatatagtgcaacttatgcagacaaacaagtgttacctccttcagaacagacccctcagaatccaatatcttaattctaacaagcctgcgtcagaggctagggccttgactatgagaggagttaaaagtaacttggaaccaaacctgataaataaggggtgagcaacttacatggggaagggaactggcatttcttgagcttccataataggaattgtgtttatgggaatggccctgtaagaaggagactactgtctctgtgttatagctgggcagtttcagagaagtaaatggcctgcacaagttcacataactagtgagtgggtccttctccaggtctccaaaagtgatttatgctttcttccatattatgatgattattttatttactgtttttttctaactgtgttagaaaaatgtgtctttaatatcatagaacaatttttttggtctggtttataaatcgatcctaaatacaaatgaacaagaggaaataaacattttgaagaatgtcatcattat

SEQ ID NO: 205405 - DNA, 154 bp, Homo sapiens
ggcccctgagtcaacacattagccattgactattgataatccacctcttcaaactatcagtgtttgaacactcacacttggaagacctaactattcttccagaagacagcactggaagtgacacatttcatttctgcatattctctggcactga

SEQ ID NO: 205406 - DNA, 181 bp, Homo sapiens
ttatactgggcaactttcatatgggtatggtttgaggattatctgagccctttgggtgaaactcattttctctatggaatctttcagtacctgaattttttccagtaaaataactctttgagtttcaaatgacttttcataaataaactgtagatcaccctccataagacacatgtcttat

SEQ ID NO: 205407 - DNA, 235 bp, Homo sapiens
acacatatgacatacaaaatacgttagtcaacaatatatgctatcagtaaacttccagtcatcagtgggctattagcagctacgttttttgggcagtcaaaagcatggggaaggagagggtggtccctaacccctgtgttgctcaagggtcaattgtaataatacccatttaagaatccatggtatatatggtaagtgcaacaactctagaagagagtgctaggagttggaaaag

SEQ ID NO: 205408 - DNA, 206 bp, Homo sapiens
ctttctttctctctctttctttctttttctttaaaaaaaaaaaaacaaaaacctcttcaacactagggattttagaatcatcttgagtgacttgaatgttggggtgtttccttccttcacataaagcacccagacccccaaattgctattttattttttgaatgttaattccagaaaggacttcaagactgtcctggaccagcttg

SEQ ID NO: 205409 - DNA, 804 bp, Homo sapiens
cacacagagccattacctaccacagagctgacgtgaacaggagtgtgcttgagggtggcgcttgacacaagtatcaatgtgcttttgtcttccagaaaaaaacttcaggctttcatgacctacagctcagaccctgcaacaccctcaccccatttctactcctgcaggatttctggaagcaaatccttatgtgactttgatagcactgaagaaataaaatctgaggtgaggacttagaaaatcattcgagaagcattgcagctcgtaagtttgatcttgatgcccacagaactggcagctcttaagttattacagtatcagagcttcagaaaatgctctgctaaagacaattttgtgctcagaactaagctaaagacacacagcctcagcagtcgcaagattttaaactcggctttggatcatgccctaaggacagcaaccattttgaaagaaactacagatcaaatgattaaaacgattgcagaagaccttgctaaagcacagaggtggaggaatcgactgaaatactagttcaacgctaggctaccaaggattcaaaagaaaaaaatgcaaagaaaacttgatcttcccccaaaatgtattttacttactacacaatttaggaagatgactttctagagaaaacacagaaaccataagaaatgggtaacacaaagtacttaaaggaaaaagaaaaaagaaaggacttctgattcttaaaatcaaaagcaaccaacaagtatttattttaaaataaatctatgttcttcttaactcataataaaagaaatcaaaacaaaacaa

SEQ ID NO: 205410 - DNA, 630 bp, Homo sapiens
cacacagagccattacctaccacagagctgacgtgaacaggagtgtgcttgagggtggcgcttgacacaagtatcaatgtgcttttgtcttccagaaaaaaacttcaggctttcatgacctacagctcagaccctgcaacaccctcaccccatttctactcctgcaggatttctggaagcaaatccttatgtgactttgatagcactgaagaaataaaatctgagattttaaactcggctttggatcatgccctaaggacagcaaccattttgaaagaaactacagatcaaatgattaaaacgattgcagaagaccttgctaaagcacagaggtggaggaatcgactgaaatactagttcaacgctaggctaccaaggattcaaaagaaaaaaatgcaaagaaaacttgatcttcccccaaaatgtattttacttactacacaatttaggaagatgactttctagagaaaacacagaaaccataagaaatgggtaacacaaagtacttaaaggaaaaagaaaaaagaaaggacttctgattcttaaaatcaaaagcaaccaacaagtatttattttaaaataaatctatgttcttcttaactcataataaaagaaatcaaaacaaaacaa

SEQ ID NO: 205411 - DNA, 418 bp, Homo sapiens
acaggagcttaaaaagtgcactcttctatatctaccttgtatcacttgagtgaggcatctatccactgaacttcacttgacaccagtcaagacctctaaaagacatccactgcagtctaaatccgcatctcagcatatgtggcacaaattatcatttgtttttgaaacttttttacttttacttggcttcaaatacgtctcctggttttctatttcattgacatttttgttgctgttccctcctctacagacctgattctgaagtgccactcttaactcctttggaatctagtctcttcctaggtatcccaaggctttcaattaaatgccattatatgatgactccagatttctaaatcaaaccctaatctctcccaagcttcagcctcattcatctgcttaatgaatgacactttta

SEQ ID NO: 205412 - DNA, 766 bp, Homo sapiens
ggtgtatttctgtggtttagcaaaagggccaagtcggaaggaaaagacattcccagcattttctaaagctagataaatacagaaacgaaatatagatgaaagatggaactgctctctatagcatctgccagattcctcgactttttggcacactgattgaatttggcaaaggtacccagtagcaatcttttccattaaaaggagcagcatatactttattttaccatactgtttgtgtatttttgaccctccaaaactctcttttttagaaggcaattatttctacagagttggctgcaattatttgaaacggatcttttatcaacaaaaaaagctgcgggacatagctactgttgaacagatccaaggacctacaggtcgtcaggaaagcgtctttctttgaaaccaaaagatgcttcaacatgtgccagcatcatcttatgccaatctaacgcttttgatatccaaacctatttaaatttggaggaatcctggactgttcaatttaggcaagataagctacccagctctgtcgttttcttctatttgtgatcagaaaaactgtaacgtagtccaacattcctaattttggtaacatgatgatgttaagaaaaggaataactctcccgtccaaaatcaaatttttgtggaatccaatacttcttaaccctgaatttttttctgagctggcagtgattctatagtaaacttctgaagatatataagtaacaatctctaaaaatatgacacgcggcagcaagtatga

SEQ ID NO: 205413 - DNA, 337 bp, Homo sapiens
aatcccatcaatgaactttatatctttaccctttaaaattataatttatgggccgggcgcagtggtttacgcctgtaatcccagcacttcgggaggctgaagcgggtggatcacgaggtcaggagctcaagaccagcatggccaagattgtgaaaccccgtctctactaaaaatacaaaaatcagccgggcatggtagcaggcacctgcagtcccatctacgggggaggccgagacagagaatcgcttaaacccaggtggtggaggttgcagtgagccgagattgtgccactgcactccagcgtgggtgacagagtgagactccatctcagacaaaa

SEQ ID NO: 205414 - DNA, 367 bp, Homo sapiens
acttttgctcatactggccctgctcaaagcttttctgctctctcatctcctatcttctgagttaagacacaagccaggtgcagttgctcatgcttgtaattccagcactttgaaaggccaaggcgggagaattgcttgaggccaggagttcgagagcagcctgggcaacataacaagaccctgtctttacaaaaattttttttgatgagctgggtgtggtggtgcatccccgtagtctcagctactggggtaagtaaggcaggaagatcacttgagcccaggagtctgaggctgcagtgagctatgattgcaccactgcattctagcctgggcgacagagcaagaccctgcctcaaaaatttaaaat

SEQ ID NO: 205415 - DNA, 505 bp, Homo sapiens
gtgctacaggtggttgtctcctatagtcaggagggatagcaggaggtagaaagaaacaagaaggagaaaggcagcattgataggaactttcagcctgggtctggacacatgagctggagacctctggtttctgttcccctgaggcttttaatgaagccaggagtgttcaggaggcgcatgttcacaaggccccttcattataacttgcacattttattgtcacatttgactcttcattgcatttaatgtcttttgctttgaattcctcttggaaataaaataacaaaaatgatatagataagaattctgttctgtgtaactatgtggatattcttatagtctaatgatactttgatcttactttatgtgtttctaatattctttaccagaaattccaagagaaatataacaagaacaaaccacagaccatccttggaagtaagtgatgtagaaaacgacaagaacttttaaaaatttaatacatactatacatttttccattata

SEQ ID NO: 205416 - DNA, 655 bp, Homo sapiens
cagttaacctttttggacaaatatacatctgtatgtttaagagccatcaaaatacctgcactctgattcagttatcctactcctaggaatctatatgaaagaaatgatccttagaaagagaaaacctataacaaggtgttatctgaaagttaacaagtttacaattgtcctgtaagaggacaacgggaataaaatgtagcaacttcatggaacactatatagccatcattcatgcagtcaccagtaggttcggactgtgttacacaggaaatggacccaaaaatgaaatcaacaaataatgtgctaagaacattaatagccagcatgtatatagcacttgctgtatggcaggcactgctctaaggatttttttcccccaccaaaaccatttcattgttttaattttacttttaattgacagataacattgtacatattcatggtttacacagtaatgttttgacacatataatttatagtgattagatcagggcaattagcatttccatcatctcaaacatttatcatctctttgcattgggaacactgattttatatataaagataggcaaagaagtgacatcacacatcagaaatgagggactacagtggagttccaaaggataagcacaagattcagaagatagaggagtgt

SEQ ID NO: 205417 - DNA, 386 bp, Homo sapiens
ttctggccacgcacagagtgaacgtataattaatgggagctagagcgaccattagaataataatggccagaaaacagaactgactcgctaggtatgagccagcagtccgaacaagggcctgctgagcacagtggctcacagctgtaatcccagtgctttaggaggctgaggctggaggaccactagaggctagaaatttgagaccagcctgggcaacatagcgagactccatttatacaaaaaatggaaaatatgaggcatcagccaccgtgaccggctcagactgtactcttatagccatctgaaatacgttttctaggtagagatagattgtgtaagggtacagttgtgaggataacagaaacatggcagattatttaaaatca

SEQ ID NO: 205418 - DNA, 304 bp, Homo sapiens
ttaaaaataaaaggcaagactataacctgtgtaggaatagggagagttatgacactgagtgttatgaaatatacatttccattttctccagtttctataaaataaagctagtccattgtctatgatatgaataacatcatatcctgaaaaatatttaagttatttccttttgacattttatgttgattaaaaagtgccttttaccaggaaatgctcagtattcatttgaaatctttaaaatcaaatggtataaactgttgacttgttgagtatgctgttaaaagaatgtgagcacttcacggac

SEQ ID NO: 205419 - DNA, 189 bp, Homo sapiens
tgcagtcttcagtgtaaatatctgaaaatggttatattgggagagacaaaaagatcttccaaatctctcttatacatctgttagtctacaagagcttgccaaaactgtattctgaacttttacaggatcctgcctcagcctcctgcgtagctgggaatatagctaaacgccaccacagcgggctcgtta

SEQ ID NO: 205420 - DNA, 532 bp, Homo sapiens
atgcagggctggcatcttgtttgtgaaacgggtcccttaggcgggctcccccggggagccccagctcttcacagaccagctgctccccgctgccggctggtgcaatcagagtctgagaagcagagccatagcaggcaagagcccacctggaggtacccagcgtagagctgctgcacgtggacactccacaacccaaggacgctgttagtgaaaaaactgaggagttgggggagggagcagaggcaggggtgggggacattttccagggcctaccccagatgggtcaggcggctgttccctgagagcctcatatcctgacatcacgccacgcccagctgagaggtatacagacccccagaggttcactaacagggttcagagaaagcgctcctctgacaactttaatcttggttcccagtgtcggaccctgttgattttaatgggccaagacccaatcgttttgataaatcctatgattaccttatagcattgtaactgttgtgtcatttatataaacacttaatatacatca

SEQ ID NO: 205421 - DNA, 492 bp, Homo sapiens
tccttaatatacaaagaattaacacttaataaaaatgacagcttaaaccataacaaagtaaaatataatgaagattatttaaggcttgttttaagtctgtctgaatttcttgtttacttctagatttgcatggcttgaacgttagaattggggggaaaatagcagttatcaaggaaggtagcataatatgttaaggacatagactttgtggcatatttcttggttcaaatcctgattcttccatttactgttaatgtcatttatactctgtatgtctcactgtgttcataatagtaatatctaccacacagagtagtgaagatcaagcaagacagtatataaataaaacttcagtatagcactgcagtgagtttagataggtgtacactttgagagaaacctctgtaagaacaccctcacttctggcactagtttcaagtttgaggcattcccaaaaccatccacagggttgataaatcactggaagattga

SEQ ID NO: 205422 - DNA, 614 bp, Homo sapiens
ctgaagtgagtcttagaaccgattcaggacgcagatttctcctctgaagggtcacagccaccctgtgccctaccttggactcgcaagggtttaggatcattcgttgatgtcaagagcaattgaagaatttctaaggaacagttaaagatgacttacttttttttttttttcatttataaaaatgctatggacccttttaagagaatcggcatcatgaaatgagagagaaagtaggatggctctgaaatgtttgagagtgagttcaggagtggtttactcctgacgcatccagcagagatgcctcttaagcaccagccatggcagacagtgtcctttgtgctaggaatacagtggtgaaccagacagccatggccctctctcagggaacttaccttcgagtcaggggcagaaaaactaaataaaagtcaataaactatatctatatacagatacctatatatttgagatgagggtcttgctccaatgcccaggctggagtgcaacggcacaatcacggctccctgaagcctcaaatgccttggctcaagcaatcctcccgcctcagcctcccaagtagctgggattacaggcgtgagccgccacgcctggctaca

SEQ ID NO: 205423 - DNA, 604 bp, Homo sapiens
ctcttataacgagtcatccaaggcactgccagtcaagcatccctgtcctgcaacaaccgagctagaggcctctccctcagtcatccttcctttgcatttctgtggccgcccctctactccatgccttcatcatgccatgtcactattaccaccgtagaatccaatcctcccatgccagtccctccaaacacctccaaacacacaatgaatcacagcataattcatttcatttattcagcaaatactgaacagcttccaaatgccagcactgttctaggacctggggataatcggaaaataagatgaagttctttactcttacatatttccataaaagcaagggggttcccacaaaagtgatgtcaagtggtaataagtaaaaaacgagcaaacaacaacaacaaaaactcaagcaagtttagttaaggggtcaagaatgatgaaaaggtaggtttctgttttactcaaagtgactgaaaaagcctctctgataagggacttggagggaatgaaacagctggctgtgaagatgtgggaaggagagtgttctgggtagggaaagcagctggtgccaaggctctggggcaggtgcatgctgctcgtg

SEQ ID NO: 205424 - DNA, 466 bp, Homo sapiens
acaggaaatgggcttcagagaacccagtacatgaagatgtgcaaaatgccttgtatagccttttttagtttgcctttattgctgtattgtaatagatattaaaatagatatttacgaatgtcttcagggtgagtcacagctcttgtttcccagccctccctttctcaagtcttccattcctccattgcaagttttccagcacagatattttcagaagctggattcctgtattggggaagttgttctgcactttaatcaccgacttgtacctacacaaggggagaggttgtaactcggggagctaatgtaaagagaagctgtaccattcaacatatgtatatgaatgttgtcatttttactttacatgcatttatttgcttacagaaaattgcatagtgcagcaaatctataaaaagtcaagctttattgtcaagaagcttagagtgaccaaagacaaagggagacc

SEQ ID NO: 205425 - DNA, 389 bp, Homo sapiens
agggattagctttagagctaggaattagagattacaaaactcaaatagtctaggtagtcttctcaaattgaattattaataaatactagaataagaaatccaggccaggcgtggtagctcacacctgtaatcccagaactttgagaggccaaggtgggcggatcatctaaggtcaagagtgtgagagcatggggccaacatggtgaaaccccatctctactaaaatacaaaaattagccgggcgtggtggtgcactcctgtaattccagctactagggtggctaaggcaagagaattgcttgaacctgggaggtggaggttgcactgagccaagccaagattgcgccactgcactccagccttggtgacagagcaagactccatctcca

SEQ ID NO: 205426 - DNA, 355 bp, Homo sapiens
tttttgtttcttttgagtcagaagaagttatgaaggggaaggaagacatgcttgagctctttaagaaagcttggaatgtttctatgtgtgcaatagaaatatttcttgccaaatgataaaatgacagctacaagaatgtttctattcagaactattcaatagaaatatgatataaaccatatatgtaaatttaaattctctagtagtctagtagtcatgttagaaaaagtaaaaagaagtcaggcaccatggctcacgcctataatcccagcactttgggaggccaaaatgaaggatcacttgagcccaggagttcaagaccagcctgggcaacatggcgaaaccatgtctctac

SEQ ID NO: 205427 - DNA, 810 bp, Homo sapiens
actcatattccttagctttttccacataaccagagaatttacctacaattcccaggtaccacagatgtgggtgctttcaagcctctgtaaattcactaagttgatgagaaacctggatattagtaattaatggcagatctgaaatctctctagaaccttcctatgtggccaacatatgtcttcctgtctaatttgtcaagatactctgcaaagtcaatcctagtacaaggctccatattcatcttgaagctttttcttgttttaccagaattctggttttaattttttgagtagcaatccatgttactctttacatacccaagtcaagggacaaagctaagccacatgcttgttttgttcattatccaatattatgtaagtctagatgactgactccattagtttaactccaggtgacaatgtagatatagatccaaaatatgtttctggacaatattaatagaaatttttatgaccttggaacacacccttattctttcattcaattattttttcttctgcactagcagctctcaagtgaaaagaaactccctgctttagctgtatatgaagaaaagacctcccaggcccttctggaagagctgtggaaaggcaatccttatgttagattccttcccaagaggcttcttacagcgacatgaggttaagatcccatcttgttggggggttacatgcttccatggtctccagaacaacttgcttaactaattcaaacttccaggttcctttctaaattcccagtccctctctattaattccgccttatatatattcggccataaaacaagg

SEQ ID NO: 205428 - DNA, 484 bp, Homo sapiens
ccaaagtaacttcttgtacttgcacttttatccacatattgattttacaagtttagtacttatttaagggtctctccctcttgtcttatgaatctttgacagatatccaacttttgggcaaataattcgtaatggaataaaaaaagaaatagggattttacatgagaacagtccttaaatcattcctagagactatcttaaaatagaagcactgagatgacattctttccacacaggcattgcatcctgcctctatctgccatcacctgtttgggcactgccaaatagaacactgtaataatttaaaagtagtaaaaagtgtatctttatcaggtaaagtatcaaaagaacagtgacaaaataagtggttaaaagtgcaacccttgggagagaacttgagttggacagttttagtatgctctatatgttaagaattttttaaagctcatatggaaaaataagaacagttagaaaaactgttaaa

SEQ ID NO: 205429 - DNA, 625 bp, Homo sapiens
catttcctcctaactaggaaagttaactcttcagctacatggtggtacacaatgttgtccctgctcagcagcccttgaacactcattaaatcccacattagagctgcaaggagatagtaacatttattaggtgcctcattttttttttttttctctgagagcggatctcgctctgttgcccaggctatagtgcagtggtaccatcagggctcactacagcctcaacctcccaggcccaagtggtcctcctgcctcagcctcctgagtaggtgggaccacaggcacactcagatattttaaaaaatttttgtagagactatgttgcccgggctgccattgtttatccattgattttttattttatttacttatttttcttttgtcttttttgttgcctagtttcccccctgttctttgcttcttaattttggttggtcaaaatctttcttttaacattttgtttcctcttcaaccttgggaattcttctgtttctattctttcttgccttttccttgcttcatttcaggactcctttccaatgaacctgccattttttcctgcaaagattgtagtttaaaagaaagcccactggcctgaaactttatgtagctaagcagctatttc

SEQ ID NO: 205430 - DNA, 804 bp, Homo sapiens
catttttagacaggatcccactgtgtcacccaggctgaagtgcagtggcaccattatagctcactgcagccttgaactcttgggctcaagtgatcctcctacctcagcctcccgagtagctgggactacagaaatgtcaattgcctacctgatggctgtgaaaaacagaaagaagaaacaaagacatatctgtatgtaaaggttgagcttgaaaaaagaaaactactcttgacgctgaagaacgcaatccaacatgaaagaatgcttatttcaagttttacctgaatctacctagagctgaatttcttatctatactttactacagatattctgctttgtgcagatctacaatggatcattaaagtcaaaggacaattacttatctttctactcctcccagtacccaagacctgagagtgagatattaaattcgtccttagatctttcatgcaatgttacagctctttggaactcctcatgaagctcctcctctccatggtggaattttactctgaggagagataggctaaaatgtttcagtcccctatatgataagtccaaaatcaccgtttcacatatatgctgacctgatacattgagtcactgatacgtgtctttccaccttcagtatattttctttgactagctttattgcttccctgtgatgctgaattttgagcatggatgtgtgtgtccataacaaaaccatcctaggtaaactgaatttggttatttgaatttcataattactctttactccaagtgttgtggattcatgatgcaaatttacccattcccattgc

SEQ ID NO: 205431 - DNA, 585 bp, Homo sapiens
ccattcccatcactgtcagtggaaaaactgtcttccacaaaactggtccttgctgccaagaggttggggactgttgctctaaagtgttattctttatagctgtctctgcttttccttaatgctattctccttctttttgactttgaggagtttctctgctatgcaacaaggtattgacagagtttatcaacagcggcagtattgacatttcagtctaattctttgttttgaagagctgtcctgtgtattgtaggatgtttaacatctctgacatccacctagtagacactagtagccacccctccacaagttgtgacaaccaaaaaggtctctagatattgacaaatgtcccttggaggaaaaaatcacccctagttgaaacctactggactaagtgatgcaagtcccctctgagctcttaagtagaataatctaggaagaaatttggtatatatttcaattaaattaagtcacaattattattgctttaagaaatgagtttatttagatgttcaaaatgttgatccacatacatttttatgctaaatagcataaaggtatatactctatctttacttactttaa

SEQ ID NO: 205432 - DNA, 431 bp, Homo sapiens
cttgtttttagtactttgcattcaaccccaatccccaacataacttcattatgtttaaaaatataattttaagaaaagattatttatgttgttttcagatagtccttttgaaccgtcttaccagtaattaagagataactatgaggccttgcacactggctcacacctgtaatcccagcactttgggaggccaacgcaggaagatcacttgaggtcaggagtttaagaccagcctggccaacatggcaaaaccccatctctaccaaaaatacaaaaattgagcaggtgtggtggcgcatgcatgtagtcccagctactggtgaagttgaggtgggagagtcacttgaacccagaaggcagaggttccagtgagctgagatcatgccgcagcacaccagcctgggtgaaagagtgagaccctgtctcaatta

SEQ ID NO: 205433 - DNA, 785 bp, Homo sapiens
tctctccctagtttctctgttttaactgtttggctctttcccattttctgtctggtttcccatttgtcaatttaatgataatatattgtccctctccaggatatttgcagcccagcctccgataaaaacaatagcagccaccatttacttatccttactatgtgtacttttagactgccttttatctctaatcctcagaacaatgctgaaaggaagggtttattattttaatttaacagaagaggaaaccgaggcttagggaagttcaatgacccacccaaggtcacacaatgcagggtttggcacttaagaggctcaaagtaaatgtttgctgaatcaatgttgaaagaattagacctcaacccaggtctagttcactccaaagcctcttgctctttccacacactgcaccacacctgcctttgtggcccgcaaagctgtaaatttggcctgtgaaagtcagcaagtttctgaaaaggccttagcaacacagaccaagctgaagacaggggaggatgtcagctaccgtggatgggccccattccccgtgatctagttctgaacactcaaattcagaaagcaagccggctcacttgtcaagttagtgttttaaaagatgattgcttctcagaacgtttttgactaaaggaaccaaggaggcaggtagccaaacctacaggcagcatcgaatagagatgggaattgctcagagattgggttccaactttttaaatgtggtcgtgttacttgacaacatgaaaactttcatctcagcatttgtaagc

SEQ ID NO: 205434 - DNA, 506 bp, Homo sapiens
gacaatttacgtgtatcccctgagatccctagagataatttttctgtggaatgcaaaagttacactctcaaatccagaacatcccagagccattctcccgagcaaacatctaaacctaagttggaattcatagtttaactgtgactgcctgaaaaggactaaaagctcctggttggttgacaggaagattttgaaaagagggagtaaggcctactcatctcataaactacacaggatcccaggatttaatagagccatggatcctgagtcatcactgaaaacctctagtctaggaaaattgagattgaggaagggttggggtttcagccctcaggatgtagctccttagggaatgccctaaatcaggattggatcctgggtacaaggagaaatggagcaagtcacctttacccctttcacatttgtccattgcagactactcttttgcaaagagtgaaacaaggaattagaaaataatagaacagtttttcctcatattatgtatt

SEQ ID NO: 205435 - DNA, 230 bp, Homo sapiens
ataagggttttcttgattgaataattttaatttatgtaaatttttatttcaagaaatgttttctatttgatagagtgagtaaaattgtggcctttcccctattttggaaagtgaataaattcattaaacccctcttcatgagcactttctgaaattttaaataaaagaagagctaaccgcttgcagtgagctgagatagcgccactgcactccagcctgggcaatagagc

SEQ ID NO: 205436 - DNA, 226 bp, Homo sapiens
ccagactgtcagctctacctcctactagtgatgtgaccgtgggcaagttgcttaacctctctgtgccttagtttcctgccaaatagggataataatggcactcttcacagggacgttgaagggatttaatgattcagttatctgtaaaatcctgagaacagtgcctggcacatagtaaacactgtgtaagttttgtgaaataaatttcgagggccagtgtaacttc

SEQ ID NO: 205437 - DNA, 235 bp, Homo sapiens
caagagttccgtgctagtgatggagatgtggaaaccaggtcaaggtgctgacttgggaacatgggtggtgactggggcacgtctcagttgagatgcttgttcctccggcagggagggattgagaagaatgcgagttgcccgtctaatttggcaagttgtctgtattagtctgttctcatgctgctaataaagacattacccaagactgggtaacttgcaaaggaaagaggtttaa

SEQ ID NO: 205438 - DNA, 298 bp, Homo sapiens
gagaaagctagaaataaacactatggtgttagattggaatttgagatattgtagtaaatttattgttttcaaatataagtattcaatatacatcatgtatttgtacagataggtgtataaatgtattatgtacatgtatatattcccaactctgttcattgagtgtgtctgagagcagtgacaccccagtagcagtaagcacacctagcacaacagccccttggagaaatgattgatccagggtctgggctagggaaagcacaagatgaagctaggacatcttagtgtaccagaaagc

SEQ ID NO: 205439 - DNA, 533 bp, Homo sapiens
tcacccatatgagctgtgtgtgcacactgagacccaagctctggacatatgctcattaagtgaaatggccagcattgaatcactcagccagtctctttccttgttcagtgctgtaactctttgttaggaagacatctgcttgtaattctttagctggctcccttcctttgaactgcagttattttttcacatctcaggtgatttatttcgttgcccgttcttagagggaagtctgttcttgtctagtttcgtatagtttcgtttagtttagttttgttgctgggttttgctttattttttaaaattttaaattagaatagagatgggatctctctatgttgcccaggctgctcttaaactcctgggttcaggcgatccttccgcatgggcctcctgaagtactgggattccgggcgtgagccaccgcacccaggctgctttgttttaatatacctgcctgtgattaacagatggcagcacaagggcctggagtatggatgacccaagaacattacccctcaaaacatatgatc

SEQ ID NO: 205440 - DNA, 577 bp, Homo sapiens
  misc_feature (8)..(8): n is a, c, g, or t
ctctaganatcccgggttccttgtctctactaaaaatagaaaaaaaattagctgggtgtggtggtatgcgcctgaaatcccagctactcaggaggctgagacaggagaatcgcttgaacccgggaggtggaggtgcagtgagctgagatcatgccattgcactcctgtctgggctataagagcaaaattccgtctcaaaaacaaaacaagacagacaaagggaaacaccggtttctctcctgtgtggactctttgatgcatgcagaggctggaggtgtgcctgaaggccttcccacactcttcacatttaaagggcttctctccggtgtggactctctgatgcatgcaaaggtttgaactattactaaagccccttccacactcactacagacatacggtttctcacctgtatgaactctcatatgaatttgaagatgggagctccaattgaaggctttgccacactcgtaacatttatagggcttctccactgtgtggattttcttatgtctattaagttttgttgtagtgctaaaatccttaccacaatcatcacatttatagaccttctctcct

SEQ ID NO: 205441 - DNA, 410 bp, Homo sapiens
aaacatgatacgagtcgagcgcggaccggtgtatcgagtccactgcacccagcccatgatattttttaaatgaagttaattggccaagtttggaggatggtaggaagacaattcattaaattgaaaactggtaaataaagagcagatagaaagaatcaagcatttattctgctcttcccatataaactgtagcagagtaatcagtcaataagggaatctcttcacaaaaatattgcaactaattgttgggaaaaagctgagtgttgcgagggaaactgaggcagggcttgcataatgtcctctcgaatgtgtctgggattcctcccaattggtggggaagtaacagagtggaatgaatcttgactcctagctatggtccaccctgcactgcagggtggcatcgataaaca

SEQ ID NO: 205442 - DNA, 748 bp, Homo sapiens
aaacatgatacgagtcgagcgcggaccggtgtatcgagtccactgcacccagcccatgatattttttaaatgaagttaattggccaagtttggaggatggtaggaagacaattcattaaattgaaaactggtaaataaagagcagatagaaagaatcaagcatttattctgctcttcccatataaactgtagcagagtaatcagtcaataagggaatctcttcacaaaaatattgcaactaattgttgggaaaaagctgagtgttgcgagggaaactgaggcagggcttgcataatgtcctctcgaatgtgtctagacttgctggctccttgcttctagctctcctaggctcctattcccattatctcaagtagcagaacatgttccatataaatgctaaaccatcacagctgtagaccatgcgcctgcccttttgacctccacattctcaccacctatttctttgttggattaccaataaataccgtggggtcccagagctcagggcctttgtgggctccacaatagccatggccccctggtgtcccacctttctctctcaaactgtctttttctcaatcctttgaatccaccggactttgtcacccccacgacctggtgttgggtctgatcaccccaacactaataaaaagaaacgatagaattagaatatcatatttttgcaacaaagcacaaaagaattaatatagtcattaagcatcaagggctaataccacaaagagagaca

SEQ ID NO: 205443 - DNA, 636 bp, Homo sapiens
gcttgatgccagctagaggctgcagtgcactatgagaacacctgtgaatagccactgcattccagcctgagtaacatggccagaccccatctcttaagaaaagaaaagaaaccctgaaccagaggagcagagctgccaccacttagtggtggggatggggcagaacagctcagggcaagacacaggccttggatgccaatgccagccgtcagatattgagcaatgtgtaagtggggttagcctgcaggagaacctgctcgccacctcctcctcttcattctttaggtgatccccattgacctagacaatatctttaatatagagttctcctgatttttctacacaattttacagggcatacagaatatatttcctgtccaataatgacagaaatacttgattttgaagagtaacagttatagcttggaatagaagactggaggcagtttgagggccgacttcagagtcctggttgaaatgaaggttgagaagtataatgcagtcagtgcaggtgactttcagctgggtatctagtcctatcagaggtaaaaactgtggttgccctaaccaaaacaataggactaagagaccttaaatgaaagatgaaagttattatagagagaaatgatcatactg

SEQ ID NO: 205444 - DNA, 203 bp, Homo sapiens
atcctatttttaaaaggctccagatttccaacctccctagatatctcattctgccatacaaccttgtcatgtgatttgggggaaatattatgactgttctttgcccttcctaatgctatcttttctcaaataatatagcaatacatcttaactcacttccaagatatataaatgtgtataggtgcagaataagatatctaggg

SEQ ID NO: 205445 - DNA, 391 bp, Homo sapiens
acatgtaatccaaatttccgaaaagcagtgtcttgatctaacgatgtacaggttaaaacttgtaactgtatttggatttcatgtatagtccacctgtttgagaattctgtggtcacagctacagatgttgactgatttactcagctgctcagtctctgcataaatccaccggaagcagccatttctgaaggtgtgtacctctcctaaaattggctcacccaggggtccatcttcactgtcctcgcaaacactccactgaggccctgacctctgcaaacaggtgctctgttgcagtatttttttttggaggattatttggacataaggagataaagctgttttgctcaacaagggagacataaatcggtgggtctcctacaaaatgtgaaat

SEQ ID NO: 205446 - DNA, 431 bp, Homo sapiens
ataatctaggataatcttatttttaattagtcaccaaaattttatttactctcatgtcagattaactatgctaccattgagtggtctctagttatggtggtggcaatgtttatgttttagtcaaaataataaattcagatggttttagaaaattaaatagaacttactgtaatcccagcaatttgggaggccaaggcgggtagatcacctgaggtcaggagttcaagatcatcctggccaacatggtgaaaccccatctctacaaaaactacaagaaattagccaagcatggtggtggacacctgtaatcccagctactcaggaggctgaggcaggagaatcagttgaactggggaggtggaagtggcagtgagccgagatcgcaccactgcactccagcctgggcaacgagagcaaaactccattcaaaa

SEQ ID NO: 205447 - DNA, 487 bp, Homo sapiens
ctgcaacatcagtctgtgctctctactggattactctcagcagcagctactattttgaaaacattctccctttgacatccatattctcttctagctgcctcatttctctgcaattgtttacagccaaacttctaaagagctgcctacacactaattctacttcctcgcctcccattctctcttcaacatactccaatttctaccatccccaccactccttccttgtgaaatctctttcaaggtcaccaacaaccttcatgccatcaaatccaatacacatttgttctgaccttgatcttcttttgatctctcaaacagtaaacacattttgatgtcccctctttcttgaaatactctcctcttctgtctctatggcagcacaacatcctggttttcctcttccctgaaggcttgttccttcccagtccctttctgtttttcccgacttctttgttggctcctcttctctctatatgatccctaaata

SEQ ID NO: 205448 - DNA, 243 bp, Homo sapiens
ctttacaaattacccagtcttgggtattcttatacccaacgcaagaacagcctaatacaagtgggtctgtgtaaccaccaccacgctgaagacacagactatttccatcaccccaagaagtgcccccatgctcttttatactcaattctctcttccgccccaggcaaccactgattttatttctgttcttacagatttgacttaccaaaatgttatataaatgaaatcacagttatatggagt

SEQ ID NO: 205449 - DNA, 579 bp, Homo sapiens
cccatctctactaaaaataaaaaaattagccaggtgtggtggcacgtgtctgtagtccctgctgcttgggaggctgaggcaggagaatcacttgaacccgggaagcagaggttgcagtgagccgagattgcgccactgcactccagcctgggcaagaccgaggctgaccccgcgctcagccgagtgagaccccgtctcaaaaaaagaaagaaagaaagaaagaaaagaaaagaaagaaagaaggaaggaaggaaggaaagaagaaagaaagatgtattacacaccttttaatttgaattaattaggcatgatcattattgaaaattggtaaagtatagattgataacaaccaaaacgggaaaatattcatttaaaactttcccaaataaatgccccatgtataggcctctattaaaataataacagtaaacattttttgaaccactttatatattttaagatttgtttagagctttttcatttgcacgggaaaatattcgcctttttaaaacaacagtaggaaacaaattgaaaaagaaaggaaaaatccttgctttttacacataaaagttttctttg

SEQ ID NO: 205450 - DNA, 470 bp, Homo sapiens
gtgaagctcctgctatgcctgggaggccttgggaggaggatgaggtctttccagaggtgtagctggaccctggtattaaccatcaggaaaatgtaaccggggggaggacaggaatccacatgcggaaagtcctgtcccaccttctcttccctccttgggctttggagcaccgcagggtggagctgtgtggccctctcagcccttctgatccagggacctaggagccttgactttgaggtctggatgtcacagaaggacacagcaaggataaaagtggtggcccaggaattaggaagctggttctggaccctgctctgccacttatagtgaactagaattaaacattctgtgtctcagtttcctcatctgtgcatgaggttgcactagaccattgcaaataaacatcgaggctccagttgcttccaggacatctgcgcgcacacacctctcaccatgcccctctgctgcca

SEQ ID NO: 205451 - DNA, 161 bp, Homo sapiens
tgtgctatccacagaaacctattccaaagaatgccatgcacaggtacaggagttaggaccaagttaagacagtcatgctgaattagggtgggtcctaatctggcatagctaatgtccacatatggaagggatggacacagggggaagacagtaatgtgaag

SEQ ID NO: 205452 - DNA, 426 bp, Homo sapiens
tcaggagattcttcagggcactattacattgtaatggtgaagagtgaagcaaaagtatgtggaaactagtttagtgaatggaagaagaggtattccctgactttcattttctctaggaagaggttgggattatttacaaataaggtaaagtcgaagacttagggaacaggaggacagtttgtaatagatactgtagaaattagactagtgcaacttgggattttttttttcactagcttaattagaggtcttaaattgaaagcagcaccagtatacatcattgtattggttttgttcagcagtctgattacatgcttatgttgtgctacttcaggttggtacattgagagtaagatattgacatgatggtggtctgactaatggaacatggaatataagctgtggaaggaaagaagtaaaagtgag

SEQ ID NO: 205453 - DNA, 649 bp, Homo sapiens
tactgccttgctttgcttaagttgcttctttctgcacgacagtcaagttgtcttcagatagaatcgtctcatttgtttttttctttttcaggtctaacagtctatgctttttgttgtccaatttctgaaaacacttgtttctgatattttgttcatgttttgagatggtggtgctgggagagttgctgcagtatcaggtactccactgcggccacatgcagaagtctattaacagctattttaaggattcaataaaatatataggccccttcacaccctctttttctttagtgatttattttccactattctccactaaacctgtttcagacttctttagctcaagctactaaactcgcctcttcttttcttgctgccggtaaatgatcttgccttctacttctctgagaaaataggaagttgccttgtggtactccaccaaattaatacatttcttgtccctaacttaatacttgctcaattctatacctgttcttgtcttctttcccttatctctcaacagaagagttgtccttctgcctgtctgaatgctgatctctctctgcctaccctctaggtctcatccattcctatctcagaattcatgttatgattcattctctttctcctacttctttattttcttatt

SEQ ID NO: 205454 - DNA, 413 bp, Homo sapiens
taacacctaagtcataagtcattcaagaccagaagtgggcaggagtgagctaaaaaatacaggctcttttgctataactaagaattggaagcctcccacagaaaggaaacaggaactcccgtgggtggccccaaatgaaaagacagggcatgccaaagccctccagcaaaaaaggggagggtctgctggcgagcctgagccaaactattagcttacggggaaggaaggaaaaagaaccttgtaaagaaagagtcagtcgctcttgatagcacatgggttaatacagggatggagacgggaggtagacagggcgtcctcacagcctgatgcaggggctgccagtgaacagactagtcttgccagcgggatgagaaagatcgtgcaagtggcaacgggactcaggtggtgtgggg

SEQ ID NO: 205455 - DNA, 358 bp, Homo sapiens
taattttatgactcatttgggttggatcactttaatcttgaccaattaaaagagttctccaaatcataaattatcatataaaagtctaaatcccacagcttcaacagctatgtctgcaccagttacgttaaggagcactacagaacctcaaatgaatccaatatgtagaagaactctgcatcttgggcacaaatgtttgataaacctgattcaccacaccatatgatttctgttaccagggacattttgttgctctacttaaagattatctgtcttagtcgagtgtgttccctaaaatgaaaggttttaccctatcatgtaattactgttgtaaaaataaagccagatttgttttatg

SEQ ID NO: 205456 - DNA, 708 bp, Homo sapiens
gttgtacaaagggcagtggaaacttgaagcgaagagtttatctgtggtttgagagggacagcgtagaatgctctcaggggagcctcacatttgacattcattttggagaatgacaggaggcttcaccttgcagtcaagattgtatggaaagggtgtcaatggggcaggcatgttgtagtaggtggtgatgtaattacaaattatgactggtcaagactgctgagcagacagatggtagagttgaggttttcttgtggtagagtgctattcaacagttaagaataaactttttctctgtagttcttctattaaaataaatctgaaaaaattcagtaatttttttggatacaggtgttttttgggttacatggatgaattatccagtggtgagttctgagattgtagtgcacccatcaccttagtagtgtacattgaacataatgtgtagttatttttatccctggccccctcccaacctccctcatctgggtctctggccccctcccaacctccctcgtctgagtctctgaagcccgttatatcactctgtatgcctttgcatactcatagcaagataggggttttggttttccactcctgtgttatttcactttgaataatggcttccaggtccatccatgttgttgcaaaaggcattattttgttcctttcaatggctgtttttctccaaacttctgtctctgagag

SEQ ID NO: 205457 - DNA, 569 bp, Homo sapiens
atttggcggtgcttctgcacttctgctggagagaagggcagaaaaaaacctttacagatgcaaaacaagaaggcttctcattaggcatttggattaagaactattgctcaagaagccctgagcaaggcctacaagttctgatctctctaacctcctctcctatgactgtcccccttgtccatgggcctctgccatgctggcttccttgacgctccgccaacccttcagacacactcccacctcacgaccttcccgggggctgttccctctacctggacgactcttctctcagacctctcgtatcttcaagtctcggctcaaatgccacctttgcgaggaggaaaaagatttcttttctttcccatgatatttatcacctcctactacaccgtataatttacttaattatctataattcaccccgtttctcctttccccctcaaataagctccaggaatgcagagatctctgtcctgttcactgatgtctatcacaagcacttagtgcctgacacacagtaggagctcgagaagtattttctgaatgaatgcagaatggacgtcttgacc

SEQ ID NO: 205458 - DNA, 472 bp, Homo sapiens
cttttattctgcaggttggatacactcttgttgtagaatctacaaagagacattttgaagttcattgaggtctatagtgaaaaaccaaatatccagtgatagaaactataaagaagctatctctgaaaatactttatgatgtgtgatttcatttcacaagttgaacttttcttttgattcaacagcaggttggaaacactcttttgtaaaatctacaaagaaacattttggagtccattgaggcctatagtgaaaaactgaagatttcgccttgaaaaccagaaacaagctatctgtgaaaatgctttgtgatggaagatttatctcacagagttaaacgtttgtattgattcagctggctggcaacactctttttgtaaaatctacaatgggacatttcagagaccattgaagtctacagaaaaagactgaatatcccatgattaaaactagaaacaagctatccatcaaa

SEQ ID NO: 205459 - DNA, 459 bp, Homo sapiens
ttcaggaatgtagtcattatcttctagatcaagggtgtccaatctttggcttccttgggccacactggaagaagaattgtcttgagccacaccacacataaaatacactaacactacgatggttaatgagttaaacaaaaaattgcaaaaaaaatctcataatgtttaaagaaagtttacaaatttgtgttgggccacattcaaagccatcctgggccgcgggttggacaaacttcttctacatgctattagaattttgccagatgggaagaaagagacagatgttagaatggccagtttcctgcgtcttttcatttcaggggaatggctcatgagctacggcctgtctctccctccatttcaacagacgcctgccaaagctgatctaggtgcaaagggaaaatcccagcccctgatatcctctgggaagacctctgtttcagtgcacgagcctgccag

SEQ ID NO: 205460 - DNA, 692 bp, Homo sapiens
gcagtgcctacttgaacttcatagtccagcagccaccctctgcttccctgccctcctgatggggcaatgtggctgcccctctggtagccagttcacctatactgctctgagagtcataatgctggaagctcagcctcagccccttcctcctgcccttccaatccttttgtaagcacctgatgaagtccctttctgagctcaggtcgtgcctgtgccccacaactgaactcagatggatagaatgatctattaataggttgtttccagaacttattaaagtgtatatggtctggtatcaggtaactcagtatttcctaggaataaaatcctacaagtggaactgttagagccctttcactgtgcatatggctaaagtaaagcaacagagaagtgcaggtacttgtctgagttcacatagggaaatgggagcagcttggggtgctccttccattaattcatgctgctttgtcatggtcattaaacacccctggcgtttttcaggtgaagaggaccaactcagtttattcaaataacttgtgagagagactgctaattttctattcaaaagtctttcggccgggcacagtggctcatgcctgtaatcccagcactttgggaggccaaggctggcggatcatctgagaccaccctgaccaacatggagaaaccctgtctctactaaaaatacaaaa

SEQ ID NO: 205461 - DNA, 503 bp, Homo sapiens
cttacttatctagtaaatcttttgttttaaatcagactgataaatgatgggaattgtcagtccagttaacaaactcattttgaaatcagcatgtggtattcaacagtgtttccctccagcggttatgtgtatgatattgaatttaatatgccatgaatttgcttttaaatacacaaatatagggtatattttgtgtatatattgatgtatttattttgttttcatagtaaaatccaatcccaattagttttataatgtaaataaattacaattaataaagtagaaatgcatattttaaaacatgtttacattgttttaatgtgtagcataggtttttacttgacagctctttgcagaaccatatcatttagttaactaataaatctggaaacttaaaaaaaattatgagctactttaaataattttagagagtacttgcaactttaaaatgtttagtgaaataacttgtatttgtattgtacctttgtttgaaattgtaaaaa

SEQ ID NO: 205462 - DNA, 485 bp, Homo sapiens
ttttctggatacagaggatgtgctatattccagagcgttaaaaaaacaaaaaacaaaaacgctctatgactcagtttcctcattcacaaaattgggataattataaaatcagccttctaaagctattatgagaatcaaatgagatgatacccagaaagaacatgagtgtgagggtcagaaagaatgacaggcaaatgtgcagcctgcgtttccttcctgtcccccttcccaatgcccagcgtgccctcctccactgctcagcacagccccaccttccacacccagcaggtccctcctaacacccggtaagggccccatcatactcagagtccttgacgagggccggcagaagagattaactagcatggtgtctgtgaacaatgtatcctgaatcataagcaagcaaacaacttttgaacttcctagtgctacctttaagtagttaaaaatcaccctttgctaaaagagatgtagaaaaaaaaaaa

SEQ ID NO: 205463 - DNA, 461 bp, Homo sapiens
gccacagggacctctgccctggaaagccaggtattgtccaaggtttctccccatgtgatagtctgaaatatggcctcatgggatgagaaagacttgaccgtcccccagcctgacacccgtgtagggtctgtgctgagttggattagtaaaagaggaaagcctcttgcagttgagatagaggaaggccactgtctcctgcctgtccctgggaactgaatgtctcggtataaaacccgattgtacatttgttcagttctgagaaaggagaaaaactgccctatggcgggaggcgagacatgttggcagcaatgctgccttgttattctttactgcactgagatatttgggcagagagaaacataaatctggcctacgtgcacatccaggcatagtacctccccttgaacttaattatgacatagattcttctgctcacatgtttttttgctgaccttctcctt

SEQ ID NO: 205464 - DNA, 398 bp, Homo sapiens
tacatacccaaagaaataaatacctgtacaagactattcatagcagctttattaatactagcctcagattggaaagtgtccaggagtccactaaaaggaaaatggataaataaactgtgatctactcatacactggaatactactaagcaacaacaaagaaggattgatacatacaacattaatgaatctcaaaaacatgctgaatgcaagaagccttatacaggagcatgcattgcatgattccattcatatgaaacttgaaactgtaaaaagaaagataaatggtgaacaaaaccacaacagtagctgtctcagaggggctagggtagaaaatgattgcgaaagagcagaaagaaactttctgcggtgatagcaatgctctgtatcttggtaaatg

SEQ ID NO: 205465 - DNA, 626 bp, Homo sapiens
tggaaagaggctacaatgaggctatctatggattttcagtgggtaattttaaaaactgtgcctccatggaagcttctgataatgcttctgtcctcacctccaccccgcctcccactgtgcttctataactggccttatgacaacaaatgaatctggcataagagagaagagcaccagagtaagtgaaacagaattgagtgaattagccgtctcgttggattctacccaatcacactgtgaaagtccattatgcattatgcttatattccattgtgtaatgaatggtaattcttctaatgataaatactggtcccctttggtaccaaccttagagttagaaatagcttaatctgttgagtaaatgaataaaaaccgcaagttgaaaacagcaaaaataatttctttgcttggaatatcagtgtacatatctttccgtgcaaagttctccacttttctcattacccattaacttgtttgttactctacaatctccatctgagagctaaaatctgctgcttactattcacaaggcagagagaattataaaacgttatacaatagtagcacacagcatagctttgaatctttccataaagtcatcataatggtacgttttctgagtattg

SEQ ID NO: 205466 - DNA, 801 bp, Homo sapiens
gtgacactggcctgccaggtgtcagcccagccagctgcccaggccacctggagcaaagacggagcccccctggagagcagcagccgtgtcctcatctctgccaccctcaagaacttccagcttctgaccatcctggtggtggtggctgaggacctgggtgtgtacacctgcagcgtgagcaatgcgctggggacagtgaccaccacgggcgtcctccggaaggcagagcgcccctcatcttcgccatgcccggatatcggggaggtgtacgcggatggggtgctgctggtctggaagcccgtggaatcctacggccctgtgacctacattgtgcagtgcagcctagaaggcggcagctggaccacactggcctccgacatctttgactgctgctacctgaccagcaagctctcccggggtggcacctacaccttccgcacggcatgtgtcagcaaggcaggaatgggtccctacagcagcccctcggagcaagtcctcctgggagggcccagccacctggcctctgaggaggagagccaggggcggtcagcccaacccctgcccagcacaaagaccttcgcattccagacacagatccagaggggccgcttcagcgtggtgcggcaatgctgggagaaggccagcgggcgggcgctggccgccaagatcatcccctaccaccccaaggacaagacagcagtgctgcgcgaatacgaggccctcaagggcctgcgccacccgcacctggcccagctgcacgcagcctacctcagcccccggcacctggtgctcatcttggag

SEQ ID NO: 205467 - DNA, 261 bp, Homo sapiens
gaggaccccaagcgttatactaatcaagaaactcagatgccttcttgtgtagtgattgtttgaaagtgctagttacttggcagcagtcagacactagcagagaccacttaagacccaacagaaggccaagtctcacaactttcattcgacacagtgcttgtttggggtagggtaaggtggagaattattcatcacaattccagtaaatagctcctggccacagagcgttacattagtcaaaaatgagtctgagcacaagag

SEQ ID NO: 205468 - DNA, 606 bp, Homo sapiens
tattatcttggttttgtatttcataaagacttctagtgatccacattgggtagtagggtgacataagtagcagttggaagtcaagcatttattaagttaccagaataatcctagataatagaaattagttgacttttaacctaagcaatttgatgttttttttaatagcccgtttaagaaaaataaaatgcctccctacaagcctgtctccttctcatgctgctgctttcttcttcaaattcagtcttcttggaaggatagcacatactcactttcatttatgctgtagtcaccacagcccagcatggccccctccacgcttgaattattctcccattcattggtgactacctcagtccagctggcattgcgcagttagttcttcccttactaatagttgatgttgactgtccctccttgaaacattcttcatccctgctttcttgaacattttttcaccagttcttcttctgccccctgtcagacttcgtttcattgtctggctttacctttccacatacttgaaaacattgtgtccacccaaaccgttcttttctttcgtctttacgaagatcgatagatgcatcgcgccatttctcatcagtt

SEQ ID NO: 205469 - DNA, 816 bp, Homo sapiens
gacgaggacgacctggaggtgttcagcaagggaggttgaatgtcactccagtttctcaagttgctgctgagagaagacctgagttcagatcacaacgctgtattcattactaagaagcctgttcattttaacgttacctggagatattaggatgcctcattgatggacatgaactccttcagccctatgatgccaacatcccctttatcaatgataaaccaaatcaagttcgaggatgaaccagatttaaaggatctcttcatcacagttgatgaacctgaacagtcatgcttactacaatagaaactttcattacgtactaggcatcacttactaacgacatctcgtgggcgaatctgcactccagctgaactcttgaagcttcaggagcacgcatatcaaggacttctccctctggctcggacagggcacaaacctggccaacgacagctacgacgcccgacatcctgaattctatttcccaacccaatatggccagaaaacacaagcttgcattagctacacaagggaaactgggctgggcaatcggcctgttatataccgcaacctgcaccgtctccagtctggaaggtaaccacccgtccagtgtaaacgtggcctatgaacgcagtttaccacaagctctctacacctgagaaaacgcccgggcagaagtctatggacaatagggaactccccaattgccccgagcacagctatatcttcatgcgccgaactagcgttagaagccttgggcaacagatggaaaccattgtgtccgacaacagatatgcgtacgagtccacactcctttca

SEQ ID NO: 205470 - DNA, 330 bp, Homo sapiens
agtttggctgtgtccccatccaaatctcatcttaaatagtactaatccccacgtgtcaaggatggtgccagttggagatagttgaattatgggggtagtttcccccatactgttctcatggtagtgaataagtctcatgtgagatgatggttttataaatgggagtttccctgcataagctctcttgactgccaccatgtaagatgtgactttgctcctaatttaatgccttctgtcatgattgtgtggcctccccagccatgtggaactgtgagtccattaaacctctttcctttataaattacccagtctcgagtacatctttattag

SEQ ID NO: 205471 - DNA, 226 bp, Homo sapiens
tgtctatatagaaaatctgaaagaactgacaaaggcaaaataaaacaactcttggaactaataagctattatagcaaggtttcaagatacaaggctaatatataaaagtcaatcactttgctgtagacgatgaacaaatataattttaaatgaaaaacacagtatcatttgcattcacatcaatgaattaaattcttaggtgtaaatccaacaaaatacgtagaat

SEQ ID NO: 205472 - DNA, 824 bp, Homo sapiens
aaactgactgtcactcacctgcttaaaacccttctgtggtgggttgcttgatacatgaactccaatttcgttaatttaatacaaaaggtcctccatggttcagctcctgcatattcctcagccttatatcctgacactccatttttcataatttaaactctagtaattcttaattggtcatatttacccatatatcttaatattccactgccatacttttgctgaagtcattctttctgtatgggctatttttcccctcttccaacccccttccctagtttattctatttagtgttccaattcaggggtcatctgctttgcccatatccagagggttagctggccctctgggctccatagactcctgtgcatagtctagtatctgcacttagtatattgatggtaatcatctaccctactaaatttgaagcaccttgcacagaagggccaagtttcagtcatctgagaatttccacctactcacttaagacctggtacatgagaattgtgaaataaatgactgtcggagagagagagggggagagagagagaaagagagcgtattctcagagcaattctactaagttctaatgatttccctgagagtcagaataaagataattttggggtggaagctgagtcgtagagaggttgaatgagttgcccaagttctcttggctgggtttagagtctaattttgactcctagcccataatttccatcagtaggcagtactgccatccacaacctgatcctttaacattcagaactgcgtgtattaatggccctggctcacttgggaatgcccaggcactattttggag

SEQ ID NO: 205473 - DNA, 280 bp, Homo sapiens
aataattcctaaatctctaacattataggaggaaaaggtactgaaatacaacagactttactttttgttttaactgtcccatgcacagcaacacatggaagttcagttaaaatctgttttgtggttagattctataagctctgaagatgtactggtaatcaagttccagaatttaaagtacatcagatatacctgacacatctaaaggagttttcacttttgtaaaacagaatatactataaccaatgaatactgaaactaatgttagagatacggtacg

SEQ ID NO: 205474 - DNA, 232 bp, Homo sapiens
agacacagaccttggacctatgtgatacacgattattgttattcgaggcaggaaacaaaggtctttgatcactggagaaaggcagggccggccaaggcaatatgggaagcaggctgattacctatgcaagcccttcctccattaaggcctcctagcctgagctgcagctgaccctgggtggtatttccagcctttctcagcctcaaagcaacacatttattcagggtctcca

SEQ ID NO: 205475 - DNA, 447 bp, Homo sapiens
cggtatggcaatctgagctaagacaagagtcaagtaggcagtggtaagtgcaatggagacaagcaaatgtggagcaagaaggggtccaacagggagagctgcaattaaataaaattgcactgagaagatgacatttgggtaaaatttaaaggtgagagaaaaaccatgaatatatgggatgggtaagggattgggggaatgataagatagagcaagcaattttgtgaatgccccaaggccgcaggatgcttggaactgtgcaaagagctggaacagaatgaatggaggaaagagcaataggaaagaaaataaaacacaagagatggggggcggggggcagattttgcaaggccttgtaggtttttgcaagatcgtggcttttactctgagactgaaagacatgagaagattggaccagaggagtgatatcatccaatttgcgtttgc

SEQ ID NO: 205476 - DNA, 512 bp, Homo sapiens
gttctggctagtgtgtgggtggtcaatttcagatgaatttcacacatgcaggcagctgcaccctgccaagttggaggtagtgatccacatgcgggcccttacactctgatgttcctgggactggctcttgcgtttgcagttgaggagggaatggagagatgagcctgcaggagagaggcagcctggtggcggcggtgatcttggtgttaacagccagcacttattaccgcatgtccagcactgtgctaagtccattacgtgcattataccaaggaatcatcatagccgccctatgaggaaaaggtactgtgacatttttagtcccactttacagaaggaactgaggtagcactgaggggcccgcttaccagaggattccattgcttcattttcaccttagtctgatccttggtcctgctcatttgaagagatccctaaagagacatcagtgacattctccgggttcaagtgagtaatggcatcagatattctgtcgagagagatgagggctt

SEQ ID NO: 205477 - DNA, 533 bp, Homo sapiens
cacacttgcagaatctgtgaactcaggaagtccttacctgcataatttgtggccattttaaactaaagaaggaagtctctctcacattgccatgctcactcccacacagcttgcacctccaggaaggtctggaaaggccatttgccccaggtgtaaatgacacgcagtgctgagaagcaggaggagcctggcagagtggatgagctgcagtggaagagagaggtccccttggaaagtgggggtgtggagggagggcttagggccactccagatgctgctcctagctggatgtggtcactggactggtcaggggtaactggactggatggggtcactggctggtcagcgttcagagaggaagcgggagagcagagcagcagggcccaggggatggagcgaggactcctaccagctcgttaactgaggctgggagtcagtctgtgctcagccagtcccgtgcccaaattcttggaaccaaattgaaatatgtacttttaacaaaaccagtgtttcaattttcccttaaaaataaa

SEQ ID NO: 205478 - DNA, 233 bp, Homo sapiens
ctgttgcgaggatgctgagtaggagatggctaaattacaggtaccaatttttaaaaagtgacgtttccattccgaatatcatctggcgctagtttctcgtgtggacataggagagtttcattacggtacaggtctctaaagcagagagaaccacaattattctcagtctgtctcatttattaggtcagaatatatggtaatagcctgctgaaactcagcatttctgaaatcag

SEQ ID NO: 205479 - DNA, 482 bp, Homo sapiens
tttccccatctgcagaatggctggctccatgctcccttaacatacctcccagtctcaacctcaaggcatcgtggtttgtttgtgtgaactgcgcttaatggccctgtcagcaaggaggtgatgatcaggacaggattcacttcagagagaagagctggtgctcccatgaaggaccaaatgctatgtgtggagagggccacaagaggaggacccaagagggacctctacaagctgagagttgagagtggtcccctgccaacagaaagtgagaaaacagggccttgctaatatggtcacaagaaaatgaattcttccaacatccagagggagcttggaagttgatctttctctagtcaagcctccatatgaggacacacctggccaacaccttgatttcagacttgtgggatcccaagcagagaacccagatgtgcctagacttctgacttagagaattgtgagctaataaacaggtgctgtca

SEQ ID NO: 205480 - DNA, 158 bp, Homo sapiens
acctgcttctccttcacgagctcccatctcagtacatggctccatcatctaccctggggctccagccagaaaactgggagtcagccttacagtctctgtaacaactactccctatttccagaaggtcctgcagctctaccccaacaacaaagccgcca

SEQ ID NO: 205481 - DNA, 174 bp, Homo sapiens
cagggcctgtgatttgctgaaaggattcacaggactcagcatatggttgtacttatggctatgatttgttatagtgaaggaggacaggcatggtggctcacagctcttatcccagcattttggggagctggggccggaggattgcttgagcctgggagtacgagaccagcctgg

SEQ ID NO: 205482 - DNA, 434 bp, Homo sapiens
ttggcccctattggaggaagcttctcttttggaaaagaagttgtttgagctatggcttaagagggtagggtaaacttaggtgcatagagggaggttatcccaggcatacaagacaacctgggcccaggcctctgaggaaggaaaaccagtcaggctggcagactggacctggtaggatgaaacgtgcctgttggcacagtgccctgcgggtactctgcagatgcagctgccagcgagagagggggcagggatgagaacaggctggcagagtagcgtccctggtgtctgtgctcaaagcagccatagcttgggcctgctctgggtgaaggagacggatttgcaggcagcttggaaaggtgcctctcataagtatccttcagatcatttatcagtaatgctgtgaggactctcccttcttttcgtttttgaatcac

SEQ ID NO: 205483 - DNA, 324 bp, Homo sapiens
ggttatttactgtattattcatcagcaggtactttgtgggatatatttgattcaattttgtattactgaactactggtagcaatggtgaacttcatttgctctcatagtttctgatagattaaacatcaatggttcagttatcttttgtcagatacagaagatgaatatgctgatttgcccaaccacattggcataatagtgttagttctattgtgagcttttgcgttcagggctgatattgacatttttctgaaaaagaagacatgtcctcaatcactattatggaacactgaatggctttggaatttagcttttgctcaaga

SEQ ID NO: 205484 - DNA, 340 bp, Homo sapiens
aatattctgatgggtttgaatgaaaacgttagttttaggacagccacagtggctcatgcctgtaatcccagcactttgagagaccaaagtgggaagatggaccagcccagacaacatagagaggcccagtcactacaagaatattttaaaaattagccaagcatggtggcatgcacctttcatcctagctatttgggagggtgaggtgggaggatggcttaagcccagtagttcaaggctgcatgcagtgagccatgactatgccactgtactccagactgggcaacagggtgagactttgtctcaaaaaaaaaggtggggggtgggggagattagcttt

SEQ ID NO: 205485 - DNA, 527 bp, Homo sapiens
agtcactgaggctcccctttcattagttccagttcactgcgtttggaaacaaaatctctatcataggaaactacagaaatagtggggccaattccccagctgaaactgattgtagagcttcttcagaaaagccacaatatcagcagtgctggttgaaaatgcagagattggggccatctctatttatctccataggacatacaacaattagcaaccaatgtcagtgccctctgcttcaccactatttctttatttcttcttcttggactcctggagtcatttagtttactaaagtgtatgcattatgttgctttctttggtaattaaataaatgatatgactggtctgtctatcctgatcagcatatcttttctgtgcactggtcagagccacattttttacctaaaatacctaaaaagactgtaatttttatgaaaatgcaagatttttcatatgttctacatgaggatatctgaaacttgacccatactgtcgtgttggctcaaataaagaaataaagcccaata

SEQ ID NO: 205486 - DNA, 210 bp, Homo sapiens
ttaacaatttttcatgtgactcttgacctagatgagtggtttcatgcatggccaatatgattgtggctcccagcaattgtgccatagctactctcccatctggcagtctgatccatcctccttttattacttgccccccttctgcatggaagaagtctttttcttccttagaataggtaggtaccaggtcaggtgtttgagggagtaagg

SEQ ID NO: 205487 - DNA, 303 bp, Homo sapiens
accctccttccactctaatgttccccaacctgtctgattatagatcttaagaccttctcatgagagagtaccaccctataccctgggggaaggaatgctgatgtcatgaagcttccattacaacccaagaggacaaggttcagtgagtttctggatagctggaggtttctggagggtggtgcatccagggaggtgcatccatagaagctccgcaccccttcccgcataccttgccctacctatctcttcatgtgtattttttgtaatatcctttataataaacccgtaaatgtaaaaacaaaa

SEQ ID NO: 205488 - DNA, 144 bp, Homo sapiens
gcagaggggccctagcattgcatggaaactgggctgaacaaccacagaaattcctctttgtttcttggagtgtgtgtgtgtgtgtgtgtgtgtgtgtgtgtgtgtgtgtgtgtaggtggtttcaacactctggatataagctca

SEQ ID NO: 205489 - DNA, 272 bp, Homo sapiens
tttgtcctcaaaaacccattttaacctatttttctaagtcttttctattacattagtggtgcttctaactacttggtttgacctgaattttgccaggaatttaaatgagatgtccaaatatggtgttcaggtgacgaatgtttccttcacatcttcactcagatgtccaggtcctacttgagtcatcattaggctaagcagcctatgttaaaaaatcgtaataataattaaaaagtctgagcctatgtcaatataactggtgaataatatga

SEQ ID NO: 205490 - DNA, 515 bp, Homo sapiens
gagggaaggagaaatgccaccaaatgccttttaaagcatcttcagagatttcaaacctgtctgaccttctttacatcagggcactgaaacacatgggagtaccaggcattaacagtatctcaaacccacgcaagctatattcctcacacagaggtttccttcttcagatggtggtggtaccatcccagagtgggttagctggctggttaaagaaatgtggcctactcactggtcttgaatcagcattccttgtgtggtttggaagtctttttatgatcgagtccctgcctcttcctctccagttgtgctggccttctttggtaattgctcattcttctgctgtctgtattactttcctatgtgtcttcgcctttactgggtgggtatagccctaacagaagtccaggttttaggagacctagagaatcccccaaattagagtcctggccttcagtgaatctggctatgggatgtttcacggaattcactccactagtgccctcacccttaatgag

SEQ ID NO: 205491 - DNA, 626 bp, Homo sapiens
atggtggtatcattaatatgagaattaagcaaagatctggatagggtgaaaaagtttattagagcaaggagtatctataaatttgttttgttactgtgattctcaattataaattatcgtggtctttctcagttatgtaagtccttaaaaagcccaatagtacagttggtattaaggaatttagaccttaggagagcttatgttggaggtagatatataaacctgtgaaatatatgttttatattcactaaagtaaaataattgatacctcacactaaattaaaatattatcagtagtattttatgcatattaaattagtaatactttccaattttgtttctcattaaattttttcagaatctctctctaggagaaagtacctggaagatattttcatttacaggatatcagcttttatatgctgataatatgcttacaagccaaatttgccctgatgtttgttcttccatcaaggatgttccagtctctctaaattgatgtgatttttctttctcttctcatgttgcctactgtagtttctttcacagtaacacttctcccctcccaggtctcatcatgctccctggggtagacttagagtaatttcaatgctagaatgtttaag

SEQ ID NO: 205492 - DNA, 382 bp, Homo sapiens
accaagtccgctgtgttctgttatcagcagtcctgggtaggcccagacccacctcacccccagcgggacccaggaaaggctttaaacctcaaacgtcccttttcgtaacactggctgtttcatgtggttaataaatcatccaataaaatgacacacataagcccagttatacactcgacacattaacactattgatcattgttatatgtccgggttaatcaacattacaatgctacagagaaatcattggtactaagagttgtaaggatgattttttaaaatttatgtatctcaattttttatactgttactttttacattttaaaaaatgtatattctgaaatatttttgatattttaaaatgttaatgtatcaagcattt

SEQ ID NO: 205493 - DNA, 121 bp, Homo sapiens
atgactctgggatgggtgggctctcaccatttttgttcgctgtcatatcctcggtgtataaaggaacagcgcatagtacatgcacagtaacacttggttgaaggaagagagggtggagaaa

SEQ ID NO: 205494 - DNA, 427 bp, Homo sapiens
acagatgctttacaaaacccacaattttatctggcccagaaaatctgcattaaccacgtacgagtatggtgaactctttctgacaccaatatatgtgttattgtacataactctgagtgttgtgctcatgggaaattttacatttattactattttttaatctaatactgttaaagaacatgtttaaaactctctttggaacttccttcagaagtgaagacatactcagtggaatactatcagtgatagcaaacttctgagtgtgaatctgattttcctaactagccccagggcatgtggaacaggtcctatcagtaattcaagtgagcaaacttgagtttgtaaccatttggtgttaaacataacttacactttatttgagaggatacaaacttagctataacgcaagtaaagatctggtatgact

SEQ ID NO: 205495 - DNA, 571 bp, Homo sapiens
cagcagatgccaggctcattatggacccagcagtaggtactttttgcttcttggtattccaagactttggaaatcctggttaacatgggaagatggtgaggtcttactgggtttttggccttggaaacagcagaggagagccatccactgcctttctgctcctgtgacacgtgggcagggtttctggcagctcttccttccctacctctccactggtctgaagtattgtttagaaatagagtaggttttatatcaaaagtctagttttttttaaagtctttaatgaagggattagggtctctttactagctaatgtgtttagattcattttgtcatcctcatgtgtttagggcttctcccccaggtggaatggtgtagaagaatctttctatgcctgtctttcagagacttcctgaagatggttcattcatgttagcgccagatggaggtctcttgaaaactcaaagaattttggctatcttcattatacttgagtcgcctaggcatgactggttgatactagctgggcacagaccagagaagcccacacattcaccagtgtcctgcctct

SEQ ID NO: 205496 - DNA, 493 bp, Homo sapiens
ttctcttctcttgcctctctgtatacaacccttagtgatttcatccaatgtcatgtatttatatagcatctacatgcttttgatgcccacacttctatttctggcctggtctattctcttgaacaccaggtccgtatatccaattatttactcagatccatgtggggaaaagaaagagagatcagattgttactgcgtctgtgtagaaagaagtagacataggaggctccattttgttctgtactaagaaaaattcttctgccttgagatgctgttaatctgtaaccctacccccaaccctgtgctccctgaaacatgtgctgtgtcaactcagggttaaatggattaagggctgtgcaaggtgtgctttgttaaacaaatgcttgaaggcagcatgcttgttaagagtcatcaccactccctaatctcaagtacccagggacacaaaccactgcacacaaaacactgcggaaggctgcagggacccctgcct

SEQ ID NO: 205497 - DNA, 253 bp, Homo sapiens
gagcatcttagcattgtgacgctacagcgggctgcagcgatcgccactttgctcctcagcagcaggcacccggtgaccctctggctggcaaatgagcccttcttaagggactgcttcctaggcccacctctgataccagctgtctcaggctgggtcctctagaagcagaccccgagaatatgatttgacaatgagtcctttatttgagaagtgatcccaggaagcaccagttggggagcaggtgagacgggga

SEQ ID NO: 205498 - DNA, 654 bp, Homo sapiens
gtagttcatggaaatataggagttcattgatcattgctgcctgtggtggtacacatgccccttaggagaaagccagattatctcgttttagtctattctaaatttatatttacttgctagggggtggcgagtgggtgttgcttgtccaaggtaatatctgtaaggtctccacagccctaaaactataaaaatggtgcttcagtacctataccaagggagacatccctggatcatgggactatgtttctctgccttgcagatacaaaccggaactgctcaatttaatggtttcagcagaagggtttaaaccacacatgtcaaagattagcttacctggatccacttggccactagatttgaagattttatctgcctttgcaggcaaaaacatataaaaatttgaaagattggggtcctgtttcctactcagtaccttaactctttattagagttagatcacctctgtcttagacagctttaatcatatataaccaactttgagaatttaaactggtccttagtatgagtatatcctatagttaattgggtccaatgcctaactaaactctggcagaaccttccactatgaggtaatactaatgtcctaccatctgcataaggcagaactcattccagcaggaattcccatctttt

SEQ ID NO: 205499 - DNA, 473 bp, Homo sapiens
atgaaattcaagtaggcttttatgtctgtaaagtagatggcattctgggaattgtagttcaaaaacaaaactgtcaaagcttgccttaaaaccaaggaaaatttctttcttcttgcttttataatcaataattttaaaagctgcctgacaaatcacttgagtcctacacttgtgttttgatgttactagaacctcctcaaagcaattattcccttgtatctgaccaaagtcaagccatagttcaatgtatatggatgagagaaaaccttttacttaatggaatttggagcagcattgactgtagtgaataaatgaagagtggagaggggatcttcacgtgataatccttaaaccccactccagaactggccttatgacactcagcactcacgaagaaagagatctgtgtaattcctagagcattagaaacaacctcttcagtcctggggacttctgaaaccttgtatattaaa

SEQ ID NO: 205500 - DNA, 190 bp, Homo sapiens
taatgatagcacacccttatgtgacatggtaagaacttaaactcttgtaagatagacgcttttttgcaagagtgttacagcccattattgagggaagaggtctgatttttgcttgaggaatacatcattaaaaagaacttctggtctgcttactgttttactttttccttgtggcaacagagatattttg

SEQ ID NO: 205501 - DNA, 402 bp, Homo sapiens
aagaggaggcttgagagcccaggaataatgataaaacagtaacggcccagggctaaaggaatcctccagaatccgagttctgtggatctaagttggcctgggactgcctgaggatggggcaggccctgcccagagccctcttggagccagcctccagcacctcctcagcctgaccttccaccttcagtgtttagagctgagagagcaggctacggggcacataggtcagccctgcattgcttacacaagtgggccaagactccaagaggggctgagatttggccaaggtctttgaagaaggaatgcccattcatgaaagaagagctattacaacttctgtctcttcccagagtcttctttccagctcttcctagaaaagcatggcctgctcagtcattctca

SEQ ID NO: 205502 - DNA, 131 bp, Homo sapiens
tttaataactcaagttagaatttccacatattctgtttacagatggctcaagctcagaattttgcttttcattcgtgaattattttctctcttcctctttctccaatttactattgtctaacagtttatac

SEQ ID NO: 205503 - DNA, 426 bp, Homo sapiens
ttgatccagtattttttagactatgtcatgaaaaatggaggagtcgcttcaattttttgtgttttggaaattagtgaatcccttagaagtaaataataccataatttccaatgttatgtcttgcttaagctcatttcccaatctttcaagctcccaatttatctttccctgaagtcttaacaaggattttgcatattgtaccattttctcctgatcctacttcttctccgtagtcataagaatttaagaattgcatttttggtctggttacaaacctggtgtcaagaaaaacagtgttttaggctgggcgcggtggctcatgcttgtaatcccagcactttgggaggccgaggtggtggatcacttgagatcagagtttgagaccagcctggccaacatggtgaagtcccatctctactaaataca

SEQ ID NO: 205504 - DNA, 494 bp, Homo sapiens
tacttttgacaggtacatgactgacatttgaggattatttatgccaaatttccccaagtttcccttgctgaaattttggttgcatcctacgcattttcacatgtagtgtttttttcttaatattgttatactttttacttttctttgattaaattcttatttttgatgatatttcttcaattaacaagcaattggaatatttctatataaacttttgttattagttctagtttaattgttctgtggtaaaaatgtagtttgtaacatttctggtttctattacaatatgatatgtctatataaatggtttattgaacttggaaaatgaggttacattttcagcttttggtgttcggagcttgatgtatgacaatttaatttttaaaaaatcattgttcaaatatgcttttaattttttttacttggctctgtcttagattaatgcatttttattttatctattttttaaataatataaaacatactctccaaca

SEQ ID NO: 205505 - DNA, 269 bp, Homo sapiens
aagagtaaattctacctggaaattcatgagcagtacatttttctgccttcactcaagatttttctgaatacatacaactgctaagctcacacagagatcaaggcttgttaagtaccaggcccacagggctaccactgttccaggtagtccactaaggaccggtgcgtaagcaggcctgcacagctgtttgtgatactagctagagctatggctggggcaaagccaagatcccattttcccctccctagttcccatgggagagaaaggca

SEQ ID NO: 205506 - DNA, 625 bp, Homo sapiens
aaatatgaagaaccaaagtgaatgttcaaaaatatctggacttctataatttaaacttttaaattaaatctgaaatttgcagactaaatttctcatattattcccaggaacaactataactctaggtcttacctaagagaaagtttgtgcttacaacagacttgatttgcccatgcacactaatagaggcatgttatatggctttataactatcttttaggtactcttaggaattaaaattgatataaaaggtctgtgcctgctattggcataaattattattatcattgatttaaaccaatgatttttgggaggtatggaaccaggtaggcagagagaggatattcgattgtagagacacaaatggtacagcttgaaaaaggctgtaccattgtttatataaaacaaaggctgtttccattgtttatataaaataaagtacagaaggtaagaaagaactcaataacattttcttgattggtaagaatgtactaaggaggcacagatttaaaaaaacaacactaagtgaaattgtgtggcttggagtgagtaatttttatatatgtagaatgctcttagaattctgtgcatgactagaatttttgcatattttggctgaggaata

SEQ ID NO: 205507 - DNA, 198 bp, Homo sapiens
ggtactatcggtggatacagaactaaatgtttgtaaacacctatagatgtgtataatacaaaagtgcaacttttactgtttgcacacacacatacactcacacacaatcagttaggatggtgggggaacccaggacagagttcagactgtaacaaaacaatctgattgtactacaaatgtaagatgtcagctcgctga

SEQ ID NO: 205508 - DNA, 408 bp, Homo sapiens
ggctgctgggctgtgtgtgtgtcgggtcaggtgggctgctgggctgtgtgtgggtcgggagggtggctgggctgtgtgtgtggaaagaacaaacctgggtgtacaatggatgcaggacctatgtcggggagcagggttggacaacactgccccccaagactgaaggagcagggatccccaagaaggcttccctgaactaccagcttcccgttcctgccaagtggcagaaggcgtatctggaaacagcagcctgctcagagcccacagtctccttactcaatgcacagtcaccctggagagaaccatgccacaagcccagatccaggacacactgtcatgcaggcttccttccccaccactcaggaaagcaaactgctacacttaaaaaggaacaagggcaagtctggt

SEQ ID NO: 205509 - DNA, 365 bp, Homo sapiens
cagcaagacaggagttaggcatgtcttctagtacagacttaagtctaactagagagggttttggcctcctctattctctatcccaggcccagctttagaattgatttcccctgctgtagagcatacatttggtgcattttatttctagacattaaattcttcttaggcttacttgtgtatactttcaaaatgttaagtagttacaaatttgtttttgtttagccctttaaaaagtggcccaggattaaagtaatgagatgaaactaatacaaactgaaggaaatatgacaatttgaggtatcttgggaacttcgttttaagtcattgcaatatttatagaatatttccacagataagaagaaatg

SEQ ID NO: 205510 - DNA, 377 bp, Homo sapiens
ctcttgacccatgaattcttactactctgaattttgagcagggtttacataaataataaattagagcaagctcaaagttagccctaaaatactgtcactttctcttgattttaatatactttcttgaagaggtgagagaaagcttgcactatccctaataggtaggaaattgtatgtcacctgcatgatagctgtggcctggggtcctgtccttccaaagcatggctgtccaaatcttccagtttaggaatctaaactggaaaatgtagccactgcgcagcactgccttcataccatccagaaaccagatatttcctttttccttaaagtgccccaggaatagagttactagatttaataaatacaaatacaggaaa

SEQ ID NO: 205511 - DNA, 1070 bp, Homo sapiens
tgccactcttctgggagaatgaggtttgcagagacattagataatattatctaataacagtactgttcgtttatataataaacttgggagatataggagggagatataggattggctaacttttatgtttatattatgttaatcaattattttttcttacataatatattgcaactcagaagcaatgttttgcttctggggtaatgtttataaacttttgcatgtgaagatgggcaatttggaagacttttggtttctggaagaacagaaatactcctgtaaaaattgagaaaatcttcacataggcagtgggaaatagaattcagacagcccctaagtcctttcttcttatggtttgtggtttgttattgtgctgcttacgtttgttttgagcatgtttttaagacttgaattttctttttttttgagacagagtcttgctctgttggccagagtggagtgcagtggcatgatctcagctcactgcaacttccacctcctgggttcaagcgattctcctgcctcagcctcctgagaagctgggattataggtgtgtgccactgcacccggctaatttttgtatttttagtagaaatggggtttcaccatgttggacaggttgttctcaaactcctgaactcaggtgatcctccagccttggcctcccaaattgctaggattacaggtgggagccaacggtatccggcctaagacttgaattttaaaaaatttataacaggatacatctgtatttaatcattatgaatattatttactcagttaatctgactgcctttgaccataatggaaaaagaaatttgaggcattttgcacacattattccaatacttgccagatgtgttggggaagatgcattaagttctgcttgtttaagctaatgttctttgacactgcccaagatttctgacaaaagaatgacaagagagggaagttaaactggacttcctaatgctcctcggttttgatgaggaagtccaaatttctaatcactgaaaggggaaaatacatcaggcagtaaggtgtctaaattagataacttagtggcttg

SEQ ID NO: 205512 - DNA, 1047 bp, Homo sapiens
cccaccgactcctacagctcatttctcgctcctgcagcctccaggaatgcaaataatttctcactgggttttggcgggggcgcggagctgcggagaagcgcgcgcccaacagctttcgccgcagctgggtccccgggcgctggcggctgcggcccccagatacaggcggaggctgcaatatgcacatgcggccacagtgtggcgccaggggcccgccgcgggacacgctcggagcgcgacgccccatcccatcatttacggatcaaaccaaataatctagaatcaagttgctgtgtgtgtcatactcctcctgttttttttccctaaacttttagtagagtcatttacatagttcagtttttacctcagctatgttacacagtggcaggaaaatattttgtctccaaactacagcccaagtatgagagcagcgtatcctgaagctaattagtaaccagaaaatcaggaaggtaaagcaaatctctggaggcaagatctggactctatggtatcgccgcttctccccacttgaagcgtctctttgcagtgccgcacttggagatttggacttaatcgttaaacaaacagaacagttacattctgccttcctacagggcaggggcctaggactggcagcatttttgttgtctctagaaatagaggggttatgagagagcctcaaaagagagggcaagaataacacatccatttctcatcatgagttacccccttgtatgcctagaacgcgtatggagacattctcttttagtaaagtcaaagagaaaagccatgaactaagtatcctgaacacagaggcgtgagccctctcagtctcacagtcccttaggagtcatttatctcagaagttggttgaaacaaaaacagttcatacagcatggtaggcagaattctaaaatgatcccaatgactcactcccttgcataatccccttgagtgtgggtggaacctatgacttgcttctagccaacagaatatgacaagggtgatgaaatgtcactcttgggattgctacattatgtaagactc

SEQ ID NO: 205513 - DNA, 913 bp, Homo sapiens
caagaacaaactaaatcagaattcagagttcctgatggctccacatgttgcattgcagctgaggccccctgtcctaaatgggctcaaccggcctagcacactcctcttggtggctttgggtgggtcagccttgcccagtttggggtcatagacctcagttattcatttaaccgatggccattgagggcttacccagtgccacactttgagacaagcatgggtgtcctgaaaagaaagtgttggcaagaaaacatgaacccaccattggactctcaactcaaaccttactgaagtcagtggctatagctttatctgcaaaggaccccaaagtgaggatcccacattgttactgctggctcttcatcccaccctctggagatgctaaggaagctcttgcccaccttttctagtgatggagtaggaactttgcataggacaaaccttcatgataggttactctagtatattccctcataaagtccaataggtaaattagtcttggcagcagaaggaacagcaggagaagtaagtgattcatcatctagaatccagaaaatttgcaccaacagatggcaggtggttataacacaacagatcttgccctgagaatatctggggacccagccaacagccttcaaggcagggcactcctgcggaagagatggcttgtgaacatgactgtggacccagagtcaccccagagctcccatataaaatgcttcacagagaaactaagagcagccttggggcattcattccaattaataaccttaaagactagagccagatccacctgcattacaaaagcaggcattcgaggaactaaactttgcttttgttcatgctcttacctgccgttttaaatgggtttctaatgtcaaataaagccaccctgcctcttgggacaaagatg

SEQ ID NO: 205514 - DNA, 659 bp, Homo sapiens
ctgaacttttctatttgtttgaaatatttgatgacaaaaatcacaaatatattttataacaagatatgtagaagacagcggttaaaaataagctcaataagtagtcaggagtcagattgcaaagtatcttctgtgtagcctgctaggtttttggatttcctgtataagcatatttactattttggtcttcattactcatctttatgtggaggactccaaaatcattcagctcaacccaacccatcctgctcctctgaatgtcagatttctctgtcctacttcccttatcctggcatcgctgtcaatgtagcatgctcaaagctagacatgttataccttaatctacatacctggccaggctccgtggctcatgcctataattccagaactttgggaggccgaggcgggcagatcacttgaggcaaggagtttgagaccagcctgccaacatgacaaaaccctgtctctactgaaaatgggataattagcccagggtggtggtacaccgagctcctcaggaggccgaggcacgagaatcacctgaccccaggaggcggaggttgcagtgagctgagatcgtgccactggcactccagcctggacaacagagcaggactctgtcttagaaaaataaaaagtaaaataataataataataat

SEQ ID NO: 205515 - DNA, 476 bp, Homo sapiens
tgtttcataggaaagattaaaaaaggccttcaaagccaaccatgtttgtttcctgtttttatccttcctatgaaggaccaacagtgttggttggtacttgaggaaatttatttttattgttagtttaaagccattctttaaatcacataaattcaggtctgtgatatctccttttctgtcaaattgagaacagcttcattactttatctctgcaagtaggatgtgaacagtataaatacagacttggtgcgtaagctactcctggagccattggggcctgaaacggcgccttgtgtattccacaaacgcgttcctactgctaagcagtgaaattcacccagtgttggtgggttattgtgctctagagagcatttggtctcttcagtgttattttgcttcctttcatgttctgcgtaagacttattttcaaagtttaattgaaagacacaaagctaaataaaattataccttaccat

SEQ ID NO: 205516 - DNA, 320 bp, Homo sapiens
ataagccttattattctatgtagctccagagggctaagctaagatctgtgaggaaaagtcataaagaagtttcttctaatagctttctaacatgcatatgttcccgctttgacaagcaatgagctctgcatcttaggaggcaatcaatccagacactgtactcctatactcagcaggaggtaggccagacgaccttcaagcttccctctaaaattctgtgattttcttgaacctcaaatctactagttatttttagacgtgaaacattaatgctgaatctaaatcatctaccattaataaaaaacaagtgacctgactat

SEQ ID NO: 205517 - DNA, 133 bp, Homo sapiens
tcagaaaaaggcatggagcagatctcccctagagccttcagaaagagcacagccctgctgactccctggttccagacttccagcctccaggaaggaactgcgagagaataaatgtctgttgttctaagccacc

SEQ ID NO: 205518 - DNA, 706 bp, Homo sapiens
tcaggtttcccggcagcacagagaacccttccacaaaagtagaagggaaagcaaatagttttactaaagaagcagcttcaaaccagagcgtgagccaccacgcgcggccccatcatacgaagttactgaagttattgcgtaaacattctgttttagtcatccttgaggatcgttttaactccttgatctgtaaaactgtcttaagcatcttaacatgttacatcacagggttttagctcagatttccaaagagccatattttttgatgcatatttccagttgaattccagtgtgaatttccagttgtactttgcattctgattctttgatatttgaacttggccatctgtgggtgctactctcgtaagactaaaaggcacctactaaatacgaacaaggataaccagttctaccaaaaacattaccaaccaaacctcccctgttcttttttcagactttccttttgctttcaacctcttaaactgtaaaggagagatttaatgtttccctattattctgctttgactcacatactaaaatgaccacatggcactccattgaatcttttcagttgttcacgaattaaaataatgcccatgttttacagtttttcgagtagtctcagcaatggatctgtagtttcaggacctgtttttaaaagatcaagatacttttatgtgtttcagaagtagctgttttttcattt

SEQ ID NO: 205519 - DNA, 1385 bp, Homo sapiens
tactatgttcatgtactacttcatatacttgaatacattgaatgattttattcagtgaactgatgcttacaaagtacttagcatgacggtatctggcatgcaggaagtgcttaatgttattggttattattaacaccatcagtgtcatacagtgtgtaagaaatcaggctctgggccaggcgcagtggctcgcgcccgtaatcccagcattttgggattacaggcgtgagccaccgcgcccagccttcctgaagctttttagaacatgacagtacttctctggattcagcactagcagagtcagagaactctgaactccccttgtacaaacataaactttgctttatatttatcccaaaaaacaaataccttatgatctgcataggagtacctagaaatataatctgggatcatttgataaaaatagtaaatagattgaagtaaaagtcattgctttatattataggaagtttgttttgttttgttttgtttgttttgtttttgagacggagtttcgctcttgtcccccaggctttagtgcaatggcgcgatctcggctcaccgcagcctccgccacctgggttcaaacgattctcctgcctcaggctcccgagtaactaggattacaggcgtgcgccaccatgcccggctaattttgtattttttttagtagagacggggtttctccatgttggtcaggctggtctcgaactcccaacctcaggtaatccgcccgcctcagcctcccaaagtgctaggattacaggcgtgagccaccacgcgcggccccatcatacgaagttactgaagttattgcgtaaacattctgttttagtcatccttgaggatcgttttaactccttgatctgtaaaactgtcttaagcatcttaacatgttacatcacagggttttagctcagatttccaaagagccatattttttgatgcatatttccagttgaattccagtgtgaatttccagttgtactttgcattctgattctttgatatttgaacttggccatctgtgggtgctactctcgtaagactaaaaggcacctactaaatacgaacaaggataaccagttctaccaaaaacattaccaaccaaacctcccctgttcttttttcagactttccttttgctttcaacctcttaaactgtaaaggagagatttaatgtttccctattattctgctttgactcacatactaaaatgaccacatggcactccattgaatcttttcagttgttcacgaattaaaataatgcccatgttttacagtttttcgagtagtctcagcaatggatctgtagtttcaggacctgtttttaaaagatcaagatacttttatgtgtttcagaagtagctgttttttcattt

SEQ ID NO: 205520 - DNA, 862 bp, Homo sapiens
tactatgttcatgtactacttcatatacttgaatacattgaatgattttattcagtgaactgatgcttacaaagtacttagcatgacggtatctggcatgcaggaagtgcttaatgttattggttattattaacaccatcagtgtcatacagtgtgtaagaaatcaggctctgggccaggcgcagtggctcgcgcccgtaatcccagcattttgggattacaggcgtgagccaccgcgcccagccttcctgaagctttttagaacatgacagtacttctctggattcagcactagcagagtcagagaactctgaactccccttgtacaaacataaactttgctttatatttatcccaaaaaacaaataccttatgatctgcataggagtacctagaaatataatctgggatcatttgataaaaatagtaaatagattgaagtaaaagtcattgctttatattataggaagtttgttttgttttgttttgtttgttttgtttttgagacggagtttcgctcttgtcccccaggctttagtgcaatggcgcgatctcggctcaccgcagcctccgccacctgggttcaaacgattctcctgcctcaggctcccgagtaactaggattacaggcgtgcgccaccatgcccgtctttactaaaaatacaaaaattagctgggcgtggtggcaggcgcctgtagtctcagctgtttgggagactgaggcaggagaattgcttgaacccaggaggcggaggttgcggtaagccgagatcatgccactgcactccagcctggcgacagagcaagactccatctcaaaaataaataaataaataaataaaaggccacacacacttgtgcg

SEQ ID NO: 205521 - DNA, 672 bp, Homo sapiens
aggatgcaaggaagaagatataggagagtaatctgccactatatccaacacttgtaacttccaactgtcattaattcagcttcacaactacttatctagtgactgtagtctacaagatatagccccaaagcaagtaagaagcagaaataatggcagaaaaagcagaatcttggtcagttgtttaagccactcccattctggttctgtccactggagtaacctgtagcaatcattatatttttagtccacttcctaaggcaaaaaaaaaaacttactaaaaacaaacaaacaaaaaaacacctgctcaaagcaagccattagttcccattctctcttactgacctaactgcttggttataatcttgcttgctatcagtttgtgatgtggcaaaacgtggaataagccaagcaaggaagactgtaaaaaggagattaagagccaaacaagcaattgggaattggcacccaaggtaaggtggaaggtgggagaaatactaaatacctcactgacctcttctggacagtcaatgatgatgggactttctaagcagtctaatctaaatcagagtatccagaaggaaagcagcagcaacctgacaggcaagccagaaataaataaatacacgacaacaacaaacagtctggaaggagagctgctgtgggggagtgaaa

SEQ ID NO: 205522 - DNA, 341 bp, Homo sapiens
atatcttaaaaggacatcctgttgtgctgagcaagtagcttcaggatggaggcaacattttaggtggagaagggctccctacctgcccaatcaatcatgtcaatcacagagatggtgaagagaccaaggtcacaagtagtttgcttacataacaaattgaaattataatccaaagcatccatattctacttcttaaaaatattaatgttcctatccattaaatgcattactcaatgctattggtttttgcaagaacagtaggtgaaaatttgtgggttgtttttaaaaaaaataattgtgcggagattatgttgtaggaaaataaaaaataaaataaaagc

SEQ ID NO: 205523 - DNA, 401 bp, Homo sapiens
  misc_feature (101)..(101): n is a, c, g, or t
gaatcgagctcggtaccgtatctctaacattagtataggtagacacagagtcagcaaagcagtgggggaaaatggtttcgaaagacatgccaaggtacgtnatagtaatattagaccattaaggtccaactaaaaaaagaaaattaggccaaaattaccttgcatgtttgactacagaacttggactttatacagggagtcaatgggacagacaagctttctactggaaactggctccagaagaaatgttaagattacctagaagtagtcaactggtgatgaaggaggaggagaataatgctacattagtataggtaagacacagagttccagcaaagcagtgggggaaaatggtttcgaaagacattgccaaggtacgtaatagtaatgttagagataag

SEQ ID NO: 205524 - DNA, 438 bp, Homo sapiens
agctattctaactggagtgaggtagtatctcagttgtagatttgatttgcatttccctgatgactagcaacgtgagcattttttcatatatttgttggccatttgtgtatcttttgagaaaagtctattcaggtattttgcacaattttaaatcaggttatatatttttttgttgctgagatgtttgagttccttatatattttgaataattaaccccttatcaggtgtatagtttgccaatatattctcccatactgtaggctgtcccttttactccgttgattgtttcctttgctgtatagaaactttttagtttgatgtaatcccacttatctgtatttgcttgtgttacttatgcctttgaggttttattttaaaaaatcttttatgcaaatggactaaaaaataaaaataaacccttgccttgatcaatgtga

SEQ ID NO: 205525 - DNA, 167 bp, Homo sapiens
acttagtgcggacacccgatcggcatagcgcactacagcccagaactcctggactccagtgatccctctacctcagcctcccaagcagctgggattataggctcatgccacctggcccagctttggagattttttttttaactggaagttttagggatgaagttgta

SEQ ID NO: 205526 - DNA, 393 bp, Homo sapiens
cattcccattcctgtgacattccagaaataaccatggctgagcagggacccaggacagcatctcagatatagcaacaaagtttgctcagttggtcaggaaactctgatagttagaattctgaattctagaaacacagagcttttgaactagaattctagaagcagagtgtgggacccacatttaaggttggtcccatcctcataagccccactggggagtttgggggactccatagcagccacgggaaaaaggtatggatggttgcagcacttcttaagatccatcatgatattaagcagcgacacctggttcccaccacctcgtgaattcaaggcctcaaaatttcgagtcaggatgtatttgtagtatttcttctgcatggggcctacatt

SEQ ID NO: 205527 - DNA, 842 bp, Homo sapiens
gtcaaggtctcgtccttactgctgtgtgtcctctgctcctagagtcccagcctctgtggccctatgacctgcaggtattgggagatccacaactaagtcgccaggaccccctggaagcctagaaatgggatcattgacatttagggatgtggccatagaattctctctggaggagtggcaatgcctggacactgcacagcagaatttatatagaaatgtgatgttagagaactacagaaacctggtcttcctgggtattgctgcctttaagccagacctgatcatttttctggaggaaggaaaagagtcctggaatatgaagagacatgagatggtggaagaatccccaggtaggtgagagtgaatacagacaacatggatgagaggtcgaaagtcaaggaggaagccagtccttaaagtgattctggaagctgtgttccaaaagaagtagtttctggagagactaatttttatttttattctttaattttctctcacacaggggcatcttcggtcttacacttttaaaatttctaagaattcttctttcccttcagtaatcttccttcaagtttacagtgacagccaaagtaccgttcatggcatacaagagagtgcacaatctttttgtttgtttgtttttgtggacacacagatatctgcatgattttaagatactccatgttaaactatcttataagttctctctttccatcatctctgaaatgtgtgagagtagtagtttctgtatctttggggtttttttgttcatttttctgtacatttcatcctgtttttattactgtagtcttgaaatatagtttgaaattataaagtaaaat

SEQ ID NO: 205528 - DNA, 784 bp, Homo sapiens
gtcaaggtctcgtccttactgctgtgtgtcctctgctcctagagtcccagcctctgtggccctatgacctgcaggtattgggagatccacaactaagtcgccaggaccccctggaagcctagaaatgggacggggtttcaccatgttggtcaggctggtctcgaactcctgatttcaagtgattcacctgcttcggcctcccaaagtgctgggattacaggggatcattgacatttagggatgtggccatagaattctctctggaggagtggcaatgcctggacactgcacagcagaatttatatagaaatgtgatgttagagaactacagaaacctggtcttcctgggtattgctgcctttaagccagacctgatcatttttctggaggaaggaaaagagtcctggaatatgaagagacatgagatggtggaagaatccccaggggcatcttcggtcttacacttttaaaatttctaagaattcttctttcccttcagtaatcttccttcaagtttacagtgacagccaaagtaccgttcatggcatacaagagagtgcacaatctttttgtttgtttgtttttgtggacacacagatatctgcatgattttaagatactccatgttaaactatcttataagttctctctttccatcatctctgaaatgtgtgagagtagtagtttctgtatctttggggtttttttgttcatttttctgtacatttcatcctgtttttattactgtagtcttgaaatatagtttgaaattataaagtaaaat

SEQ ID NO: 205529 - DNA, 511 bp, Homo sapiens
ttgatatgtctcgatcgttacttgaaagcgtgtaaaaaacaagacgcattctttgagcgcctacgggatgcgttagaaactgaggaccgaccaaaattaactatgtgtagactttgaacagtttgcagtttgttgaggatcacagggaaaggagctggagagaaacatacactatacttattatggctgtcaaaggacgtgtacgcagttaatatgggtggcttgaatgggtagggagcctaaagttaaggagtagtgttaatcaagacatattgaaaagatgaactaaagcatgctgtcagaggacaataaggtaattcatactggagagaaaccatacaaatgcaaagaatgtggcaaagcctataagtggtcctcaaccctcagttatcatagaaaattcatactggagagaaaccctacaaatgtgaagaaagtggcaaagccttcagctggttctcagtctttagtaaacataagaaaattcatgctggagagaaattctaaaaat

SEQ ID NO: 205530 - DNA, 238 bp, Homo sapiens
caggatctctatgtctcgatcgttatgaataccttatgttagtaaggattgagaacgtactaaagcttttgccacattcttcacataagagaattcatactggtgagaagccctacaaatgtgaagaatgtgataaagacttcaactggtcctcacaccttactactcataaaagaattcatactggaggaaaaaccctacaaatatgaaaaatgtggcaaaactattaattaattct

SEQ ID NO: 205531 - DNA, 3723 bp, Homo sapiens
gtcaaggtctcgtccttactgctgtgtgtcctctgctcctagagtcccagcctctgtggccctatgacctgcaggtattgggagatccacaactaagtcgccaggaccccctggaagcctagaaatgggacggggtttcaccatgttggtcaggctggtctcgaactcctgatttcaagtgattcacctgcttcggcctcccaaagtgctgggattacaggggatcattgacatttagggatgtggccatagaattctctctggaggagtggcaatgcctggacactgcacagcagaatttatatagaaatgtgatgttagagaactacagaaacctggtcttcctgggtattgctgcctttaagccagacctgatcatttttctggaggaaggaaaagagtcctggaatatgaagagacatgagatggtggaagaatccccagttatatgttctcattttgctcaagatctttggccagagcagggcatagaagattctttccaaaaagtgatattgagaaggtatgaaaaatgtggacatgagaatttacacttaaaaattggttataccaatgtggatgagtgtaaggtgcacaaagaaggttataataaacttaaccagagtttgacaactacacagagcaaagtatttcaacgtggcaaatatgcaaatgtctttcataaatgttcaaattcaaacagacataagataaggcatactggaaagaaacatttgcaatgtaaagaatacgtcagatcattttgcatgctttcacacctatctcaacataaaagaatttatactagagagaattcctacaaatgtgaagaaggtggcaaagcttttaactggtcctcaacccttacttattataagagtgctcatactggagagaaaccctacagatgtaaagaatgtggcaaagcctttagtaagttctcaatccttactaaacataaggtaattcatactggagagaaatcctacaaatgtgaagaatgtggcaaggcttttaaccaatctgcaatccttactaaacataagataattcatactggagagaaacccaacaaatgtgaagaatgtggcaaagcctttagtaaggtctcgactcttactacacataaggcaattcatgctggagagaagccctacaaatgtaaagaatgtggcaaagccttcagtaaggtctcaacccttattacacataaggcaattcatgctggagagaagccctacaaatgtaaagaatgtggcaaagcctttagtaagttctcaatccttactaaacataaggtaattcatactggagagaaaccctacaaatgtgaagaatgcggcaaagcctataagtggccctcaacccttagttatcataagaaaattcatactggagagaaaccctacaaatgtgaagaatgtggcaaaggttttagtatgttctcaatccttactaaacatgaggtcattcatactggagagaaaccctacaaatgtgaagaatgtggcaaagctttcaactggtcctcaaaccttatggaacataagaaaattcacactggagagacaccctacaaatgtgaagaatgtggcaaaggctttagttggtcctcaacccttagttatcataagaaaattcatactgtagagaaaccctacaaatgtgaagaatgtggcaaagcttttaaccaatctgcaattcttattaaacataagagaattcatactggtgagaaaccctacaaatgtgaagaatgtggcaaaacctttagtaaggtctcaacccttactacacataaggcaattcatgctggagagaagccctacaaatgtaaagaatgtggcaaaacctttattaaggtctcaacccttactacacataaggcaattcatgctggagagaagccctacaaatgtaaagaatgtggcaaagcctttagtaagttctcaatccttactaaacataaggtaattcatactggagagaaaccctacaaatgtgaagaatgtggcaaagctttcaactggtcctcaaaccttatggaacataagagaattcatactggagagaaaccctacaaatgtgaagaatgtggcaaaagctttagtacattctcagtccttactaaacataaggtaattcatactggagagaaaccctacaaatgtgaagaatgtggcaaagcctataagtggtcctcaacccttagttatcataagaaaattcatactgtagagaaaccctacaaatgtgaagaatgtggcaaagcttttaaccgatctgcaatccttattaaacataagagaattcatactgatgagaaaccctacaaatgtgaagaatgtggcaaaacctttagtaaggtctcaacccttactacacataaggcaattcatgctggagaaaagccctacaaatgtaaagaatgtggcaaagcctttagtaagttctcaatccttactaaacataaggtaattcatactggagagaaaccctacaaatgtgaagaatgtggcaaagcctataaatggccctcaacccttagttatcataagaaaattcatactggagagaaaccctacaaatgtgaagaatgtggcaaaggttttagtatgttcctcaatccttactaaacatgaggtaattcatactggagagaaaccctacaaatgtgaagaatgtggcaaagccttcagctggttgtcagtctttagtaaacataagaaaactcatgctggagagaaattctacaaatgtgaagcatgtggcaaagcctataatacattctcaatccttactaaacataaggtaattcatactggagagaaaccctacaaatgtgaagaatgtggcaaagctttcaactggtcatcaaaccttatggaacataagaaaattcacactggagagacaccctacaaatgtgaagaatgtgacaaagccttcagctggccctcaagccttactgaacataaggcaactcatgctggagaaaaaccctacaaatgtgaagaatgtggcaaagccttcagctggccctcaagacttactgaacataaggcaactcatgctggagaggaaccctacaaatgtgaagaatgtggcaaagctttcaactggtcctcaaaccttatggaacataagagaattcatactggagagaaaccctacaaatgtgaagaatgtggcaaaagctttagtacgttctcaatccttactaaacataaggtaattcatactggagagaaaccctacaaatgtgaagaatgtggcaaagcctataagtggtcctcaacccttagttatcataagaaaattcatactgtagagaaaccctacaaatgtgaagaatgtggcaaaggctttgttatgttctcaatccttgcaaaacataaggtaattcatactggagagaaactctacaaatgtgaagaatgtggcaaagcctataagtggccctcaacccttagatatcacaagaaaattcatactggagagaaaccctacaaatgtgaagaatgtggcaaagcctttagtacgttctcaatcctcactaaacataaggtaattcatactggagagaaaccctacaaatgtgaagaatgtggcaaagccttcagctggttatcagtcttcagtaaacataagaaaattcatactggagttcccaaccctcctacacataagaaaattcatgctggagagaaactctacaaatga

SEQ ID NO: 205532 - DNA, 1822 bp, Homo sapiens
acgagcttcgtgcagatcgtgcaatgtggcaaagcctttagtaagttctcaatccttactaaacataaggtaattcatactggagagaaaccctacaaatgtgaagaatgtggcaaagctttcaactggtcctcaaaccttatggaacataagagaattcatactggagagaaaccctacaaatgtgaagaatgtggcaaaagctttagtacattctcagtccttactaaacataaggtaattcatactggagagaaaccctacaaatgtgaagaatgtggcaaagcctataagtggtcctcaacccttagttatcataagaaaattcatactgtagagaaaccctacaaatgtgaagaatgtggcaaagcttttaaccgatctgcaatccttattaaacataagagaattcatactgatgagaaaccctacaaatgtgaagaatgtggcaaaacctttagtaaggtctcaacccttactacacataaggcaattcatgctggagaaaagccctacaaatgtaaagaatgtggcaaagcctttagtaagttctcaatccttactaaacataaggtaattcatactggagagaaaccctacaaatgtgaagaatgtggcaaagcctataaatggccctcaacccttagttatcataagaaaattcatactggagagaaaccctacaaatgtgaagaatgtggcaaaggttttagtatgttcctcaatccttactaaacatgaggtaattcatactggagagaaaccctacaaatgtgaagaatgtggcaaagccttcagctggttgtcagtctttagtaaacataagaaaactcatgctggagagaaattctacaaatgtgaagcatgtggcaaagcctataatacattctcaatccttactaaacataaggtaattcatactggagagaaaccctacaaatgtgaagaatgtggcaaagctttcaactggtcatcaaaccttatggaacataagaaaattcacactggagagacaccctacaaatgtgaagaatgtgacaaagccttcagctggccctcaagccttactgaacataaggcaactcatgctggagaaaaaccctacaaatgtgaagaatgtggcaaagccttcagctggccctcaagacttactgaacataaggcaactcatgctggagaggaaccctacaaatgtgaagaatgtggcaaagctttcaactggtcctcaaaccttatggaacataagagaattcatactggagagaaaccctacaaatgtgaagaatgtggcaaaagctttagtacgttctcaatccttactaaacataaggtaattcatactggagagaaaccctacaaatgtgaagaatgtggcaaagcctataagtggtcctcaacccttagttatcataagaaaattcatactgtagagaaaccctacaaatgtgaagaatgtggcaaaggctttgttatgttctcaatccttgcaaaacataaggtaattcatactggagagaaactctacaaatgtgaagaatgtggcaaagcctataagtggccctcaacccttagatatcacaagaaaattcatactggagagaaaccctacaaatgtgaagaatgtggcaaagcctttagtacgttctcaatcctcactaaacataaggtaattcatactggagagaaaccctacaaatgtgaagaatgtggcaaagccttcagctggttatcagtcttcagtaaacataagaaaattcatactggagttcccaaccctcctacacataagaaaattcatgctggagagaaactctacaaatga

SEQ ID NO: 205533 - DNA, 1787 bp, Homo sapiens
gtcaaggtctcgtccttactgctgtgtgtcctctgctcctagagtcccagcctctgtggccctatgacctgcaggtattgggagatccacaactaagtcgccaggaccccctggaagcctagaaatgggacggggtttcaccatgttggtcaggctggtctcgaactcctgatttcaagtgattcacctgcttcggcctcccaaagtgctgggattacaggggatcattgacatttagggatgtggccatagaattctctctggaggagtggcaatgcctggacactgcacagcagaatttatatagaaatgtgatgttagagaactacagaaacctggtcttcctgggtattgctgcctttaagccagacctgatcatttttctggaggaaggaaaagagtcctggaatatgaagagacatgagatggtggaagaatccccagttatatgttctcattttgctcaagatctttggccagagcagggcatagaagattctttccaaaaagtgatattgagaaggtatgaaaaatgtggacatgagaatttacacttaaaaattggttataccaatgtggatgagtgtaaggtgcacaaagaaggttataataaacttaaccagagtttgacaactacacagagcaaagtatttcaacgtggcaaatatgcaaatgtctttcataaatgttcaaattcaaacagacataagataaggcatactggaaagaaacatttgcaatgtaaagaatacgtcagatcattttgcatgctttcacacctatctcaacataaaagaatttatactagagagaattcctacaaatgtgaagaaggtggcaaagcttttaactggtcctcaacccttacttattataagagtgctcatactggagagaaaccctacagatgtaaagaatgtggcaaagcctttagtaagttctcaatccttactaaacataaggtaattcatactggagagaaatcctacaaatgtgaagaatgtggcaaggcttttaaccaatctgcaatccttactaaacataagataattcatactggagagaaacccaacaaatgtgaagaatgtggcaaagcctttagtaaggtctcgactcttactacacataaggcaattcatgctggagagaagccctacaaatgtaaagaatgtggcaaagccttcagtaaggtctcaacccttattacacataaggcaattcatgctggagagaagccctacaaatgtaaagaatgtggcaaagcctttagtaagttctcaatccttactaaacataaggtaattcatactggagagaaaccctacaaatgtgaagaatgcggcaaagcctataagtggccctcaacccttagttatcataagaaaattcatactggagagaaaccctacaaatgtgaagaatgtggcaaaggttttagtatgttctcaatccttactaaacatgaggtcattcatactggagagaaaccctacaaatgtgaagaatgtggcaaagctttcaactggtcctcaaaccttatggaacataagaaaattcacactggagagacaccctacaaatgtgaagaatgtggcaaaggctttagtatgttctcaatccttactaaacataaggtaattcataatggagagaaaccctacaaatgtgaagaatgtgataaggcaactcatgctggagagaaaccctacaaatgtgaagaatgtggcaaagctttcaactggtcctcaaaccttatggaacatagagaattcatactgagagaacct

SEQ ID NO: 205534 - DNA, 698 bp, Homo sapiens
gtcaaggtctcgtccttactgctgtgtgtcctctgctcctagagtcccagcctctgtggccctatgacctgcaggtattgggagatccacaactaagtcgccaggaccccctggaagcctagaaatgggacggggtttcaccatgttggtcaggctggtctcgaactcctgatttcaagtgattcacctgcttcggcctcccaaagtgctgggattacaggggatcattgacatttagggatgtggccatagaattctctctggaggagtggcaatgcctggacactgcacagcagaatttatatagaaatgtgatgttagagaactacagaaacctggtcttcctgggtattgctgcctttaagccagacctgatcatttttctggaggaaggaaaagagtcctggaatatgaagagacatgagatggtggaagaatccccagttatatgttctcattttgctcaagatctttggccagagcagggcatagaagattctttccaaaaagtgatattgagaagatacaagattcatcatcatgcctgtgagctgggtccaataatgaatcaccatcctacttgtggccaaatgcatatatgacagttacaactctaactgcagactgcatcggcatgtaaaatttaggtcaccagtgggctctctccatgtttgaatgtggtgattctaatggtcagc

SEQ ID NO: 205535 - DNA, 797 bp, Homo sapiens
cttctaatttccaatgtaagaccttacaactaaataactgcatttactcactcccctagtgtgatttttaaatcacattttaaacttttatatacgttataagccctactttacagtgttttattttgctttaaacagttatttgatttttaagtgaattatgagaaaggaaacagtttttgtgtttaccaatttatttaccatttctgaagctcttttttcctttctgtaagtctacatatccatttgatagaatttgtctttggtctgaagaacactcttcagcatttcttacaatgtagattgactggcaagcattctctcagcttttgtttagctaaaaatgtctttattccaccctcatttctgaaggatatttattattgatgaatataaaattctaggtcgatagccttcaccccccaagtactttaaagatatcattttactgttttctgacttccagtgagaggctgggaataattcttatttctcccatacatgatgtctccctgcctccctttctttttgtcccttttctggctgctttcaagattttttcttacttttgtttttaatcaattgattaaaactgtattgattctaatgtatctcagtgtggttctctttatatttatcctgtttgggattggctaaacttctttttttttttcttttttcttttcttttcttttttctttttttagacaagagtttcgttgttgtttcccaggctggagtgcagtggcacgatcttggctcactgtaacctccgcctcccaggttcaagcgattcc

SEQ ID NO: 205536 - DNA, 391 bp, Homo sapiens
gcgtaggtaacgctgacgatcccattctatcgctctccctgcctgccttgtggaatggttataaagatagaatgagaggaaggttgtgaaggtgtgatcaaggtgttacaccaatcattaaacattataaagtattgcaaacaaatggacttaggagtcacctgactgaggcagaaattccagttctatttaataggtttgtctgtgttatttgatccactttctcattataatagaggtggatgataacagcatagggctgtgataaacattaaattctgtaacttatgtaaagaatctagtgaagtatatgttgcacataacaggtactcaaaaagttgtgtttgggttagtcaggagtttgagaccagactgggcaacatggtgaaac

SEQ ID NO: 205537 - DNA, 148 bp, Homo sapiens
ttggtagagatggggtttcaccatgttggccaggctggtctcgaactcctgacctcaagtgatccacccgccacttatttttgacacattacattcagatggaaaaaacatagttgtttagggtgtgcccgtttttgtatgtaaatat

SEQ ID NO: 205538 - DNA, 950 bp, Homo sapiens
ctacgtaatactagaacaaatactgaagtaatagaacatcaagttaattgaatgactggaagagatctaaaaaacacattttccaaaaagaaattagattagaattaaggtacattggtcagtaatttgcctccaagatgagaagtagaagtgtcctgcttaggagttctggctactgagttaaatccagtctcttatacttgcatagttatttgaatagatctgtttgggtagtttgtgtcactctgagcaagttagctagtatttctttgctaaatttctcctactgaggaaaacggcttttaattcagtgctttgcaaggattagatgagatactgcatgtgaagctctctgcatcatttttggcacatagaagcagcttgataacctgtggctgctgctgctgttactgttattggctattgtaattttgtctcagccactgaactcagtccagtagagtcctcgtgattcccggtagaaaagatgcatgcttatggtaggcaaaatcctcaaatgaccgatagccttccccaaaaacttctcaatagtgttatatggtttcatgcaaactctgaaatggcaattaatccagggaaaagaaaaattaaaaacagaagaattaatcagcacatggcaagaatttgaagaaaggaagcaatatcttaacctagatagagtgcgctagcaaccaagccacacagtaaacagtcatgaagccaaatgtatcgcaggggataagtgaagatttgaaagtcaaacaaccttcccataattctgtaaccgatcccccaattcctcagcaaaacctggcatggtccaaaccccaaccctttggatctaattgcagaggcttttagaaaagagcagttatgctaagtcatgcagaactttctcataatcaaagcactgcaggggttggggattgggggtaggcaacaaaaacaaa

SEQ ID NO: 205539 - DNA, 613 bp, Homo sapiens
tccaatcctccatatggtgagtgctttctgagcagctcctaactactgatgggaggctcctgagaggaatctaagccctcctcctgggtgtaaaatctgccatggggatcctacttgcctctatggcttcaaacatgaccttgtcgggactcagaaagtgataccccaaagactggtgccttgacatgcttagaggccttagaagctgcctcagaatcgaggtccttctaacctggtcttgtcccacccccatccagcgaaggacacaagaacggacttgctctggaatttcctcatctggccaagaaagtttaacagtcacagtacgcaggggtcgccaacagaaacacaactgtttccctctcctccctgaaatttcattatctcagaaaagaagactgaggaatgcaaccacatctgagaagactccttcacaagataatacctgcctcttgggctcattcaaatttcaagaaaaaaatcatttccaagttaacttctgtccattcatttcctctaatgattgactgccccctcaaaagaaatgcctacatccccccccatctcccggctcccctatgaaaagggtatgtacgattctgtattgcactag

SEQ ID NO: 205540 - DNA, 155 bp, Homo sapiens
caaaagaattcccaatgagctatctaaattacttgttttgctggatgttacttgaccgaagattgcataaatgagctgtcacgattgggaccggatgatatttgttgtaacaagatttagcctgcagagggttatgaaatctggacctattctag

SEQ ID NO: 205541 - DNA, 153 bp, Homo sapiens
ggatacacccttatcactcttaaggcccaggggtcaaatccagcataccacctgttttcctaaatcaagttttagaggaacgttgcctgacccatttgtttacttatcctctgcagcttctgattttttttttttttttttttgagagggagt

SEQ ID NO: 205542 - DNA, 304 bp, Homo sapiens
tcaggaagattaaaaaagaatcagaagaacaatttcttcctagtatggcttggtgtgatgagtgtcatctgtattccatataaaattctttcagatatcaccaatgagtgatatgttcattacaatggggggtgtccctttctttggttcatgtataataactggaaacatgtatatagcatgtggtatgtgccaggtactcttcaagatactttagttatttaatctattgtcagataaggaaacagaggcttggagaggctaaacaacttatcctagctagaaagaggcagaattggggctt

SEQ ID NO: 205543 - DNA, 626 bp, Homo sapiens
cctatagatcagtctgtcttcactttggacactgcactatactccaaaaaggtacctctcatgcctgtcaccacatataaatgtaaatttcagtttcagtggaaatttacatctatacatccagactatcagatgacagatacaagcttggcaaacttaccctttggaatcctaacatgatcagctcagtcctgtctcactgcctatcccataaaagaccctctaaagtttaattccagccctctgctcttccctttaacagcataaatagctgggcgcggtggctcatgcctgtgatcctagcactctgggacgctgaggctggtggctcacttgagctcaggagttggagtgcagcctgaccaacatggtgaaactccatctccactaaaaatacaaaaactagccagatgtggtggtgcacggctgtaatcccagctatttgggaggctaaggcatgagaattgcttgaacccaggaagtggaggctgcagtgagctgagatcacgccactgcactcccgcctaggtgacagagcaagattccatctctgggcaggggaggggaagaaataaataaattgacacatggtagactctaacaggagaaaatgtcattttatttat

SEQ ID NO: 205544 - DNA, 193 bp, Homo sapiens
taagctattaaattatgcccaagtatgggaagttatgctgaagttgatatttcaactgatcttcaactgtgtattgagaaataaatagtactgtgatgaaaggaagtggaaataagagcctataccataacacggcactgtaagttggtgatattttctagatatggagaaaagatcattgtcacaggtgcag

SEQ ID NO: 205545 - DNA, 543 bp, Homo sapiens
tgccagcatcaggcttactataaagtctgaaaagccatgagccaattaaacatcttttctaataaattacccggcctcagatatttcttaatagcaatgcaagaacagcctaacacagaaaattggtaactatgagtgtggcattgctataaagatattggaaaatgtgaaagcgacttggcaactgggtaacaggtaaaggatggaagaactttgaaggctcagaagacagatatgatcaagtctgaaatttcttagaaactggttaaatggttgtgaccaaaatgctgatagttacatcgacagtgaaatccagattgatgaggtggaagggaattgctttatctcagatgagactttggacttcagactttttttttttccccaaaatgaagtctttctgtgtcacccaagctggactgcagtggtgcgatcacagctcaatgcagcctaaacctcccacgatcaatcaatcttcccacctcagcctcccaaacagctggaactataggcatatgccacaaagcccagctaatttttttt

SEQ ID NO: 205546 - DNA, 513 bp, Homo sapiens
caagcagttgatactgactcaaaactattctcaaaacctaagcctttatcatcgccatatgctttcagttacatcctgtttatctgaaatgttacttaaagttttagtttagtctctccatacagataggctcctagagtgcagaggccatggctcaattttcttctgtatttcctttcttcatggtgctcaacgcagagttaaatagtccacacccaataaatatttgttggttgactgagtatcttttgaaataatttattgtactaggaagaccactcattacattcatggcacattaaagctactcattcaggccaggcacagtggctcacgcctgtaatcccagcactttggaaggccgagatgaccagatcacctgaggacaggagttcgagaccagcctggccaacatggcaaaaccctgtctctattaaaaatacaaaaattggctgggcatggtggcgcaggcctgtagtcccagccactcaaaaggctgagccaggagaattg

SEQ ID NO: 205547 - DNA, 514 bp, Homo sapiens
aagaagaagaggcgagaacgaccccgggaccgaccaaagcccgcgcgccgccgcatcccgcgtacagcacctacatcccgccaccgtcaccgccaccaccatgcccaagagaaaggctgaaggggatgctaaaggaggtaaagccaaggtgaaggacgaaccacagagaaggtctgcaaggttgtctgctaaacctgctcctccaaagccagagcccaagcctaaaaagacccctgcaaagaaggcagagaaggtacccaaagggaaaaagggaaaagctgatgctggtaaggaggggaatagccctgcagaaagtggagatgccaaaacagaccaggcccagaaagctgaaggtgctggagaggccaagtgaagtgtgtgcatttttgataactgtgtacttccagtgactgtacagtttgaaagaccattttttaaatcaagttttataaaaatgcagaattttgttttacttttatttttcttttaaagctatgttgttagcacacagaac

SEQ ID NO: 205548 - DNA, 161 bp, Homo sapiens
ggcttaagggaatgttatagctgattcaattttctatccagattgctaaaactttctattagcaataatgctgtcttactttcttatcatttgtgtattcactggagtagcactttcaatttcgttcaagagcttccctttgtattcacaactggcttaac

SEQ ID NO: 205549 - DNA, 612 bp, Homo sapiens
gtgacattagtaaatggaaatgaggtgcggaaacagctggattggttacagtttggtgtttgccttatttctggattggttacagtttggcatttgccttatttgaacacgatttgaatagttggtcacctttgattggccaatacttggtgattagcagaagagtaggttatgctctgtttacacatatagttaggttacagtttactatggagaaaccttttggctgaatttaaaatatgtaaggaggcagctttaggctaaacctaatttaacaactgaatgaccaactgaaatacgtttttaggagaacatccagtaaacctgaagataataagaaagcctgaatggtctcattcagggtagaaagggtgagaaacagattggtaagactcaggtaattttctccttgctgtgaatttcttgtcttagtccattcagctgttttaacaaaataccatcctgggtggcttataaacaacagaaattgatttctcacagttctaaaggctggaaaatccaagatcaaggcactgtcagatttggtgtctggtgagggcctgcttccttgtagatggccatcttctcactgtcactccacataatgaaagg

SEQ ID NO: 205550 - DNA, 596 bp, Homo sapiens
cccgctgggcccaatggcactgggccccaagaagagaccaccctgagccatggccctgcaggcaagcaagggacagctccccacactgacaccaacagatacattccaaacagttgaaacgctgacatgtttgtctttggaaagaaacaggctaactgattattatgaaccattactcaagaacaattccactgcttattcaacaaggggaaatagaatagaaatttcttacgaaaatttacaggtcacaaatattactagaaagggaagcatgttaccagtgagctgtaagttaccgaatatgggtacttcccagagttacctttcctcatctatgccagctggttgtgttttgccagtaggtggtaattttgagatcttgttacattactatcttctcaattatgccaaaaaatgccatcaatcagaagaaaccatggttagtatgataatagctaatgcacttttaggcattcccaaagtcctttataaatctaaaacaggaaagtacagctttccacatacatatataagagctgtccatgcactgcaaaccaatcaacccttggtaagcagtcagacaggtttggaatcag

SEQ ID NO: 205551 - DNA, 697 bp, Homo sapiens
aagaacagtggagaaagttatcaagcaccagatcctggtaatggctcaatacaaaggccttatcaggacacagttgcagagaacaaagatgcattggaaaaaactcaaacatatttaaaagtacattctaatttggtaattccagatgtagaattagaaacatatattccgtattcaacccccacactgacaccaacagatacattccaaacagttgaaacgctgacatgtttgtctttggaaagaaacaggctaactgattattatgaaccattactcaagaacaattccactgcttattcaacaaggggaaatagaatagaaatttcttacgaaaatttacaggtcacaaatattactagaaagggaagcatgttaccagtgagctgtaagttaccgaatatgggtacttcccagagttacctttcctcatctatgccagctggttgtgttttgccagtaggtggtaattttgagatcttgttacattactatcttctcaattatgccaaaaaatgccatcaatcagaagaaaccatggttagtatgataatagctaatgcacttttaggcattcccaaagtcctttataaatctaaaacaggaaagtacagctttccacatacatatataagagctgtccatgcactgcaaaccaatcaacccttggtaagcagtcagacaggtttggaatcag

SEQ ID NO: 205552 - DNA, 745 bp, Homo sapiens
cctgagcaaaatgatcaaattccaaaacccagggtttaagaaagcagacagaaagccacagagaggggaagtggttaaagagaggggacattccaaaaagacagccacttagcacaaacaattcaaattccagtgttgttggtgccagaatccttttcactgttggtgatgggattttgagaaaagtgtttcaaatagaagaatttgaggtgtcttaaaaatgggtttccaaagaaagtggaggaggcgtgaaaagattccattatccagttgagatcgtcaagtatcctgctgatctatgtgcgggtctggatacacacagccttcaggaacttgggcacaaacaaaatctactgtgatggttaacactgagtgtcaactggactgattgaaggatgcaaagtactgttcctgggtgtgcctgtgagggtgttgccaaaggaggtgaacatttgagtcagtgaactgggagaggcagacccaccctcagtctaagtgggcactgtctcatcagctgccagcacaggtaggataaagcaggtaggagaagatggaaaagcagacttgcttagtcttctggcctttatctttctcctgtgctggatgcttcctgccctcgaacatcagactccaagttcttggacttacaccagtggtttgccagagcctctcgggccttcggccacagacagacagctgcactgttggcttccctacttctgaggttttgggactcagactggtt

SEQ ID NO: 205553 - DNA, 478 bp, Homo sapiens
tccatcacctctccgaccttattgccttcccctctctcccttgcacacctggttccagccacacggtctctgtactgttccttgcacatgctagcacagcccaccccagggcccttgaacttgctgctccctctgcctggagccttcattcaggttatcttcaccatcccttcttccccctcctcaggtctttgctcaaatttcaccttggcaggttaaaaccgaaatctctgccctccccagtagcacttaccacctctcacagctagctcctttatttctttgcggatgtcctccagcagaatatcagccccctgaaggtacaggtttttgtcatttttgttcagatctatatcctcaacaattaaaacaatgcttgcggcatagcaggcattcaaaatatttactggcttaacaaagaattatctcctgtctcctggtaacagcccctgttagtgctttgaggccacaagtgctc

SEQ ID NO: 205554 - DNA, 1334 bp, Homo sapiens
  misc_feature (1)..(1): n is a, c, g, or t
  misc_feature (1333)..(1334): n is a, c, g, or t
ntttgccacattgcccgggctggtctgcaactcctgagctcaagcgatccagcccgcctcggcctcccacggtactgggattacaggcgtgagccccaggctggcctctttgcattctttagagtgctgttttccctttgttgctgagttgtgtgacgaccccaaagaggaatcaccccatgacagtcctacttctctcgccctgaggatttccggacagggaggccagcctgcgggtttggcttgtctggggagattggatgtcacaggtgcctcgccgtgctccaggccttggatcgagtcctgggctgacattttctattatccatgttcagaaaatggcagttgggccactcccagattgtagcgctgcaacacaattggcaccagtgccctgtgaggtgggcggggccacctgcttgtccccttgtgtgcaggaagccaacggagccacctgcccgaggttagaacacgggaggcagcagggctgggagtgaccttcagatgtcatgtcattgggaccgagcgctttgggctgttgagaggcggcagtgtctcgggtgtggaccacctgctgctggcagcccagacgcacacggtgcctgtcccttggagagccatgtgcctcctgccctcgtggcgtgatggccgtcgtaaaatctccatgcagccctaagctgccacacacgagcaccagccagccactgtggacgtgggatgggcagatagttacagagcccggggtgactctgctgtcctttctctgcaggccaagcggaggctggactgaaatacatttacaaattagaatgtattttgctgtgggaaaatagaccccttgccattgcccctcggtgttgactacagaggtttttgaaaggtggcattgacaggcatccgatccgtgccagggcacagcactgtaggctggatgccgagtgctgttgccgcagatgtactcgggcctaaagtacctcctggctggggcgtgtgtgagctggaaatgcacgcgctctcccactcccaagctcactccacttgcacgccgtgacctggacgtgctgtttctggacaaggggaatggcactcccttctcagcgaccggctactcctgttgggacccagtagctgccagtccgtactggaattgtccccccatgcccagccaagccactggtcctgggcccatagagactctgtctccctttctggagtcagacagtttgacaggggcactcgcccctctgcttcctgccacctggcccggggcgcctcagtcagcccctccagatctgtttctttaactgagagcgggacaccttccccccccccnn

SEQ ID NO: 205555 - DNA, 378 bp, Homo sapiens
agatgtgaatgatagcttgttggtgaaaaacagcaatgactggaatattgtgtgtaacgtaatcctgcttttctgtatataatgtaggcatagaaaataggattgaaaggacatactctagtcaacagtggatatagcttgggtggagggggtgtataatggggaaggagagtcccttttcctatctattccatatacatctctggatttaaaagatcatacatgcatatgcattaccttcaaaattaaaatgataaagacaaaaggagaagctttgtatttgaatcatgatactactgtttgcaacttatatgaccgtggggaagtcgcctagcctcctggggtttatttcctcatttataaaaatagggaaagtaa

SEQ ID NO: 205556 - DNA, 284 bp, Homo sapiens
agaaaacagagttaactccaaatggtgtaagaaactctaacaacggggctgtttacagtagacagggttaagtgagcaagcaatggatattaatagatgatgaggcacaaaaactggcaacagctggaagccattatcatcacctgagggctgatggggcaaggggaggacaaggtattgtgggagcccagtgaaaaaggaaactgccaagagactactcagtggaattgcagtcatggagccatgcagccactgccaggggtgctggtccagcttgctgggca

SEQ ID NO: 205557 - DNA, 173 bp, Homo sapiens
aaactggattctcttatcatctctggcccatcagagagtagaactctttaacatcttatagaaaggaaaagaactagctagagagagcagagctaagatcccactgccagggattcattctggaaccaagagaagacttgctggagttaaaccaccggcaggtgccctcccgc

SEQ ID NO: 205558 - DNA, 629 bp, Homo sapiens
caatcggtgttaactacatgtgcagccaccgtcttcttagtcttattacaggtgcagaggtaatataggtgaatccctcacaagttgagtgggttgacctcaaaattgactttagcgatggcttgtgaccacctggtaggtggtggaccattacagcgtttggaaaatgagtaaaacaaaggatgcatacggaagccccactagcttgcttggcttctgcagatgcagagagaggtcgtttttctgccttctgggtgttgagtaacttaattttttatcttttgtttaaatgaaatagagctgaaaatagaaggcgatttccttttaacgagatagtattgagatgcttgcagagtatccccgcgtggattctgcttagctctgtgataccagcatcagaaactgtgcaaagagctctaatctggaggtgtgggttgttcagtagcttagaaagaggttattcctggagaataagtgcagcaggtagaaaaggatccattgggattgggagaataaaagttcattcattatttttattgatggaaaacaaagaaatgagctttaccctatactgatcttggttcctggagttccgagtgcttgcatctcagggcagaaacttccttaga

SEQ ID NO: 205559 - DNA, 576 bp, Homo sapiens
gaaacaagccaggtaagagcagagctgccctgactggagctaatggggccagtcccagtcccataaccccccacccctgcctcacccccgacatgcttccaggcggtctgagacaccttcacaggacactgagagcttagtgtgaaaactgtcacagaagggatgcagggacacaaacagaacatatttggatctttgaaacactctatgatctttccaggtagttagggcccagataccgtctgtctttgtctggttgggagaaaggggttctgtgggacctttggtttttattctccaggatggaggtgggcatttattccaagagcaagcaatggaggataacagtggctttgacctaggaatctggttggcaatgctgagagttcctggaggtcacttggtagaagctccccagcatgaccactacctggataagtcacatgaaaggtttgtcaggaagtgtaatagtgcaattcttgatgatgtttgggttttcctctagaggacccagggcagcctgcaggactgtctgaccatgcgctcactcccatacccacagacccactcactcac

SEQ ID NO: 205560 - DNA, 251 bp, Homo sapiens
agttgcatgtaatagacaattagaaaatacaagaaatctttaaaaatattgaaatggcaggttactatctaccagatagatactatttggtcagatgaccaagtagttaggaacttagcctcttgattgccagatttgaattttagctgtactagtttttaaggttttttttttaatcttggacatgtaatttaatttctttatgcctcaatttattcatttgtaagacgagaatagttaatgatatttaa

SEQ ID NO: 205561 - DNA, 574 bp, Homo sapiens
actgagaaattgatgaattgaattgaatgtatacctgggttcccgggcagcaaaggtgctgatggaactggtcttctcaccattttctttgaaagagaaaggaaattgcacatggtccatgctcacatccaggagacaagtattacattgctcctgaaatggaaccattcctctctgatcattgcttttctccatggttatttcttaaacataactttgtttatatgtaaccccaaatcaaagaaaactaaaacacctcatggaaaacaaaattgcctaagtataacacaagaacaatttgcttttcactgcatgcagggttgcttctctgccctggctggttgtgagatacttccagggaacatgtttcagggtatgagaatgaggccagtggctgctgatgttaaaaggacatggcatctgcactaggttggagagggggctggttgcacaaattaaagtcaaacacatcacagtctgatcagcagacatgggcttgagtgtgttgtctaggttttttcttttctttccttttcttttttactacctcccagtaacagtgaggcaattaaaa

SEQ ID NO: 205562 - DNA, 383 bp, Homo sapiens
gttaaggactattctggttccagtttaggatctaacatacaggaagagtttagttctgtgtagatggtgcagacaaggttgttaagggcaccaggcttatggattgcttctcttccaagcacttattttgtttaaattctggaaacattcaatgtaaacattagttatatcagacaaaaggattaggcatccacttaagtctattatgtagctcataaaagtggtaattataaaggctccaaatttacttagattagcacttctaagttattatgatagagtgatgtactaaatatacatcacacttacaaccaggtagaattgaaagaagttttgaagaaatattaaaagtgcttttagttttgtgttgggagatatgagtg

SEQ ID NO: 205563 - DNA, 354 bp, Homo sapiens
atctagttaaccagttaattgtagtcacagataccactggaggctgtatgtatgttaagagagaaactaaagcaatgaatatgtcacatactttagtttgaagaattacaacagcagtgggcatcattcttgttactactgcaacagcaaaataaatgagaaaatggaaattaaacaagggtgacagagaagggagaaagccacaaagtgttccttttaaataggattaacatttcagaaaaacatgttggataagttttgatcataaaggaaattctgagaaagaacatacagaagaccagaataacatcaaagttacctagaaaaacatcaagataataaatcctggagaaa

SEQ ID NO: 205564 - DNA, 229 bp, Homo sapiens
gggttgtgggagttggtaccagcagagtgaaacagcaaatctaaggccgtggttcaggtggatgaaagtgatgtcatgatacttatacttgaatcactgatttaaaatgtcaaatgcagaacatgccgatcttaatttattaacatgccaattcagattattagaatttaaagtactaatactttttcatagcgtcttgttcctatttacatgataattttttttctat

SEQ ID NO: 205565 - DNA, 559 bp, Homo sapiens
ccctggtaaaatttgttcatattaatttaaaatcctgaattaaaaactaagacatgggtaattgtcctattggttattaaaagtgttttaatactttcattaaaaagactatgaagtattcacccatgaatatacaggtcagtgggatatgataaaactgagaaaacggcccacttatttatgcagttatagtatataataaaaacagccttctgtatctgtggggaaaaggtgagttaattattaatgatgtgggtaccattttagcagaatctgggggaaaaaacggatgtatactttaaaatttacatcataattaattccaaatagatgagttaaatataaacaatgaaactccaatagcagtaaaactatgggagaaagatgatgagagcactgaaaaacctctttccacctctcaagttcaggaaaaatatgtgtgattatatttggtgttgataaggatgtgaggaccaagctttcatttattgtttgtggaaatgtaaattggtaaaatttctatgaagggaaattccgatataactttaaaattttcaaa

SEQ ID NO: 205566 - DNA, 501 bp, Homo sapiens
aagtcctaaatgaatgcagagcagtttcaacacatgagttcacatacatgctcccaactgtttctaaatgttaggggaaatcccaacctttgtctttgaaaaacaccagagtgtcttgtttgtgattttaaaacactcaaagacaaattgccagtttgccgtgtgtatttcaaatctactttccgtttatttaatttcttggcttctttaacttgaagcttcccaccagggctccaaacctctttcttactatcgaacagtgtgactacccaggctgctgaaggcaccgcttgtcatctatctagaaattaccttctctgcatgttgcctggaactgtggagggttcaccattataaattatagttcaaattacaaaacagggcccctattgatgatttcaggttctaagtgtgtaattatggtgcttttgctaatgacataatgaagagaggtgattatgtcattaaaatgtgatgttttttatatcccgaagaagctgc

SEQ ID NO: 205567 - DNA, 404 bp, Homo sapiens
ctccaggactcaaaaagtgcactcttctatatctactttgagtcaaagaccagaaatgtgtctagaagttcttagatgaagaggtagtgttaacagtattccagttagtgggagcatctgaccatgtgtaaaggagctcggtgcatttgaggagccaaaagaaggctgttgtcactagaacatagtcagtgatcgggagagggactggaaatgactagattcccttccttttcttaatctgcttttcaatgttcactactgtgttgtagaaaatggatcagagggtcaggggtaggtatggagagagcatttaggaggctgtttgtttatagtagttcaggtgagaaacagtggggacattacaactagggatgtgacagtagatatagaagagtgcacttttg

SEQ ID NO: 205568 - DNA, 685 bp, Homo sapiens
attaaacctatagatcagtttggggggataatcttttctatttgagtattaaaatagatgaacacagtatatttatttattttagtttttatttctttcatcagtattatgattttcagcataccagttgggaatatgttttgataagtttagacctaagtatttgattttgattgattttcatttgtttctcttttgtcctgctaaactcacttattagttgtaggagggttttgttttgttttgtctttgtagattgcctgggattgtctacacagacagttgtgtagaaaacatagagacagtgttatttctttcttttcaacctgtatggcttttccttcttttttttttaattaaattttttaggggtagtgatggggtctcactatgttgctcaggctggtctcaaactcctgaatgccagtgatctgcctgcctcagcctcccagagtgctgggattataggcgtgagcgaccatgcctggccttctttctgttttaaaattttctgccttaattcagtgactagacttttagtacaatgtggagtaagagtgctgagagtggacttcctatgttgttcccaatcttgtcactgttatttatttactaacatgattggatgttgaattttgtctaatgccttttggtgtcagttgatatgatcatctggatatgggtt

SEQ ID NO: 205569 - DNA, 194 bp, Homo sapiens
gacgccagaaacacttggtggcaggccatatcctctctgtactggcaagcactcccctccgtcctaattgccacaccatctcctctgggggttggggctcgtacacatttttcataacattagtaccagtgataatttaatacaaacagagtgccagccaccgcggtcacacgattaacccaagtcaatagaag

SEQ ID NO: 205570 - DNA, 587 bp, Homo sapiens
atatagctcagattatattcacttgatactgcctagtctgtacctcagtgatgcacttaacatataactctcaacaaattattctttgtatctcatacctcaaacctcattttttttcacaaaacttttttgtggttatctcactctccatttcaaattctccatatattgggcagttatatatgtatttaatccctgctttattctagaaaagtctcaacgggaatctttggtatttgaagtaaactctacactacacacacagatgatctgattacatctgggtttgtgttggtagtatctcctctaggctcttaaattatgtgattatgtttacaattctaataatttattttgtcaaatgtgttgatgcttaacaacactgtactccaattcatgttcaccctatgatcaccaacagatattaatagaactttgcatgtttgttgaccatatataagaaattttatacttgggtagttttcttcagcattctatgtttagttaattcctgcctaattaactcatatataacccctctgcaggtgattaaagtaaaatacataatagtagctacagctgaatga

SEQ ID NO: 205571 - DNA, 334 bp, Homo sapiens
atagtgcttgtatgccaggcactcctcatcacagctatgaatcgtggtccaccaaataagtgcaacagagtttatctatttttaaatctttgccatcactactaatgttgcagcgagtgttttcttgtacatacatccttgcggaagtgtttgggtatatacctacggtagagttccttggttatgtggtaccagcatcttcacctaccaactctgtccaaatggttaccccaagtgtttgtatgaccctgtcagtatgtgcgagggttttttactccacatttcctcccaaacttttttttttttttttttgacagagtctggctctgtcgcc

SEQ ID NO: 205572 - DNA, 474 bp, Homo sapiens
tagtaatttaggaacttagagccatattttatcatagaaacaaaaaaataaataggataacaataaaaagacagttgtgggcacaggaattttgtttcagctttctctcacacatttagaggaacagttaggtaaatgatgatgcagtcacatgaggggatataacagttatacggaatatttttcaaaagctttcgataatgtagaataatgcttacagataacgtgagtggaaaagtatgatgcaagggtacatctattcctatctcaactgtggaaataatacacatgcatcaaaaaatactggaaagaaatatcccaaaatgttaatagaatatatttctggatattaagattatgagtgatttaaattttctcttttagacttttctaagatttctggaatgatcttgtattatttttataatgaaaaccatttttgaacaggtgaattttgctcactcctctttggaa

SEQ ID NO: 205573 - DNA, 180 bp, Homo sapiens
taaaatgcagatattcaaataaaggattgcaccttacccaaataaaagttgatgttgcttctaattatttctaactactttgtgtgagaattatacagagttctggagacattacctatattagaacatcatctctcaaaactacatctgtaaatcatactttttaagtcttatcttgtc

SEQ ID NO: 205574 - DNA, 731 bp, Homo sapiens
gtctaggatcctgataattatgcattttctctgaagatatctatttccagtaaaatttgactatctagtgaagattgtaggcctgataatatattttgaagtacttgttatgatctgaatgtgtgtgtcacccccaaaaatgcatatgttgaaatttgaaccccttatgttatggttttaggaggaggggccttggggagtcctgagaatgggattagtgcttccaggagaagagacaggagagcttttttctcactctccctgctgtccaccatgtgaggacacagccagaaggtggctgtgtgccagtcaggaagggagccctcaccagacacccgatctgctggcaccttgatcttggacttcccagcctctagaattgtgagaaatagacaagtgttgtttaaggcccccagcctatggcagcttgttatagcagcctgagctaagacatatttgattttagcaaaatagcacttgatttgaaagcattctgctcattgccatcacctcctccttcacagttgtggattaaaaaaaaaaaaaaatgaacacatgaccacaacaaaacactgatatgtgctgagtttaatttacttcttttttttttgagatggagtctcactctgtcatccaggctggagtgcagtggtgcagtcttagcccactgcaacctctgcctcccaggttcaagcgattcttctgcctcagcctcccaagtagctgggatt

SEQ ID NO: 205575 - DNA, 373 bp, Homo sapiens
ggaggggcctttctgcccaggaggagcccctcccctgccatctcctgctcctgtctcagcagcccctccccatagaagcagttggttctgctcctggtgctgggcaccccctggatctccaaggaggcccctccttcctcccaaatggagggggggctgcctgtgtgctccccaaccccaccgagggcagtctcggcacctctcccctcccctagggctgcaggtggctctgggtgtggggggccagggccaccttcagtgagatggaaaggagggcgccacgttcccagccgcctgtggccagaccaccacctggccactgaggagagaggggccgtgggctcgccctagtcctcagcagcccctgcgcact

SEQ ID NO: 205576 - DNA, 528 bp, Homo sapiens
catcggggtcctttgtctcacgccagttaaacgacatggacacacaggagtggttttaaggagcagaaagtttaatagacaagaaagaagaaaggctccctgcggtacagaaaaagggggtctgaacagagaaaaagccccgtgtgtggcagaacagtactcggttatattgggaggctggaggaggtggtgtctgatttgcacagggcccagggcattggtttgaccaggcaggtcattcatgtagcccgagaaaaacgtggccctcccaccctagccttttaatatgcaaatgtaggtcaccatgttgtcctgcacacatggggtcatctggaggtgtcaccttgaggtggtgactagaagaagagggtgggaatctccatgttgaatggacacagtttctaagcgctggcatttgcatatcaaagcttggcagcctgtagtcccagctactcaggaggctgaggcaggcggatcatctgaggtcaggagttcaagaccagacaaagggaaacaccgggtaccgag

SEQ ID NO: 205577 - DNA, 210 bp, Homo sapiens
ttcactggagaactgctgggatatagggtgtgatgaccagggtttgatgacgtcatcaaaccctagcctgataattgtttggcttaagtcactctgggctggatgaccttgggctccacctctgggccctcgtttctttcctcccagagctgagagtatatgagatgtgggcagaatgtgatttggtaactgcagacagggatctcaagc

SEQ ID NO: 205578 - DNA, 131 bp, Homo sapiens
ccttccctccttccatgttaacagaaagtcagttcacatatctgggtgtcagtctgctcacctgtgaaatggcaatgatgcctgaactgctttgcaaccttataaaaatcaagtaagactatctacatgaa

SEQ ID NO: 205579 - DNA, 349 bp, Homo sapiens
gctcaattccaacactcaaggcaactacagagatttatgaagaatttaaacaggtgctctttttccaccagagtattagaaagcgatgaattaacgtatcaatctttcaatgtcttcctcttctcccttcttcttcgtccttcttttttttgtttctttttttttttcttctccctctctttctcagtctctctctcttgctgttacttcctatgtaaaaatagcacaactccttgtgaggaaaaattggaaaatgcagaaacatacaaaggaattaatcacctgacatcctgctattgctgagagcttatcactgttgtttgagattttcatcctgactcttcccttt

SEQ ID NO: 205580 - DNA, 434 bp, Homo sapiens
agatggcagcagcagcagggcagcacctctgggaagtcccgggaagaggcctggctaggccaagtcagggccacacctgagctggctgcaggactgtttacaaagcaaatgcatactggagggattagcaacctgagttcttggccagctgaggtgggtcacacctgtaatctctgcactttgggagtccgaagtggaagggtctgtgcaaatcaagcctctccgccaaatcacctgccggcttcccacccacccccaatccccacctgaagccaggtgtctctaatctctactcctgagcatgaggaaatccagcacaaccccaccaccaccagcaggtagagcaccagctgtaaccagggcacagctcctgagccagcgggctcacttttcaatctggttgtggagcaggacactgagaagcagcccacaga

SEQ ID NO: 205581 - DNA, 346 bp, Homo sapiens
catatactttaaatcatcagtagattacttataatacctcatgcaatgtaaatgctaagtgaatagttgctatacttcatttttaggtttatattattttttattatttttcctctgaatatttttgattcactattgaatgaatacaaagatgcagaacctgtggctatggaaggcaattgtatacttgattaattctttaaatatgaaagggtatattataatggagaactgtgttctatatttttgggacccaattatttacggcgtccattgcaatgtcctaatgttagaatattcatttctactcttacaaataataaatgacacaactaccggctaagca

SEQ ID NO: 205582 - DNA, 794 bp, Homo sapiens
gcttcaggaattcagagcttcagaatttggcttatggttttgggatgtggggaatttgtcttcatgggctgtttatctgccttaattgtgatagagatgctccaaggagatgtgtgggcaggattgggcccagggccagggtaaatcagagcagccccaggcctgaactccccagttcactcaagacggcagtgtatgtagctttcggaggaaagctctatcatttctcctgaatatgaagctgcacccattcattgcaaaattgtacaactgcctgcaaaatcgtgagtttcaggcagtggttggtgattgctattgcattagacatagtgattccacatttggggagaataaagagaaagaaaacttgaaggatcagagtagtcccagaccttggaaatgtcacaactgtgaaacaagtctctagaaagcaagataaactaatcagtgtgatatttacagctcatctctcgatcatatttatttcttggtgcatgaaaattggttcctagggttcacattaatcatgatgaaatatatttactactgtctgttggctggtttagatcaagagttggcaaccattactagtaatatttctaggttcccaaccagcatttaggctgaagatttcaggggttgggtggaggtcatgaccacatgttgacactctgtgcttggagagggaaggaagaaactgacttctcacaaccacggccactaaatatatccacagcagagatctgggcttgattgaaagcctcttctccagtgtggtccattcatgcaagaat

SEQ ID NO: 205583 - DNA, 684 bp, Homo sapiens
taatatatatgacttattttaaaattaaaaacatgtactactgccaacttataaatatgagtacagtttaagaccttactttttagggaagaaaatatatataaattaaagcttttacattttcttcccattccccaaaggattatactgagcaccaaatgttcgaacttagtgcgtgatatggtttggatctgtgttcctgcctgaatctcatgtagaattgtaatccccagtgttggaggtggggcctggtgggagctaattggatcaggggggcggagttctcatgaatgggttagcaccatcccctaggtgctattctcctgacagtgagtaagttattgtgagatattgttgtttaaaagcatgtagcacctcccgcctctctcttcctcctgctctggccatgggaagtgctggcttcccttcaccttctgccatgatggtgagtttccttgtacctccccagaagccgagcagatggccagcatcatgcttcctcacagcctgtgaaactgtaagccaattaaacctcttttctttataaattacccagtctcaagtatttctttagagcagtgcaagaacagactaatccagtgaccttgatgccacacagtggttgcttggagcccagtgagcttcatcttcaaccggcatccctgacacaccttgtcctggcct

SEQ ID NO: 205584 - DNA, 1033 bp, Homo sapiens
aacactggcaggagtttggaagaagcttatcccaaactttatagatgactttgagacattcaagacttcagtggtggaagtaagtgcagatatggtaaaaatagcaagataactataagtagagcctaaagatgtgagtgaatcactgtaatctcatcatcaaacttaatggatagggagttgattcttatggtggagcaaataaaatgatttcttaagctgaaatctactcctggtgaagatacagtgaccaatgtttttattttgcttttattttttgtttgttttgaattttttgcagaatcaaggtcttgctatgttgcccacggtggtcttgaactcctggcctcaagcaatcctcacaccttggcctctcgaagtcctgggattataggcataagtcactgtgcctagccctgtgaagattgctgaaataatcacaaaggatttagaatattacataaatttagttgataaagcaatggaagggtatcagaggattgactttaatttttaaagcagttctactgtggataaaatttcatcaaacagaaatcgcacagaaattttcaggaaaagaataatcaatcaatgtgtcaaaccttattgttgttttattttaagaaattgccttaccactctaaccttcagcaatcactcactgatcagtcagcagccatcaacatcaaagcaagatgctccagcagcaaagaaattacaactcactgaagactcagacgatcattagcattttttagtaataaaacaactttaaattaagtaagcaagttaactgaaatggagaatcactacccaggatggaagagggaacctgtgtttacctacagtctctgaaaacgatatgtgtctacatgagcaacaaagcttggaagtttggcttgatccagcagtctataatatctatgtgtacgattttctgtctttgagtgttttttgacatttattattaacaataaaagcagatgcggccgtctcgccccgccattctcccgtaggcctgtaagctggcgtc

SEQ ID NO: 205585 - DNA, 443 bp, Homo sapiens
aacactggcaggagtttggaagaagcttatcccaaactttatagatgactttgagacattcaagacttcagtggtggaatcagcagccatcaacatcaaagcaagatgctccagcagcaaagaaattacaactcactgaagactcagacgatcattagcattttttagtaataaaacaactttaaattaagtaagcaagttaactgaaatggagaatcactacccaggatggaagagggaacctgtgtttacctacagtctctgaaaacgatatgtgtctacatgagcaacaaagcttggaagtttggcttgatccagcagtctataatatctatgtgtacgattttctgtctttgagtgttttttgacatttattattaacaataaaagcagatgcggccgtctcgccccgccattctcccgtaggcctgtaagctggcgtc

SEQ ID NO: 205586 - DNA, 295 bp, Homo sapiens
ttttcctctgccattcttattagatagaagaacatcccttaagtaagcaagttaactgaaatggagaatcactacccaggatggaagagggaacctgtgtttacctacagtctctgaaaacgatatgtgtctacatgagcaacaaagcttggaagtttggcttgatccagcagtctataatatctatgtgtacgattttctgtctttgagtgttttttgacatttattattaacaataaaagcagatgcggccgtctcgccccgccattctcccgtaggcctgtaagctggcgtc

SEQ ID NO: 205587 - DNA, 1037 bp, Homo sapiens
  misc_feature (1003)..(1004): n is a, c, g, or t
  misc_feature (1023)..(1023): n is a, c, g, or t
  misc_feature (1025)..(1025): n is a, c, g, or t
aacactggcaggagtttggaagaagcttatcccaaactttatagatgactttgagacattcaagacttcagtggtggaagtaagtgcagatatggtaaaaatagcaagataactataagtagagcctaaagatgtgagtgaatcactgtaatctcatcatcaaacttaatggatagggagttgattcttatggtggagcaaataaaatgatttcttaagctgaaatctactcctggtgaagatacagtgaccaatgtttttattttgcttttattttttgtttgttttgaattttttgcagaatcaaggtcttgctatgttgcccacggtggtcttgaactcctggcctcaagcaatcctcacaccttggcctctcgaagtcctgggattataggcataagtcactgtgcctagccctgtgaagattgctgaaataatcacaaaggatttagaatattacataaatttagttgataaagcaatggaagggtatcagaggattgactttaatttttaaagcagttctactgtggataaaatttcatcaaacagaaatcgcacagaaattttcaggaaaagaataatcaatcaatgtgtcaaaccttattgttgttttattttaagaaattgccttaccactctaaccttcagcaatcactcactgatcagtcagcagccatcaacatcaaagcaagatgctccagcagcaaagaaattacaactcactgaagactcagacgatcattagcattttttagtaataaaacaactttaaattaagtaagcaagttaactgaaatggagaatcactacccaggatggaagagggaacctgtgtttacctacagtctctgaaaacgatatgtgtctacatgagcaacaaagcttggaagtttggcttgatccagcagtctataatatctatgtgtacgattttctgtctttgagtgttttttgacatttattattaacaataaaagctgactaaaaagaaccggccccnnctccctataagaaataagnangggacaagggaa

SEQ ID NO: 205588 - DNA, 1035 bp, Homo sapiens
  misc_feature (984)..(984): n is a, c, g, or t
aacactggcaggagtttggaagaagcttatcccaaactttatagatgactttgagacattcaagacttcagtggtggaagtaagtgcagatatggtaaaaatagcaagataactataagtagagcctaaagatgtgagtgaatcactgtaatctcatcatcaaacttaatggatagggagttgattcttatggtggagcaaataaaatgatttcttaagctgaaatctactcctggtgaagatacagtgaccaatgtttttattttgcttttattttttgtttgttttgaattttttgcagaatcaaggtcttgctatgttgcccacggtggtcttgaactcctggcctcaagcaatcctcacaccttggcctctcgaagtcctgggattataggcataagtcactgtgcctagccctgtgaagattgctgaaataatcacaaaggatttagaatattacataaatttagttgataaagcaatggaagggtatcagaggattgactttaatttttaaagcagttctactgtggataaaatttcatcaaacagaaatcgcacagaaattttcaggaaaagaataatcaatcaatgtgtcaaaccttattgttgttttattttaagaaattgccttaccactctaaccttcagcaatcactcactgatcagtcagcagccatcaacatcaaagcaagatgctccagcagcaaagaaattacaactcactgaagactcagacgatcattagcattttttagtaataaaacaactttaaattaagtaagcaagttaactgaaatggagaatcactacccaggatggaagagggaacctgtgtttacctacagtctctgaaaacgatatgtgtctacatgagcaacaaagcttggaagtttggcttgatccagcagtctataatatctatgtgtacgattttctgtctttgagtgttttttgacatttattattaacaataaaagccangatcggccgtctctacttaaaaacacataaagaaaatcgggtatactgtgc

SEQ ID NO: 205589 - DNA, 1030 bp, Homo sapiens
aacactggcaggagtttggaagaagcttatcccaaactttatagatgactttgagacattcaagacttcagtggtggaagtaagtgcagatatggtaaaaatagcaagataactataagtagagcctaaagatgtgagtgaatcactgtaatctcatcatcaaacttaatggatagggagttgattcttatggtggagcaaataaaatgatttcttaagctgaaatctactcctggtgaagatacagtgaccaatgtttttattttgcttttattttttgtttgttttgaattttttgcagaatcaaggtcttgctatgttgcccacggtggtcttgaactcctggcctcaagcaatcctcacaccttggcctctcgaagtcctgggattataggcataagtcactgtgcctagccctgtgaagattgctgaaataatcacaaaggatttagaatattacataaatttagttgataaagcaatggaagggtatcagaggattgactttaatttttaaagcagttctactgtggataaaatttcatcaaacagaaatcgcacagaaattttcaggaaaagaataatcaatcaatgtgtcaaaccttattgttgttttattttaagaaattgccttaccactctaaccttcagcaatcactcactgatcagtcagcagccatcaacatcaaagcaagatgctccagcagcaaagaaattacaactcactgaagactcagacgatcattagcattttttagtaataaaacaactttaaattaagtaagcaagttaactgaaatggagaatcactacccaggatggaagagggaacctgtgtttacctacagtctctgaaaacgatatgtgtctacatgagcaacaaagcttggaagtttggcttgatccagcagtctataatatctatgtgtacgattttctgtctttgagtgttttttgacatttattattaacaataaaagcggtaccgacaagcttcttttttttttattttccaactcacgacaaaacc

SEQ ID NO: 205590 - DNA, 1096 bp, Homo sapiens
aacactggcaggagtttggaagaagcttatcccaaactttatagatgactttgagacattcaagacttcagtggtggaagtaagtgcagatatggtaaaaatagcaagataactataagtagagcctaaagatgtgagtgaatcactgtaatctcatcatcaaacttaatggatagggagttgattcttatggtggagcaaataaaatgatttcttaagctgaaatctactcctggtgaagatacagtgaccaatgtttttattttgcttttattttttgtttgttttgaattttttgcagaatcaaggtcttgctatgttgcccacggtggtcttgaactcctggcctcaagcaatcctcacaccttggcctctcgaagtcctgggattataggcataagtcactgtgcctagccctgtgaagattgctgaaataatcacaaaggatttagaatattacataaatttagttgataaagcaatggaagggtatcagaggattgactttaatttttaaagcagttctactgtggataaaatttcatcaaacagaaatcgcacagaaattttcaggaaaagaataatcaatcaatgtgtcaaaccttattgttgttttattttaagaaattgccttaccactctaaccttcagcaatcactcactgatcagtcagcagccatcaacatcaaagcaagatgctccagcagcaaagaaattacaactcactgaagactcagacgatcattagcattttttagtaataaaacaactttaaattaaggtacgtacattgtttttatggacatgatgctattgcacactgaatagactatgggatagttaacttttatatgcactaagaaacaaacaaaaatgtgtgagactcatgatattgtaatatgtgctttattgcggtgatctggaactgaacccatgatatctccaaagcatgcctgtactttaaatatacacatgaaaacttaaacttatctgtattcaaatgtttcactatagttttatacctaacaacaaatgcaaaaaatattgtaaaattattattcttataaatttagaaaaataaaaatgactccatata

SEQ ID NO: 205591 - DNA, 995 bp, Homo sapiens
  misc_feature (959)..(959): n is a, c, g, or t
  misc_feature (981)..(981): n is a, c, g, or t
  misc_feature (995)..(995): n is a, c, g, or t
aacactggcaggagtttggaagaagcttatcccaaactttatagatgactttgagacattcaagacttcagtggtggaagtaagtgcagatatggtaaaaatagcaagataactataagtagagcctaaagatgtgagtgaatcactgtaatctcatcatcaaacttaatggatagggagttgattcttatggtggagcaaataaaatgatttcttaagctgaaatctactcctggtgaagatacagtgaccaatgtttttattttgcttttattttttgtttgttttgaattttttgcagaatcaaggtcttgctatgttgcccacggtggtcttgaactcctggcctcaagcaatcctcacaccttggcctctcgaagtcctgggattataggcataagtcactgtgcctagccctgtgaagattgctgaaataatcacaaaggatttagaatattacataaatttagttgataaagcaatggaagggtatcagaggattgactttaatttttaaagcagttctactgtggataaaatttcatcaaacagaaatcgcacagaaattttcaggaaaagaataatcaatcaatgtgtcaaaccttattgttgttttattttaagaaattgccttaccactctaaccttcagcaatcactcactgatcagtcagcagccatcaacatcaaagcaagatgctccagcagcaaagaaattacaactcactgaagactcagacgatcattagcattttttagtaataaaacaactttaaattaagtaagcaagttaactgaaatggagaatcactacccaggatggaagagggaacctgtgtttacctacagtctctgaaaacgatatgtgtctacatgagcaacaaagcttggaagtttggcttgatccagcagtctataatatctatgtgtacgattttctgtctttgagtgttttgttcnatctattaagcctcctgggccnggttcccaaaggan

SEQ ID NO: 205592 - DNA, 419 bp, Homo sapiens
taaatttggcttgataatactaacagagaatggctatttgcataaatatgttttataaaatggtgttaacttttagtctttgttcaggataatgagacctactagttaaccagaacggggccagcaagcaactcttgaatgctagttttaatgcctgatcaaaattctgtaaagctgtgttgatcactgaggcgttgcggatatactgagcctgcattaagtggatatttaatctaattatttctggaatctttaccagaaaacatgctcttacatagtttgctcctgggtttgctgttggtgaactgccgttggttggtgggatctctgtgtcccatgcgctttgccacacagctggggctctgagtacttcagctcacattcctttgctgttccgctggtgccttaactcacttacc

SEQ ID NO: 205593 - DNA, 612 bp, Homo sapiens
catttacctatcagaatccgcattttcctggatgcctttcatgatgttaaccccctccccacaaactgcattgacattttgctctatttatatctgtcttataattattactgtctgaattgactacctttgttcagttcagtagaccattacttagtacctctgtgttctagaaattattccaggtgctggtattactgaaacatgaggggtttaatctaggtcctgctgctcaccacacagaaagccaatctctgagacgaggattattgccaaggaagaaggctttaattaggtgctgcagcggaggagttgggagctcagtctcaaatccatttccctgaccaactaaaactaggggctaatatagcagggaagaaatgtaacaggtataagaaagcagaaactagggaggggaaaggaagcaatcaggatgaatgaagggtctggcctgtcatgtctggatgcagtgatctggtaagtttcaattcttttgatttttttttttttttttgagaagcctaaaggttgtttcctgaggaaagaactcagataaaacaaatataagtctcaagctttaagaccagaagggtcaatttctatgtttatcca

SEQ ID NO: 205594 - DNA, 617 bp, Homo sapiens
ctcccgtaagaatataggggaagcagctgaagagagctccccggaagctagaattttgttcagggtggtaataattatgcatgaaaatgatagttaactgtaatgatgattgacttctcttgcacctttcttccagagaactccaggtacatccaggtttatctctttgctcttccttgtgccctccttctaaggtgtgagtggggtagagataattcctcttttttgtagagtgatctgcccccaaggtcacagaaggaagagccctcttgggcttttcttagtgtgcaggtgagggaggatggtattcagccagagagatggaccctattgccttcttcatcttattgatttcattacttctgacattctgaggccttgaagattcacaaacgggaacgagaaatggtagtctgtgtggactcctgatttttataggtcagatggtacattttgtacattttaatatgttatattgttcctgtgacaggttaagattattctgcccactttacatatgggtaaactgaggccaaggagtattaaatgatttgtcaaaactcttagcaaattggattaataattagatttcttgatgatttgttctcttgactagc

SEQ ID NO: 205595 - DNA, 240 bp, Homo sapiens
gctctgtctcccaggctggagtgcagtggagtgatctcagctcactgcaacctccgcctcccaggttcaagcaattctcctatctctgcctcccacagtgctgagattacaggcatgagccactgcgtccggccaaccatcctgttctatgtcctgagagctgacctctaggcccacaccactgggctccattgccctctgctttggggttggattcagccaaaaggaggtactggtggg

SEQ ID NO: 205596 - DNA, 121 bp, Homo sapiens
ttattcaatagaaaatctttaaagataaatggactacacactggtagagaaatgagttgttctggctaacacattaatctcttaaacaccaaagtcttcaaacctcttttgatggaaaact

SEQ ID NO: 205597 - DNA, 496 bp, Homo sapiens
cttcaattgttgcctaatgtaacaattgcattggaacaaattcatgttttcaaagcaactgctatagcagaagtgtctgcatcttgtattgttgcaaggtaacaagggagatagggagtggcaggaagtgagttagggtggagttccaggctagggcttccattcacatctccaacatctttttaatactttgtcatttaaaaaggacatcagggctgggcacggtggctcacacctgtaatcccagcactttgggaagccgaggcgggcagatcatgaggtcgggagattgagaccatcctggctaataaggtgaaaccccgtctctactaaacatatgaaaaaaattagccaggcctggtggcacatgcctgtagtcccagctactcttgatactgaggcaggagaatcgcttgaatccgggagacaaaggttgcagtaagctgagatcgcaccactgcactccagcctgggcgacagagtgagactctgtctc

SEQ ID NO: 205598 - DNA, 522 bp, Homo sapiens
cgttttatgtgggcacttagaacacattttctataacatccctttgccacaaataaggcatcagaacatttgttacaaagcaagggtatacaaaatacactatatgattttgtatatccaccaccacctgcatactcaaaatcacagagatagattaaaaaggatatagttcaaaatgttaaagccatatatgctgtgtaggagcactttaccaaattacctttgttgcagtcgctgaagttctcatcacaaagagtaaaaaccatcatgcttccacatagaaataagcaaattgcatcagtgaaatataaccaggaagagaaaaggaattcaacctcccccatcaacactaaaactagtcaataattatctaagtggtatcagttatgttttctgcgcatcctggttggcctctaagtaaagagaaggagccggagagaagggcttgggaatgctacggtttctctatagcagttttatcttaggcggtgtgtgtgaagactagggtgtatgcagcgagta

SEQ ID NO: 205599 - DNA, 400 bp, Homo sapiens
agacagagtcttgctctgttgcccaggctgtagtgcactggtgcgatcttggctcactgcaacctccacctcctggattcaagcaattctcatgcctcggcctcccgagtagctgggattccaagcgtgctccaccatgcccggctaatttttgtatttttagtagagatgaggttttgccattttggccaggctggtctcgaactcctgacctcaggtgatccacttgccttggcctcctaaagtcctgggattacaggtgtgagccaccacatcaggccatgggaaagtaatttttaatttgtatcctctggtcagtggacatttaacgagtatttcctgagtgcctaactctgtgcttagtgttgtaggaagatacgaagattaaaacaaaaacgtg

SEQ ID NO: 205600 - DNA, 436 bp, Homo sapiens
ttttaaaaatttgttatgggtacatagtaggtgtatatatagggtacatgagatattttgtacaagcacacagtgcataatgatcatgttgggtagatgaggtatgcatcacctcaagcatttaccctttgtattacaaacaatgtgattatactcttttagttattttaaaatatacagtaaattattgttgactgtgtagtcaccctgttgtgttatcaaaaactagatcttactcatcctgtctaactctatttttgtaccccataatgtactttctgatgtatgatttcttgagttagttatggatgcagctaacttgacatttacctcactgatgagtagccttgagcaatttttctgcagttcagcaagctaacataataataaaaacaagttttgctgtcattaagttttatcattgagctgttaggag

SEQ ID NO: 205601 - DNA, 374 bp, Homo sapiens
aggagccagccccactccactgccattggtgggatcaacagtcacttagcaattagcaactgtaaaagtaatggtagcaggaaagttggatgtgacaattctattttgtgattgctgaatggtggtatgattttgatggtcaaaaggtgttcttatatgttataattcaatactcatttttatagtgaagtaacttatacgattaatttcatagtttgttcccacctttgctctaccttgatattcaaaaccctctttacaaagataaaaattttctttattttaaaattttctatcaggtctatgagcattaaaaaaaaagtaattctttaaaatggtacaacaacaaatttttccttactaataaatagcat

SEQ ID NO: 205602 - DNA, 222 bp, Homo sapiens
actttcttgtcttgtgtattagctagaacttccagaacaactttgaattgcagtgatgatgggcttgcccttattttgtttctgactctaaagtgaagaatgcctttagtgtctcactgtttcatttgctgttagtatataatggatagcctttatttcattaagaaagtttccttggccaggcgcggtggctcatgcctgtaataccagcattttgggagg

SEQ ID NO: 205603 - DNA, 245 bp, Homo sapiens
tccaccagcttgcccgattgcatcctgttagggggccagggacacagcggaggcttcctagaagcgcagcttcttccgcattcctcagaaagctacagaatgggccaaggagctccccagtgcctgcacagggaacattcctcgaggatgacaatgtcctttgtctgcactgtccctgcagcctttagctacaggtgataagtgagcacgttgaagtgcagctgctgcgaccgagaaactgaatt

SEQ ID NO: 205604 - DNA, 361 bp, Homo sapiens
ccagagatgacttaaagttgcaatggtcacagtgaggatatttaaatctagaaaaaattgttcatttaagggatgtattgggaaaaaatgagatcccaaatgtctcagaaacaatgataaataattttgattggtatgtaaaggtttctaaaagaatgatttaaaaaaatagtctctctaagtaaatctttacaatgtgctaataagaaagtattctaaacctattaacctctttgattgcttgctttttccatctgaacctactcaatgctaacctccttaaaaaattagatcctcaaatgagccaggagtatctacaacaactaaatttaactcttgttattgcacacatgaactatta

SEQ ID NO: 205605 - DNA, 651 bp, Homo sapiens
cttggtgtccacaaccccttatcataacccagaccttcctttctattgattccaggtctctagataataactctttcaaccaattgccaatcagaaaatctttgaatctgcctatgtcctggatgaccccccttttccagttgtcccacctttctagactgaaccaatgtacatcttacatgtattgattgatgtcttatgtctccctagaatgggtaaaaccaagcagtaccttgggccaccgaggtaccttgggccagtacctggccaccttgggcacatgttctcaggatctcctgggcctatgtcacagcccattggtcactcatatttgggtcagaataaatctcttgaagtatttcacagagtttaactctttttgtcaacataatatttaacaaacataaagtttgttaaataaataagtcattttggaaagaggtcccaaataagaaactaacagcatggtagaattcacattcatatgaatataaaaatgtacatattatcgttaatgatatcatgctgaattcatgtctgattcataattttgtatgaaaaggactcatgtttgacttattcaccactgtatcccaacatgtagcaaagccttacgcacagcagttaataaatatttcttgaatgtaaaaa

SEQ ID NO: 205606 - DNA, 345 bp, Homo sapiens
tcactgattcccatcctaccctccagtcatttgcctaactgacttttttttttccaggaaacctcagagatgcattggacttggtcagcagacttgagttctatgcccatgccagtcactgactggccatgacctgagttggacaaatcatgcccactctagacttaagttgttccttatatggaaaaggaaaggagtgctttgtcagtggttcccagataccaatttataaagatttcactagtctgtggcaaaataatataacaatggctatgaattactgggtatttcctttgtgtgaagtggttttcatatattaactcatttaatctcataaccacctgg

SEQ ID NO: 205607 - DNA, 333 bp, Homo sapiens
tttcctcatactataccggagtcaccagaactggtatctaaacgtgcagtctgattctgtgctatttgggtcagtgggttttgacttacggccattcatttaacttatttttgagactcgcacccctagactcttaaattgagattaaaaaatacaattccgttgagaagctttaacctcacattggaaccatcatcttgttctctacctagcattcctcaaattcttaggaagaaaatactgaaagtgtgttctgtttcctcccttttaaaataactcttgggaaggcttttagacatttaacacaaaatctcttcatacgttaagaggcga

SEQ ID NO: 205608 - DNA, 470 bp, Homo sapiens
aggatccccatgccaataacctccagaggagctgggtttgaaaagatgaggcagggtccctatggtggagggtatagaggctatgatgactatcgtggctgtaatgatggatatggctttaggtctgatagatttggaaaagaccgcaattactgtttttcaggaatgtctgatcatagatacggagatagtgggtccagtttccagagcaccacagggcactgtgtacacacgaggggtttaccttacagagccactaagaatgttataatttctattcacctcttaacctcatgagagtacatattgaaattggacacgatgacagagtttactggtagggcagatgttgagtttgctgctcacgaagatgcagtggcagctatggcaaaagacaaagctaatatgcagcacaggtacagggagacctttttaaatgctataggaacaagtagggaggttattggcat

SEQ ID NO: 205609 - DNA, 288 bp, Homo sapiens
tgcataatacacattttctcatacttttactttcaaactgttcatatcattacatagacagcatatagttgagttatggttgttattccattctgccaatatttgtctttagtatatttagaccatttcatttaatgtaatcattgatatggtagtgtttatgtttgtcttttttgttgttatagttttcagtttgttttttctctatcttctttctttttgccatggattatttgaactacattttccactagaactctcatacatctcctgtatgataattccaac

SEQ ID NO: 205610 - DNA, 427 bp, Homo sapiens
ttagcctccacatccgtatttaagacataaagtgtcagagtatgcagagaaaacaaaaattaagatctatgtatttccatgatagtactctataattatgtcagcttcatgtacatgtgaccaccaaatatgtactttataatataattatagttcaagcaaaacaaactactcaggcaacagagtgtctagtacacatatacatttaatattaacataagcatacttggataaaataatgaaaacgtatgaactaggaagatgatctattatgactaaatttatctgataggtttatgattcataatttaactttcttttttccttttctttcagcatagaaatagatgaagaatgttttagagacagctgatgaaatttcagatatcagtgatgtgaaactaaaaaaaaaattcatcattaaatt

SEQ ID NO: 205611 - DNA, 255 bp, Homo sapiens
ctcaggcatctctggatgtccaaaaataacccccacccccacccgcaccctccccggcagtcactgggggtatttctggcagatggaaggggactcacagtgggagggagggtcatttctctgaatccagggccaggggtggggagggacagagtcaaggccctgccttggcttggagctttaaaaacactcatttcttctggaacgcagcctctccccagtaaatccttctcaccagagaaaaccatagtcaaa

SEQ ID NO: 205612 - DNA, 311 bp, Homo sapiens
attgtaatccccattatgccatctaattgtcaggttttaattgatagatcccatttttgagaaagaagcaggtcaatgtcagggtaaatagtaatagctaacttctacagcactctaatccattaagaggtcttctctctagattggacttcattctgggtcctgttgaagctaatttgaaaatcatgagccatttgtctgttttggctatgctggcatgatcctcttcttacttccttttcactccttcacccacagagtttctggaaagtaacataagcttgatgggttctcgtacttggcagtaatgg

SEQ ID NO: 205613 - DNA, 159 bp, Homo sapiens
caaacttgcatagtcaatgtcactccccaaaaattctatattgggggtccctaacctccaggccatagacctgtaccagtccatggcctggcaggaagcaggccacacaggtggtcagcagcaggagagggagtgttagggcctgagctccacctcctg

SEQ ID NO: 205614 - DNA, 731 bp, Homo sapiens
tttccctttgtctgtatacttacaaggtggaatatgatcttttagctttgttgaaatctgattttgttggcaagaatctttctgtattaaaactgctatggctttcgtgtctcagtatgttcagtggttatgtcaaaagttaaataagggaggctgaggcaggaggatcacttgagccaggcagttgaaggctacagtgatgagctatgattgcaccactgcactccagcctgagtgacagagtaagaccctggcctattctctttcttttataagactttccttctactttctctgttcctgccttctggaattcctgttaagtaggtgttggaatgctagaagttctctaacaaattttttctcttttctcttttatttttcatttccttggcatgttattctacttttagtgaaatttccttcactttgtatgccagttcttctatagaattttctgtttcggacactatttctaatatctctttcttgttctctaaatatttttttctgtagcatcttggtcttatgatacatattgagcattttgtcctctaagcaaattgcctacattttttgtttgttttaatcttcatctttcatgttagagcacttcctcatcagtttattcatatttaagactgaagcactgcaaagctgattgaaagctcttatgtgaaaaggaagaccttgttggactgatgggcctcatttagggagccggtgtttgg

SEQ ID NO: 205615 - DNA, 414 bp, Homo sapiens
gagatgacctacagctacatagtcagcaaaagacagagtgtcaaaagacagaggggaaaagccatacaaactgtgaagagagatttcaagaagcagagagtaagaggggggaaaggagaggcagaacaagaggaagtgcagtcaaagttaagatgaagacagacaactatcaccatcaacccatgccactggcaaaagcaaggtgcagaactcaaatatatttgaagctatcagcaccaaactggtggacagcacctcagccaatttattcttatcttcctttaccactatgacaaatctttaacatgttttcccttgggggagaagggggcagggcagagaaagaagggctatggagaattagagagatgagtttattattcctggtcccaatactgcctttctcaaaaagca

SEQ ID NO: 205616 - DNA, 204 bp, Homo sapiens
tacatccagaactatgagggcagagacagaactgtgagggaagggaaaataggaaggaaaagacatttacaaataatcagacttacttcccattgcagggataactcagtgactactgagaagagactaggaaggtggcactttattctccttacctctttgcaccaagagataatccggaagtattttcatgccaactaatta

SEQ ID NO: 205617 - DNA, 339 bp, Homo sapiens
gaagcagaagacttagaggacctgccagagcccaacccactgccaagtgagtttggagtgttgggttggttttgtttttaatgacaggagggatctaaatatgttcatgaaaaggagggaaagaaccagaagagagggaaggatggaagaggcagtgggaggaaaaagacctggtccaggggcaagtccggaccaaagccactggcaaaagcagatttctgtcaacatctctccactcccgagtccctcccaagcctcacccccgacaccccaccaaaggcaaagccaactggcctactctccacagagctgcccccaccccaaaccggaggcaggacc

SEQ ID NO: 205618 - DNA, 569 bp, Homo sapiens
gaaagaggcaaatccatagagacagaaaatagattcgtggctgccaagagctagggaaatgggggatggaaagtagtagctagagggtacagggtttctttgaagatgatgcaaatattctaaaactgactgtggtcacagttgcacaactgtaaatgtcctcaaaaccacctaactgcacacttaaaatgggtgaattgtatgtcatgtgaattctgtctcactaaagttgttatgagtaaagattaaacagctataattgtagggaacaatcaagaattgcttttctttttaaatatcctatgaatctaactcttaattcattaaagccgtatgtgtccctattagtgaaagacaatagagcagtttaccactgggacagaaaatacccagaggatgttagaaatgaaggcagaaatagacacgaggacttctgctggcttttaacatctctgagtgggcgtgaaggatgcttcaagttcttcataatgggtacctggttaatggccactctttgtacaggtagaaaaaggcaatgaggaagaaggtgctaagtgacagctaatatt

SEQ ID NO: 205619 - DNA, 303 bp, Homo sapiens
ggagaagcagatccctataggtagccaggacacagtctgaaaatcactaaaccacagcctacacaccatttgagaagttcaaaactagattttgttcttcctttccttctatctctttcttctctttatgcccattactgaactctccaatgtcctctcaaatataaaattcccagttagatcccaaattcacatacaagtaatctaagaaacacattctaatgcaggatcctttttacaacctatctctacaaacatctggacaccttttccataaggcaacttggcaatatgcatcaagag

SEQ ID NO: 205620 - DNA, 496 bp, Homo sapiens
aagacaaggcataggttttttgtttgtttgttttgtgacagagtctcgctctgtcgcccaggctagaatgcagtggtgtgatctcggctcactgcaacttccgctcccgggttcaagcgattctcctgcctcagcctcccaagtagctgggattacaggcatgcgccaccacacccggctaattttttctatttttagtagagaccgggtttcaccatgttggtcaggctggtctcgaactcctgacctcaagtaatccaaccgcgtcggcctcctgaagtgctgggaggacaggcaggagccactgcacctggcgacaaattgtaggttttgagatgaagactcagccagtttgccacacactggataagagacccagagaggcatccaggaagccagggaagttccctcaccacccacccaagctgttagctgcagtgacgggaaagtgtgaggtggggaggcaagagatgcagaaatgacaggaggtgacagt

SEQ ID NO: 205621 - DNA, 458 bp, Homo sapiens
ggtaaaatagttgggttcaaatgttttttcaagtatatttcctttagaacaagttcctcctctcctgccccaaataattaactatacaactgttctcccaaagcaatggaaaagatctcattttgacaaagcaagctgtttatgacaaattttccaactagaaatttgcagaagaaaagttctcaaatgatgaagaagcttaatcaggcaaaaagacatttttatttgcagaaataggccctttagagggaggcaattatttatagctgataggaaaaactggtatacctgaattcgtttggtaaacttcatttaaaataggaaggttattcttgttattctagtgaaagaaaaaaaatatggtactgaattatgttacagatttatattaaagaaacaaagttttatacattaaaccactcttacagggatatatactgatttaactaaagaaaatg

SEQ ID NO: 205622 - DNA, 495 bp, Homo sapiens
atcagaaaggcctggccacctgctctgcccacaccctggagaggacaggggcaccttggggtcttctgtgggcagatgccacatggaagccattggagaggccactgcaggtcatatgggaggttcaggccaccagatgtggtctccacagggccaggatccaggtgctgcagagacaggggcggcttcctgcaggtcctagagctgggagctagagccacctccccagccatctgccagcccctcccaccactctgtctgccaagctgccccaaattttgcctgcagcaaagccctgcatttggtcccaggacagccctggacaagctccacccacagtggcctcagcacctcagcctcacccattgctgtggggcagcggcttcctccagaaatacacaaaggacagaaagccccgtggccctgagctgggcccgcctcctccacgagcgcccacttgtgcggctccacatccttcacccactgagcggccgc

SEQ ID NO: 205623 - DNA, 170 bp, Homo sapiens
acagtggccacctagatgtggtttttagctgtttgttaccttcaagattctgtgccttgtgtggagagaagacaacttcttcaacatgctaacaagttagaaatacaggtcacataaaaatacaggaaacatcttgtgtttttatgataagattgttgatgaggcagtga

SEQ ID NO: 205624 - DNA, 495 bp, Homo sapiens
ctgtgtggtcaaattaggtcaaattaggaaaaataattcctctaccttttaaattttagttcactaagttttgatgactttattttattgtggtgacgttcttatctcatctgcctgaatttgttttcccagatttaggtattggaacatgaacagaacatttttactggaaaacttggattttttatgttaccatgtggggatatatatattaagcacattctatcagttttttggaggcattgggacttctgcacaacttttttattactcagtatgttgtttaaactaattttgaccttgtttatttcccctaattgaagagtgaagttaatatgttgtgggctgtttttttttttctttgccattttcaaattattaatttcagagcaagttggttacggagtatattttagtcataaattctttgtaattattttttaaaagaagtctttattcatgaccaataataaagcagaaataattaaacttgag

SEQ ID NO: 205625 - DNA, 497 bp, Homo sapiens
aataagtagtcattggtattagggtcacatctcctttctccttcacactgatttacctcatttcattgtgtttatctcacaccattttgtaaattatcccatgttagctattgttattctcaaattccacgcatatgaagaaaaacagtaattagaaaataatagcaatatccataattatgggagctactatttactgaggggttactatccagcaggtgtatcacatttttcccataatttattccatctgtccttagccaaaatgaatgtttaactttgctggtcacatacaagttttgtcgcatattcttcttcctctttttctttatttccctctctctcttcttcattttcatctcgcaaccctttaaaaatgtaaaaatcattcttaagtagcaagccatacaaaaacaaatcgtggactagaagtaaacaatgcattatcttaattttgaacatgagattaaaactgaagcctaaggaatcatctaata

SEQ ID NO: 205626 - DNA, 301 bp, Homo sapiens
actgatccgcttaagtgagagacaggcaagagtcaagactatgcagacaattaattaactgtcttaattcaataagatttcttagaggcatcagtggtgttctggagcatgtgatcacttcttgtttttaaagataatgcaccatattcccatttgagaaaaaattcaccatattatataaatggggttaaggttctgcatcaggtttttgtactgctgctggttttaagactcaggctgctgagtgcccagcctttgcaagaatccacttcaggaataatgacatcatgccttaagcgct

SEQ ID NO: 205627 - DNA, 449 bp, Homo sapiens
cggtttttttaaatgtgcataaaaggaagatctgttggaagaatagattaacagaggcaggaatacaaataaagccagggctctgctgaatacctttgagactcggcgtggccaaagctaagctaagaggaagcctattgtgcaaatgaactggaaaacagtatttgccttggagaaatcggaggcttttcatagttactgggggaagtaactgggaatgtttttactgcccaagcaactatttttcaaatagttctattgtaatgttgtatagaagaaagcttttattttggataggcaatgggaattataagtttaaaggccgaggataatctctggaatgacgtattttagttatctctgtgtgatgtaaacaggtctttggaaaaagagtagagttgactgtgatctttcactcttgtcaataaataaagttgataaataaaata

SEQ ID NO: 205628 - DNA, 421 bp, Homo sapiens
ccaatatagagaaagtgaggaagtatgaaaacattcatgtaatcagcagtgtcagaagaatcaatcctgaaaacaaaataaagaaaaagatggttcagcaagaaaactttcatatgtggtttgaaaagccactttaagaaaaatcatgtcccaagtcccaggaattgtttacaaaataaataatgcctccatccttttagccattattctttttaacaaagtttttcattttttatcttgtcaatgtgcaaacaggaaatgatgatactagacaatgttgctcattggtcttccatatcagttcatccttccataagtattttccgtaaaacacaatgcctaaaactgcacacgagactacagatgttatcttatcagggccaagaacagtgcaatttctgactttcttatttttagtttt

SEQ ID NO: 205629 - DNA, 725 bp, Homo sapiens
aagttgcagtgaagatgttggccaaggatgcctttatctgaaggcttgactggaactgatgggtctgcttctggaggctcatgcacatgtcgttcattgttttcaggaggtctcagttcctcctcaataagctacttgaatatcttcacaacatagcaactactttccccagagaaaatgctcaaagagagagcaaggtggagccacagtgtcttttctgaccttgcctccagagtaactcactgtcatttctacaatattctactgtttgcacaaatcagccccaattgatgttgtcactgacacaagagatgcatatcaggaggcaaggatcattgggaccatttgctagctatcacagagagccaaatagaaaagaggttagcttacaaatagattttaattactaaattatggcatgattgcaaatggcaattcagccagggaaagtaatgattttttaggctagtaacatcagtcaaagagcacgcatggtacttctaagaggggaaaggtaacataaatgatatgctaggtattattagaatgccgattttatttattacactacctttgtacctcctgataggacacatgaggtggaataagggggacagttccatgtgctgctaattagattactacaactggaatgaagactgttgagttaaggaaaacatgaggttggcgagctttaacttcttgccaaggccaaggcagccttg

SEQ ID NO: 205630 - DNA, 411 bp, Homo sapiens
agtatttgttattttcctgaaataaatttaatttttagagatttggctggtaagtgtatgtatgtatgaggaaggaggatttttaaagtgtaattttcttaaaaatgtaagtaaacttttaatgctgactccctccacattagagtataatagcttaaatttttgtttaggtgcattacttttatagcactttagagaagtgctgtagaagactttggtcctttagtttttgctgttttatgtttttatagtaatttcaaatataaagctattagaaatttggcttgatttttaaaacaattttatttcgaagaaactgcatgatataagtaaatgttgaagaaaatgttggttggattgattaatgttatgatgtatacgatttggataaatttagactttaccagaaat

SEQ ID NO: 205631 - DNA, 276 bp, Homo sapiens
tggtcgctgtgctccaggacactggtcttcctgctgttacacaaacactaaagtgttttttcaaaaatacatgggcatggccaagaagattgaacttgcattcagagaaatcagatgtgggctcctccattcatcggggttaacagcattcccatacaaaatagcacctcgcataaatacgctcagagaggtgggacatgagcaattctttccaatcagcagtaacaaatttttcaaagactccctatttttttcttgagtagctaaataagcaaa

SEQ ID NO: 205632 - DNA, 517 bp, Homo sapiens
agtgcacagattctctatctgcaccacatggctgctactggggaatggtggaggggtggtgttggtgattcacggttgtcttttctaccctcttcagcaccagcactgtgaccattcatctgatttttggttcttatgaaggtgcttttttgttcttatgaaggtgcttttttgtgtagatagttattaaatttggtattcctgttgggaggacgatggcttctgtttggctgtcttgctctgcctccccaggatatgtttttatggctgaaaagagccaggtagcaaacatggacactcacttataatcaaaggcaatgtgagctaatatggaaaaagaacttagctgtatagataaataacttttactgtgatacatgaaataagaaaatgggacagagtattatcatggtttaaaagtagacagatgggtgggattcttccctattatgagagctacatttcaatcttttccctgtaattagttgatgattaaataacatatcgatctttcaca

SEQ ID NO: 205633 - DNA, 355 bp, Homo sapiens
ttggcatcgggatgtggagcaagaaatgcttttgttttcattcatcctagtgttcataaaatggaaaacaaataaggacatacaaaaacattaataaaataaattaatggaactagatttttcagaaagcacaacaaacacaaaatccaagtattgccatgtcagcaacacattcctactttaagttttatgaagttaattggagtagtggagaacaaaagtggatgtggggcagatctgcgtcctgcatgtgtcttgcagccagactgttccagctgttgcagacctcaaaatagagaggacccaggttttctgattttgccttcttttttttttttttaaatttattattgtt

SEQ ID NO: 205634 - DNA, 471 bp, Homo sapiens
agaaatagctggttatttctaagccttagaaggcataactataaatatttttcacaaaggaaccatatacaagggaaagaattcagccaactcttgtggatgggtgaggtcactaactagcttggctaccctcttttgagaaacactttagtacttttggggtgtggtcaataaaaaaaagaacttaactgagatcagaagattgaacaagggtgatttcttaaagatttttctccttccttctttggtgccaactttttaaacacgcgttacaattaagttgtaattgcttatttcccatgtctgaacaaggcaggtggttccctaatattgcatattaatcctaattcaatttattgccttacaagtaaaatttggccctaaaatgaggatggcaagtaaaaattcaaagttgatcactaatgttatttttaattattgctttaatattattaaaaattaaattccaaa

SEQ ID NO: 205635 - DNA, 341 bp, Homo sapiens
agagccaccagatagaagtgaggtctggctgacatcttgatttccgcctgtaagactctgagcagagaatcgccatgctgtgcctgtacttccgacctacagaaccatgaggtaatcaatttgtgttttaagctaataaatttgtggtaatttgctatgcagcaataaaaaatgaatacttttgtatttggctttttaaaaaaatggcaatcatttttatttggagagagctgtcttactaaacacgcaggacttcaggtggatattatcaggctcacttagtgtttgtaataaaatgaacttttttccccaattaaataaaagcattgtttttgaaatta

SEQ ID NO: 205636 - DNA, 455 bp, Homo sapiens
cctgccaatatcccaggcatcctttaagacacatttcaggtcagcttggagcagcttcccttgctccctcggcctgggccatcagggtcctggtggcactttgcacatcacccccattcattcagcacctgccagcaccaaggacttacagctatgaacaggacctagtgggtctctaccctcaaggaccttacactctagacagggaagacaaagagataaaccagaaaagggccagacagtggtaagagctgtgcagagaaaagagggtgactggggctactgtggactaggtggtcagatcagggaaagactcaagggcagggcatccaagacttcaatgaggagatggagtcagtcatgcccagatctgagcgaagagcattccaggagagggagcagctcctggaaaggccccgaggtgtgaacagagctggtgtgttccaggaacagca

SEQ ID NO: 205637 - DNA, 321 bp, Homo sapiens
agaaaagcataaaaaaaaacattgaactttatcaaaagtaaaaacttttgctctttaaacaacactgttacaaatatttaaaggcaagccacagcctgggagaaaatattgtgaaacatctacaacaaaggtcttgtactttactgttgtactttactaagtcaataaaaagtcaaaacaaagtcaatacaagacaaaggtcttgtaccttactattcagtaataagtagacaaagggccagctaaaaataaacaaagatatgtatagacacttcaccaaagtagacatacacatggcacgcgacatcgccaaaagattct

SEQ ID NO: 205638 - DNA, 281 bp, Homo sapiens
gtgtgctttttttctccaggaagcatacttttctttgccatcttcagtgatgagagtaacagagacagaaagataaaaggagttgactgctcacgaggctgttgctggactttttaggacagtcactggaagattctagtgtgtcttctgaattgctgaccataattcattctcttccctcttttgcctggtttgttatttgatccaagactgtgctataagttttgggttgataaaagagagctaagagtccatgaagcgctcacacctcccgtcgaata

SEQ ID NO: 205639 - DNA, 429 bp, Homo sapiens
attggtcttcacctggatattagaggctttaaaaaaattacagatgttacagatggaaagcaccacagtttatctcatcacacagatgagaacattgagggattctgacgtttttttcatagaacaagaactagaaaccaggcttccagttattattccatgcctttgaaccacatgctaatgaaaaggcagccttacacataattccaagtgttaaagcttcaaatagaacttggatttaagtaataaaacctattatctgacactataagcacgaaaagaactgaaaaagcaaaaagataaaatttaatacaatctctcacttatagattaagaaatgaagttcaaaggggtgaagcaatttgcttgtttgcatgtttcaaagacatctctactgatactctgtttaatttggattattaattatgc

SEQ ID NO: 205640 - DNA, 577 bp, Homo sapiens
gttctctgcttaaggcagagaatcttaatcaccaatcagatattacctgacctgcttttcagctctctgacaaagatgtgtgtgaattacagagtggatatttttgtttttttttcacattttgtcccatttgtttcttctttctctctgactcaattcccctcattataaaaaattttgattgatacttaataattgtacatatttatggggtacagtgtgatgttttgatacatgtatacattgtgtaaagaacaaatcagggtaattagcacatccctcaccttaaacatttatttctttgtgaacatttgaatagctctcttctagctgttctgaaatatatcatgcattattgttaactctagttattctactgtgcattaaaactccagaacttattctttctatcttactgtagctttataccaattgactaaccttccccctgcctccctatcttctggtaaccactattctactctgtacttctgtgagaacaacttttaagattccacacatgagtgagatcatacagtatttgcctttctgtgcctggcttatttcacttaatgta

SEQ ID NO: 205641 - DNA, 256 bp, Homo sapiens
cctaatccatttgtctgtctgtggctgaaaaaggattatgtccttttgtactgagtgtgtctctgatatgcaagaaatgattggatattttaatctatttaggtttaattggggctgaaaactttaagaccgtctactaggctgtgttattaggctaggcttttccattatctaaacactccctacctctaccacctgtcagtaattacctttttttttttttttttttttgagatgggggtcttactatactatg

SEQ ID NO: 205642 - DNA, 571 bp, Homo sapiens
aaggcagttattacatgactcagaaatggcaaaaacacaaagagaacagaaacgccccatagcgggagggatgactaaaagacatgtcttgataagatattggttcaggcataggcccaggcacagtggctcatgcctgtgatcctagaactttaggaggctgaggtaggtggatcacctgaggttaggaggcggacgttgcagtgagcctggatcgtgccactgcactccaagcctggggcaaacagagtaagactccatctcaaacaaataaataagaaataaagaagcagcatgtcgagtgtggtgctatgtagaggtgtcgggggtgattggcatccagcatccggaagcaaggtggggtagggtgcagaggtgactgacagcagaggctactgggagcagatgggaagctggttatggagctaataaagtaaattgattgagcaaataagtaaacatatggattgtaacacaagccaggcttggcactttggagaaggtgcttacaaacttggacgagacagtacccagacacatagctgaaacctgtaggtactggcaggcaaac

SEQ ID NO: 205643 - DNA, 560 bp, Homo sapiens
cacacacacgcataaatttatttaaaaacatacaagcacctctgtaacttgggatctggcattcagtgctgcctcagtggggtgcataaccctcaacatccattctcatgattgatgccatgcaggctccagggaacgcttcttctcatctttagctcagtgccctaaaaacaaaaggttacagcctctcagtgccatgaaggatggtgacactgctgatgtttgagactaacattatgttaaatccaagaaaacctagattttcttttaaaggtcagcttgtcaaatccttcttctcagacagcatgaatgcagtgactcctgcattacaacgtactgtttcccaaggatgtgaatcgtccattttcttgcttctgtcagtgttccagtttgtggttccagatgtactcaagaattagcatggctttgcaacagttacacatgacacttaaggagtggcagtaattcttattactctaaaatttctatttataaaagttgaaaatcctgtatggatttagatattcttataagggatggtacaatttacaaaataagta

SEQ ID NO: 205644 - DNA, 794 bp, Homo sapiens
accttgggcagtatggccattttgacgatattgcttcttcctttccatgagcatggaatgttcttccatttgtttgtatcctcttttatttcgttgagcagtggtttgtagttctccttgaaggggttcttcacatcccttgtaagttggattcctaggtattttattctctttgaagcagttgtgaataggaggtcactcatgatttggctctctgtttgtctgttagtggtgtataagaatgcttgtgatttttgcacattgattttgtatcctcagactttgctgacgttgcttatcagcttaaggagatttgggctgagacaatggggttttctagatatatgatcatgtcatctgcaaacagggacaatttgacttcctcttttcctaattgaatactctttatttccttctcctgcctgattgccctggccagaacttccaacactatgttgaataggagtggtgagagagggcatccctgtcttgtgtgtaaaggaatttaaagacagcctactccttctccccttctctgccccgtttatagatgaagaagtgaatggccaaaagggttaatggcttgcttagctggacagtggccatgcttgtcccagagcataggtgctccatcgcctgagcgccattccctgggctagtctgttgttagtttcaacatgtgtcataaaaaattcattggtggtttatttttagggtaatcttcttttttcctctgtctctttctttgtgtagtttctgtatctaaacttttttaatggcatcttcaaatagga

SEQ ID NO: 205645 - DNA, 704 bp, Homo sapiens
tgcttttcttcaaaggatgggttggagcgttaaaaaatgttggtgggtttgggctcgcaggaggcggcgcgcggagggcgagggcgcttttgctgagctgtgcagttcggtccgctgagcccggcggccctgcccgcccgctcgtccgcccgcggtcgctagtgttgccgccgccgccgccgccgccgccgctgctgctccatggccgcgcccgccccgcgcccccgccgcgtcccgtcgccgcccgcccgcgtccccggtgagcgctggagtggggtcgggcccgtgtgcctgcctcccgcgccctctccgaatcccggactcctagtgaaaggaagggggagggcgcgggcgcggaagggaggtggatcggagcggcagcgcggcccagccgaacgggtaccgaccgtcaccccgcgatcttcctcgcagggggcgccggcgcccaagctgctcgcccggagggcccagagccgcttcccagaccagagccgggggaggcgcagccagtagcgagccctgagcgacctctctccccactcgcccccctgccccagtgaatttctgtcagttgaagggagcggggctcttgcccggggaaaaggaaaacagttcgtggcctgggatctgggaccccttgccgcccccagcgcccctcccgctccccggcgcccttgcggcccagtggctcctgcgcgccggag

SEQ ID NO: 205646 - DNA, 601 bp, Homo sapiens
tccctgtgtggaggagggagtggggacaaaaattcactgcttttggggacagaaatgtttaaaactttacccttatgaacttggacaaaggaaagatgtggacgtctgttttgttatttgagcttaaagaagtgatttagattagcctagcaatgagcatcttgtgacctcacccaggatgtcagttcctgcaggtgtaaaacttgtgccattccaggcctcagctggacacacgatgggggccggggagtggagttgaggccagtggctgctcccaggggatcagtgagcaggtttgtttctttcccgtgttaatcctgggagaccaaaccttgatttcagctatattttccctctacctttaccagataaccttacctttaccttacataacagccactttttatatttgtgaagtaactcccccacaactttttttttctgaaagtaaaacaacttggtgacattggcttttattcttatcgggccccatatagatagtggcttattttacagcagtatttgtttacatccctacaggtaggacagtgtttcttttcacatggctgaaaacttttttttttaaagcaagaatcttacc

SEQ ID NO: 205647 - DNA, 515 bp, Homo sapiens
actctgagtaaagcatacattgctcccactcatttgttcccaaacctgtgctagctgaacttactactggattatacaacgtaaccaaatattgtgtaaataaatggtaaaatctgagggcaaaaagaaaggatgtctgtttctctggaaacaaaattaaatgcttttaaaagactcagtagtacaaagtcactaaaaaacactgtaattgaattaggcatatcatgaagcaattaagaataaaaaactagggaacactacaaaaatctagaagtagtctctgctcatgttcttttgcaaggttctttatcactccactttaaaaaaaaaaaaaaagtaaccagggctgggcgcagtggctcacacctgtaatcccagcactttgaggccgaggcgggtggatcacgaggtcaagaaatcgagaccatcctggccaacatggagaaactgcatctctaccaaaaatacaaaaattaggtgggcgtggtggtgcacacctgtagtcccagctactc

SEQ ID NO: 205648 - DNA, 810 bp, Homo sapiens
aactgggctgaagtgatgcttccaccttggtctcccaaagcactggggttacaggtgtgagccacacacttggctgacactttttttttttgggagtcagagtcttactctgtcacccaggctggagtgcagtggtgcagtctcggctccaacttcagctcccaggctgaatgtgatcctcccacctcagcctcccgagaggctgggactataggcatgtgccaccacacctggctaagtttcatagtcttagtagagacagggtttccccatgttgcccaggctggtctcgaactcctgacctcaagtgatccttccaacttggcctcccaaagtgctgggattataggcatgagctactgcacctggactgcctctgactttttgaacagataagactgattgtctcacagaatgacactatctggatttgtctgaacatttccttatggtgtcttttaatttgctcttctatccgttatattttctataaagtgggaattaggtctaaaggcttgattagactgcgagtaaacatttttggggaagaataatttgtaagtgatactgtgttcttcatattgcaggttatcatgtggaacatgatggcagttgtatcactctgtgatgctgaatttgatgatttgattcaagtggagaccaccaatgtcttcatcataagggaaatatttcactttgcagattaccatgtaatctgagggatttggcagttgaccaatagctttttctccagcacacccattgatgattagggcacttacagttattttattgggccctgcaaaatgg

SEQ ID NO: 205649 - DNA, 428 bp, Homo sapiens
gggcactgaaatgaaagcaaacagtggaagaaggattggtatcatatagaaacattttcagagaaatgataaagtaacaaagtcaaatagaaattatgatgtatttctgtaaagccacactgtgtgtacctgtctttcctgtagaaattatgatgtgtttctgtaaagccacactgtgtgtacctgcctttcctgtctttctttttacctcctccactgcctctgcctctactaccctagagaaagcaagaacagtgcctccccttcctcctcctctacctgttcaatgtgaagagatgaggatgatgaaaagcgttatgatgacccacttccacttaatgaatagtaaacacatttccttgtgattttctaaatgtcattttctcctgcttattttatagaaagaatacagtttataatacatacag

SEQ ID NO: 205650 - DNA, 398 bp, Homo sapiens
  misc_feature (347)..(347): n is a, c, g, or t
aagacagaggtcacccttggtgaggggagtgaccaggtggggacatgagaagggcaacgattctcgaaatgtgggccagggacccctgagggtccctgagaccattcagaggggtctgagagatcaaactatttttatcgtaacattaagatgttattttcccctttctgctctcatgcgtctaagaacattcactggagttctccagaggctccaggacatgtgaggacaccatcagactgacagctgatggaatgtgtacgtgtgtactcttgtgttttaaaaatatctctgtatttttgttgtgtttttgagacagtgtctcactctatcacccaggctgcttncactcagcattacatttttgagataccggcacggctctctggatcattcac

SEQ ID NO: 205651 - DNA, 151 bp, Homo sapiens
gttatttttagaattttgtgcagtttgttattgagggagtgtcagtctggtaagagcatacctggccatatgagaatcacaactccctcttcatttgtttaacttctctcagcaaggtttcagcattttaagcagaggtcattgtgtgtgt

SEQ ID NO: 205652 - DNA, 346 bp, Homo sapiens
tgggtttcgttaactctttgaatgaaatatacatatacttacttgttcaccatattttaaaaacattttaaagtagaggagtggcaaaagcagtacagttaaaataattttagacttacagaggaatggcaaaggcagtacagagattttctgtaagcccttcactcacccgccttccgctaacgtgaactcacataaccacgctacggtccccagagctgagaaacggacgttgtcgtgggactaactaaacgacggactttccttgaatctcaccagtgttttctctactgtcctttttctgttccagaacactctattaaatgtagctgtgtctccacagtcg

SEQ ID NO: 205653 - DNA, 574 bp, Homo sapiens
aaagaaaggaagcaattaaatttctgtaagagtcacagacaaccctctttagaacaaagtaaagtccataagaatgagtttccatatctctaaaactccacatagcttatttaatactgcacagaaggcgggttattgatctgtgtgtagagttgttggcagagagggagagtagtatattccaggagcttctctcagtctgcagcattactctaagcaggaaaagacccatgattccctgtagtgtcttcagctgcctctattaatccattgtcaaaatcatggcaacaggacacaaggcaaatagcagttttgtatcatcttgcttatgaatatgatcatgagtaagtgctagtagtctccccttatgcaactgggttttataagcaatagaccagatgtatatgcccttacattataaatgtacctttaaaagtctgatgtctaaatcatgataaggaatcatttccaatgtataaaacttaaaatttccagaacagagagcaatatttatttctaccagctttctctccattaaataattgtttcaatatcaggatgtgattggagcttg

SEQ ID NO: 205654 - DNA, 573 bp, Homo sapiens
gtgaaaggcatatcttatgtggtagcagacaagagacaatgcaagagccaagcaaaaagggaaactccttataaaatcatcagatctcatgagacttattcactaccatgagaacagtatgggggaaactgcccccatgattcaattatttcccactgggtccctcccacaacacatgagaattatgagagctacaatgcaagatgagatttgggtagagacacagccaaaccatatcatcccatcccagcccctcccaaatctcatgtgctcacatttcaaaaccaatcatgcctttccaacagttcccctaaagtcttaactcatttcagcattaactaaaaagtccacagtccaaactcttatctgagacaaggcaagtcccttctgcctatgagcctgtaaaatcaaaagcaaattagttacttactagatataatgggggtagaggcagtagataagtacagccattccaaatggaagaaattggccaaaatgaaggggctacaaccaccatgcaggcccaaaattcaatcgggtagtcattaaaccttaaagctcctttgcctccat

SEQ ID NO: 205655 - DNA, 463 bp, Homo sapiens
ggactcctagtgcagtgctctgtccaccatatcacaggccaagaaacaagactactggccatagttgctccttgccagggagagttctcccagaaaggggtaaggaggggaaggggtttattggggagctgctgcttttttagagtctttttttttagaaatgtatgtagtaggccgggcgcagtggctcacacctgtaatcccagcactttgggaggccaaggtgagtggatcacctgaggtcaggagtcgagaccagcctggccaacaaggtgaaacctcatctctattaaaaatacaaaaactagctgggcatggtggtgcacgcctgtaatcccagctactccagaggctgaggcaggagaatcacttgaacccaggaggtggaggaggcggaggttgcagtgagccaagatcatgccactgcactccagcctgggtgacatagcaagactccatctca

SEQ ID NO: 205656 - DNA, 1498 bp, Homo sapiens
atttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcgatggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcacaccccccaagctgaccgacgaggacttctcgccatttggctctggaggtggcctgttcagtgggggcaaggggctatttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctcttctttttctcggcaccccacagcaaaccttctaaaacacgcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttacagcaaaaatctcaagccctcatcagaaacaaaagactcaaaaaggcttattttcagatgaggaggactctgaggatttgttttcttctcaaagtgcgagtaacttaaaaggtgcatctctgctgcctggcaagctccccacgtcggtttcctggtttgatgatgaagatgaagaggataatcttttgggggtacag

SEQ ID NO: 205657 - DNA, 1286 bp, Homo sapiens
atttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcgatggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcacaccccccaagctgaccgacgaggacttctcgccatttggctctggaggtggcctgttcagtgggggcaaggggctatttgatgatgaggacgaggaggtgagtccacggcacccagcaacactccctgcagctagctgtgtcaggggtccacagggaagatataggctttgcttgtttagtgggggaaaaacagtttctcagttggaagttgcttctattttcatattttgggacattttgaactaagaatcacagagtgagaaatgccgtatccttctatgctttgttaggtgaggagaagatgtgcacgtgttaatgtgaataatttactaggtgattgtttcttgccttatctgttgtcttccacgtttgtttttaattcctggacaggcctaaattattttagggtctgatttttccatagttatcactttgcaactgattttctggcagagtagtaaatatgtagctttaaatcttgtaggttattt

SEQ ID NO: 205658 - DNA, 323 bp, Homo sapiens
gggtgtcagtggactgtgccaggggtttagtgtgaaattcatcagactgcctcacactttgttaaatagtgtcagataaactccatgccagtttggagacacagcagatgccaacccgggaatttgagttctggccccatctttaatactccctgcaaaacattgctttctgtttgctagatgaagaggataacttattcacaccccccaagctgaccgacgaggacttctcgccatttggctctggaggtggcctgttcagtgggggcaaggggctatttgatgatgaggacgaggaggtgagtccacggcacccagcaaca

SEQ ID NO: 205659 - DNA, 898 bp, Homo sapiens
  misc_feature (781)..(781): n is a, c, g, or t
  misc_feature (857)..(857): n is a, c, g, or t
  misc_feature (860)..(860): n is a, c, g, or t
  misc_feature (883)..(883): n is a, c, g, or t
atttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcgatggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaaagangataactttattcgcaccccccccaagcttgacccgaccaaggaactttttcgccattttggctttttggaaggtnggncctggttcaatgggggggccaanggggcttcttttgga

SEQ ID NO: 205660 - DNA, 1528 bp, Homo sapiens
atttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcgatggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcacaccccccaagctgaccgacgaggacttctcgccatttggctctggaggtggcctgttcagtgggggcaaggggctatttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttacagcaaaaatctcaagccctcatcagaaacaaaagactcaaaaaggcttattttcagatgaggaggactctgaggatttgttttcttctcaaagtgcgagtaacttaaaaggtgcatctctgctgcctggcaagctccccacgtcggtttcctggtttgatgatgaagatgaagaggataatcttttgggggtacag

SEQ ID NO: 205661 - DNA, 647 bp, Homo sapiens
atcgtcatccaagtgttcatcctcgtcgttaagatcatatacttcctgcacgatatccatcctaacatcgtgcccaacgggcacattatctttcagacattctgggagatctccagacagatccatgagttcatgacatggacacaggtagagtgtcctttcgagaaggacaagaagattcagagttacctgctcacggcgcccatctacagcgaggaagctctcttcgtcgcctcctttgaaagtgagggtcccgagaaccacatggaaaaagacagctggaagaccctcaggaccacccttctgaacagagcctgaggcggatgcagcccgcgacgccagaggaagcacgtgcactaactgggtttaaattttgactgatgtgggttgagatgaggaggcctcactggttggggtccattttgtatataacttttatgagaaaaaaatggtaattatttcacgcatcaacctttggcacttacaaagttttttttgtttattttaaataacagggcagggccctgctttggggagggggaggggagagtatcatgggagatggtatccatgataacatcttattctaatgaaatgtagatttttattttctacttttgattattaacatcttatgaaaaaaatat

SEQ ID NO: 205662 - DNA, 253 bp, Homo sapiens
gcgggcgactccaggactccctcagctggtgaccctcagctgtgtggtcgtggtggtggtggtgggttttatcagtctgacaatcttttatcttttaattggtacatttagaacatacacatttaatataattacaaatacattagggtttacatctaccatcttatttgtgctattcatctcatctattttatccttctctcctttcttgcctctttttgacttagttttgtttttatttttccctctctcc

SEQ ID NO: 205663 - DNA, 511 bp, Homo sapiens
cccctgttggtcctagttctctctggccaccagaactcatctgcttcctcctcccacgagaaactggggagagatggagacagcacccaaagcctgctcttctttaagctgtttcctctcaactgggctttccatcgtgccattgctgggctaccttggcttggccaagccccatctcctattgtcgcagtgtgaataccagaagaagcaaacagcctgcagatgggacacctattcacccctgatgcaagtgtgactggagctattgaatgactgatgagatccgttgtaacaatcattctggcaaaggtgtggagatggctcagaggattgagctgggagcagggtggcctcagccacatgtgctaccatggctctgagcaggcagactgagcttgttgagggagggactgtctgattcagttacaattaccagatgagaatggccaattatgagagaattcagagtacaatcaagtccaataaatgccatagtgatgctgaggacaaa

SEQ ID NO: 205664 - DNA, 989 bp, Homo sapiens
cccctgttggtcctagttctctctggccaccagaactcatctgcttcctcctcccacgagaaactggggagagatggagacagcacccaaagcctgctcttctttaagctgtttcctctcaactgggctttccatcgtgccattgctgggctaccttggcttggccaagccccatctcctattgtcgcagtgtgaataccagaagaagcaaacagcctgcagatgggacacctattcacccctgatgcaagtgtgactggagctattgaatgactgatgagatccgttgtaacaatcattctggcaaaggtgtggagatggctcagaggattgagctgggagcagggtggcctcagccacatgtgctaccatggctctgagcaggatgccaagagggtctaacatccctgaaagagacagcctcttgccctggaaagatgccagagagggaagcaggagacttgagttctgatccggatctctctgccgttgggtgatcccctgccctcctctggacctcagtttccccatctctacagtgaggataataatcctagtgctatttccccatagaaatgttgtgaagctcaaaggtgagaccaaaatcactcattggacaaactccaggcagggtgggagtgttggctgggtagatgtggtcatctgccaagtggccatgctgaggctttgggggctctactcccaccaccaatggggtccttctcagagacttgcactctcttcttccagctcactcatattgtggggctcagagaatgttaattattagggcccagcccacatggagggcttaagatgaaagcaagctcagagtgtaaagtctaatcaatgccccacacttggcgtcagggcctcggcttggtctgcttggagatggatcattaatctagacactccgacttggaacactgggcacaggaagtcctgaaacattcctgaccacccacagctcagcctgtcagccccat

SEQ ID NO: 205665 - DNA, 239 bp, Homo sapiens
ctacaccctgagagtccttgccatattaacacctgccagggcagcagccttcactgaggttgcgacctggtcgccttctctccacagaaccacctgctgtcccctctgcgcctcttcttcgatgcccctctgttgccctgttcccaataacttccagaatgatttgcttgctttgataaaacagctgagtcagtttgggaatccggagtcagcaccttcttttacctaccacacgaaat

SEQ ID NO: 205666 - DNA, 570 bp, Homo sapiens
tactaggatccatactagtatcattactagtctctaccagtgggtctcaaccctggctccatactaggatcacctacagagttgttaaagcatactggcacctgggtaccatggtagactaattaaatcagcactttgttagtggaggcagagatcaatatttttgaaaaggtcctcagatgattccattgtgcagccaggtccgaaaacctctgtgtattaagatacaaagatagcatttacctaacccagtggttttatctcaaagtgcagttcctggacccaacattgcccgggctgtttaataatgaagaactttcagccccaccccagacttcctgaatcagaatctgagaggacagtaatcttttttaacaacactcctctccatccccatcctccatcagttctgatgtgcgccaatttttttttttttttttgagacggagtttcgctcgtctcccaggctagagtgcaaatggcgtgatctcggctcactgcaacctctgcctcctgggttcaagccattctcctgcctcagcctcccaagtagctgggattacaggaatg

SEQ ID NO: 205667 - DNA, 367 bp, Homo sapiens
ccccaaccccaccctggcgctttgatttccagtttgggaaattcataccaatggaatccgatgtaagcaatccaccatcagctcactgatgctctcttgccttccacacttcgagaagacctgaaatgtggtgtccattcccctctttattcaaaagaggaccttcaaaaatattcacctaactaggaatttaaagaacacaagaaattgttggtatatttcacttcaggtaactgccctaaaattaaaacctccaatttatgcaaaaaaagaaaagatggtgcttcaatttacaaaaggattcatttcagggttatctctagttgtctggtttccccaatggctggccttgccaaatgatttgctg

SEQ ID NO: 205668 - DNA, 249 bp, Homo sapiens
tacaagtaagttgcacaaatgcctggagttcagtaaatactgcgtctgatgaaagtctacctttcttttatgtctctctgtgtctggtatgtcagctgcttcctccttgcattatagttatttgtgaatgtgtattgtttccttcattatttggggtcatgtccagactttgaaggcaacaacatttagataattgacaaagaaaccaacaaatactcttatcatcaagctatttgcctatgactgcct

SEQ ID NO: 205669 - DNA, 578 bp, Homo sapiens
gacagcagggtgcccagtgtggctggagtagaagaggaaagagaatagtaagaaatggcctgtaggactgactcagtgaggtaggaagatattaaagggtttcgagcaaagggatgagataatcctggaaatttggttgccttctctctctttttaatgtttttagccttgattgatcttttttttttttttttttaaataagtgttactagaaagccttgatggaccttaatctttattttgtagtgaatccatgctttagataacagggttattttctattaagaattaaaaatagctcacgcctgtaatcccagcactttgggaggcagacgcgggtgtatcattttgaggtcaggagttcgagaccagcctggcctacatggcgaaaccccatctctacaaaaaataaaaaaattagctgggcatggtggctctcttagtttttgcctgtagtcccagctatttgggaggctgagactgaaggactgcttgagcctgggaagcagaggttgcagtgagtagagattataccactgcatgtcagcctgggtgacggagtgagaccctgtctcaaa

SEQ ID NO: 205670 - DNA, 860 bp, Homo sapiens
cgattctgtttcctcacttttcaagtgcatagtacttcataccttgaagttattttgagatttgtatctatgtattactccagaataaagaaccccaaaatttagtgacctaaaacatcagacttcttaaaccacattatttcttatgattctgtaggtcatcaacttgagctgggttcacctgggcatttttttttctcttggtcttttctggggtcattttgcagtcatctcaaggctgactctactggggccagggtctaagatggtttcaatcacgttgtctcaatgtcaaactgttagtgccggctatggcttgagtcctcatgtcttcagcaggtgacgctggactttttcacaggacagcttgtttccagtcagagaaggcaagctcttttcatacctatgtttgtgtttcatctgttaatgtgtttcatctgttaatgtctcattgatgaaagcaggtcatatgaccagttctaaagtcattatagaaggaaactacacagggatatgggtactgggagataggattcactggggtacactaatactataacaggccaggtgcagtggctcacacctgtaatcccaacactttgggaggccaaggcaggaggaatgcttgaagccaggagttgaggaccagcctgggcaacaaagtgagaccccatttctacaaaaatttaaaaaattagccaggcatggtggtgtgtgtgtgcctgtagtcctagctatttagaaggctgaggtgagaggattgcttgagcccaggagttcagaggcagcagtgacttatgattgcaccgctgcactccagcttgggtgacagaataaaatgcgatctccaaaaaaacacc

SEQ ID NO: 205671 - DNA, 607 bp, Homo sapiens
gctaatttttgtatttttagtagagacagggtttcacagtgttggccaggctggtctcaaactcctgaccttaagtgatcctcccacctctgcctcccaaagtgctgggattacaggcatgagccaccgcgcccggaagacctgactcatttctaaagtggcatgtcttcacaataaaactaatttttaaaaatgcttcatagttaattaatacttgctaggtcagtaacaaaatcttttctgctgttagaatctcagcaacataataataaataaaaagataacataattttttaaagaaaacttaatactttaggtttttgtattagatatttctttaaatttaaaaaatgcttcttgacacataactttagagttctcattctaagattgttttgtagatatagttgccagaaattaaataaaatgaataatatttcagagtggcaccaaagcttgatcatttttaaagaactcaatatttaaatactgtggaatttctgatataaatgtggctttaagatttttgtttttgtttttaacaaaagaagaaaacctaactgatacagggctattgtgtgtggtgaatattatttattattaaaat

SEQ ID NO: 205672 - DNA, 141 bp, Homo sapiens
gtattttagtaatactaatgattacaatgatagaagctatcatttattaaggaccttctatgtgccagatcccaagctaaagcttcacctcatttttttctcatatgacttcatgcaattcaaagaggaaagaataatgag

SEQ ID NO: 205673 - DNA, 593 bp, Homo sapiens
cacaaattctttgatcagaatcagttctcagtgactacaatcatgactcaaaactcttggtatatacctcaggcctgtttatatctgtgacacctgcccatttacattgaactttgttttgtttgagatagggtctcactatatcacccaggctggagtacaatggcgccatctgggctcaccacagcctcagtctcctgggctcaagtgatcctcctacctcagcctcccgagtagctgggaccacagacatgtaccagcacacccagctaattttttattttcgtagaaaccatgtctcctcatgttgcccaggctggtctgaaactcctgggctcgagtgatccatctgccttggcctcccaaagtcctgggattacaggtgtgagccactgtacccagcctcaaaaaaatttttttaaagattaaaggaaggccaggtgcagtggctcatgcctgtaatcccagcactttgggaggctgaggcaggcggatcacctgaggtcgggagttcaagacaagcctgaccaacatggagaaaccccatctctactaaaaatacaaaattagccttgcatggtgatgcatgcctt

SEQ ID NO: 205674 - DNA, 385 bp, Homo sapiens
tcagcaggtggcaaagccagacaggcttatgtccttctccttaggacggtgagttccccaggcctcaggttggtatacagatgccatccatgagccagggattggagtaaaaatccttagaaatctacctggtgttcctttgcactgcagctgagctggcactcaaactacaagctagagcccttcccactcttccatcccctttccacaggcagagcagcctcactctgtggccaccaccagcacgggcccacagggagtgctgtcagactaccactgaggttccattaagggctaagagctcttcagtcagcttgtggtgaatgttgcctggtctgaggctgactcttcaagactcacccagggcaggtccagcaatgtcatc

SEQ ID NO: 205675 - DNA, 449 bp, Homo sapiens
tctggcctcttaaaggcttgtggggaaccaatcagaacagctcacctcaggaatgctgcaagggggaattaaacttttattttcctcacgccactgcattttggtgcccctttaatgcagcagcctaacctttatcccaaagcttatatttacctttactacctgcaatgtactttatcatattctattctatttttttccattaaaaaaaaagaaatcctggtactcaacccactaaactgattttccaactcaataattggacatacaaacctacagtttgaaaaccactatggtatgaagagagaggagtaaacagataaaaatcagtaaagaatacaaatacttaaaaaactgaattaattctgaccacaaataatcaagatataactcaactggccattttataaacttctgactcaccctcctaacatttgacacaactgccc

SEQ ID NO: 205676 - DNA, 383 bp, Homo sapiens
gcgggctgagaaggcctccacatttggttcagtgctctagtgtcaccaatccttagtaacttttgaacaaggactctacattttcaagttccctggccccgcaaattatgtagccacttctgtattccctctgggactctaagacaagttatttcgcttctccgagcctcagctcttcatctgggaaatggggacgagatgttttactctctcagattctagagggcgataaatgagtgcatgcccaaaatgccttttacattctgaagcccggggccaatgccagggatttgtatcagagtgttgtcttccagtgtctgcaccttccaactctcctgggagggagcaagagctgcagaaggatgaccacaggaagactgagt

SEQ ID NO: 205677 - DNA, 473 bp, Homo sapiens
tcataattttcatttcctgggtctgtttaaattgcacagaaataacctgtttcttgaaggttggaaagaacttgccaataaaataaagagggcacagaactttttgggggcagcccttctttgacgtcctctttactttttatacaattgttggtgtgttcgggatttctccagattctttaatccaatttgatcaatataaaatacaaaaagataatttgtattttcctagaagccttctggacagcaaaggcaaatattttatactattttaaaatattttcaagttattttgcagtgatattttgatttattctctcttcagagaatgtgggttttatttagtctcattttttgaaatgttgtaaggtgctcaattttatgtgtatcccaaggatatttgatagttggacattttgtaaattttcacagctatttgacaataaattatattctctgcattgaagaatatt

SEQ ID NO: 205678 - DNA, 380 bp, Homo sapiens
tgtaggtgtttaaggtatgtacatttagtcattttcagagataggaagaatgcattaactttgcaaatgggtcccaaaggatatgtttggatattttgatactgaaatattattacagagtatgtgtgtcctagatctctaggtccttatttcactggttacatctaccttggctaatggagttctttactctgtttttattgtgaaatatttatacctatgagaaagtacagagaataatgtaacagcacctacatacccattccctagtttaggaaataaaacctaacaattacagttgaaggtctctgcgggtcctctcaggtctcataaccaggaaggagttactaacttgaatttggtgtgatcattttctacat

SEQ ID NO: 205679 - DNA, 299 bp, Homo sapiens
cctgcaaggtggccatcccacaggccaggaagtacaatctctggcaaagaccagagacaggcacttcaaaggaggagcaggggtaggaacttgatgctgaataggttggctaaacatacatattcaacaggttacaggaggagctatgaataattatgaaggtcatcctgactcatgcttattgaacaaacatgcatgtaacatacaacccatgttcactttgaggtggagacttaactctttttgttgttgttattgtttgttttttgtttttcgcgacggagtcttactctgtcacc

SEQ ID NO: 205680 - DNA, 170 bp, Homo sapiens
gtgcctctgcaactcagcggggccttgggaccgcagccaatccacctgagtccaactgcgtttcttcagtttacaaagggaggtgggggcggtgctgtttgaaccttcctcacagaattgtaataaatgcaaataaagggtttggtgcgagtacatgccatgataaacac

SEQ ID NO: 205681 - DNA, 590 bp, Homo sapiens
gtagattctgtagcactggcatgccgtagctgctggcacctacgtgtggactgacgaactttgagaataaactccaaacttgggctgttgaggcctgatacattgtcatgtgaaaggaagcgagactgatttctgccataatggataacagagatgcatttaaataagaggattagtatgtctgcctcctagatggtaaagttaatttggaatctttcatggtacatgggccaaggagggtttgcacaggaatctcccttcttttcaccccttagtgatcactttacagtcgctctgtttaaccacagaaagaaattttatgaatgttggaagcagaagatggcaactcctaatagcatctagacatataggtttggatttgaaagtgtgtatgcttaggaaagaagtgaaggtccttctttagacaccactgtttttgtcaggccagccatctgcatggatgtgtacgtgcacacgtgtgtgcatttaaggcaagtactttaaatatctttgcacagttcctactgaacatgtaagacctttggaagcaatattgtccagctccataccaagtttaatttaaaaaaaaa

SEQ ID NO: 205682 - DNA, 615 bp, Homo sapiens
attgacactaggtcgtaaaagagaattcaaacttttggagggttaatttctcataagctttatttttctattttattttatatgtatatattcttgaggcggagtctcactctgttgcccagtctggagtgcagtgcagtggtgtgatcttagctcactgcaatctccaccccaccccaggttcaagggattcttcctcagcctcccaagtgctgggattacagatgtgagccaccatgcccggcccttacgtatttatattatacaagttttcaatcataaacaattagaaagcttagcgagtggaacccctatgtacctatcacttatatttgtggtacctttttgatctctgtgtcattttttttcctaagggatttttttctcatttcagaaaaaagtgacagtgatagaggagtcttatccccaagaataaatgaaactgaacaaaaaacatggagagtattacccttcatacgaagtgcacaaattaaaacaatgaggcttttttttttttttttttttttgcctgtgagatacgggttttaaagttagaatagcctgtatgtacaagagtttaaagaaatgggcatatgtcactggtgtgtatataaa

SEQ ID NO: 205683 - DNA, 462 bp, Homo sapiens
  misc_feature (22)..(22): n is a, c, g, or t
tgtcattgtgcacctgttgggntggcaccaatgcctcattcccctcagcctcccaagtgctgggattacagatgtgagccaccatgcccggcccttacgtatttatattatacaagttttcaatcataaacaattagaaagcttagcgagtggaacccctatgtacctatcacttatatttgtggtacctttttgatctctgtgtcattttttttcctaagggatttttttctcatttcagaaaaaagtgacagtgatagaggagtcttatccccaagaataaatgaaactgaacaaaaaacatggagagtattacccttcatacgaagtgcacaaattaaaacaatgaggcttttttttttttttttttttttgcctgtgagatacgggttttaaagttagaatagcctgtatgtacaagagtttaaagaaatgggcatatgtcactggtgtgtatataaa

SEQ ID NO: 205684 - DNA, 774 bp, Homo sapiens
ttaggaattagttgtaatttagactctgacctccccacttgtctagttgcagtcctagaaagcttacaactcaacagaaacaagactgttgttggctgattgatagatcaagctaccttagtcttcagaccacatgtcgctccagtggacaagaagagcccagggaatgatctcagtgactgtgtctgcctcttcagatcttagccgggcaattttgctcacgtgctgtctggaaggctctcttcttctggttctctccttatctgttcattcctgcctgggtcctggtgccacttaggactttttggcccaagcatgtgtttgctgtgaccgcatgctcattgcagccccacgtagagttaccgaaatttgtctctgcatagtctggcgctggatttgtctccttcggcttccctgggattgcccagaccgaacctgcttacccgcttcggttgcctcccaactttgctcgatggtgttttctctgcaggatcactgtcttttgtcctcttctttacttggatgatgcctacttttccttctggttcctacaccctccctcaaggctaggtatagcctttcctctgagctcccatcgtatgctgtctgttcttctggaatgatttcaccccattccatactcacctgttgtttagttccatgggaccctcactagcctgggagctccagtaaggaagaaactgtgtgtcatacacaagtttggagctctcagcgcctgttcagagctagacatcaaaaacactcggtcctcct

SEQ ID NO: 205685 - DNA, 371 bp, Homo sapiens
ttgaaataattccagcaataataagtagaattatctccactacctgtgtttatagagaaaatgatgttttaataacgtgtgcatagaattggactatgttatcaatacgttaaatgtgtaaatattagtataaaattaatagtgataatgctgaaaaactattgcaggagctgaaagtgtaagaactatgacttaatgtaaatgctttcacacatacggtttttgcctgcaatccttatgttcaggctgactcggaatataagattcatgagtctctgtccctctttatatgttgtttcatgtgtcagaatggaaaaagcaaatatttacgtagagggaactcctccctcctgttggaggtacgcggcggt

SEQ ID NO: 205686 - DNA, 299 bp, Homo sapiens
ggatgtctgtagtaagaaggtcaaagaaaagaatgtaagaaacacttgaattttagacgtaaaagaacaggaacctacaaagatgtccaagaaacaatgttcaagagaagggaggaaaaaacctggagagtgagtagtgttacaaaatcaaagaatggatcccaaacctggttatataccagaatcatcttgccagttaaaaattcagattctcaaattccaccttggcagctttacttttgtaattaagcttgttatgtaaatcatcatccaaatttaacacccatctaaattaaatt

SEQ ID NO: 205687 - DNA, 133 bp, Homo sapiens
cactgatgacaaaaccaaaggctggatgatgagaaggcctggtatgttcaatgacacccatcacaacactgctgtcagggtggttcaaattcggaaagagaaatgctgactgatattaggtttcagatttagg

SEQ ID NO: 205688 - DNA, 448 bp, Homo sapiens
gtggcacattcttggctcactgcaacctctgcctcccaggtccaagggattctcctgcctcagcctcccgagtagctgggataacaggcatgcaccaccacgcctagctaatttttttttttaatgtagtagagatggggtttcaccatgttagccaggatggtctcgatctcctgatcttgtgatccacccacctcggcctcccaaagtgcagggattacaggcgtgagcaccgtgcccgaccaagattgaccttcttaaacaactttgtcatcatgtgcttctcctgctcagacatcctccttggcagcctttcaacacgtttctcaaatcctttcccagcttcctgtgcagcctttcctcctcagcctggctgccttactgtctcagctccgatctctgggccttttcccatatggctgcttccctctacagtgttcctcctagc

SEQ ID NO: 205689 - DNA, 589 bp, Homo sapiens
acgggtctgtttttacccagggagaaaaatgactactaataggattgtgtgagttagatttccctgtgccttaaagctgttttaataaagaaaggatgaagctgttcctaagttgttaggttcgtttgttgtacttttccactagaagccctatatctcttggcaaaggggagctgcttcacattttctcagatccttcagctcaccaggttggaacggagagatgattgacattggagctcttcagtgggcagagactggtggcctgtttgtctgtaaaatgccccagaggagcaggtggactgacgtctctgcagactgcaccttccagcaggctctagagaagagagtaagacacaggtagcaatcccagaggcaataatcatgacaaagggcttccagcagatcccaaggtggtttgggagtccttttgtaacacatcttggtcaccgttcaatattacattgctctaagatcatgatgggttcattgatcccgtcatgactggacatttctgcttctcatttctcaaaatctttcctggaagcttttttcccctgctttcccttctgtttgcctaataccagtt

SEQ ID NO: 205690 - DNA, 778 bp, Homo sapiens
  misc_feature (576)..(576): n is a, c, g, or t
  misc_feature (627)..(627): n is a, c, g, or t
taccagtaagccatctgatttcccagtaagccatcctgggcttttctttgttgaaagctttttgattgctgattttcattttcttcatttgttgtttgtctgttcaggctttgtatttcttcttgattcaggtctttgtaagttgtacatttctgggatatttccatttcttctaggttgtccaccttgtttgcatataattgttcatactagccccttctgatccctttcatttctatgccctctgttgtaaggttgtctttctcatttctgactgtatttatttgtatcttcttccttttcttaaaaggtttgttgattttgtttatcttttcaaaaaaccaactcttactttcaatgattttttttcccattgtttttcaactctcttttttaaaaatgtattttgctcttggagtttttgctctactttaaacagcttactaaagtcattttactattaacaaatacaaggctctttcaaaagctcctatagggaatacaaaatttccccatctccttataccagaaaacaaagttatttacaattcatcttaagtctcttatgatcttcanggtcttcctgaaagagattggtcatacaatccaataaactgtttgactctnttgggaaagtctttttttgccgatcttttgggatgtgtttaaccttttgttttgctctatgggagttttgccccgtcttctgcgtgttttccccctttctggcctccaaagggtggcggccctacgtttggatctttttttcccaagggtc

SEQ ID NO: 205691 - DNA, 234 bp, Homo sapiens
ggctttactcaccagatgaggaataggcattactctttccattctacaattgagaaaattaaaactcaaagtatttgacttccctacagttccataattaataagtagtaaatccaagacttggaccttgaacctatatctgtataagtacaaaaaaataggtgtgcaactaggattacagataggaatcaaatggctctaatttgatatctgtgtctattagtggtggggata

SEQ ID NO: 205692 - DNA, 493 bp, Homo sapiens
caggtcttaggaggctgaataagagcaaaaaggaaacactaggtaagaacaaagatgtgtatgaagaaaacactgtccacccctaaggctgtgggaacaaagggagaggttaggattaacacaagctagtagcccagagaagggtccctgcagagcctggtgctccccagctggagctgctaaccaggagatggaaggccctgcagagctggggctgaagccttagcaccttagctcagaggagagtgtcagggaagctcagacctctgaggagacagcactgcctgactgctactggtaccttgaaggggtcaaaataaagttggtctgtaagtgctaaaatgcactgaagactgaaatcaactattgttgcttgaaataaggccattcctggggacaatatggggccgttcctgggggcaaggaaaggggatagagcacttctctgcttccccagctcctgtctgccagtctcccgctagtggccgctccg

SEQ ID NO: 205693 - DNA, 334 bp, Homo sapiens
gaaagtacttcctggaaagaggtaatgggttcctccttcaggtagaaaaaatataattaagtgaaataattattggtaacactgaggtagcgagagactatcacatgtgtgtttaatgtttcttcttatctggccatatatttgctgtttttaattatctagtatttaacttgcaggctgtgtagttgaatgtgctcctttttacataaataatatgctttaaataaataacatgcttataggaaaaacatacttgactctcttatatagtctctcagctctggggcacctgggagaatgtaaccatcggccagtcccatacatttcatggctg

SEQ ID NO: 205694 - DNA, 504 bp, Homo sapiens
ccaggagcccgagacataggagaatctgctccccaaaaggaaaacaatggtgtcccctccagcccgcctcccatgaaccagaaacatgttataaaaggtacaggggaaggaggaagagagaggggagagacagagagagagagagagagaaagagagagagagagagagacagctcacccggtgccccagtgggggagccggggaagggagtccctccctccccacccgccctggatgcttatacacttctcctgaaggaggcaaaagaagtatgagaaaaggccaggtcccccgaaagggccagggaccaggaaggagggacagagagagacagaaacagcgagagagagaaaatcctgcccaagctcagagaggagcttccgtgggtatctggagggtggagatgcccgtggccgcaccagggctgttttggagcatggagcaccagtcctccccacccccaacctgatccccatctctgaccacctggagtcatcacgtct

SEQ ID NO: 205695 - DNA, 459 bp, Homo sapiens
aaagagaaaaagagaaagagaaagaaagagaaaaagaaagaagaaagaaagaaagagggaggaaggaagaaaggaaggaagggagggaggaaggaaggaaggaatgaagggaagaaggaagggagggatttcctagactaactcccacattgcatctatcattttcttcatgtctgcactagtaattgtgtaaattatagcacattgttttgtttatatacatatacatatgtgggtgtgtggtggtggtgaatgtgtgtatctataggtatgtgtgtggaatgtatataaatcttctttattgtttgaagtgctcatgtgtaaatgtttttgccttcaacttcattaaaattttttgagggcagaatattttaaagtcttcaataacaatcattatattactttaaacgagatcagataaaaaaggacataaataaagtctactgagttataaaagga

SEQ ID NO: 205696 - DNA, 436 bp, Homo sapiens
aggggatgcctatagcgtctgtgctactatagttaattacattttcatcaaaaactaacaactcatggtcaccaactccagtgtctcccagttgtcaaagccaaaatctaaactcaggtctatcactgacttcctacatgaccaccggcacccctggcacaccggcacctcacagctgtttacggaccttcccgcttccctttgagtctctctggagaaatgagggcatcctctgtatgtcttgctggatgtgagggagacacagagcacacgagggcttctgaaatctggccttgggggaataagaagccttttatgcttctggagtatagatttgtgcctttcctgcttctttcctgccagagttcatctggcagagctaagcctcaccccaggctctggggtccgggggatactgtcctcccaggtcagccac

SEQ ID NO: 205697 - DNA, 524 bp, Homo sapiens
gccaaattctagctggctgtttttgcaaaacctgcagaaattgatatggaaatgcaaggaactcagaatagccaaaacaatcctgaaaagaaaaacagagttggaagacacactccccaagttcaatccttactaaaatctactataaggagcactatgtggtactgaaataaagatggacatatagatcaatggaacaaaactgagaatcagaaaatagcccatacatctatgattaattgatttttgacagtggcactgacaattcaacgggggaaatgaatagtcctttcaacaaattttgttgtgacaactggataaccagatgcaaaataataataataataataagttggaccactacatcacaccacatataaaaattaactcaaaatagatcaaagacctaaaggtaagagctaaaactataaaacgctttgaagaaaaccctggtataaatacttgttatcttagattaggcaatggtttcttaggtgtgacacctaagacacaaccaaaggaaa

SEQ ID NO: 205698 - DNA, 305 bp, Homo sapiens
ctccactgaggatcctgggctgctctgtcccgcgtacgggcatccgggttctgatagcccgccgggccctgggccaccagaggccttgaattgcgtcctggtgacagtcagccccttgcatggggcacgcacagacctgggcctaggctggggcaccgagatccccacatccagcagccgcggtgaggctggcctgcctgcttcccggggccacctctgccgtgccgtctcctccctctatcactgctcaccggctgagggaggcatcagtttcccgtagacattccaccacagaggaccgtaag

SEQ ID NO: 205699 - DNA, 390 bp, Homo sapiens
gtatatatgccacatgccctttttcctccaatttattgattaacttaaatgtagatttatttctaggcagtgagtataggtgttactaacttcctgtttagctatcaaaaagccaatgttttaaaaatgctttttgctgcctctattagtgcatcatttttaagggttatttgtttacattgcaagggtaagaattacattaactgcatgtgatacctatgttattacaatgtgattaaatacagttgtatgcaagatatatagctgtgtgtaaatattatatacttcatatcaaactgcaattttaaaatggattatcttgtaaaagtgtgtctagtgtcagaatattgcataccctgcatacgtgtatgcattcttaaatttggtctg

SEQ ID NO: 205700 - DNA, 322 bp, Homo sapiens
gctcccattaggtttaaaataagcactgatgtttctgttctttctaaaagtcggcgctttcagttgcttcccttttgtgaacaatgacatcaaaaaataccatctcccagtagtctattctaattcaaaaggcttcataaaacatcaggtggattaggtgcttatttaagccattctctaagtgggggcatccagggctagacatctggcctttaatcagaagggctgccctccagagacagctactaccagtgtctctgctatttttatagttttatatcagatcaaattagcataataaatgttagaaattggatatcca

SEQ ID NO: 205701 - DNA, 482 bp, Homo sapiens
gaggggctgtcttctcctctggtggtggactgctcagtccaggcatcctgggagctgccttattgccccatgaactgtaatgctgtgttggctttacctacaactgcatgggcctgctgtgtgtcaagggttaaatgggagtggatattcaaccctgggtttgtttggtagcctctgaaattaataaggaagaccaggcatggtggctcacacctgtaatcccagctctttgggaggctgaggcaggtggatcatttgaggttaggagtttaagaccagtttgaccaacatggtgaaaactcgtctctactaaaaatacaaaactagctgggcgtggtggcacacacctgtaatcccagctacttgggaggctgaggcagaagaaatgcttgaacccaggaggcggaggttgcagtgagctgacagcacgccattacactccagcctggtcaacaagagtgaagctccatctcaaaaaaaga

SEQ ID NO: 205702 - DNA, 269 bp, Homo sapiens
aataaggatggggtcaaataaggtgaaagatttggggaaaatgaatatatatcccccaaaaggtaaagtgagtgataaaaaagtttacattagaaaagcagcatagacttaaaagtagatcatctattttatatgtatgtttagtaagaaacagactagtgattttgaaattttggttggggatcccagggtgtaaatttttgccatatgaaagaaagtttcagttttaggaagcaaggaacagtagaaaatctatgagctctagagtg

SEQ ID NO: 205703 - DNA, 765 bp, Homo sapiens
catccccactgtcccatcctgagcaggcagttggattacctctgggtgccactcttagctgtatatcagcttagttcctagtctggcagtaagttcttagtcctagacaaagagcaataagaacccagctcagctgcagcaggctcggagctcagccatttctcacccctgccacactccccaccactctaacactaaaggcaggagttctgtttgtgatatgactctgcctttatagtgggggctcctgtggggcaggccagtgtcttacacagcttcgtcacacatccccactgtcccatcctgagcaggcagttggattacctctgggtgccactcttagctgtatatcagaatcaccagtagtacttagtaatttcagtgcttttagtttttgcttttgttttcagaacttgcagtaaaatcagatagtacaaaaggtgaaagtgaggtttttcttccagacttcacgttctcatttccttatgttttatgagataaattccctgcatatatgaatgcatatatattttccttccaactttgtcattgttttgtcttaatacatatggccaaacatgcatattaaccagtttggttttttcacttaccaatatgatttgaagatcattccgtattcagcacatacgtctgtttctcgttaagtatttatttacacctcacaacaactctgtactcccctgttactcccccattttacagaggagactgtaggtctggagatattaaatgacttgctgtggg

SEQ ID NO: 205704 - DNA, 732 bp, Homo sapiens
ctgatgatggtgaatagaaaataagggccaggtgctagaagaactgggtcaggagtgtctggcaggcattcattcagtcttgggactgaagatatggtgagtaaagttacaaattaatgtcgagtaaagaggaagttgtggtggcgataggggaagatacaggagcacagatggctgggtggccttgatctggtccctaaagctgcttggttggagctgctgcaggttaaaacccctagggcaaggatgtggaatcagaggctgcaccagtaagaaatctctttccaagagattttgtaggggctttgttgtattatttgacaacagtcaattctgctacagatgaacaagaaaaagaagatggatgaaactcataaacgtgtgttaagtatagataatgactatgtagtagcttataagacacaggtgaaatgtatgtgttacatttagataatgagtaagtaaacagacatacaatcattcccccttatctatggtttcgcttttcaaggttttagttacctgtagtcaaccatggtttgaaactattaaatggaaaattccagaaataaacaattcataagttttaaattctgtgccattcttctgatgaaccctcgtgccatcctacccaggatgtgaatcctctctttgtccagcatatccacactgtggacactctacacccaggagtcactaagtagctggctcagtatcagtttgactgtcttg

SEQ ID NO: 205705 - DNA, 147 bp, Homo sapiens
tttatggatattcaagattttgtttttcctttcagacaaaacaatattttatatactgttttcccaagtatctcaaaagtggtatcacaatacgtttttgatataagcctttatgtatcagtgacccctatgttttttttttttagg

SEQ ID NO: 205706 - DNA, 508 bp, Homo sapiens
atggtcatttgttagcatatggctacttaattttcgaaagggagttaagattttagaaattgtcggctatacagtcagggtcctggcagaaaacagatggcacacttaaaccggtgatgaagataatttaataaaaagattctttgtcaaggtgtggacaagatgtagggatcccaaaaagggaagatgcagaatttcagggctgctggacaaggagcaggtattacaccccagagggtagttgtatagagagggcacctgacaaggggagtggccatcagccaacctgtgggaactctggaggagccagatctcactctgcctacgttcccaagcttctgcctactgccttctgttgggtgaacccaactggaagtttgagggcaagagagcttattgatagggttcatgatgtcatcatgttcctgggacaccagttgggatttaaaaaaagtgggaaaggggatctggaggagtacgtggaaaatagcaaccatattagccgaag

SEQ ID NO: 205707 - DNA, 752 bp, Homo sapiens
gtccaggagtttgagaccagcatgggcaacacagtgaaaccctgtctctaccaaaaaaacaaaaaataaatacaaaaattagtcgggcatggtggcatgggcctgtagtcccagctactcaggaagccgaagtggaaagatcacttgagcccaggaggttgagcctgcaagtgagctgaaatagcaccactgcactacagcctgggtgacagaacaagaccgtgtctcaaaaaaaaaaaaaaaaaaagatgctgtggaataggggataaggaaattccaggagccctcctagaggaggttggacttctaaggcatttggattgagatactaagagaggaagctagaggagaactcagggacagagaaaaagttggatgtggccactgagaggatttgtgtttaggagcctggagcttactgcttataagaagggatgaattaggtgaaagggaccttgagacaaagggaaataaaaactcttagagtaatgaaaagtgaaaattattcccatttatgtaaaatatatatatttatgtatgtagattcatagaaaaaagagttaatagtttactctggaaaggggaaaggaaaaagatgggggataaaaaggaaactttcatgttttactctatataattgtgtgttgtttgaatcatttacattaagaattacttgtgagccgtgcctgtaatcccagcactttgggaggccgaggcgggtggatcacctgaggtcaggagttggaaaccag

SEQ ID NO: 205708 - DNA, 195 bp, Homo sapiens
ggccttaaaggtagctattcttatgtgcatttacagatgaatctgaggttcagacaagcacagtgatctccatgagtggcagagccagcctcagaattcagtttatccagttccaaatccaatactttcaaattagcaacaccccatcagatggaacctgggaatgtgattcaccacacagagttccggcattaa

SEQ ID NO: 205709 - DNA, 510 bp, Homo sapiens
ctatgtatcaataaagaaattaagaaggaattcaatttacaatagctacagaaaaacacttaggaaatcatttaaccaagggagtaaaagctcactacaagaaaaaccacaaaacattgatgaaagaaattggagaggacacaaacaaatgaaaaaaaatctcatgctcatagatcagaagaattaatatcattataatgaccatactaccgaaagcaatataaatatatatagaatgaaatctctacatagtttcagtgttatttttcacaaaaatagaaaaaccataaaattcatatgaaaccaaaaaagagtcagaatagtcaatctaatcctaagcaaagtgaacaaagctggaggcatcacactacttgacttcaatatatattacaagggtctgggcatggtggcccatgcctgtaatcctatcactttgagaggccgaagtggcaggattgcttgagcccgggagcttgtgatcaagcaatatggtaggaactcttctttaca

SEQ ID NO: 205710 - DNA, 578 bp, Homo sapiens
ttcggaaactgcggagagttctcctgccacaattctcttgttgtcgtcaaaagcaattacatgtttcagatgatgaaaagcactgtcatgaaaagctggcacagcagccaaggagacagatgtattaaaccacacggcttctcagaactcccacttacgttggagctcagcacagagatgagcatggtgatatccccccgtctaacatcctcccatttggatttaatgcatgaggctcgtttctgatgaggtgccaaattctttcggtggacaaacacaaagttgcagaattcagtgatcatacaagtccatgtcctcaaacgaaaataataatactataaatgcaaagatgctaccataaaaaatacagtaggtggacttttgtgagtcaacataaaaaaatccagcatttctaactggtagcatgaggagtaccagtctgcaggatgttaacgcactgataggctatggacaatatattccacacttacggaagtggggaaactataggtcagacaaagctacaggtacttctttctttcttttttctttttttctttctgagatggagtctccct

SEQ ID NO: 205711 - DNA, 502 bp, Homo sapiens
gtggcttatacagagagtggagtctgagctgggggtgaaaggattgaacggcaattggatgagaaaaataaattagaagataagcattcaggacagtggaatactgtggaagtgaggacagaagctgaaaggcatacagtgtggtcagagtttatgtgaacaagagagtgtgagtagggaaggagtagatgatgagaccaaatggttggctggagatagagtatgtcaatatcaggatggcagcctaagctgtttgggcatcacacagtggcactttcaagtcactggtggcttctgagtgattggtgaatggaatttttattgatatgattggacaataatacataaaatggattaacttaaggactggaagctgggaaacatgttaagaagcccccaaacagtggccctaaaatagggttgagtgatgaggaagcataagccaagatttgttcatcatctagtgtgtgccatgtgccagatactgacctgggtgccttta

SEQ ID NO: 205712 - DNA, 241 bp, Homo sapiens
ttcagtcatgaaaccactcctagtcccaagcttactgatgatgcagcaggttgccagagtaattcggttaatcacttaaccaaagggaagaaactagtttaacaattatctgaggctaatttctttctaaattattccagcacgcaaaagaaataagaagtagcctgaagaaaaatctgtgaaccaaaggtgtactaaatttttgttcttgacacaagatttttagttgactaaaacagag

SEQ ID NO: 205713 - DNA, 174 bp, Homo sapiens
aacgagtggctactgagagtattccagccttcaaaggcaggctctgagtgcaaatttgaaccagcctcggggcagccattaaaactaattaggaaacaaaactacctcatgctcagtgaatatttgtaggttctggaaaattctgaaaggaaaggagtgattctaattagaagc

SEQ ID NO: 205714 - DNA, 452 bp, Homo sapiens
cagacataatcgggttgagctgtggaaatgtgttcttcaacgttggaggtgggatctggtgggcagtgtttggatcatggggatggatccctcaggaatggcttggtgtccaccccacggtaatgggttcacaagagatctggttgatgaagagtctgggacctcgctcctcttccttgcttcctcactcaccatgtgatatgcctgcaccttccaccatgattggaagcttcctgaggcctcatcagaagccaagcagatgctggtgttatgctggtatagcctgcagaaccatgagccaaataaaacttttttttttctcaagatgggggtctcaccatgttgggcaggctggtctcaagcaattctcccacctcagcctcccgaagtactgggattgcagagtgagccaccacacccaaccaaataaaacttttttctttaattacaaa

SEQ ID NO: 205715 - DNA, 786 bp, Homo sapiens
tgtttgcagtaaatcttgctgctgttcattgtttgggtccacactgcctttatgagctgtaacattcactgtgaaggtctgcagcttcgctcctgaagccactgagaccacgaacccaccagaaggaagaaactctgaacacatccgaacatcagaaagaacaaactctggacacaccgcctttaggaactgtaacactgactgagagagtcccagacttcattcttgaattacagggctttgactcttgggtctgaagaaggcaccagcccctgctaaattctgagcattgacaccagtggaagcctcatcctcagacttggaagaaggtggtctagagatttcctgccttctgaagcttgtctgggaggcaggaagaccacggcggaggagaaaggagcacttctacacacctcctcactgacacccctgcctgcctttgtcagaccttcggaggaggcactccatggagaaagggctccagctgacactctgagttgtgcagcgtggggtggggtccggaagatgtactattccaggaaacgattctactccaagatgggggggccagcagaatcgcccaggccaggctgtggcagatgagccgtccctcttacaggcaggtgaatcgggagctgtccctctgcctggaatactcccctaaggccctccacagttgcattgaaaatgtcacttgatgcagctgactcatctgggcctgaactctggatgggctggacgactgccattaggttcctttgactggaagcacactgggagaggtgc

SEQ ID NO: 205716 - DNA, 240 bp, Homo sapiens
tctgtaaaactgtcaattctccccaaatcaaaaatctcaaaaagatttttctattaaactggaaaagctaattcaaaacataatctagaatagagaatagctaagaaaattaaaaaaaaataatatgtatagcgcgatccaatttagagaatccatatgtacacatcctccacgtgacaaaccctaaaagaaaacagaaaacattcccgtcacgctgcacccagatggaatttcttccca

SEQ ID NO: 205717 - DNA, 385 bp, Homo sapiens
tgtgcatgcttatgtagaagtgacatgtatcagcaatgatacaatggagaggagggagaaattaggattattttattataataaggtactcacactactgatgtatattgcaaactctcaagcaaccacttaaaagtaacactataccactaacaacttaaaagtaacactataccactaaatgcacattgcaaactctcagcaaccacttaaaaaagcaacaaaggaatataattcacatatcaaaaaaggaaagaaaatggaatcatataaaatgctcaattagaaccacaaaaggcataaaaagagtagaagacaaaaataggaacaaagaacaagggcaacaaatagaaaagaataacaaatattgtagatattaaaccaa

SEQ ID NO: 205718 - DNA, 835 bp, Homo sapiens
  misc_feature (387)..(388): n is a, c, g, or t
gagaagcagaagctgctggaggagaaggagaagatgctggaggacctgcggcgggaacaggaggccacagagctgcttgcggccaagtacaaggccatggagagcaagctcctcatcgggggcaggaacatcatggatcacaccaacgaacagcagaagatgttggaactgaagaggcaggagattgccgagcagaaacgtcgtgagcgggagatgcagcaggagatgatgctccgggacgaggagactatggagctccggggcacctacacatccctgcagcaggaggtggaggtcaaaaccaagaaactcaagaagctctacgccaagctgcaggcggtgaaggcggagatccaggaccagcatgatgagtatatccgcgtgcgnnaggacctggaggaggcgcagaacgagcagacccgcgaactcaagctcaagtacctaatcatcgagaacttcatcccgccggaggagaagaacaagatcatgaaccggcttttcctggactgtgaggaggagcagtggaagttccagccactggtgccagccggcgtcagtagcagccagatgaagaagcggccaacatctgcagtgggctacaagaggcctatcagccagtatgctcgggttgccatggcaatggggtcccaccccaggtacagggctgaaaacataatgtttctggagttggatgtgtcccctccagctgtctttgagatggaattctctcacgaccaagaacaagaccctcgtgcgctacacatcggagaggctcatgcgattggacagctttctggaaagaccttccacgtctaaagtccgaaagtccagatcc

SEQ ID NO: 205719 - DNA, 328 bp, Homo sapiens
gttctcattttaagtaaggcaagactcttactgttcaaagtctagtcctggcagtcctaataaggatacggatagaatgtacatgtgtcttacgagattgatagaaaacacagtgctaaattttactttaaaataaaactactatattgatctccaccttcaacccaaggtattgtgagaaatgtggaaaatagtggagtaacaccggtattggtaaaattagtagtagtattagtaattatcaatgtcactgtatgtattagagaatatttgtggaccactgcaccaatagtacagtcaaataaattggagtatagagttgtttgag

SEQ ID NO: 205720 - DNA, 709 bp, Homo sapiens
ccagcctgggggacagagtgagactctgtctcaaaaaaacaaaacaaaacaaaaaggaggcatgggggactcaaacatgcaaaggcagcaagggacacacttgaggagtccgagggggattgtgggtgagatggtagaagatgaggctgcaggtataggtagggaccaactgagaatgtgtcaaaaggctcgggcttcatcctgaggcctgggaggccactagtgggttctgagcaaagaaacactatggcggatcactctggcataagccgggagacttggggcttgtgttgttaaatccctatggggaaatccctttggaaatgttgacctgagagacgagaaacccctcagaggaatacatatggcacttttacttgaattccttttcatttcgcctagaatttctgctttgcaccagctgtttacatataatttacaaaagtacattaatgggcttgattgtgtttcttaaaactcactgagaagtaaccccaagtaaaatttttccactggggcatgttcttaatacatatttatagttactgaatccatttgagaatgtagaaagctcttttgaaatgttgcgggagtacatgacatcttcaggtagggttttccccagtcctggcaaggggaagagaaggagaattaatgtctgtcaagtagctgctataggccggacactgatctagattctttgaattca

SEQ ID NO: 205721 - DNA, 396 bp, Homo sapiens
gtaagtggcaagactgggggtgggcccaagttcatatgaagccagaaactgtcctctatccaccacagtaccctgcttttcatttttaattcctttttgtacagcatcactgtgtatttctacatggagtctagattgatagtggatttctcctttgtatggtactgatatattgttacagtgtcattaaaatatcttggtgtcagcaggtcagggatgggactgactcgttagtgtccagtatttcacaggctacagtggattttcacttcattttataatgtgatcccataggccagggataaattgtgacttcagaagagtaaaggttaatattaatcacagttcattttttggacatactgttcttttacggagctgcctctttatgaaatt

SEQ ID NO: 205722 - DNA, 494 bp, Homo sapiens
aataagcaatgttaaaaataattataaacactaatgaatacaaccaaaatcatggcagtaagcacttgttaggtgcttgtggctggcaggtactgggctaagaccttcatatttttctagccccacagacaaacttaactaatctgtattactctctgcctatctaagtcttactaattctcaaaaggagttctcttcaagcctttcctgaccaccctgctcagaataacctccccattcatctcaactggttatctagcactgagtagagactggttggtattgctggtcatttttttcagtgtctgtgtctaatcccaatttcaccatcaatacctacggcaagaaccagaatagaccgtatgcattttctaaatacttagctgattttacaatgcatgttaaaagcgtcttgtaaagtaagtactaggagagtgctgactagaggagaaaatgaggagaaaaaaactagataagaagaaaaaaataaaaaa

SEQ ID NO: 205723 - DNA, 464 bp, Homo sapiens
gtggagggtgcatttgttttgtcagaggagccgggaaggcttccccgtggaagaggcgattggactggaatctcaagggcaagtggtagtgatctaggggaactgatgtacgatctgggagctcatgaagggttttaggcaggaatgggagaagatttgtgttttgaaaaagtcactttcgccgggcgcagtggttcacgcctataattccagcacttgggaggccgaggcgggtggatcacttgaggtcaggagttcgagaccagcctggccaatatgatgaaaccccgtctctactgaaaatacacaaaaattagccaggtttggtggtgggtgcctgtaattccagctactcaggaggctgaggcaggagaatcacttgaacctgggaggcggaggttgcagtgaaccgagatcgtgccactacactccagcctgggaaacaaagcaaaactctgtctcaa

SEQ ID NO: 205724 - DNA, 759 bp, Homo sapiens
gggcttcaccatgttggctaggccggtcttgaactcctgacctcaggtgatccacctgcctcagcctcccaaagtgctaggattacaggcatgaagccaccgcgcccagccaagaattttactctttattatcaataatgtttcagcatggaacagttattttaatttgcttcaaaataaattagccagattgggcacagtagctcacccctgtaatcccagcactttgggaggccaatgcaggagaatcgcttcagaccaggagtttgagaccaccctgggaaacagtgagactgctgtctgtacaaaaaaaaataaaaataaaaagtaaaaaaaataaactgggcatagtggcactcggttgtagtcccagttacttgggaggctgagttgagtggatcacttagctcaggagtttgaggctgcggtgagccatgatcatgtcactagactctagcccaggcaatagagtgagactctgtctcaaaaaaaaaaaaagggaaagaaaaaacccaaaaacaacaaagtagcccactttcctttaaaaaaaattttttttatttccgtggatttttgggaaacaggtgatatttggttaaatgagtaagctctgtagtggtggtttgtgagattttggtgcacccttcacctgagcagtatacactgaaccaaatttgtagtcttttatcgctcaccccctcctaccctttccctctgagtccccagagtcctttgtatcattcttattactttgcatcc

SEQ ID NO: 205725 - DNA, 629 bp, Homo sapiens
tggaatataaggagatttgacctgtgctgctgtgattaacagacatcagaggcatggtaccatgaggacagagacctcaactgtgtgttcatcattaagtctccagaattcagcaaaatatatggcacatagaaggaagaaaaacaacagtaactagatgaagcaaggaccacccttctggacaacaaagggagaggaatgaaagtctgacctaggaaaagacggagtctcgctgtgttgtccaggatggagtgcagtggtgctttctcagctcactgcaacctctgcctcccagttcaagcaattcttctgactcagcctcctgagtagctgggattacaggcacctgctaccacaccatgctaatttttgtatttttagtagagacggggtttctccatgttggcctggctggtctcgaactcctgacctcaggtgatccacctgcctcggcctctcaaaatgctaggattacaggtgtgagccaccacacctggccaacttatcctttttttaacatctagttttctgtgagtgttttctaatgtgcactgtagacggacatagtggtatgtgattactattcatagataaataataatttgtttattattgtgtaataaacattg

SEQ ID NO: 205726 - DNA, 484 bp, Homo sapiens
gtgtagattgcactaaatactgaagggttctcactttaaagactccatggataaggagtggcttcaggaaagctcttgaacatttaggaacatgtaagtttgcactgcatgagacttagattcattatctgactcaggaaattgggatgtaactaattatccctcaaaatatctaacaggaatggagtctcctcagtcaaaaagaaaaagaacaaggttgatattttattccttttttgaattatagtatatttgttgtagagccattaggtgctttagagatatttgacttttgacatataacatacataataaagtgtgtaaaaggtactggtctaaagtgtactgctcaaggagaatcacttgaacccaggaggctgaggttgcagtgagccgagatcgtgccgctgcactccaacctgggtgacagaatgagaccctgtctccaaaaagataaataaataaataaataaataaataaata

SEQ ID NO: 205727 - DNA, 265 bp, Homo sapiens
tagatgaggagaagaactgggtcaacagagagtccaggaatgtatcaatactggaaaagaaaagaaaaagctctcattctgtggtagcagctgagagcagattcacaaaatactcctccaaaagaggcccctgatggaaaatgttggtgattggctcagaatcagtcagaagcactcactggtatgcctcccaatagttctagagcctggtttcgttggatattgcaagaaaatgaatcaataaatacatggtgcactgtggggg

SEQ ID NO: 205728 - DNA, 524 bp, Homo sapiens
aattgcaagcagagtctggagatttttctttcttgcttctgttgtatgatatattttagcaagttctcttgagactattaaaatgtcttggtttttaggacatgtgatcaggtggggataactttgtctatagatgcagtgggttagcagttagattttgcatgtcttctcatttctttctagtttctctgaccccgggtaacctttggaaggacctttggttcttctgaaggcaggagtgaaggaggtttgagcaggtgactgatgatcactgtctctacagtccacagacaatatacgaattactttagcagtccccttagtcccctcctcccactcctccccccttaaaccaacaaatgcaaatagcttcatccccatttgctagaaattcaggcttgctcaggcaacatgggctttgttgacttgctttctccagaaaggcaattttattcctggtaaggagcaaggctatcctatcatttggaacctaaatcaccttaacggtaaaaacagcaacaact

SEQ ID NO: 205729 - DNA, 380 bp, Homo sapiens
tgggttcacacagcaacctcttcagaggtctagcccagttcttctcaagctttggcaagcatcagaatccctgaggactggctaaatagattgccaggccccatcccagagagtctggttcagtaggtcagaggtggggcccggaatctgcacctccagcaaaccctcagtggcgctgatgctgccagtcctcagaccaccctttgagacgcactgctccagggaagtaccgtgatgatgaggggcaggcaggctctgcggtggggctcggggcaggccctggcccctgctgtcatagttgcccagctttcacctatgaagtggagataacgccagcccctccctcactgcatcgcagaaatgaaggaatgaaatgtaaa

SEQ ID NO: 205730 - DNA, 860 bp, Homo sapiens
ctgcctgggggtacctctgcagcatcattgtcagtggtgaccaccaaaattatccagttccagcatggtcaagaagctgaatgttctcctgcagcccccagggtaccacgcacggggctgggcacactgcaggctcccaacatatggagaaggcagggaagccatcctctcccaggaaggacagagtgtccctccgtccagccactctgcctgcctcctccagcaggacatcatagaaatcacagcatcttgggacagacagacaaacgcctgatctctatggctgggttgtggagaggacagtgagaagagactacaaggagtaaaacagtagcagagacaaggagggggctcccctgcaacccctgagctctggcccacacctccttttctcccacgcgttccctccagggcatctcagatccattcaactgtgtgggttgaatggcagccctcaaaatatacgtcctcgcgctaatccccagcccctatgaatgggacctaaaagggtctttgcagatgtgattaaattaaagaacttgagatgagatcatcctggattacccgggtgggccttaaatccaatgacaagtatccttatgaagtgacacaaaagagagagacagaggagaggtgaggggagacggaggccaggatgggagtgacgctgccacagctgagcatcatctgagacaacaggagctggaagaggcaaagagggactctcctctagagtatctggagggagtgtggccctgataccttgatcctggtctccagaactgtgaaaataaatgcccactgtcttaagccctcctggtgtgtggcaacttgttatggccaccccaggagactactgc

SEQ ID NO: 205731 - DNA, 308 bp, Homo sapiens
tggttttttcttccttcttttaagaaatgaggaattttatgctgacagtgttgagtgaagtctctaaagatacaattttgtatacaaattatttttcgtatgtacaaattttgtatacaaaattttgtatgaaagatacacatttgagcctttggatcaccagagactgagaggcacttgaattattatgcaactgctgatattgagagtgttagtcaacctttaagatgaaagaatcttggcaagatactatgtaatgcaattgaaggaggtccaaaatggacgcttgcatgtgtctttcccgagcg

SEQ ID NO: 205732 - DNA, 647 bp, Homo sapiens
atttttaatatctgaacatcttaaaataggcaaatacccagccaatgtagaaattttatattgttaaatatcagcttaatagaggcagtatatagactcatataactgtttatcaatcacaatttgaactgctgtattatgttaaattagtgtacatggtttagatatataaagttagtgtacctagtttggaggtatgtatacacacacctgcacacacaaagagtgagagagagaaatatctaatgccagtacagcctaaaatttttacattgatatctgccactgtatgatttttatgacttgaagctaccttggatatagtatatgcttggtaaataattgctaagtaagtgaatggggtaatgaattgtatccattgcgctaccttaatttattatttatacaaaattgttaagaatcaacatgcaaggtacaagcctaaaaattgtaaagtacagtgttttgtcttgttgtcactcagaaaggaagaaaattaaccaaggagtgaatttgtcgtcttaacctaataatctaaaggaatatatattactttctctgtaaaataagagatttctgacaaataaatattttcatgaagtctgattgggccatattttggttgaaagtaaggaaaatttcatgaa

SEQ ID NO: 205733 - DNA, 518 bp, Homo sapiens
acatccagtgagggaagggtaaagggaagcttttattagcaaaaagggagaggttcacacaagctgcttggaaactgagttcattggttcctgaggctcaaagccaagttgtcagttcattggtggcgatgccattactgggcaagtgttcttttgagtgcatcttatctgaattactgcagtcctaaagaatggcagtgataaaccatgtgaaagcaggagttgcaatgaagggcgtgaaaggatttcttgtggggtttttagaaagtctttggaaacaaggactctttttgtctctattttgtcttggtctgtcaaaaggtgatttcatcctaatgtctgcaactttcacattattaaaagatatgtgcattttaaatttgaataaaaattgtggccaggtatggtggcacctgcctgtaatcccagcactttggaaggttgaggtgggaggatcatttgagcccaggagttagaaattagcctgggcaaaatagcaagaccgtgtctcaaaaaaa

SEQ ID NO: 205734 - DNA, 436 bp, Homo sapiens
tgacagtgaattctggttttagtaataaggacgtctgtgaagaagctcctgttgagtacctaattcatagaaactccaactctgccttgattcacagtttataaagaactggaagtaagctttgcatgccaggccctctgaccaaacctcttttgtccaaggttattcctccagcttccctgcctgcttctcttctttctttgaactgtgcctactgcgtaccagcatactgcctggactacctatctacccattcaggtttctttcccagctctgctggaactttcttgattgcttactcccttcaagtgagtctgtctatgccctaattcctgcatgtccctgttctgccccataaatggctgaacccgctctgggttggactctgtgtgagtagcatttacatcagtgaagtatactctttaagctctgcaat

SEQ ID NO: 205735 - DNA, 801 bp, Homo sapiens
gaactaccaataacaagaaaagaatttttttttgaaataaaatggttcccattataatggattctccaggtatgtggtgtgctagctggatatcttttggcataattgttacacatttggcatggacacacacacacacacacagttctgatactaaagaatagcttaaaaactatcagactagttattctttaacattccgttcagccccaaggttctgggattctgatattgtagccaacctaaactcaaggggctctgcacacatcattattaactttgatcttggcagcattgtgatactgtgtgtatttcatgggccttccccagagccactccagaatgtctacttggagggacttgggagtagtaatccggttggaagagagctagacgtgtccagcagctgcgcttgcatcatagcaaagcagtgtttctgttcagactgtggattgcagatcttaggaacagcttaatttaaaagggcaagtcggaagaattcaagtacactacagaacagagtttttgttttattttctttttttcctgatacatgtgatgtgatcacctgacagggactcattaccagtaagaaaagaaagacatgattattataactgtatgcttcattctcatgagtctcatagaagcagaattgttgttttttcctccagatagtcaactgattattccaatggcatttgtttcttttatttattccccaaataaactgggtactcatggccttaacgttgaaatatagtaataataatatgaaatgatatcagtactactgctgct

SEQ ID NO: 205736 - DNA, 381 bp, Homo sapiens
tgcaggtcagctcacagcccgcagattctaaaacccctatgctcacagcccaccatgggtacgagttcaccgacataacacacaggaaggagttccttagatccccaagaatttgagtgtttcacgtatcctacaagaaggaaacagagatgagaaagaaaaatgaccacgtccatttttaaaataaccaaataggaggtctataagttaaaagtatggctattaaaagatgtgtctgaggaaattacccagagtgtatcgctggaagaggtggcagtttattgggattttccataactgatactctgtagtgtgtaagtctgatgcccggatgttgacgcacacatgtgacgtgcgcctccctccagccttgttaccatg

SEQ ID NO: 205737 - DNA, 572 bp, Homo sapiens
gaagttacaataaatgtagtcttttgtatttaaccacgcgaagggtagctgcttctggcatgacctctttaaaatagaaaagtaatagaaagtattccgtaacaatatgacaaggatgtgacagtttaatgtatgtatagtatatagtacaggttgaacacctttaatgagaatccaaaatctgaaatgctctaaaattggaaactttgaatgccaacatgatgccacaggtggaaaattccacactttacctcatttgacaggttgcagtcaaaactttgtttcatgcacaaaaggtataaaattatcttcaggctatgtaaggtatgtatgaaacatagatgaattttgtgtttagacttgggtcccatctccatggtatctcactatgtatatgcaaatataccaaaatgaaaaagtcaggaccaggcatggtagctcacacctgtgagtactgggattccagtactttgggaggctgaggctggggggattactccagaacaagagtttaaggtcagcctgggcgacatagcaagaccctgtctattaaaaaaattaaaagctccaaa

SEQ ID NO: 205738 - DNA, 579 bp, Homo sapiens
gataaccttaattacatcctgagcaaagagttcggcctctgccttgattctagatggagccttcctttatctctgatgtactggattggcttcctgctggaaatagtgagcttcctgctgaggccaatttacacctatcgacacccttcaaccaccacagagtgacattgtcaaatagcgtgttcaccttctcttacaagaaggctcagcaagatctggcatataagccactttacagctgggaggaagccaagaagaatgtacctgagtctgttagaaccgtggagtgggtttcccttgtggactggcacaaggagaccgtgaagtccaagactcagcgatttaaggatgacagagatgtgcatgtgggtattgttaggtgatgtcatcaagctccatcctcctggcttcatacagaaggtgacaatggcacaagcccaggtcctgttgtctccctttcacacaatgcccaacttattgtcttcctcatgtcatcaaaacctgcccattccctggctcaaccaggagctttctgtcctaatcatataccagaggaaatacaatgtgatttgctttttc

SEQ ID NO: 205739 - DNA, 778 bp, Homo sapiens
gatgttagggttggggctgtgttttaatcacttctctgattttagcacttaacagagtacatgagatatagtacataagcccaatcaatgtcttctattgggtaatgagactgaaattctggtcccaaaaccaacttcataattatcatagatcattcctaattatgccaaaacacgtggcgaaaaagtgaaatcaatcagctgattgctttgtctacataataccaaaacattaatacaaatgctgctatgtcaaagccatccaagtaactgattatttggcattactaaatgctttggggaagattctaaacttagacctatttcctttcagggttgtgtgtatgaaatgggagtgtgtttgaatgttgggttatttgtagtgtcaccaaacaatcatgagtgaatgtttgagtatcttttattttccttttactttgtgagctcttagcatgtttaatttggtttcatgttaatgaaaagtttgttggtgcatatagaagattgtcttttaggaatattttgggcattgaaaaacagaaaacctaattaaaactgtcttggaaaaatgagaacatcatcactattatcatcattattttcgtcactgaagaaaaaggtcagaagtaaaggaggctctagtcctggtgttatctgaagtttattgatcccatcaagaaccccaatttcttcccctctgtctacccttccatccttagggtcaaatatctgccctggatatttattcttctaagagttacaaaatagctgcagtagt

SEQ ID NO: 205740 - DNA, 589 bp, Homo sapiens
ggcaagctcccaggaggctggacactggcaggggccctggacacagggctgtggagccacagtgaggagttgggcttttgtcctggggaacacgggaagccggtggagggttccctgccaggcactgacatgacctgctttagatttggctgtgatgtcctcatacagagaaaggccccgaagatggtctctgtgtctgagtctaccgctctgtttcttccattcttctgcttttcttcatttttggggtactgcatcccatttaaaattctagttacaactgggcactcccctctcccagaagaaaagccacacccagacacccactctattttgccaatcatttcaggggccagggtcactcagggtgagcttttctggtctagcccctcatctccaagttgcagggacgctcactgggctcagagcggggacattttcaccgagttaccctgagaagatctgagatgagtgagaaggtgtgtctgaattcttacatgggggcctggaagggctaacgggaagggttggtctttatcacccctatccttgaaaattacagaagcatctttcaaatacctgggctaaa

SEQ ID NO: 205741 - DNA, 546 bp, Homo sapiens
tatgcagcgttgctccctttactactcttccaacctctgcaacattttagtgggagcctccaatgtaccaagatctatggtaaacatgaagggatataacaagaagaagtgatcactgttctggtataacactagttataccacattctagtgtccatctgctgtaaatatctggaacattctaaagaatttttaaaaattcagttgtttttgttttcagttctcacctctcccccaagtactagtctcatgttgtcaaatgcccactggatcttgatatctgaatattgtactgttatctcaaattgtcaagccatcttatctaactatgacttaacttttaagactcaatggaaatctctcctgctagttcccagaactttggatttgccttttctttttaatggttttataattcactgttattcagactgttccatttgctcatccctaatatccagtcattgtttaacttgattttcttttttcctcatactgccttgtggctgtgtctcttctttttctttctcttcactactattctag

SEQ ID NO: 205742 - DNA, 336 bp, Homo sapiens
ggataagtgttgaagtagggctacacgctaaatatttcttatgtgataaaaaaattataatgacctctagtctttgaaacagagaataactggtgatgagtaaccagggagtaagttctttcagtcacaatcatgtagaaacaaagtgccttagattaagtgatagttaaattgataattttagcagaccaaacttcaaaatacaaaattcagtaaggtaaacgaattattaaaactataggaaaagttaattaaaattcaagggctgaaggttaaaacattaaaatatatcctaaaaattataacatgctcactaccaatattttcttcacctag

SEQ ID NO: 205743 - DNA, 203 bp, Homo sapiens
gaaaaggttctagagatggatggcagtgatggctgcacaactatgtgaaggtgcttaatgccaccgaactgcacacttaaaaatgattaaaacggtaaatttcatgttacgtatatttgccatacacacaaaactctctgtttaaatattttgaacatgtaatctgtttgcctgtcaagacccttaatgatacattgatatat

SEQ ID NO: 205744 - DNA, 841 bp, Homo sapiens
gtggaacaaaaagaaatagtgttgttaccatagctagtttatatagctagttgaaattctatttgaagtgtatatattcattctgttaaacatatatatggatgaacttaggttcaaaatgtaagtctactccttaccgcctatagttttatatcctctacctgataaccctgccactatcattccatttttgttgttctatccattttctaaccctattactttaatctactttcatccacagaaatttggcatttcttatcttcaaaacgctgtggatcttatcgttcatctcggatggtttttgtttgtttgtttgtttttttgtttttttggtgagtcttatctcttctagacacgcttgaatcagttgagatccaaaatagcaacatatagtcttaactgaaagaagttagaaagaaaaattaataataaattaagtagaaaaataaggtatagcattaatggtttagtttaagaaacagtgtccttaggaatagctactgagggaaaaggaagataactaacatttgtaagatacttagaactcacagactgtgtcgggagttttccaaaaattactttaattaatccacacaataattctgtcaagcaggtgttgttatatgagccagaggctcaggcgggggtaagagacttgcccaaggtcatacagagagtaactcgcaaacctagatgccaaccaaagaccctttcattttgttgttccttctcctgtaccatctcatatattttaaaatggctttttattagattgtttttcagtcaagaatttttggagttagctaggaagttaatgtgtaagtggcagtttgaagat

SEQ ID NO: 205745 - DNA, 489 bp, Homo sapiens
gagaaaaagtgctgagaaacctacaactatggcattagagacctgcaaacccaggagaagggggatgacaggatagagatgcaatagtaaggctaacttcatggatgaaggacacagagtagaaggaaaacttgaaaaccaagaacgtggctttaaataagacaaattgccacatgaatgagtgtacacacccaacataaatcaaaaggaatttctccaaaggattctgaggacaaacttagccctgtataaatgcatcctgtctacttaatcacaaaaagcattctgattgcctccaaacataaggcaacaaaattgcactgagccataccagctgtttgtcgaaggggctctgccacagtctcccaactcccaacttttcttgtctgtcccaagaaagcctgccgctaatgagatggatcaaaagttagggctagattctattttcaagaagaaatcaactcagagcctgatctagaaagtaactag

SEQ ID NO: 205746 - DNA, 501 bp, Homo sapiens
cttaaattgcgtaaacatgcacagatactggttggttcagctcccagcatccccacagtataactttctaagaaccactggtgtgttaggagttaaccacattttcaaacaatactcagtcatagcatatggcacggtagcctattgcttaccatagcctctccctaaagggcagcaaaccagatggtttgagtagggcctttggtgtaattatgacagacacaaagaaagacataaccaccattctccctcaataatatcatgcttcttgttttccagtatttgctatagttaattatacttaatttttgaaaatttgtttttgcagtttgattgttcataacaaagttccctttccaggttggggaggaaccattcaaatatgtatcattaagtgtctgcatatcatttcccattcatccttctctagctagtagatgcaggccacatagagtggcatctctcattcccaagtgtgagcaattttcttattctggcaaa

SEQ ID NO: 205747 - DNA, 892 bp, Homo sapiens
tatgctgtcttttattgaaacttgtgtgtgtgtatatatatatatttctctttctatagttattaatatgttcatggaagtattacttatacaaaggagacttgtaagaaacccagattgctatgctgttactgctgctaggttctaggaaaataccctttaacctttaagatttttacttgataaatttgttgcaccattactaatatttcaactgacaggtctttatgtattcctgaaaggtttaatttcttataagattttttttagccaacacagatggatcattagcaattcaaaatgtcaaattctaaatgacaacaggcaataataatgtctaataatatctatgctctgcaggtccctgattctggtcttgaatagcggaggaggaaaagaagatgatgggggaaaagaaaagaagccatttatgcatccctccctaattcagtatccgagcatgagggagtgtcaagctagtggggaagaagagagggtttagttttgaatgaagttgggagtttttattattgcactgaactaaataggcattttactaaagtcaagactgttcttgttatttaaaggaacgggatcatcaatggaactctttgagatttcatccagaggctgggaaagaacattcatggtagcttttattattatttccattattgtaagttgaggaagagaaaacccaggaaaatatacaaagagtgattggaattaataagagtaaaacaaggtggctgtataaaaggtcaatattcaaaatcaattttgttattacttactagcaacataattttttttttttttttttgagacagagtttcactcttgttgcccaggctggagtgcaacggcgtgatcttggctcactgcaacctcc

SEQ ID NO: 205748 - DNA, 605 bp, Homo sapiens
gcagaaatccgtctctgtgagcggaggagggtgctgcttatgcgagagcaggtttgggagctcactaaagcaggtccctgattctggtcttgaatagcggaggaggaaaagaagatgatgggggaaaagaaaagaagccatttatgcatccctccctaattcagtatccgagcatgagggagtgtcaagctagtggggaagaagagagggtttagttttgaatgaagttgggagtttttattattgcactgaactaaataggcattttactaaagtcaagactgttcttgttatttaaaggaacgggatcatcaatggaactctttgagatttcatccagaggctgggaaagaacattcatggtagcttttattattatttccattattgtaagttgaggaagagaaaacccaggaaaatatacaaagagtgattggaattaataagagtaaaacaaggtggctgtataaaaggtcaatattcaaaatcaattttgttattacttactagcaacataattttttttttttttttttgagacagagtttcactcttgttgcccaggctggagtgcaacggcgtgatcttggctcactgcaacctcc

SEQ ID NO: 205749 - DNA, 330 bp, Homo sapiens
aagaaatgcattagtgaaaagtattaaaaaattacctttgacatctctagcacacggagcaattctagatggttgataaaagagcataaatcaatcgacacaaatatccccttaaaccttgtctttcatgtccagtatttaattcttcccatttctagtatgaagataggaattccattatcactaagaaaatccactctgggcatccaagtcgatatttctaaaaattcactcactattaattaatgaatagtgcaaattagggaaataacttgcatatgtgttagtgtgtgtgtgggggaatactcaactaaaaaggggagagagaaa

SEQ ID NO: 205750 - DNA, 596 bp, Homo sapiens
atgggctttccctctccacggatgcccagccttctgggcaggcgcatggccgggcggcgcccagcccgcagccccgatccggacaccccactgcatccctcccttcccggtcccttcctcgcacgggcgcccgagagacggacaaagagttggggccaagtttgagcgccgggcacggccaggctcagggaaggaaggtccccggaagacacctgggtaccagagttggtgcgaggaggaaaagctgggaggcgaattcacaatcctgggggtggagggcaggcaggggaggggaatcaggccaatcccagccgagtgagcccccagcgagctggggctccggatgggaggcctgtctcgcgctccaaagaaaagcaaaccgccctcccaggtccgcccggattgccgaagcccctctggaaaaactccttcccctcttacaccaaactttgcgccgggcctcgttccctcccgggtaggcagcggcgcaggaagggttaagccagcccgtcccagctgacagtcagctgattgggccctgattgacagctccgaaaagtttccttgtttctatactattatgctaatcgcggccg

SEQ ID NO: 205751 - DNA, 406 bp, Homo sapiens
gagaagaaaagatacaattaagaaatttgtgtgctaaatgctagggtaatatgggttctagaaattttggcacaatctttttggtataggtgttagtaaaggggcatcagctgcatctattttggaagaaaaactgagtttgacaataacatttcaaaatctttattattttagagaagaaattgcgtggccgatccaggaacgctatctcagcactgaacaaagactacttttattgaagtcactgtcattttacaatgatctgatttgcttttgatagagtcctcagaacatcttggagcaaggtgctcaggcttcaagttaagactttgctttttataaccatgaagagttttttaacattgtaaaaaagtatgacatttaaataggggaaaactaacaaaaa

SEQ ID NO: 205752 - DNA, 1867 bp, Homo sapiens
  misc_feature (10)..(10): n is a, c, g, or t
  misc_feature (27)..(27): n is a, c, g, or t
  misc_feature (50)..(50): n is a, c, g, or t
  misc_feature (64)..(64): n is a, c, g, or t
  misc_feature (90)..(90): n is a, c, g, or t
  misc_feature (97)..(97): n is a, c, g, or t
gatccccgcntcctgcttctgctgctncctgcttctgccgcttcctgctnctgccgttgtgttntctttcagggtcttgtccagttcttntcttcantgattgcttttcctcttcactgcatgcggtcatgattttatgctcagcttcaagttcaaaagacattcaccatggagattttgagacacaaggatattattgatgaccttgttaaatctgggcataaaatcatgaccgcatgcagtgaagaggaaaagcaatcaatgaagaaaagaactggacaaggtactgaagaactatgataccatctgccagattaattcagaaaggtatctgcagctggaacgggcacagtccctggtcaaccaattctgggaaacatatgaagaacttgggccatggctgacagaaacacaatcaatcatctctcagcttcccgccccagcccttgaatatgatactctaaggcagcagcaggaagaacatcggcaactgcgtgagttgatagctgaacacaagcctcatatagataagatgaacaaaactggccacagtactgaatgagccctggggaaggcttttctatccaagagaagtatgtggcagccgacaccctttacagtcaaattaaagaagatgtcaaaaagcgtgctgtggcactggatgaagccatttctcaatcaactcagttccatgacaagatagatcagatccttgagagcctggaacgcatcgtggaacgtctgaggcagccaccctctatctctgcagaggttgagaagatcaaggaacagatcagtgaaaataagaatgtgtcagtagacatggaaaagctacagccgttgtatgaaactcttaaacagaggggagaggaaatgattgctagatctggggggactgataaagacatatctgccaaagctgttcaggataagcttgaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagagaccataagggaagaaatagatggactacaggaggagctggatatagttattaacctaggttctgaactcattgcggcatgtggggagcctgataaacccattgtcaagaagagtatagatgagttaaattcagcgatgggattctctaaataaagcttggaaagaccggattgaccaacttgaggaggcaatgcaggctgccgttcagtaccaggatggactgcaggcggtatttgactgggtagatattgcaggtggtaaattagcttcaatgtctccaattggaacagatctcgaaactgtcaagcagcagattgaagagctaaagcaatttaagtctgaggcctatcaacagcagatagaaatggaaagactgaatcatcaagcagagcttttgctaaagaaagtaacagaagagagtgacaaacacactgttcaagacccattaatggaactgaaattgatatgggatagcctggaggagagaatcatcaacagacagcataaactggagggtgctctattagccttgggtcagttccaacatgccctggatgagctcctggcatggctgacacacaccgagggcttgctaagtgagcagaaacctgttggaggagaccctaaagccattgaaattgaacttgccaagcatcatgtgctccaaaatgatgtattagcccatcagtccacagtggaagccgttaataaagcaggaaat

SEQ ID NO: 205753 - DNA, 528 bp, Homo sapiens
ggtcgttctacacggatcccccctggcttgctcaggtctggggggactgataaagacatatctgccaaagctgttcaggataagcttgaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagagaccataagggaagaaatagatggactacaggaggagctggatatagttattaacctaggttctgaactcattgcggcatgtggggagcctgataaacccattgtcaagaagagtatagatgagttaaattcagcatgggattcctacacagtgcaatgtctagtgataatataaatactaaaagcaacttgttaaatgtataaataaatgtgatttatttttgctccttta

SEQ ID NO: 205754 - DNA, 1018 bp, Homo sapiens
ggtcgttctacacggatcccccctggcttgctcaggtctggggggactgataaagacatatctgccaaagctgttcaggataagcttgaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagagaccataagggaagaaatagatggactacaggaggagctggatatagttattaacctaggttctgaactcattgcggcatgtggggagcctgataaacccattgtcaagaagagtatagatgagttaaattcagcgatgggattctctaaataaagcttggaaagaccggattgaccaacttgaggaggcaatgcaggctgccgttcagtaccaggatggactgcaggcggtatttgactgggtagatattgcaggtggtaaattagcttcaatgtctccaattggaacagatctcgaaactgtcaagcagcagattgaagagctaaagcaatttaagtctgaggcctatcaacagcagatagaaatggaaagactgaatcatcaagcagagcttttgctaaagaaagtaacagaagagagtgacaaacacactgttcaagacccattaatggaactgaaattgatatgggatagcctggaggagagaatcatcaacagacagcataaactggagggtgctctattagccttgggtcagttccaacatgccctggatgagctcctggcatggctgacacacaccgagggcttgctaagtgagcagaaacctgttggaggagaccctaaagccattgaaattgaacttgccaagcatcatgtgctccaaaatgatgtattagcccatcagtccacagtggaagccgttaataaagcaggaaat

SEQ ID NO: 205755 - DNA, 457 bp, Homo sapiens
taaacgaacagattcctctcaaaaaatacaaactactacaactcatccaatatgatataatttctattaagaaaattattttacagaggcagaaaggataaaatttttttttaagatagaagtcccaggtactcaggaggctaaggaagaaggttggcttgagcccagcagttcaaggctgtaataagccataatcacaccactgcactctagcctggatgacagattgagactgtctcaaaagaaaaggaaaagataaaggaaaggaaaagaaaaagaaaaagaaaaaaaaagaaaaaaaagaaaagaaaaatattaaggaaattgaatttgtaatttttttttaaatttatttatttatttgagatggagccttgctctgtcacctagactggaatgtagtgcacaatctcggctcactgtaacctccgcctcccaggttcaaacaattctcctg

SEQ ID NO: 205756 - DNA, 330 bp, Homo sapiens
ctcctcttcttctatatgcaaaggctgcacagctcctggttcacctgcacctctccagaccaccatggtgcctgcagctctgagggcattttaaatcatcacagaacaacaagcatataagcattatgagcgcctctggacctctgacgtgccttgtggaggcctgccaggcccacgttttaatttacatgaactcgatgccctttttgacagggagagatctgtttctttatttgttagcctttcccctggacctgctagatctggaccatccccaggaaaggaaggtcacaccacaaagataaatataaacaaaatgagttaattaaa

SEQ ID NO: 205757 - DNA, 243 bp, Homo sapiens
tcaccactgcactccagcctgggcaacagagtgagaccctacctcaaaataaaaacaaaaaacagagaaaagaaaagaagaagaaagaaaaaaatctaattagctattgaatgaaaagttggtgtgtaagcaaaaaggaatagaaacagtaaagcagggcataaatttgctcttagcaaagcaagtatttattgctggagggataattaaaattattattcttcctcctcctcctcctcctct

SEQ ID NO: 205758 - DNA, 444 bp, Homo sapiens
ggtgggcggatcacgaggtcaggagatcgagaccatcctggctaacaaagtgaaaccccatctctactaaaaatacaaaaaattagctgggcgtggtggcgggcgcctgtagtcccagctaatcagaggctgaggcaggagaatggcgtgaatccaggaggcggagcttgcagtgagctgaggtcgcgccactgcactccagcctgggcgacagagccagactgtcaaaaaaaaaaaaaaaaaaaaaatcaatatattcataggttctggagattaggacatggacatctttgggaagccattattctgcctactgtacctgagctttcccaactgggtattctttatttttattatatgtatatttaaaatttatgtttaattaaaaaaattaaaaattatatatatatttatcatatacatgttgttttgaaatatgtatat

SEQ ID NO: 205759 - DNA, 170 bp, Homo sapiens
cggaggtataagagcctccaagtctgcagctctcgcccaactcccagacacctcgcgggctctgcagcaccggcaccgtttccaggaggcctggcggggtgtgcgtccagccgttgggcgctttctttttggacctcggggccatccacaccgtcccctccccctcccgc

SEQ ID NO: 205760 - DNA, 443 bp, Homo sapiens
tgagaccctgtctcaaaaaaaaaaaagcattccagagtttcaagttattcctggactcaactaactggaggagcagagccatgaggcagaaggtggagaaaaagaagaatgacattcccaatggggttgagtgggaaaagctggagtctgggaaaaggcaaagagaagtaggtttcagagaaggtgatcaattctgtttgtacctcagtgcccagtctatgtgaagagatgtggctggaattaaatacaggctctaaaaaaaggccagagtcaggtgtagaggtctgggaagcttcagattagatgtgaggaaagccaaggacatgtattatgaaatttccaaaagactgaatgagagatgaaaaagaatgctgaggtcgccatctggccagtgctctacttgcaactctgattttctctgatttaacttagtaaggcaatcc

SEQ ID NO: 205761 - DNA, 296 bp, Homo sapiens
tgtcaatgctcaccagcccaaacccatgagaaacacaactgcagttgaacaaagtagggtctgttgacttatttcacaatgaggtgaccacacagcatgaggaatggaaatctcagaagttgcatgttagaaggctgggagcgccaggtgtggtggctcacgcctgtaatcccagcactttgggaggccgaggtgggcacatcacgaggtcaggagttcgagaccagcatggccaacacggtgaaaccccgtctctactaaaaataccaaaattagctgggtgtggtggtgcgcgc

SEQ ID NO: 205762 - DNA, 479 bp, Homo sapiens
cactttctttattgtccattcaaaacacttgctgagacctagggtgtcagattctattttgcctgttatttgacattcccttctcttcgcaggccatttagctacatatttcctattggactatctgctttggcatttagtaaataaataacgtaagtcactgagggtatgggaagaaatattgagtcataaataccattttctcttagggaattttcctctgaaggcttgcaagtgtggtatagttcagtgtagtgctaccagcttctgttctgaggacacagctaattgggttgataatccaagataatttaaacagattatttaacctttttatgttagtgtttctattttgtatagtggttataataaaaccatttactacttaagattaagatcttcatagatctgaagaaatattgtactagaatgcttagtgaaaaatgtctgacacataataaatactccatacattttgg

SEQ ID NO: 205763 - DNA, 532 bp, Homo sapiens
ccctcacccctaactccctatttggttcactccagaccctgagctaggacatcaactatgggacacgtcatacaaaacacgtccagaactgagctcttggccgtccctgcctttctagcctgcctggcccggggatggcagttccttcctcctgtctctcttcccagaccagagtccttggagttgcccctgattcttctctttctctcacatcccacatccggtctctcagcaaaccctgtccattctaccttcaaattacaggttgaacggcatgacagtgccacattcaactgttctttttttttttttttccccactgtaatcttgacctcttgggctcaagcgatcctcctgcctcagcctcccaaagagcggggataacgggtgtaagccatggcgcccggccaagtgtgagtcctttaaagcggttggaccttgcgcaaggtggtaacccttcccctgccacgtctcaaacacctcttggtccagctactatgctcccatcaggacccaatgggacctatgtccc

SEQ ID NO: 205764 - DNA, 389 bp, Homo sapiens
tacacacgcacattgtgataaccacagtgtacaataaacagtatgcccatctccaatttctctacaattcttctcagttattggtgaaagcagtgcatacccaaaactagatttgcaccagaacagtttcaagttgaatatttgaaggaatgcccacatctgaaagaagcaattgaaattgatttagttcttatcatagctgacaaagttacagaaaattttaaagaatgatacagtgaaaacctacgtaatatgccccacctagatattagttattattttgccatatttgctttattatttgtgtgtgcacttttattgcttgtaataccattatcacactgaaaacattttaataaaaaatagccattgttacatttccaaaggtt

SEQ ID NO: 205765 - DNA, 135 bp, Homo sapiens
cctctatgactgcctctaaaagagataccatttacctgggtgcatgtggctttcatgctgaaggcataatacaactgagtaaaagttaaccctctgattatagactactagccccacagtaacattaaatttttt

SEQ ID NO: 205766 - DNA, 185 bp, Homo sapiens
gccgaggattcaaaagtgcactcttctatactctactttttcctacagagaacctattaatatcacttcaaactactgtttcacagaataatatatgcgctctcgtctttcctatttcaaagtatccaccacttaaatataaaagcacttctgatttctggtagatatagaagagtgcacttttg

SEQ ID NO: 205767 - DNA, 456 bp, Homo sapiens
tgggaacccctgcctgtcttgttttctgtgatgtttccccggtgcctagaccagagcttcacacataaatcattgagtattactgaattgaaggaattgttacatattggacacaccagagatcacacggatatttaaaactgagtagcatgagcaactaacaatgaaattagacatcaaaggattcaaattttcatgggccttgttgccaatccacagcagtgcttttcaaacactgatgaataccagaaacaactaaagaaattactcaaaatgggccgggcacggtggctcacgcctgtaatcccagcactttggggggctaaggcaggcggatcatgaggtcaggagatcgagaccatcctggctaacacagtgaaaccccgtctctactaaaaatacaaaaaatagccgggtgtggtggtgggcgcctgtagtcccagctactcgggaggc

SEQ ID NO: 205768 - DNA, 218 bp, Homo sapiens
gggaagctttcagtcaggctagctgagggaggcttcggtttccccatgacttagggagaggagctgggagggaggtcccgggcccagggccacatgggaagaactagatagaggctgagactagtgtctcagggccaaatgccaagtcagggtgggctctgtgtgtcctctcatctgaccacagtgtcaccctgagcagggaggtggggcctagagct

SEQ ID NO: 205769 - DNA, 368 bp, Homo sapiens
ttgctttacccattccaaatagtggttagatggctaagagtgctcttaacatttccaaatttagtttgcttttacatcaaagttcatttgttttatgaatgctgtccagtattaataatttaatgaccattcactactgtgtgctcagaacagtaccaagtaataccgaacacagtaaattaaccaagttctgataactcaatttgtatatgtcttatgcacatgaacagctttccacttcacaccaaccctcccaactatgtctaggacaggtgacctaattaatccaaaatctctttcttatcctttgagtgcttaaggtaactaaacattcaccatattattttttcccacctgtattccccaca

SEQ ID NO: 205770 - DNA, 763 bp, Homo sapiens
ttttgagtggctgtggataaaggcaaggggtgattttattttactggtcatttaaagattacattctttttaaagaaaaaaatctatgatagttttacaggatttcaaggcaaattcatcagttttgtttcaaacacacccaatgggtgtttcccttgtctccaaatgaaaagccttaatccaccttttcctacatgtgtttctacagcatcttctggctgtgagtttgtacaccactacagaattattattactatttcaactcccatgaaatgtactacgactggcaggcatatgagttctgaaatttaaagtgcgttactagagaaactaaaactcatgttggccgcaaggatggacaacaatacgaaatgctacagatggcaatgggaggcctaaaacaatgtgcagttcctttctattctggtttgccccattgtgttctgaatagactgaatcactgcccagcttcagggccagcctctgaaaggccccattgtaagggctatgctttccagagcagagttaaggttgctgtagtaaccttcactatgaatttcctgaccagtgtgatgaaaatctcaactgaactgcgacagtactacagctacaaacaagaccgcgaaatgagcgtgggtctacccatttagggggtctttcttatctgaacatagcccactatctactacttcaggcatccacattgccaaagaagggactaaatttctacaagccagagcttgagaggtgaccttgttgtata

SEQ ID NO: 205771 - DNA, 260 bp, Homo sapiens
gccgtagccgtgtgaacgctcttcgggctcgcgtcgtcgacccgcagccgcggggcggactaagaagggagccgcctgctgcgaggccgccgggctcccggtttaaatgtgatactggtgtagatctccttgttctaagctatattcatccaacaagccataaagccataatgtggtataacatcctttttgagaggtgaatattattgaatgaaaatggctgacagaagtgggaagattattccaggacaagtgtatat

SEQ ID NO: 205772 - DNA, 593 bp, Homo sapiens
gcctcacaaagtgcggggatacaaatgtgagccattgtgccctgtcactaacagcttttaatcattccattaatcatgtgcaaataaaattaatgacagcattatttctgtagtttacaggttagtatcttaaagtgacagccacatcactaaaattgtttgcattattctactttagagctttaagatttagaattatgttaatttgatttaagacatcattacttataatttctcatggttgttgggaacagtggaaacaagtaagttgctccccactgacctcattatagtgagataatcattgaatggcgtgcacatgattcaatagcagatacactcatggggaggaaaaacaaggaggagaaataaaggaatctttgatgatgcatagaatcagaattcattatccaaacccaggatgaatctaaacttgctcatcttagggtacacatcaaaacatacatgcatcatttctctagcctgttttttagttctggggttgcaattccatttcaaaagagaggagatgtttaaaagagggtgttgttttgcagagtgaaagtttatcataagtcatactgcccataatc

SEQ ID NO: 205773 - DNA, 897 bp, Homo sapiens
ctaaacctataacctccaaggactccatttccaaataccagcaaccacatgtgtgagcttagaagaggatccttccccaggtgagccttgagatgaccctggcctgtgacttgatggcagcttttgagagactgagccagaggcctccaggtaagcccttctcagattcctgaaccacagaaactgtgagataatcaattttattgatatcttgtggatattgatatccccagttttattgtggaatagataactgccacacagctcctgacaactggcatcttgacacatgttctgtgctccaggtcccagtaactgtgcccatccattgttaccacaggtcacagtggccctggccctggggcattatactctctcttggtgtattagtccattcttaggctgctaataaagatatatctgagactgggtaatgtataaagaaaaagaggtttaatggactcactgttacatatggctggggagacctcacaatcatggaggaaggtgaaggaggatcaaaggcacatcttacatggtggcaagacagagagcatgtgcaggggaattgccctttataaaaccatcagatctcatgagacttattcactatcatgagaacagcatgggaaaaacccgcccgcatgattcaattacttcccactgaatccctcccatgacacatggggattatgggagctgcaattcaagatgagattttgggggaagggcatagccaaaccatatcattcttccctgggcccctcccaaatgtcatgtcctcacatttcaaaatacaatcatgccttcccaacagtcctccaatgtcttaactcatttcaacattaacccaaaagtccaagtccaaagtctcatctgagacaaggcaagtccctt

SEQ ID NO: 205774 - DNA, 789 bp, Homo sapiens
tgagatggagtctcactccatcacccaggctggagtgcagtgatgcaatctcggctcactgcagtctctgcctcctggattcaagcgattctcctgcctcagcctcccgagtagctgggactacaggcatgtgccagcacgcccagcttgttttttgtatttttagtagagacggggtttcaccatgttggccaggctggtctccaactcctgacctcaggtgatctgcccggctcagcctcccaaagtgctgggattacaggcgtgagccaccccgcccggccaagtttgccatcttttatgggtgcagtttgtggtgccgcaaaatgatgatagtagtaacatcagagagcattgatcacagatcaccataacaaatataataatgagaaatttgaaacattgtgaaaattaccaaaatgtgacagagacatgaagtaagcacatgctattggaaaaatggcactggtaaacttgcttgatgcagggttgccacacaccttcaatttgttaaaaactcagtatctgcgaagtacagtaaagcaaagcacaatcaaatgaggtgcgcctgcatattacaaccaagaggcttttcgcagaaacacgagtgtgcttcaacattcaaaaatcagttggtgtaattcaccacattaagataataaaggaggccgggtgcggtggctcacacctgtaatcccagcactttcagaagccgaggtggacagatcacttgaggccaggagtttgagagcagcctggccaacatagtgaaatcctgtctctactaaa

SEQ ID NO: 205775 - DNA, 385 bp, Homo sapiens
cccatgctgtgtgctacagagatatggaaaaaaaaatgacgtattttcccggctcttagggagctacacagtggagatgggtacagggtggggagaaatactatctcatatagctgacatttagagagtgtgcaagcactgttagagattccctatattaacttatgcagtcattaccacaacagatgaagaaacaaaatatggagacattaagcagtttgttcaatgcccaacagtaaatgacaaaactgggatttgaacccaaagaagtctggtgccagaacctgcctttttaactacaatcctatacagcctcttaactataactctattaattatctatacagtatagtgctaaaaaatgctaaaagtgggtataggactg

SEQ ID NO: 205776 - DNA, 854 bp, Homo sapiens
ctgattgtctgcctcagcctcctgagtagctgggactacaggcacgcgccaccatgcccggctaatttttgtattattttggtgcagatagggtttcaccatgttggccaggctggtctcgaacttctgacctcagggcctcccaaagtgctgggattacaagcgtgagccactatgcccggcctgcaattattttaaaaagtagttcttcccaggttgcttttccctccacagtattaaacagtcattttaaatgttggtgctgtcacttagcaaacgatgaagtagagataaagtgaagctgtgaggctctaataggccttccacaggggagcccgagatacagcaggaagtcccagcggccttgcctccggagcacagcttcataaaaccagctcagactctttcaaacgagctgaggctcctttgatctccgcagggattctctgttcaattcagaaggaactgcttttaagccactgggtcaagcggatattttaagcctggtgcccagcattgaacatttctccttgacatatgcacgttcttctgtcttgtgagtacatttggggtagaatcagtgtttttctgctgtatcaaggaaccagtttcccatctttcagggacatggttttctggctgagctggcccagggcaagcaggcagtcatcctgcatttatctccttctagaaagttctggattttactgggactgtgcgctactccctgttcctcagaatcccagggtttttccaagttgccataggggctctccaaatatttcacttgatactgaattttacaatgtttatagctattgaaacacttgtaattaaacacataaccaaatgta

SEQ ID NO: 205777 - DNA, 538 bp, Homo sapiens
gtgaggctaaacagcttagttgcagagatggagagctggtctctaagtgctcctctcagagctgtctctatatgaatgctcagtaaacatgccagtcatctgcagggatagctccaggagactgtaagctgcttgcttaaatctggggtctagatgagtgagaatgagattttctaccagcaagcatgacaaatcctcaaatcatgccagcaaagtacttcatctgagagagggtttacctctttcagggccttatttcacactggaaatattggttggatgtctactccaggaaaggcctgtgcccaatccttggagtggtgggctacaagcatgagcaggacacagaccctgcccaccaggggtttacagttgagtggcagaggctgacttgtgggcgccgatttaacacaaaagtagaaataaccaccatcgacaactccaccagccactgctgctgatgggctggcagtgagtgcttcagggagaaggtggcatttgagctaggttcctaaacagcaagtaggatagcaggtac

SEQ ID NO: 205778 - DNA, 175 bp, Homo sapiens
caaaaaacattaaattgtacacttcaaaggggtgacaatgtatggtatgtgaattatatttcaataacgctattttaaaaagatgtaaatgtaaaaaaaatttaaatattgacatcattaaatgatattaacaaattagtttggctaacattaatctgaagtaaaatttagattt

SEQ ID NO: 205779 - DNA, 338 bp, Homo sapiens
tcaagcctcatgtccatgggcttgatgattgatgagtcaaagcttcatattcctcggccgggtgcagtggctcacgcctgtaatcccagcactttgggaggccgaggcgggcagatcgcggggtcaggagatcgagaccatcctggctaacatggtgaaaccccgtctctattaaaaatacgagaaaattagccgggcgtggtggcaggtgcctgtagtcccagctactctggtagctgaggcaggagaatggtgtgaacccgggagatggagcttgcagtgagccaagatcacgccactgcactccagcctgggtgacagagcgagactctgtctca

SEQ ID NO: 205780 - DNA, 292 bp, Homo sapiens
accatgtgttagaggtttaggagttacaggaactgctccctacaggtggcctcttctatgaaaaggggaccgatgatttttggctgcaagctgaagggtagcaccactgtcaccttatcacctgcttctaaagatccagacgtctgctggccagaggagcatctgctgaaccttctcattagaggaaaggtgtggaggaagggagtggaggtgtttgccatgaactattttcattattcagaaagtctggtcgatgtacacttacccgaaataaagctgagcagtacagttt

SEQ ID NO: 205781 - DNA, 209 bp, Homo sapiens
aaattctctgggcgtggtggcatgtgactatggtcctagctactctggaggctgagatgagagaatcacctgagcccaggaagacaaggctgcagtgaaccatgatctcgccaatgcactccagcctaggtgacagagtgagactctatctcaatttaaaaaaagaagaagagaggaagggaagaaaggagagaggaagggaaggaaga

SEQ ID NO: 205782 - DNA, 352 bp, Homo sapiens
ctatacaataaaaggatcctgggttcccgagagacttcgtgaagcagaacatttgtcctttccctccatcctattggatttcacataagtaaaaaataaaatcctattttactaagccactgagatttggaaattatttgcattagcaaatagcctgctctgcataatacaataaaataaagatcaatataagagctttttttctgtatcaaagatagatttcttcagcattgggagagattttctgactcaaagcccaaacagtagcgtcctgaaatcaaagccacttcaagataaagcaggattctaggactctttctgttttacaacttttattttagattcacagggt

SEQ ID NO: 205783 - DNA, 350 bp, Homo sapiens
acaaagtttagtttcttgccatccaataacaacttattgaagttactaaattttgttttccaatttaatggcagaaggactgtgtgtgtgtgtgtgtgtgtgtgtgtgtgtgtgtgtgtgttttcctgggttattgagtttattgcttggaattgatctaattatgtaaagtggagtggttcatttcatttttagatttttcttttttgtatgtacacatttatttgataacatctaagaagtcgactatatgtttttcagtcctgtttctttttcattgtgagttaatttgctttttgtgcaaatactgggtatagacacaccacaagaatgtaatttgttttttaatc

SEQ ID NO: 205784 - DNA, 494 bp, Homo sapiens
ctagagcctttgcatcctagaaaccaagtctattggaattgactcctcagcaaggatcatgctacatatgttgaaagataaagatcaagagccacatatttaatagaccaagcaaaatcaagccaccccgctaagtatctctccataatttttactaaatttcttttcctcttttggagagaactaaagccagaaatcttcattagtgactgaggagtagagggggcaatataagaattatatatgcaatgtttttgtacatctgaaaagagacatgggagttacacatagaactcctatggatgaagaggatcttaagatgttatgcacttcacctgccaaatgatacctaattcattcactagcaggctataggaaacaaagggatgaaagagaaaagaccaactttcttaaatttgggaaaatgcccttttaattaagggatgaggacggttcagtgctgttggtaataattttgttgagataagtaaggc

SEQ ID NO: 205785 - DNA, 503 bp, Homo sapiens
cctatctgcctaggcatttggctgccctcctgtcactgtcaccagggccatagtctgagctgccttcctgcccttcaggtcctgcacagtgggtctgactgagcaagaggaacctggaccagttggctgtgcccgaccttgccctccctccctgattcatggcctgcccttggcttgtttcttcagtcaatgacagctgagtttgagatggtatctattccagcatcttcatgtacatttcagattcatattcttcaagaataaaacaagacttcacggtattaaaaatggaacaccagtggattgcatttccaaagcagttgagaattgtcgggactgacagctcacttcagttcagaataagactggaaaagtattgcttgcacagcaaaaacgatgtagatgcttaaatcaatgtgtggttcctgattgcgtgacaaaagtatagaattatatttgggtattgtgaaataaagttttggaaaaaggatagaaaaaagaag

SEQ ID NO: 205786 - DNA, 480 bp, Homo sapiens
agtcaaacaagcatatgaaaatttgtttggcaaaaacacatatactccatgacccagccttttcactcctaggtttatattcttccaacagaaataagcacacacgcacatgtaaaacagatgtgcacattatagaagctttatttgtaatagccctgaattagaaacaacgcaagtgaacatcaacattaggtaaattttgttataaacaatggaatactatgaattacagccatacagagataagtatctcaaaaacaatgttgactgaaagataccagacacaaaaatgcataatgtatgattccactcagaccaaattagaaacaaactatgagatggtggtaatagtggttatcttcgcaaggtgacacttttggggtgatggtaaaacagttcttgatctaggtggtggttatataggtgtgttcattttgtaaaagttcattgaaagcctatgtgcatgctatacctgaattt

SEQ ID NO: 205787 - DNA, 267 bp, Homo sapiens
agcttcgggttctgacagcaaagatacagaaaaggggccccttagctgtctcagctgaaatcagcaaataaagtgctgcttggagcttgaattcattctggagaccagctaagtgggaattactcagactttgttggagggaggtgatgaagcttttgccaattgccaatgctataaagcccaaaactttgggaaactttccagtctgacagttacatatagtatcactttcccttaatttgaatattgattaaaaaaataagaaca

SEQ ID NO: 205788 - DNA, 399 bp, Homo sapiens
caccacattcccaatataaagcatttctgtcacctcagaaaggcccctcatttccctttgtaggcaatcccttcctcccaccatcagcccctgttagctactaatctgatttctgttcctagttttgtctttttcagaatgtcttataaatgaaatcatgtagcatgtagcctcttgtgtttgacttctttcacttagtattgttttttattttttttgagacggagtctcactgtcactcaggctgcagtgcagaggcatgacctcagctcactacgacctccgcctcccaggagaattgcttgaatccaggaggtggaggttgcagtgagccaagatggagccattgctgtccaccgcctgggtgacagagcaagactccatctccaaaaaaaaaaa

SEQ ID NO: 205789 - DNA, 720 bp, Homo sapiens
attgtaagtataatgatataactgatattcctgaaataaagtatttaagggtaaggattcagaaaagaggattgttttgttaacatcctgcaagaataagaagtacagtcagccctccatgtctgtgggttccttatccatgaattcaaccaaccatgaattgaaaatatttgagaagaaaaattgtatctgtaccgaacctgtacagacttttttccttgtcattttctaaacaatatagtatgaaaactctacatagcatttacattgtattaggtattgtaagtaacctagagatgatttaacagatgggaggatgaggataggttacaggtgaatattatgccattttcaatcaggaacttgagcatctgtggattttggtgtccatgggaggtcttggaaccagtccccccatggatactgagggaagactaatttgaatttcttaatggtttgtagaattttttaaaaaattggcttacacttaagctaaattaccaattttttggaaagattttatatcatatcactttcttagctattgacagtataacaaataggtgttaaagagaactttattgcatatctagctattcatataataaatagaaacagtgtatatactggcaaacataagagaccaaagacatactattaactatagaatctgtgttctcttctgatcctcagcatattgattttagttcattgtaaatg

SEQ ID NO: 205790 - DNA, 253 bp, Homo sapiens
aactgatgaaagggctggattaacatccagcataaccaattgcagaatatggaaacatgcatagaggcaggaacccagatccagagttaacctggagatgatatgccataagggaatctgcagaaatcttgggaggggcttcagactttcacagagaatcaaaaaagggctaatgcaacctaggtgtccatcaatatgaattggataaagacaatgtggtacgtatacaccatggaatactacacagctgtaa

SEQ ID NO: 205791 - DNA, 520 bp, Homo sapiens
tgagatggagtctagctctgttgccaggcggagtgcagtggcatgatcttggttcactgcaacttccgcctcctgggttcaagcaattctcctgcctcagcctgcaagtagctgggactacaggtgcacgccaccgtgcccagctaatttttgtatttttagtagagatggggtttcaccatgttggccaggatagtctcaatctcttgacctcatggtctgcctgccttggcctcccaaagtgcttggattataggcatgagccaccgcgccctgctgctttggtcacttttatatgagtatgttgcacaatgagagaaaaaccatcagtttttcaagcaagaaagtgggaatatcctctttaacaactgttcctaactttatttttgaatttaggatttcagctaaagtattgctattgtctcttgatttcttaagctttaaatttttaccacaatgagactatggataaatagctactataactcaagcagtatgttatgtactaggaaccatgata

SEQ ID NO: 205792 - DNA, 789 bp, Homo sapiens
gttacttggagcccagactcagggaggcaccgtattgactcatgtgacagggaaagggacactgatgaacagcagttcactgttaacacatgtcacatgggtacttctcattcaaaaggggtgagaaagtacattcctactatgtgcctgggaggagaggagaattggagtgtttgtaaacgagtcctagagagacccacaaacgtcttctgatggatgagataccggatgacagcgtatctttttcttctcaacataagcctgtattgtaaggaaggtagaatcttatcattgcaccttctcagataggaagttgagaatcagaatgcctggacagcgtcactatacacccacagctagtgagtagagggatcaggtttattatgtctttacagcataattatgtctccatatatttcattgatatgaaacctgtactgtgttctgctactttacattctatgatccttttatataattgctactttattttataatcaaacaaagagccagtttatgataagcatagattcttaggtttaagtgtgtaaatttataactattaccatcggtttgtcttttatactttcctttaaataatattttttagtgttaaaaattattcctaccttcagtccacctttacattttcgctaaaaaatattctgttaagttgaaaaacgaagcaaatcattgccactggacaccatatttatatcactgggaatgatgttgtttctcaataggatttgattttatctgaaattccaatgtttccaccgacaatat

SEQ ID NO: 205793 - DNA, 990 bp, Homo sapiens
gactaagggaagatggtgtcctggagctggcatgtttggggaggaatttgcatcgggtggttctttggcaaagatggtcaggaggtgacacgggactgagatctgaaccaggagactgaggcagccggtaggaaagtgcaagggggagcactccaggcagaggcaacggcaggagtgcagaggtcctggggcaggaaggcgtgggacgtgctctgggagcagcatgggggccggagggtgggagtgcagccgctgcggtcgggattctgcgtagacgtgcgacagctggtcagtactccttggtgtcagggacccaggcttactccatcctgtgctgccgtgatgagcttctcatcctcatggtctagtgtggctgcaccggctctggccctcatacctcccggcaggaagccttcttctaggtgaagaagagcaaatccccacctttcaaggaccctcactgcaagttgtccctgtgactccgtttgtgtcccattgagtacgacgcttccctgcacaggatgctaggacacgttgtctttattccgcacacagctgaaatttcttactgagaagaggaaagttgctgttgaacaaaaactagcaacctcagccagtcagtgaccgaggggcagggtaagaagagatgaagatggaggggcagcccgaggccggctcccagagcgccgcgtgaccagagcggaccctggagtaccgtcagtgcaggaggacgtgcataggagagatcagagcagagcgacttgaccttcagaaggtccctccacagagggaagagcagagtctctgggccgaagagtggtggggagggtaatgcggacctggccctcactgtgttggggaggaagctagtgctggggaaggaggctggagcgctgcggtctgcctgacgttctggtagcttagggctcatgtggcagtgcagagagggactcgagtgtccctgaggttctggcggaacctgggtgctgc

SEQ ID NO: 205794 - DNA, 159 bp, Homo sapiens
aaacaatccaagttgaacattcactaactttccatgcatttaacaacagaatctgccgtgcaggttctctccttgagagggccgatacactcatattccacatctcagataaagctcactgtgttgtatgtctccttgagtgtataaggagtgactctc

SEQ ID NO: 205795 - DNA, 181 bp, Homo sapiens
tagcagacagaaaagcaatgtagaaataaaagatcacaggaatatgtaagcaaaacaatttttcctaagaagatgtagtttggagctctatttcagatgctcaaatgtattgctctatataaatcccataagtacatgtcatgactccaggtagtttattgtactcatgaataaagacaca

SEQ ID NO: 205796 - DNA, 542 bp, Homo sapiens
ataaaaaagaaagactccaccaaaaatctcttagaactgataaatgattccataaaacttcatgatacaaaattaatgtacaaaatttggtaacatttctttacatcaacagtgctcaagtgagagccaaatcaagaatgtgtttctatttacaatagtcacacaaaaatattcctaggaatacatctaatcaaagaagtgaatgatctctccatgaagaactacaaaacactgctaaaagaaattattgatgacaaaaacaaatggaaaaacattccctgttcatggactggaaaaaaaatcaatattgttaaaatgctcatacaacccaaagcaatatacagactcaaactattcctatcaaacttttaatgtcatttttcacagaatagaaaaaaatattttaaaattcatatggaaccaaagaaacacccaaatggccaaagcaatgctaagcaaaaagaacaaacccagaagcaccttgttacctgacttcaaactatactataaggctacagtaaccaaaacagaatggtactagt

SEQ ID NO: 205797 - DNA, 324 bp, Homo sapiens
  misc_feature (19)..(19): n is a, c, g, or t
tcagacgctgaactattgntgtatgaaaataaaaactctcattgaaaataaaacctaaaggctgggcgcggtggctcacgcttgtaatcccagcactttgggaggccaaggtgggcggatcacctgaggtcgggagtttgagaccagcctgaccatcccttgagacacgactcatgggatgaatctcagtttgtgtagtgattaagcgcacaagtcttggagtcagcttggcctgggttagattctctctcatctcctctacctatctactacctctgtgacttcaggcaagtcacctaatgtcactaagcttcaggtccttta

SEQ ID NO: 205798 - DNA, 474 bp, Homo sapiens
tgtttgacaattggctgggggagggaagtgatttgtagcatttgtctctttccatggcataaaaactcccaccacggctgatttcaaattgtcagtgtgacatcatctggctcacaaaattcctgaatgtgtaataacagtcagccctcatgagccaggagaagccaactcaggcacaccactcagacactgaatgtgggagcagagtgctctgaaggccagactcagggatccaggctccctgagggctttcccaacaacctaggagatgggtggaaggctggattgtattatttatttattgctattaagttacccctaaagctaagcagcttaaaacaacaaatatttattatcttgcacaatttctgggagtcaggaatcagagaatggcttagctggctggttctggctcagaatctctcatgagtttgtagtcatgatgtcagccagaactgcagtcacttgaagctc

SEQ ID NO: 205799 - DNA, 455 bp, Homo sapiens
acaaagtagactttctaatttttttgataattatataagacatgaacacagtttttaattagaacaaacataatatgccatttgaagaatagtatcaagatgatagtttgattaatttgattagtacttgcttactacatacaaatatgttgggcaagattgtaagccattaaacacacacacaaatatatagacatcatacataattgtttaaaataaggaaaccgcagattcatgagcagtgaaaaattgacattttcaatcttagtaactttgaaactatcataaaaatttactattttgatttataataactaaatgtacataaaactattagagaactttattagaaagtttgactaggcatggagataaatgtgtttcacaattgaaaagtaaacaaagacacaccttattatcaagtaccaaacaaaagcatttaaaaaaagattaag

SEQ ID NO: 205800 - DNA, 797 bp, Homo sapiens
gggtaacacatgtaatctgagacccagtactgtggattccaaacagccccatggaggagcctccagctcaccgtgctctcccgggcacctccctggtgcaggttcagaaagacacggaccacagcccctggagggacagtgcctgctctccacccatctccagaacccagggaaacaggcaatttcacagatgagtcttcctttttcagtcaagataaatgttaagggccatgtatggtggcacatgcctgtggtcccagctactcaggaggctaaggcaggaggatcgcttaagcccaggtggtgaaggctgcagtgagctatgatcacaccgctgcactccagcctaggtgacagagcaagactctgtttctaaaaggataaatacatacataataaaataaagttaaattaaaaagagacatacaaggaagtaaaactgaggccaagcacagtggctcacgcctgtaatcccaacactttgcaaggctgaggagagaatcactcgagcctaggagttcaagaccagtctgggcaacaaagtgagaccctgtctctacaaaaaattttacaattagctgggcacggtggtgcattcctgtaactgcagctacttgggaggctgaggtaagaggatcacttgagcccaggaagtcgaggctgcagtgagctatgatcatgccactgcactcaagcctgggtgacagagcaagactctgtctcaaaaaacaggtaaagctgagaaaagaggaggcctgttctttcactgggtggttgtaagcagccatgcagaatgc

SEQ ID NO: 205801 - DNA, 631 bp, Homo sapiens
tctcaaggatcccacgtgctttgtgtgttagagcagtgaccatcacctcccaacccaaggacctttgctgctctgcttcccacatgggactgccagcaccctgaaggcagaaaaactgaatgtacccgttaaaggaggagaagctggtggtgtatgttgagataaggagggtggggagtgtacagttacaggctgcacagggagggcaagatcaatgttgacaccaaagtgccaaaggctgtctgcgccaggtctggggcccccactggtcataccgcctgataaaaccattgcagtccacactaggtctggaggcttcgacacccacagcatgtgggtgttctcatgcaggccatgagtattcggggtgctttaagtgcaggggagttctgttgtccacgttattcttaaagcccagaataggccctgttttattctacagagataggaaggcactggggctcacagagtggtgctgcttcccaccctcacccttctgcccccacctgagcacagtgtggtgctcagtgatggttatcctatattccaaatacgcatggcccaggactggcagagtcggagctcggggtctagctgtgacctggggatcggttggagtagcttcttgacc

SEQ ID NO: 205802 - DNA, 501 bp, Homo sapiens
ctaaaacagtaaggtgttactatatagacaggaaatgcaaatatttactttgaaaaatagcttgtgaagcttggcataatgttatctcattaaaaaatatgaccagggatataaagttgcttcattctgtatatcaattttttccttcgaaattgtaaagaacaaagttttgaatatctagttcttctaggatttgttttatcaactgaaagtagcagcggcctttatatattagccaatgtgaacaaaggacaagaaagaatatttgtagtttgttttgtacattaaaaaaagttaaattggtgaaaatttaaaatgaatgaatgtagtctctaaagagactctccatccaaagtgtttcaatagttaagtaattgaaatataaagtttaatgatcctatagtgctaacagtgctgctattaggaaaatggcagtaaaggtgacaatataggtgtatattttccaaatatttaatattttcattactttcttcaaaattg

SEQ ID NO: 205803 - DNA, 133 bp, Homo sapiens
tcccagaatgctgggattacaggcctgagccactgctcctggctgcttggtaacttgttaaatcattcctgcagcattcaacttttgagctgctactttgttagttgtactgtacttgttatgataaacttaa

SEQ ID NO: 205804 - DNA, 568 bp, Homo sapiens
aaaaaaaaaagaactttaatgtagctactatacatcttataaatatgattaaggatttaaagaaatacatgatgtgatgaggagagaaaaagaagatatataaaagcccaaatgaaaacttccagagatgaaaaatatctcaggtatttacaccagatgagattaacagcagattagataatgtagaagaaaaaaaaaagactaaacttgcagacattgacaaaagaagctatctaaaacaaagcagagaaaaatgacctacatttattaattgaaaaatgccttgtagagctgcaggaaatatcaggtagtctaccaaacatacaagtagactgggattacaggttcctgccaccacgcctggctaatttttgtacttttagtagagatggggtttcactgtgttggcaggctggtcttgaactcctgatctcgtgatccacccgccccagcctcccaaagtgctgggattacaggcatgagccaccatgccccgccacaaatattttttaaaagtagccaggcatggtgacacatgcctgtggtcgcagctacttgggaggttgag

SEQ ID NO: 205805 - DNA, 312 bp, Homo sapiens
gtgttttatagttttagacagtgagcctgttcactagggctttatgaaatctgccagactggttttagggaacaagcctccagagggtattttgcatttgcttctgtcaggtgccaccaacacagaaattactgaagcagacttttagtttactatatcttagtattgtcagatgttgatttagtgtttaccttataggctggcttgtatttagaaattctcagaattatacacaatgtgggtgtggggaaaaaaaaaagggaattctcaggagaaaacttttttccttaccccgaacccagacagtgacag

SEQ ID NO: 205806 - DNA, 577 bp, Homo sapiens
aagaccagcctggccatcatggtgaaaccctgtctctaccaaaaatataaaaattagctgggcatggtggtgcacacctgtagtcccagctacttgggaggctgaggcacgagaatcacttgaacctgggaggtagatggttgcagtgagagattatgcatgccactgcactccagcctgggtgatagagcgagactctgtctcaaaaaaaaagactaaaatgtggagatcataacgacagaatataatgttaatattgtataccctgatgatatacaaatgatcaaactaataaaatttgagagaaggaattgccctatggtaataactggtattgaaaaagatgtttaaacatcacagatcaaataatagaaatataaacatattcagcactttaaaagaaacattaaaataaaactaaaacactaaagataatgctattagtttcaatactattgattaaatagggtaatgggagaggaggcgtgctaattttaacattactcatgttgaggaactaataggtattgtctaaagagatagaaattacaaaggtaaccattagaacaaagctata

SEQ ID NO: 205807 - DNA, 284 bp, Homo sapiens
aagaagataacacaaagaattaactcagaaaaacaaaaatcatagaaatacagaatacactagtctacaaacagccatacaactccaatgaagacagcatttcaagacaaacagataaacctagaaagccgagaagacctaatatgtgtcaagactggcataagagaaacaaaccaaagttataatcagcaaagtgacactgaatgtttgctagacctgaatgacactctctgtaaaaggtgttcaacgggcaagctgctatgtggatgttttttttttttttg

SEQ ID NO: 205808 - DNA, 496 bp, Homo sapiens
tagatatttattgaatgagtgtatacatgggtgaataaatgaatgaatggttttctgcccagtaagaggacctattttggtattaaggattgcagcaagcttgactgacacaaacaagtcccaaggacttgggaaaaattctaagccattcttggagagccttatagaactatatctgtccagtaattcttgctccttcagtgtagaaatggcctccctaaaatgtacttgtcaattctgtgtcaataagtcgttttagctatcatgatagtctcaattgtttgaaacaaaaatatttctttagcagctttatatggcagaagcattttccacattttaaggtgtcaagatttaccctttgtgatgatatatgtgttctcaaggtttaattacactttatcataaaatatagttattactggattaaaaatgactgttttgttaacagactgataaatatctttgaagggctcaaaatgcagtcatggaaatatgt

SEQ ID NO: 205809 - DNA, 180 bp, Homo sapiens
gattttgtgagtcaattacagacactacacaaacattaattataattccaaatatatgtcaactctgaatcattcactgtaatccatatatacggcaatctatcaaatacagaaatttgttttttatacaaagtacaatttttgaaagtcatgctatcttgtacttaatgcatatttttc

SEQ ID NO: 205810 - DNA, 759 bp, Homo sapiens
aggagtaagctggtgagaggccttccatggcctcccactctctgtgggctcctgtccctgtggggccaccacgctggccaccagctgcctctacttctgccttacagcctccctgccttctgctctcaacgttgaaacagccccctccacagctcccgaacctgtgttccagcggatgcttctctcccttgatgatgcacccgcctgagtcaccccctaatttctcccctgggggattctgactttccacttctcttgggtttctcttccccagcctctcagctgtggttggtgtggagtcagggccgggtgcctataagggcctaaggtaggacttggtgactcggcggtggtttcccttggttccgacttccctcttgcctctctgtctattactggctggtcaactcctccagtgccccttcctccaggcagcctcctcagccctgcccacctgctccatctgagcctgccccagtccccagcctgagtcctcaagcagaaccaatcccccctacctcagctgatgattccctgtgcagagtttgtattggggctcccctaacaagagctgatgctgtatatgcccagctgtgccatctcattgacttctccccaggatcctaggagggagggaacactttacagatggggaaactgaaactcagagaggttaaataacttgcctgaagtcacagccagtgaggtcaaagtgggattaggatttaaagccaataaacccccaaagctcagcactga

SEQ ID NO: 205811 - DNA, 932 bp, Homo sapiens
ccctcttgggtcttttacaagtgaactttctttcctgttttaaagccttttaaataaacttccactcctgtgctgaaacttgccttagtctttttttctgctttatgcccctcagtcgaattctttcatctgaggaggcaagaattgaagttgctgcagacgcctgtggattcaccacaagtacattggagtaaccactgggaacaacaggttgccttagaagctttgcagtagagttggggtttcaccatgttcccagctggtcttgaactcttgaggtgaagcaatccgcccacctcagcctcccaaagtgctgagattacagacgtgagccatcgcgcctagccttgcaagttgttttttgttgaacagaagaagctattcaaaaatgtccaggactctgttatttattcagcaagcttacaaagccatctttgattgactgattctttgacaatgactatctggatgacacaggaaggatgcaattctggccttggagagaaaacttgcaaggaaaggaacatgtttgaatttcagatgtgttcctcaatgaatcacgatcttcagggaatgtttcatgtggaggaaggggctcttggtcaatgagcctgaagactgcatggcaacctttgccagcttttggcctgaaaactcaacttcttcatttgagataattcctgttttatatactttcatttgagatattcctggtgtatcaactgaaacaaaatctatgaaatatcagattcacaaaaatacattttgaatattgaacgtggatagatgtatttaaatctttcctattttttgcactttcataatatatatcattctttatttttctactaataatgatgaatctacagtatctcagggccttattttcaatatcttaactggatttttaataaaagtcttactgaataggt

SEQ ID NO: 205812 - DNA, 781 bp, Homo sapiens
ccctcttgggtcttttacaagtgaactttctttcctgttttaaagccttttaaataaacttccactcctgtgctgaaacttgccttagtctttttttctgctttatgcccctcagtcgaattctttcatctgaggaggcaagaattgaagttgctgcagacgcctgtggattcaccacaagtacattggagtaaccactgggaacaacaggttgccttagaagctttgcagtagagttggggtttcaccatgttcccagctggtcttgaactcttgaggtgaagcaatccgcccacctcagcctcccaaagtgctgagattacagacgtgagccatcgcgcctagccttgcaagttgttttttgttgaacagaagaagctattcaaaaatgtccaggactctgttatttattcagcaagcttacaaagccatctttgattgactgattctttgacaatgactatctggatgacacaggaaggatgcaattctggccttggagagaaaacttgcaaggaaaggaacatgtttgaatttcagatgtgttcctcaatgaatcacgatcttcagggaatgtttcatgtggaggaaggggctcttggtcaatgagcctgaagactgcatggcaacctttgccagcttttggcctgaaaactcaacttcttcatttgagataattcctgttttatatactttcatttgagatattcctggtgtatcaactgaaacaaaatctatgaaatatcagattcacaaaaatacattttgaatattgaacgtg

SEQ ID NO: 205813 - DNA, 647 bp, Homo sapiens
ccctcttgggtcttttacaagtgaactttctttcctgttttaaagccttttaaataaacttccactcctgtgctgaaacttgccttagtctttttttctgctttatgcccctcagtcgaattctttcatctgaggaggcaagaattgaagttgctgcagacgcctgtggattcaccacaagtacattggagtaaccactgggaacaacaggttgccttagaagctttgcagtagagttggggtttcaccatgttcccagctggtcttgaactcttgaggtgaagcaatccgcccacctcagcctcccaaagtgctgagattacagacgtgagccatcgcgcctagccttgcaagttgttttttgttgaacagaagaagctattcaaaaatgtccaggactctgttatttattcagcaagcttacaaagccatctttgattgactgattctttgacaatgactatctggatgacacaggaaggatgcaattctggccttggagagaaaacttgcaaggaaaggaacatgtttgaatttcagatgtgttcctcaatgaatcacttgaagatgaaaattctaagtaatctcaccaggttggacaactggctatgaaatggcatgaaatatgtaagttactattgtcagct

SEQ ID NO: 205814 - DNA, 738 bp, Homo sapiens
gggaaggaaggatcagacgcggctgtatacaacttcttaaactcactgtgtgctcaattcccagaagtaaggagggcactgcgcatgcgggaagcccaccctaagggaggaattatgggaaagaggcaagcctgtaaagcccgaggatcaaggttaaacgctctctttttgaccttcaggcaccctcttgggtcttttacaagtgaactttctttcctgttttaaagccttttaaataaacttccactcctgtgctgaaacttgccttagtctttttttctgctttatgcccctcagtcgaattctttcatctgaggaggcaagaattgaagttgctgcagacgcctgtggattcaccacaagtacattggagtaaccactgggaacaacaggttgccttagaagctttgcaggttgttttgtttttttgtttgtttgtttttttgagacggggtctcactttgtcgcccaggtttgttgcccaggctggagtgcagtggcgcaatctcggctctccgcaacctctgcctcccgggctcaagtgatcctcccacctcggcttcccgagtacctgggactacaggcatgcaccaccacacccggctaattttaatttttattttgtatttttagtagagttggggtttcaccatgttcccagctggtcttgaactcttgaggtgaagcaatccgcccacctcagcctcccaaagtgctgagattacagacgtgagccat

SEQ ID NO: 205815 - DNA, 799 bp, Homo sapiens
tcccttggttccgaagactcctgggggctgcctaatgatggtgtatggaagctgtagcatttctggcacctgccaacttgtcagagctgcctttcccttcctggcactttgtctatgtggcagatctgaatcaagaagccagaggctggaacttgtggaccccaggatgctcacctgaggcttcccactcccctcctcctctcccaactgtagatgattggctatcccgggaggctgggaggccaagaggctgggcacatgtgtccaagatgctggggcagttcttatgaaggcctggctagttaggagagtgagcatctccagagaagggattgggcaggagagttaggagccctcgatgcagacgtgctgtggcccagggtccacccccaccacaccctgcctccctggatgctccgagccattccccagcatcactgggtgtggctagcatggctgctttgggagtgggaataggagaagggggctgctaggtggggagctgggggtgctgagaggatgtggggggatgtgagatggagagtgaagcccaggtgggtccacaggccctagctggtccagacattctggccagcagagcggagggaatcccccaaggggcgggccagtctacttgaatcgcctggccccaggagccctcccctcccccggattgttcttgctccagaacaaaggcagggtggacacttgatccctgcatgtggggtgagctggctaagcccccagccctttgattgggcagctgtcatgggagagagacagctgggggggaggggca

SEQ ID NO: 205816 - DNA, 155 bp, Homo sapiens
tgggtttggaagggagaagaagggaggaaaatgaaagggaagaaggaatgatgccgaaaggtaagggtttcctaatcaggtgaagcatagtgcttaattgatagattgcgtagatggccatgtgcttttgtaacttggggctctgaggtctttca

SEQ ID NO: 205817 - DNA, 856 bp, Homo sapiens
caagaaagtcctcatagaaaagtcaaaaagagaagatggcatgtagagataagagcatgcaagaccgcttgagatggggccgctttactactgtccgacatggggcctcgtttactgaacaatgggcagatggttatgcttttcagaatcttatcaagcatcagaaaaggataaattcacagagggaagagatagacaacggaaaatgttagcaaagcggaaacctcctgccatgggtcaggaccctcctgcaaccagtgagcagaaacagtggaaaagcaggaccaatggagctgaaaataaaacgttaacattagcagaataccatgaacaagaagaaatcttcaaactccggttaggtcatcttaaaaaggaggaagcagagatccaggcagagctggaaaggctagaaagggttagaaatctacgtatcggggaactaaaaaggatacataatgaagataactcacaatttaaagatcatccaatgctaaatgacagatatttgttgttacatcttttggatagaggaggtttcagtaaagtttacaaggcatttgaactaatagagcaaagatacgtagctgtgaaaattcaccagttaaataaaaactggagagatgagaaaaaggagaattaccacaagcatgcatgtagggaatactggattcataaagaactggatcatcccagaataattaagctgtatgattacttttcactggatactgactcattttgtacagtgttagaatactgtgagggaaatgatctaaacttctatctgaaacggcacaaattaatgtcagagaaagaggcctggtccattatcatgcagactgtaaatgctttaaag

SEQ ID NO: 205818 - DNA, 445 bp, Homo sapiens
catgcaatttcagtctcctctgtctgcattctctcctagctctgtgattctaatggcgtgggaaagataatctctcatttctttatcaaatagaacagtgaggagaaatcaataccaaatggaatacctaatattttatatcccagcagtcttctgaacattgtttattctatagtccatttgacagagaaacaaaattgatcagaaggtactttccactaccatacttgcctacttttaggtttgattttctaccttgagttggttaaaatacctctctatgctgacttgtaattcagacagtcagaagtaaatgtgatgtagtccaaaaaggtgccctacgttttggttacttatagaatatagaaggccttcaaatgtttgttgatttttatggaaggctttgaaatatttgttgattgatgttcagtaattttcagatttc

SEQ ID NO: 205819 - DNA, 149 bp, Homo sapiens
atgtggaaaatactggttcaccgagttttattttgtgtgtacagtacttcccgtttcatcatacagaatattcaaagacatgtactagagtattgaggcttaataaaattatttttattgcttcaagaacattcctaagtgaaactaac

SEQ ID NO: 205820 - DNA, 374 bp, Homo sapiens
tattaggactggaagagacctgaggggtcatctggtcaaccagcttattttacaaatgagacacaggctggcagctcgcccacagcctgtctgtcacacagggagtgggtggtacacacaagacgataactcaggcttctttccaatttcagctgccctcagttttccatttcatttggcagttgtgcattttggcatttgctggattcacacattttggtttgtagaaaattaccaagttttaacgtatgaatgattgaggtgaaggcagaatattgtcacagaaacacttgatggatagttttgctcctctacttaagtctgatggaaacatttgaaataaaattgacttcaactcagtagtccctttttct

SEQ ID NO: 205821 - DNA, 170 bp, Homo sapiens
gatattctttatgagtgaaacactcttaagtgcatggttttggtgataattttggctacacaaaagcctacttttaaaaagaaaatccttttttttttttttttgagatggagtttcgctcttgttgcccaggctagagtgcagtggcacgatgatctcagctcattgca

SEQ ID NO: 205822 - DNA, 179 bp, Homo sapiens
gccatggtgattgattcagagatgggcatgtgactggtttgctcagttagagtgaaacctaggattttgtttggtaattgagataaagacacttttcttcaggaagatgtggtgtacggaactgttccagacattttgtcaccatgataaaagtgagtctgaaaagtaaaccatcatgt

SEQ ID NO: 205823 - DNA, 414 bp, Homo sapiens
gcaacattaacaacaaaaaaactaactcatttacaacacatccttctgaggagatgtggtcctacagttgtctgtgggacaataagcaatcagtgagtggtatttagattcccctggctttgtgaaagcatattatttttctgaaaacttctccaacctaagctgagagccccatagatactaatctgaagttaataattaacataattaatatgtactatgcctaaatatacatctcccctcttccaaatgtttgattcaaaactagcattttcaccagcctgggcaacatagcaagatcttatcgctacaatttttttttttttttaattagccaggcatggtggcacgaacctgtaattccagctactcaggagagtgaggtgggaggatcacttgatttctggaggttga

SEQ ID NO: 205824 - DNA, 213 bp, Homo sapiens
taaaaatacaaaaattggccaggcgtggtggcacatgcctgtaatcccagctactcgggaggctgaggcaggagaatcatgtgaacctgggaggcagaggctggagtgagccgagatctgagatcgcaccactgtgctccagctcaggcgagactccgtctcaaaaaaaagaaaaaaaaagaaaaaaaaaggtctaacttgcatgcaatggga

SEQ ID NO: 205825 - DNA, 534 bp, Homo sapiens
tggagatcacagaaagaaagaaactcatgaaagcaatctcttaaagctgtttataaacttgtgggtccattcccaaggtgagtgagtatggatatgatcctcaacagtacacaccgaccctgacaaccgaattacaaatagaacaccactataccagtcccagactggtgactgggtggcatatacatggggcagatctgagcaacactgcaaaggctttgacaaggctggctggacctagcccaatcagatcaattggccaataaaacaaaaatatcaaaatccttggagcataaaaatgctccaagaagtaagggcaaacactcttaaaatgaaaggaaagttttaagtttcagaataaaaaaatgtaaagacgggctatataggaattttagaactaaaaataaaataaccaaaaacattttactgaataggtttaccaacaaaatgcaaatttcaggaaacttgaagacagatcaatagaaattatctaaccagaacaatagtgaaaaaaattggaaaataaacagagcc

SEQ ID NO: 205826 - DNA, 330 bp, Homo sapiens
gagagttcttagttattcatttgttgttattcagtgattagaaataaatgtttcctgataaatcagagtctatgcactaatttcatgctaaaatatacaaatcttgaaaagattgcctttgatctgcctaggaagaacatgaagttgaagaaataaacacacacacatacacaaatcttcatttatcgctgtagaaactaggaaaataaattttcttatgttacaatgtggttttttttttctgcaatgtatcttctattactttgtttctctctcaggaaacagaaaataaaattaaaaattcttctgaaggatgtctgtttttatttc

SEQ ID NO: 205827 - DNA, 539 bp, Homo sapiens
ttatttgtgcaaatttacagattacatgaggaattatgttacatgtatattatgcatagtattaagccagggtcttcaggatgttcatcaccaggtacaatacatttttgttaggtatagtcatcctgctctgctatcaaacattgaatctactcctatcttaatgtatgtttgtaccctttaactcacttctcttcatccttcccctttcccccactcacccttcccagtctctcttatctattttccattctctacctccatgtgttcaaatttttagctcccacatataagtgagaatatatgatatttgtctttttgtgcctagcttatttaacttaagataatgaccttcagttccatccatgttgctgtaagtgacattattttgttttgtttttttatggttgaacaatattccattgtgtatatataccatattttctttatccattcatccactaatagatactcaacgctgattctgtatctttgctgttgtgaatagtactgcaataaacatgttgatttattttcct

SEQ ID NO: 205828 - DNA, 510 bp, Homo sapiens
aatgggtaacatatttttgcctttaaaattctgtggttcaatccgtgcaagcacagcttctccatctagcaagaggttcacagggatggaatgaagattaactgcttttgaaagccccaggagaaaggcagtaaatgaatgatagggggtaatacaccagtatctagtgaatactagatactgaatgtccactgatggctataccattgttgaaagggggcttgtaataggtaaaatggttatgaagatgccaaatagatcaaattggtgctttaactcataattatagtttagtagagaaatgcgagacaagaattattattattccttaaaattcattcccatagtgatatgcatttgtctgctacattctttctttcagcagataataccacaagtgaagtcataaataaaagctattctactcatagcagaaattatttctagattcacattaatgaaaaagttttaattttatttttctttcttttaacgtgaatgcaaaataat

SEQ ID NO: 205829 - DNA, 675 bp, Homo sapiens
cacctgccaataaatggtcaacatgattatggttagaataaggattctaaaagcattataaagtgccggatcatgaaagatcgtagctcttcattgattcagtatttatctcttgagtacttgctttatgccagatacagagtttggcactggggacccagatttacaatgtgttgaaacaaatggaagtttctcgtgaactcttggtcactaatgagatgagaccatcccgttccaccgcactttcaagttaatccatgctcttctatagaatccttacattccagctgtgggatggctgtgtctcatatctcctcagatcaaaaagcatttctgcgaacagtgatattgaacattaaactggctgcatcaaacttgaaaggatggggcggtgattttgtgtcacaatatttttaacattatgcctggcgaatgtgcacatgttagatataaaggaggtttccaaaggggaagctttactacttggacttttaaattgccaggctgcattcttgggaaagccacataaaagaatacccctttttaaatgagtattacctcaaaaagtatagctcttttacgaaaggaatatgttgttctgaagccttgtccttgatgattttactgatattgtgatggttatttcaactaacataagaaggaatctattagata

SEQ ID NO: 205830 - DNA, 508 bp, Homo sapiens
tatgtagaatttggataaagtctaggaaaataaataaatccattcagatgtttcttgaagtcaggtgaaataatcagctactttctcatttattccttagaatggctacattttatttgattgctattttcaagggagtcctatattattccttttctgcttatgaatggatctgaatcctttttggttataaatatcagtggttatgtttctgagtaataaatgtcatgctttgcctttcttggtttcaatgttgttagcattatgaacattatctcttaatgcttgcatttcttcaatattgattccattaactttctctagctctgtcatttttggctttaaatattcaatctcctttaaccaaatggattactactgaaaaccactagaattagttgatcaacttaacgatgtgttgatctgtaaggattgaaacctcggtaattttagtatgccagtaatgcacagtacagcatacttaccaataagaacatcaaacattcat

SEQ ID NO: 205831 - DNA, 351 bp, Homo sapiens
caaaagaaaaaagaaaagcagttgtttatcttttggcttaagccaaaagaacctcaaatgaaagaaaacaaacagatgccattagaaaatgcactaaagatatgatgaaagcttatcagaaataataataaaaaatcaaatgtagcacatcctatgtacctggcactgttataggagctgtgtctgtattaacacgtaagtgtttgaggtaggtactgttattatccctatttgccaatgagagaaagaaggcaagagagcttaaggaagttttcctaattgcccagctagaaggcaggacaggtacaatttggtgctaggtgattaggcttcagaatcatccctcagtca

SEQ ID NO: 205832 - DNA, 661 bp, Homo sapiens
caaagatcacttattccaatgacatgtaagtagactaccaaagtactttctgcctggccagcaaacacatactacttaaaaactgaaagatttgcagaatagttagtgaagacaccagcagtgagttaataatcaaagagctggtgaacatataaaaacaggtgagtaaatgtagctcaacttcccatagtaaacgtacaccagagaagtatttcctattgaataaatttagcgaataaatttagcaaataaattacattctccattctaaatatgtaaaaagaaaactttgaagtgatcataaacttgaaggtacaggttctatataagaggggatcccaataaaccatttgtaatcaagaacaaaatagctcaggagaattttacgacccccttatcaaactatactggtacacagtttcattataacaacatacaaaatgtgtatagatttaattcaggattcaaataggatttttacacaacctagctaaagctctttcctatttgtgcctttgtaataaataatttatataattttttttctcactctgccacccaaggctggagtgcagtggcgctatctcggctcactgcaaactctgccttccgggttcaagcgattctcctgcttcagccttccgagtagctgggattacag

SEQ ID NO: 205833 - DNA, 324 bp, Homo sapiens
ggacactatagttccacctgttcttctccaagaattgcaacaaagcattttcaacctcatctgcagccaattttaaggaaatctaataaagaggtttgcagagcacctgagagcagctaagatcccaagacaaagtagaaaattacctattgaaactacaaataaaaatgaaatttaaatatatcgttttatatatgggccatttgcttgctcaatctctttgtacctgggagtggagggaaaggctgggagtaaaatgggactggattaaaatatagtgattgtagatttttatgacatatgaaataaattgtaaatattaaa

SEQ ID NO: 205834 - DNA, 445 bp, Homo sapiens
tgagattcagaccatgaactccaaacccaggctgcttaggttctcatcctaactctgtcactaacaggccatgtgaccttgggctaggcatttaaactctttgtgcctcagtttttccatctgcaagatggggatgacaataataccactacaccagaagggttgacgtgaggtttaaatgaacgaatacacttaataaggcacttagcatagtacctggcacacaagtgctattaaatagttgtgcactggagtaagcttatactggctcatgagagtcaaatgttagcacctcttcctaccttcgtactcagagacatcagtcatcccctgccagagccaggtgttaaacatttatcagcataccacataaacatcatattttcaaaaagtttgtgtaaaaatggaattaaaagataaaaattaaaaatataaactttatttc

SEQ ID NO: 205835 - DNA, 292 bp, Homo sapiens
tctgctgagtgttttcttttttaatcacaaaaggagtggaatttgtcaatactttttgtgtttattcagatgatcacgcagtttttgtcctttttttctattaatatggtgtaataaattgatttttgtatgaagaaccgaccttgccgttccttaaataaatcctacttttcatggcatataatccatttcatatattgctgagttcagtttgttagtattttgttcaggactgcgaaaagttgtgtggtttttttgtttgttctgagcccagacaggtgcagcgtagaat

SEQ ID NO: 205836 - DNA, 636 bp, Homo sapiens
atcatcatcatcatcatcatcatcatcatcatctagttatggccatgagaagtctccgtaatataaaccatccacactatattcatttgacattttgaaaattcaggagaaatacctgcatattaacctaatacactattacatagcctttagaaattgtaattttgaggtctataagtataggagcatgcttttgataacagtaagtgggggacaaggaagccaaacatgacactatgtatgctataattataataatataaaacagaaatgtgggaatagcattgttaggagttcagcctttagaatcattaaggaagaacctggttagaatctttattagctgtataactttaagcaagttatttaacttctctaagtttcagtttccttattcgaaataaggatgataatggtacctatgattcctctagggattaaatgagataatttagcaatggtcttggcacacatgtaataactactcagtaaaaattagctgttaaatctagaatatgacaggtatggtggctcatacctataagcccagcactttaggaagctgaagctggaagattacttgagaccaggagtttgagaccagcctggtcaacatagcaagaccccttccctaac

SEQ ID NO: 205837 - DNA, 654 bp, Homo sapiens
cttgtgctttgcttacttttgcaagtaatggcatgcttatcgttgttaagaaggctttcatatgataaagcttttaaagctgtgtaaatcaatagatattagaataataatgagagtttcaaaactcactagagccaacacaagctgacctaacccattacggcccagaataatgaactaaaaaatcattgctgagctgccctccaacagaaaaaacaatttgaaaaaaacaggaagtattcattttctattaatggacccactttacttgcagatgcagctagataatgcatcaaagccaattagggttccagaaggagcgtctttactaatagaagggtcaaactcttattgacagagttgaactttaagcaagaaaatgtgttcctggaaaggcaagtggcatcttgattctgccactttgaatttctagttctcatctttagggagaaggtttttcttctacgcccagtgtactataaagacagagacatatgcagctacaaggtttaatcagaagccaggcaggtggatggataatgactatttcaatttgtatcattccttgagtgcagaatcatttaagtgggagaagggtctaattgcctttgaataactagtttccagtcagcactttaaatagccccttttttt

SEQ ID NO: 205838 - DNA, 586 bp, Homo sapiens
agacaaggacactgaggctcagagaggtgaagtgactttactttttatttttttcagacaaggtctcactgttgcccaggctgagtgcaatggcacgatcacagctcattgcagcttcgacctcctgggctcaagcaatccttgcacctcagcctcccaagtagctgggacaacaaacgtgcacctccatgcacatctaatttttgtttttttgtagaaatggggtctcactgtgttgcccaggttggtctcaaattcctgggctcaagcaatcctcccactccagccacccacagtgttgagattacaggcatatgccaccatacctggcctgacatgacttattacctcaaggttgccacagtaaaggagggaaaacaagatcctcagatgtgccaggtgctcctcctctagctcgctggcctgatacttgccatttcctgtgtcaggaacactctagttcctgctcatcccatcacagcacctacttatctcatggggctgaaattgccttgtctcgtctcccccactggactgtgagcaacaagccacatcaaggctctgctgtagcccagcacaaaacctg

SEQ ID NO: 205839 - DNA, 260 bp, Homo sapiens
ctcaatctctacatatcacagctcaactattgtttccaaataaatgtggactcaaaatgtacagaaaataattttatataacctcttcttcatttattcactttaaaactagtacaagcacccaattaattaagtataaatagactgttgttctgataaactccaaagtacttttcatggtaaaaagcactggaaagaatcctaaggtaacactgatctcatcaggcagatggcatttatttggcacgttgacaataaaa

SEQ ID NO: 205840 - DNA, 784 bp, Homo sapiens
tttaacaagaataagtttctattttatcgacacacttttcaagtagatgttgagatctcctaataaagccgtcagtgcttctttgttaacttattcctaacaactagcataacggagccaatcagaatctgaaccatgcggtaagactgcagtgagtctaagtttgtagagtaagtcagaggtcctggcaaagaaagccttgttaggcattaggacaagcctcctgtgagttataaggaattgccttgcaaattgatggaacatgagaaagtaatatcagccatgatattccagcactttttaagaagacctgacctcatgtgtgaagtctgagccatagtccactgaaagacatagcagaccccacctagggtacctaagcatagtgagggttggaggttacttttaattcacaacattagggcttatctctaacactaacatcttctttcccagagctaggaaggctcctcaaaggaagaaggggaatacaacttcaagagataaatccagaacccatttgttgtcaatctttgttgtgtttggggggggggctgttgttgttgttgttgttgtttatattagctttagatactgacatatcacataccagatttatttccttttgaactacaatagtattgtgctgcagattctgaataaatgtaaaatcagagtggagtatcagccacaaagctaatagcaatacattgaaaattcatcaagaaattgccaagattctagaagactacattcttcacccagaatataccatccccatcta

SEQ ID NO: 205841 - DNA, 132 bp, Homo sapiens
acctagaatacattattagttcctggaagccagaaaactaagtaataaagctcttgaaatcagggaacatatctgctatgtattccctacagtaaccagatatgcatgacatgttcactgacatgttccaag

SEQ ID NO: 205842 - DNA, 469 bp, Homo sapiens
catgcctgtaatcccagctactcaggaggctgaggcaggagaatcacttgaacccaagaggtagaggctacagtgagcccagattacgccgctgtactccagcctaggtgacagagcaagaccttgcctcaaaaagaaaaaacaaaagacaaaacaaacaaacaaagaaacaaactgaatgagtccccccagaacctctgggcaggtgaaaaaaaaaattagtttttagacctacaaacttatgaatcagattctgaccaaattcctgcctatgaggtcctacaagcagtaggtcagagtcttcccaaacccctctgagccatagccagccatatgcatcaaatggttttcatgtttgttgaatgaacacatggatgaatgaatgagcaaatgaaaaaacagattactggctggttggctagttgaatagatgaacagaaggatgaaaagaaccatttgatataatact

SEQ ID NO: 205843 - DNA, 405 bp, Homo sapiens
caaaagaaaatatccaaattactaagaaacatataaaagctttccttttcactgtcattagtttttgaggcaatgcaagatacccgtataccgtcatcagaaatgttactcaaaagtgaaataaaacaaaatataacctgacaatatcaaatggtaagaagaatgtgaagcaacaggtcactcacatcctacttgtgtgggagtaattttgtgcagcctctgtttatcaggttacacaaggctgaatacacacattctaataaatctactaaggctaaacatataccttctaataaatctatcaagtttctagatatatagccttcagaaattcttacatgtgtaaatcaagactgtaatgagaatggtcataacatcattatttatgttagtgcctatccaagc

SEQ ID NO: 205844 - DNA, 471 bp, Homo sapiens
tcctgacttcaaatgatccgcctgcctcagcctctcaaagtgctgcgattataggcaagagccaccatgcccagcctaggaaaaaaacacttttaaattagccaggcaaggtggtacaggcctgtagtctcactactcaggaggcagaggtacgaagatgacttgagcccaagagtggaggctgcagtgagctactatgatcctgccactgtcctccaccctaggcaacaaagcaagaccttgcctctttaaaaacagcaacaacagcaaaaactatggtgtgaggtaggagatccagctgctttcttttgcatgtggatatttagttgtctcagcaccatttgttgaaaagatttcttcactaatttgtcctgcaacctttgtgaaaaattaatttacaaatgcaagaatgtatttctagactctattcttactccattgatctctgtctttaggtcagtaccatactgt

SEQ ID NO: 205845 - DNA, 158 bp, Homo sapiens
cagccacaccaaaacacattatagtcaaactcaaaagccaaagacagagaatcttgacagctcatcacatacaaggaatcctcaagaagattatcagcatatttctcatcagaaactttgaagactacaaggcagtgcaatgatatattcaaagtgct

SEQ ID NO: 205846 - DNA, 608 bp, Homo sapiens
cactgttattcaacagtaaacaagaaagacatgttttctgcccttgaggagtttcctatgggtgataatgaaatatttgtttcttaatctttctggagatcttcagtagctggtacgaaatgtgacatcaaggaggtttaagaagtccttcaggagatcactggtgatatgttggaaggttgcctagatattacacaaatgaatcagagttaagaatacatgtgttggctgggcgcagtagctcatgcctataatccatttgggaggtcgaggcgggtgcatcatgaggttagggttcaggaccagcctggccaacatggtgaaaccccgtttctactaaaaatgcaaaaattagccaggtgtggtggtgcacacctgtgatcccagctactcagaaggctgagagacaggagaatcagcttgaacccaggaggtggaggttgcagtgagctgagatcatgccattgtactccagcctgggtgacatagcaagactgtcccccgctcccaccccgccgcccagaaaaaaaaaaaagaatacgtgtgtcttaattggatcactgattattttttcttcctagagaccaagttatagattgggtgttttg

SEQ ID NO: 205847 - DNA, 629 bp, Homo sapiens
gcaaggggggtcagagccagatgaggagcttgcaaagctcatcctttggtgctctattggatagtctgcaaattattttctgactccaggatgacaaaaatatgtgaatccattttcttttctctctcatgagcatcacaagcccgtttatttttatatccattctgtctaaattactttgctctacaactttatagcataatcatgagagcctcttttcttgcatggatgttgcaaagagcatgaagtcctccatggcttttaaagaaggcttttgttgaattagcagaacctaccagagctcctggaaattctgggtttccggtctctgggggcgtcttcactccaagcctcggtgcccttacttggatttgcaagtttagagttaaagtaagtgtcagaaatacgtgtggtgattacagacactttgtagccaataatttccatagtggaactgatatcacttcttgacctattttttcagaggacttttgcgcaatagttactttagaagcaccctcttgaaaagaaatctgaaatggacgtaaaaggctatatttatttgttcatagcatttcttgatgacctgctttatgcaagatttcaaagagctcacagctattaatgac

SEQ ID NO: 205848 - DNA, 559 bp, Homo sapiens
cagtctcactccaatttaatattattcctttcaggatctagatataaatacagtttttgccactagacaactgtcttctcatacaccgggaacagtcttttgttagctacaaaaataacaaaatgcaaacttctggtcgataagtaaggtgaaaaaataatcttaagcccctaatactacacattcaaatgttttaagatgaaatttcttcgacgtttttcatattaccaattttaacgatctaggaaaaaaaaactacagtatattacagcaaattaaatggtagtcttccatttaataattaaaagctaattttaagttgtctagactccttaactctagcatactttaagttattgtggatttttcccctttcaagaatgcttttttgtaaagcccatttaacaagcttccttttcttgccaatttgacctagtgtatttccagtgctataaagtgtaaacattaggaatgtatctttgtgttaaatgttctggtctctcaaacgatttcaactttgatggatgcaatagatctaacaatgttccccctttaacaa

SEQ ID NO: 205849 - DNA, 620 bp, Homo sapiens
gttattttaattctcctttggcacgtaaattaatatatccacaaattccaggtattaggacacagacatcttgcagggaggcggattattctgcctactacaagtgagagaatcggaagactggctggttaatagcacgtttcgatagaacaattttcaagcaataagataccaacctagtggaacttaatgcagccctgaagctgacaaagtataactaagaaaactgtaacaaaacacagtccagaaaaggccttttctgttataaatttacatagataaatatttatataagaagttacttgaaaataaaacccactgataaaccttaaatcacatacttaagaaaatcacttttaataaaataaattaagaaggagagtaaaataatacttagcaaatacagcagataaaataatcctgattgtaacaaattggggctgttctggaaaatgtgggagattaaaaaaaaaaaaaaaaagaggccaagctcattagtgtattactaacaggtaatgatcacattaacatgtcaagcaaagctcacacaatttaggtgattttataaaagaagaataatttgtgttttttcaaaaaacaaaaacacaggtgtcaattcc

SEQ ID NO: 205850 - DNA, 319 bp, Homo sapiens
ttcaataaactggaggccttaagagcagagctgaggcttacttgaagaatacattttcgctgaggatagaactttagctcatgcccaacagttccagcctgccctatggattttggacttgcatagccatttccttgcaataaatcatgtaagccaattccttgtgataaatctcttaatacttaaaaacagcaacaaacaacaacaacaaaataacgaaaagcagtcaacgacttggctcaaaaatattctaatgactaaaatcctgtaaaaatttcatccaaaatagttttttctttttgcccaggctggagtgcaa

SEQ ID NO: 205851 - DNA, 944 bp, Homo sapiens
ttactttcttgtgtccaagttgccccatctttggcccttgggaactccttcaagttgccttctgtgttgttttggcaagaccccatcagtctgtgattgcttccttgctttctggcgtaggatgaccatcttgctcattttgtacgagtcctgccagacctggaaacagctgtttcttgaaggagcgctgtgaactgcattttaagatttttgtacttttgttaattaatttagactgcttccatacagtgtgattatcttcttaggctgtgagtacttctgttagatatttatttgcggggccatgctgctaatactagcatgcatttgaagtcgtattgctagtgttagactacatttggaggcgattttttttttactggcaatttacatgttagtatgctgttcactctagtgctcacaggttatacagcataactgtttgccttgtatttactggtttatggtttaatcgtttagacaagcttgacaagcctccatcaaaacctgttcaacttgtaccaaactgtcttacccttgtctttcctgccttctaaagctcagcaaagatgaattgtatgatcagccattttgtgagcagatatttccatcaagtaagagccggtcagcattctagctgcatgcctccactgatgccaaggagtgtggttttatcttgttgaggatctgtgatgtgtaagaggacaccactactagataacaaatgagtactacaggatttcagaggataaaatgtggtttgggttaataaggcaagggttgataaaaggaataggacttaagatgggagttcctagtagtttagaatttacacaggcagaaaagagagaaggcatcctaatggcatatgactgggaacaaaggtacaggggcaggaatgaacataacatgattgaacagcggaccctaagggtaccgagctc

SEQ ID NO: 205852 - DNA, 255 bp, Homo sapiens
taaacaactcttaaaggaaagctgagccggctcctgttttcacaaatctatgtaaccatcgttgaatgggttccaagcatcaattgttcccagtgagtaaggacataggatatggcaaaaactcacagcaatttattaccagaatgttttaaaagaaatggaggatttcagaaaaggaggagctccacggattcatgtttaaattcaccacaaatgatttatctttgtgttccatttcttgtccaaggtcggttt

SEQ ID NO: 205853 - DNA, 263 bp, Homo sapiens
tcagacgctgaactattgttggtggccagaaacagattggtctattaactaagactcaggcaattgtgtcagacaggcatgtgaaggtgacagggggccctgtcttctgtactcctctcccctcccccaacaggcaggggcttccctcctcctaactcagcatggggctgctggattagggtagctggtggttggatctgtcatctgggacctattccaacccctaccccaatcttttctgcacatagttcagcgtcttattt

SEQ ID NO: 205854 - DNA, 250 bp, Homo sapiens
caataaagcagcttatatagaatgagatctaactatttaaattctgagactttggaaaatggatcaacagtgaacagtgattatctaacgcggtctcacagaagtagctgtaactttgggtttgggattctttcacttctgggtagctgctgagaagtgaaggggctcagaagtattcaggttcactccatgttccttccaaatcctaaaattcggtcacctacagaaagtcccaatcacctgaatttca

SEQ ID NO: 205855 - DNA, 166 bp, Homo sapiens
cccatccccctctcccaggctccctcccttcgccgtccgctttcctgtgcgagtcgccggacgcaccgcccagcccgtccgcagccccgcgccgggtcggggcctcgggccgggccatttcggagggaccgcggcttcggggaggggctaggaggggggagaggga

SEQ ID NO: 205856 - DNA, 423 bp, Homo sapiens
gacagaaaggagatcagtggttgcctgaggacaggaaggagaaataggaattatcaaagttcaggaagaaagttttgtgggtggtggatatattcattttcttgattgtggtgaagttttcatggtggtatacatgtgcctaaacatcaatctgtatatatagcaaatatgtacagtttattttatatcaagtacacctaaataatgctgtttgaaaacacaaagtaaagaatatgtgtatgtactgacttggagggcatgctaagatatgttaaatgaaaagtttcatacaggagtatatatagggtgctatatttggcataaaaaagaaaggaaaataagaatgtttgtttgtatttcttgattttgcataaaggacaagcaaaaagtaatgaaaggattattgatgcagagtgagtgggg

SEQ ID NO: 205857 - DNA, 117 bp, Homo sapiens
ggacccacagcaggaaaatggcaaagcctagttctcagctctgtcccatctgactccactctagcctggccattccccctcaaggggacatctgaggcccaggtccataggttttcc

SEQ ID NO: 205858 - DNA, 534 bp, Homo sapiens
gaactgacgctatctccctccccgcatcaagcttatctcctctcatactatgtcctttcaaggaggttgttttccacactcctttctatgccaaatgaattcaatgtcagtttcaatcccgtttgtatttttgaaaacttaatatgcacctgggactgtactaggcactgtgacaacagcaaaataaaatgtttgacataagttgggctctttaagagttaagaatttagttgagacaagatgtacacctgcaaagagttcaaaagcaaagaggaaactacaaaactatgtgaaaaatgtgcgcactgtgaacttcaaagtgccccaggggctcagagcgaagaagcagtgttgtctggagtgttcaggttgctcatgagggcaggtcagcactgggacttgggaggaatcttgaaaggaagagaaacagactatgactgattgacacaaacttagggagaaaaacaatttcctagtgaaaattttggccccggcacaaccgctcttctcttactcaccggcgctcatgtccac

SEQ ID NO: 205859 - DNA, 609 bp, Homo sapiens
cgagggccggggtttggggtcgcggccacctggcgccccgcgcagtcggacatggttgggtgcctggccgcgccgggccggttgggcctttgttcggtgtgcgcggagggtgagggaagagtgcccaccgggccgcatttagtacctgggtaggaaccggcgcaacttgggggtcatggggtcctcggcgacgcggagtgaccatcccgtcacttttttctcggccgtggccgaagtaattaggccgttcagtagctggtctcagttccagttctttgaaccagtccaggaaaacccacctggtgccgtcctttttcctttagcaaccgtgacacactttccctgtcgctgacggggtgatgcagcttttactagtttgtggtttagaatggtcaaatggtcattttcatctgttaacacagaggaacacttttctttttcttgtttttgaagtgagtggtataagaataagctttggaggcgaccccccgaaaaatgagcttgatggggattcgaaaatgtttactgggtatggtgatttgggccattataggttagccgcagtcatacaattgagggtattattaaaggagtttcattttaaggccg

SEQ ID NO: 205860 - DNA, 555 bp, Homo sapiens
tgaagaaatggtttgtatatatcaatttttatctactcagtatttaatgaaatatgttaggaagccttagaacacaaacactccatttaaaaggtagacattgtcagatggaaaaaacaaagcatggccgagcatatactgtctaaaaaaggtgagctgaaaaatataaagactaaagaggttgtaagttcaagaatagggggagaaatcatggaaaaaataagcataagaaagctggtgtagctacatttctaccagtcaaagtagacttcaagagtatcatgaacaaggagaaacatttcacagaaatcagaatcaacgcgacaaagttatgggaagtgagtgaaataattatctgtaaacgccagggcagactgactaaatagtggggaccctgaataggagtatatgctttggtatctctgaagtggtggcatgatagcactttggttcttttcaacttcatggaccctcatttcagttctgaattcccttcttctagaattattttactttctattcataaacttctgtcatttccaaagagagagagaa

SEQ ID NO: 205861 - DNA, 178 bp, Homo sapiens
attacaggaaagcaggctatgaaacaatggctggttatcatttgactacacacaccaacattttatcagaattcaggctccttgcataatcctaatcttgtggcctttcattagtcttacaaaggcagtttcagtccccagacaatgaggagatcagttttagggagggattatgacc

SEQ ID NO: 205862 - DNA, 742 bp, Homo sapiens
ttgctaatgcccaaattagaaattcatcacatgcattgtaaaaactgcagcttaatcaaatactgcaaatacccaaatacagtctgttttatggtcagtgttgctctgattcgcaaagagtgagactgtggcaactggatgaggatatatgggaagagccagaggagctgaggatgcttgactctccagcctcctctgaaacacatcctaccctatccttcacactttcacacttgataaaggtggcagagcctttaattatgaagccagcccaatgtttaatgttgaaatcccagagtttgcagtggaagtggcaatatgcaatgacagattaggaaagacagggatctgctcccccattatcttgttcccctacccacattagtctattctgcaacagggcctgaggctcagtcattaaggaaaggataacaggtatggaaggagcaagggtttagttaagggggttgacactaagtaaaagtaatcttgggggttctccactgtagaccaagaacagctctgaaaaatcagcattattcctgatagtccaactgtcccctctaccaaattatacttctagatatgggcaatgcaaattatatgttagcctttttagattatggttttaaggacttgaaggttcaaaatatgaccttttcagctcggaagccaagatggccaaataggaacagctccagtctacagctcccagcatgagtgacacagaagatgaatgatt

SEQ ID NO: 205863 - DNA, 444 bp, Homo sapiens
ctaatcagaaatatttataagagtagcaatggagtttgtatatactcccacaaaataattatttcaatccttactggaataaaatctttctccattctaatctctggtctaaagacataatttgttaatgctcttttcttttcaattcattgtgttgtaaaattacttataatttatgcaataaagcatattagagttacagtattctctaggtttaatccaagtccatttaattttcctcaaaagactattatctctattttaatgatatattttactatctcatttaaagcatttataaaagttatgtcatgttgcttaagtttgggatatgtacaatttatactaagattttatcccctctcactgtcttatttaccatttattgaatatcctgttacttgcaaggtattgacatatatcacattggagaaacaatgataa

SEQ ID NO: 205864 - DNA, 396 bp, Homo sapiens
cccccagaacgcggagaggcagcctgagtcttactctcccaccacatcaattcccagcaccgtgggccccggggccactttattttttgtatttttttgagatggggtgtctctgtcgcccaggctggagtccggtggtgcgatctcggctcactgcaacctccgcctcccgggttcacaccattctcctgcctcagcctccggagtagctggggttacaggcccccagtccactttcttggagtctgctgtgtctgaccaaaaagcccatcttcgccacatctaaagctggaagttcatttgccagcgttgtttagagcaaaaagagacacatcgtcatgcaaatcttggactcacatttttgaacctcagcttcttcacccagataattatgac

SEQ ID NO: 205865 - DNA, 371 bp, Homo sapiens
agtggggcctctggaaggtggttaggtcatgagagtggagccctcgtgaatgggactagtgccctataagaagcagacaggacgggcgcgatggctcacgcctgtaatcccagcactttgggaggccaaggtgggtggatcacgaggtcaggagttcgaaactagcctggccaacgtagtgaaacactatctctactaaaaatacaaaaattagccagatatggtggcacgcacctttagtcccagctactcaagaggctgaggcaggagaatcgcttgaacccaggaggcggaggttgcagtgagctgagatggtgccactgcactccagcctgggtgacagagcaagactctgtctcaaaaaaaaaaaa

SEQ ID NO: 205866 - DNA, 332 bp, Homo sapiens
ttgctcaatccaccaattcaaatgctaatctcttttggaaacacccacattaggcacacccagaaatactgtttaatcaatatctgggcatcccatggcccagtcaagttaattcataaaattaaccgtcacacatgataagcactttaacgctggcacattcggttctcacagttgcctcataaggtaggaagtacagttaatcctgttgcccagatgggaaaagtgaggctttggaagttaaatattttatctcagatctgtccaccaccagaacccatactgttggtcattacaaaactgcctctagcagggcaaatcaaagaggagat

SEQ ID NO: 205867 - DNA, 328 bp, Homo sapiens
agatggtgttgggcaagattgatctacctagattgtaaattttagtactgtttatagattagtaacatccttctggggagaagaaaatggcattaatatagacttaaattgtttgtggaaaaaaagtttccttacaggcaagaaaagcgtaacatgaaagtagttttcctaatgccaaaggctttctccgctgcccactgtgctgttttgccaaaattttggcattgttcttttctcgggtcattaccgttcatgctggatttggggcctaagtaaaaaaggaatatgctgtcggtttaattttggaggtgaggaaaccatgccatcg

SEQ ID NO: 205868 - DNA, 284 bp, Homo sapiens
ccgccccctacatctgcaacgagtgtggcaagagctttagccactggtccaagctgacgcggcaccagcgcacgcacaccggcgagcggcccaacgcctgcgccgactgcggcaagaccttctcgcagagctcgcacctggtgcagcaccggcgcatccacacgggcgagaagccctacgcctgcttggagtgcggcaagcgcttcagctggagctccaacctcatgcagcaccagcgcatccacacgggcgagaagccctacacctgccccgactgcggccgc

SEQ ID NO: 205869 - DNA, 209 bp, Homo sapiens
gtcccccagttgaccattatatcaggtgagccatgcagcagactaggaagagttaagatctcttgggttcagtttcctgatattttagagaatcttaagttacaacaattctacattcccgaattgggacatccgtccacgagaaaggcatttccccactcccaccatgatctagagcaaacacgaacaacctctgaataaagcaaaga

SEQ ID NO: 205870 - DNA, 732 bp, Homo sapiens
cataaactgatactgcaactttttaaaatgtattttatttcacttactttattggcatctactaagatcccagcattattatagttaaataaactgaaatttctgaaattcttcaggaatattacatatatattaagattctcaattataaaagattaagattcttaagacctgtcagttcccaattggtgagtgtgcatactgatcagtatgattatagattcattaacagctttatgaggaagaaaataggctacaagaggtgaaaatgtgttctcaaaagttacagagttggtcgtagcaatctaaaagcgaaaacccaaatgtgtcgagtctgttcttaccctgccatcctctgctactcatggggtgcttttattggaaagaactgcagggaaggatgtttttaaataactctgacagattgagattggatacttttgcatttaatgtatacttctaggaatatcaacagagttaaaattatatttaatgcgtattatgtaaaaagagggaaaagaggagagagtgagggtgggaaaacatacctctcaagaatcatgaaaatcagatttaaagattgggtaatatgatagataaggtaacctgaacccatttgtagagcccatggactatggtaaacttgcaactgatacttcgcttgtgtagctcaagaggcgacaagagctatgcttaggatgcgaaggatcggggaactgggttttccctgtc

SEQ ID NO: 205871 - DNA, 898 bp, Homo sapiens
cataaactgatactgcaactttttaaaatgtattttatttcacttactttattggcatctactaagatcccagcattattatagttaaataaactgaaatttctgaaattcttcaggaatattacatatatattaagattctcaattataaaagattaagattcttaagacctgtcagttcccaattggtgagtgtgcatactgatcagtatgattatagattcattaacagctttatgaggaagaaaataggctacaagaggtgaaaatgtgttctcaaaagttacagagttggtcgtagcaatctaaaagcgaaaacccaaatgtgtcgagtctgttcttaccctgccatcctctgctactcatggggtgcttttattggaaagaactgcagggaaggatgtttttaaataactctgacagattgagattggatacttttgcatttaatgtatacttctaggaatatcaacagagttaaaattatatttaatgcgtattatgtaaaaagagggaaaagaggagagagtgagggtgggaaaacatacctctcaagaatcatgaaaatcagatttaaagattgggtaatatgatagataaggtaacctgaaaacccatctgctagaagacacatggaaacattgggtaaaatatgacaaataattattttaaaagcatatgtgtaagctccaggaaggagaaaaagagggtaatgcttatggatgagaaatgaagagagagaactgtagattaataaactgaaattgatgttacagatgcccctggctgacttttataacctgttactgcacaggggtagacatactgggagcttccttttaattcccatactgagaaaagaagagtcctggggttcacatggcctttgtgagactca

SEQ ID NO: 205872 - DNA, 456 bp, Homo sapiens
cacagtggcttatacctgtaatcccagcactttgggaggctgaagtgggaggagcgcttgagcctgggaggttgaggctgcagtgagctgtgattgcaccactgcactctagcctgagtgacagagtgagaccttgtctcaaaaacaaaaaacattagctgggcatggtggcgcatgcctgtagttctagctactcgggaggctgaggcaagagaatcgcttgaacctgggaggtggaggttgcagtgagccaagatcgatcgtgccactgcactccagcctggatgacagagcaagaccctgtctcaaaaaaaaaaaaaaaagagagagagatcaaaaacctataaatatttttcatcatactgtcttttcattttataacctttttggtttttaattgctcctcccctgcccctcatttttcccgtttgtctaattttctttgaacatttaagg

SEQ ID NO: 205873 - DNA, 443 bp, Homo sapiens
gttgcccataacagaccatacgcataggacttcctcggtatgtaggacaggcgtacgagccaaagggcagttgctatattcacccacacagaccataaggaatccatgcttcctggaaactgcccattgatgtcaccctgtgcagctgtaacctgtgtgagtgttctgactcagtcataacaatgacattttggctgggcacagtggctgacgcctgtcatcccagcaatttgggaggctgaggcaggtggatcacttcaggtcaggagttcaaggccagcctggccaacatggtgaaacctcatctctactaaaagtacaaaaaaaaaaatagctggcagtgatggcgcacgcttgtaagccccagttacttgagagtgctgaggcaggagaattgcttgaacctaggaggcagaggttgtagtgcaggaacccactcggga

SEQ ID NO: 205874 - DNA, 817 bp, Homo sapiens
gatgttgatggggaagcacttagtcctgggaacattggcaattacctgtgtggccacaaggagagagaattttagcatgaagtggattccacaaaaggccagttggggaaatggaaagaaaccaggccctagtgacatcagtaagccactgggttaaacccacactgaagcttcatctacctttgaatttcttgtaggagctaatagagtacgtattaagttgagtttgttacttgaaacctaaagcatctgaagcaagatgaggggattatttcttatttgtaagaccttcctaggccccacatgatggctcatgactgtaattccagcactttggcagtgtgaggcaggaggattccttgaggccaggagtttgaaactagcctgggcaacatagtgagagactgtctctacagaaaaaaaaaaaaaaaaaaaaagcctaagtttgattctaggcttcaccaattgttaactgggtgactgagaaaatttccaaatctctctgcttcagttttctttatagtaagattccagatggatgtgatagagggctttattttctagagtgggaggaagagccattgtgaaagagaaaagtagaaaaagaaaatagcaaactgtgtcctcaggcagatcagtttaagtaaagaatacagtaatccctcagtatccatgggggattggttccaagaccttccttggagactgatgttggctgataaaaagtggcatagcatttgtatataacctatacacatcctcttctatactttaaatcatctttagattacttatatctaatacaatgtaaatgcta

SEQ ID NO: 205875 - DNA, 750 bp, Homo sapiens
ccttccactgttgtggtcttttggctgctctgacagttggactgaagggcttttccttttgattttttcctctttttcaatctcaaagttcagactcagactgctttagtgagaaaaaaaaataagcaaaactaagagctctttaatcctaagaaggagctttgtagcagttaccttgaagaagagtttactccccaaaggagtatttagtattacttagatactgagtcactgaacagagagagagagagagacagagagagagagagagagagagagacagagagagagagagagagagagaaagagagagagtgagagtgaatatgtatcccagccagcaagaaagaaaagatacttaatctaaagatgcaggggaagttgtggcctcttcctgaaaattattttatcagctttttaaaaatcaggatgagtgctagttgtgtttaaagtattgtgttctggaaatactaagagttgggatgtctaccagagtgagggttagaagcattttctttggcagcaagaagatatttttatagaagccatgcctgttctgggggttgcctcaaaagtgaggcagccagctgttgggtcaaagcctgtgcatacctgctcttccgataccaaatcttggcactagtgggtcacagcactgttcttcaagacctttgggacttgttgaacagagacctcatgcttcttgtcagtgcgttaaaatcaactgtgaattggggagaaaaaacctta

SEQ ID NO: 205876 - DNA, 514 bp, Homo sapiens
caacatggtgaaaccctctctctactaaaaatacaaaaaattagctgggcgtggtggcgggcacctgtagtctcagctactcgggcggctgaggaaggaggatcgtttgaacccaggaagcggagtttgcagtgagctgagattgcaccactgcactccagcctggcgacagaacgagactccgtctcaaaaaacaaacaaacaaaaactacaaaaatttccagtgacagctggctattgtcaccaatggatttctaattttgctgcccttgccaaacctctgtatgccctccttgaagacaccatcccagcacccattttctggccctgagaggcactaacctcctttgtagccttaaaattagcatttcccatacctctgatgttggcttactgaattttgactaatcttttcacttctattaccatgaaaataatggaattgctggaggtattctatgcaaccttttgcctctcagatatatcctatatttctcatgccaattgaatcctg

SEQ ID NO: 205877 - DNA, 505 bp, Homo sapiens
gtagcctttgctctgtgagctgggaattttagaaaggcttccagaaaatgctctgattttctgcggttgtcactttgatgggagccctttcccagctcggcttgtcccttcctttcagagacctagggaaagagaactcacactggtggagtagggatgggtgctgggcacctgcgcacggggtgtctggcacatgtgactaaatgaaccggaagctgagtgggggatgtgcatggcacaggactcgagaacaggtccgccctgagggaaactgagtcaaactgaggaccagccctttgtttcaggaactgttctccctttcccatatgaatatctcgttctcactctgcagtaaaatgcatctctctcccactgtcttcccacacctcagtttctgatcagctctggcccgacattggcgtgtgagccaatcatgtgtttacagcacgttgaggtggatcacgctctgtggtgcttggtgtttttacatttttggcgacctttg

SEQ ID NO: 205878 - DNA, 609 bp, Homo sapiens
gcttgttgggtacttgggacaagaagtttgatttgggaatttaatttatggcagataacagataatcagtctcagtcttttctgttgcagatataaaaagcagcagtggttatctttaatttttaaaagcattttatcctttttctgttgtttgtgtccataagaaaaatgcatgcataccaaatatccatcataaaatagggaactaagaattttgtgtgcactggattttctttttttaaaattattgtttgaaatctgttaaacaagggcttgaactcaaatgaaagaactggcttttactttaagcttaagctcaccaatgcactcttagagttacttttgttcagggctctgtataaccaaatggaattagcctgaggaaggtacggttttttccacagcattttgtttgtgatgaggaggctaagatagtttaaactgtgtgagctggcactgttgtaaccataaagatttgaggtatttgggttttggttgtagccaagcctagcttgggagctgcgtgtgcaggagtacaggtgtctgaacagagtgtggctgctcagtgctggatgaggctctttggtgacagtctttgaaagcaaatta

SEQ ID NO: 205879 - DNA, 317 bp, Homo sapiens
gttagggtccagaaggcctctgaggtgccattgcttacttccttactgaggaaactggctcttgtcctgggccatgtagttccattctgggctctaggctagtggtgcttctgtccatcaagggtatctgggtgagttgtaggttaacccagaatttagtagggatataggggtttgaataggaaagtgatctggggattcagaaatttttctgatgtatcaatgagcaacttctcagtggatttttatacctcagggtcatttgcaaatctttatcttttcctatttcttaggtgttcaagttggttaataggaga

SEQ ID NO: 205880 - DNA, 467 bp, Homo sapiens
ggaaatcattttccaaaccataactgttctattcagagctttgaagacagatatcaggtcttcagaaccaatgaagaagaaaccattacttatcaaagaagacggagtctcgctctgtcaccaggttggagtgcaccggcgcgacctcggctcactacaacctccgcctcccaggttcaagcgattctcctgcctcagcctcccgagtagctgggactacaggcgtgcaccaccacgcccagctaatttttgtatttttagtagagacagggtttcaccatgttggccagggtggtcttgatctcttgaccttgtgatccacccgcctcggcctcccaaagtgctgggattacaggcgtgagccaccgcatgtggcccaccattaaaattcttaacctaaagaggataattcccatgaaaaatggatgctatgggtcaattaaataaaatcaaacaacacattttat

SEQ ID NO: 205881 - DNA, 860 bp, Homo sapiens
ctgttattactggaagcttttttgtttgagactatactggtagcttttttgtttgttttcttcttcctgcataatcatcgtttcttccacgttgctctcttctgtttattttgatgtctgtgtttcgtgttcagggttttctttgattagtttcttgcttagaatcacacaaagaccaaatcctcataatgagaatccttatttgcagttttgtgtagttctctaattatcgtgaagtgtaatagaaaggtagggatagtgtattgctcacagaagctgctaagttaaaagtgctcagaattctagagctgctaacattaaaaacaaaaatggccttgtgttttacttgattaaaattaagccttaagtttagaacatctttaaacttggtttaaaatgttcattttagggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaagggtttcacaatcaatgagtacaccatccgtcccttgggagtcactggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacctcatgtactatta

SEQ ID NO: 205882 - DNA, 1325 bp, Homo sapiens
agcgccgtgcgccccgccccccatcgggggcaaccattgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaactcgcaaactttgagaagaacgtgagccaagctatccacaagtacaatgcttacagaaaagcagcatctgttatagcaaaatacccacacaaaataaagagtggagctgaagctaagaaattgcctggagtaggaacaaaaattgctgaaaagattgatgagtttttagcaactggaaaattacgtaaactggaaaagattcggcaggatgatacgagttcatccatcaatttcctgactcgagttagtggcattggtccatctgctgcaaggaagtttgtagatgaaggaattaaaacactagaagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagccaaaactgttacatcaggttgtggagcagttacaaaaggttcattttatcacagataccctgtcaaagggtgagacaaagttcatgggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaagggtttcacaatcaatgagtacaccatccgtcccttgggagtcactggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacctcatgtactatta

SEQ ID NO: 205883 - DNA, 726 bp, Homo sapiens
ctgttattactggaagcttttttgtttgagactatactggtagcttttttgtttgttttcttcttcctgcataatcatcgtttcttccacgttgctctcttctgtttattttgatgtctgtgtttcgtgttcagggttttctttgattagtttcttgcttagaatcacacaaagaccaaatcctcataatgagaatccttatttgcagttttgtgtagttctctaattatcgtgaagtgtaatagaaaggtagggatagtgtattgctcacagaagctgctaagttaaaagtgctcagaattctagagctgctaacattaaaaacaaaaatggccttgtgttttacttgattaaaattaagccttaagtttagaacatctttaaacttggtttaaaatgttcattttagggtgtttgccagcttcccagtaaaaatgatgaaaaagaatatccacacagaagaattgatatcaggtattgttcagactttgttgctgacctgttaacttttccaaacttgtctcgttttctccctccctgtttgtatcttggagttcacattcatatctagagcctttttttactcccaagagccatatgttcttgccaaatgcaatgtttagctccaaagtatgtaaagaataatgactgtctacagactccaatttattttctctagatttgcacctcaccatgatgccttccacagctcaaaagtcatttcct

SEQ ID NO: 205884 - DNA, 1267 bp, Homo sapiens
agcgccgtgcgccccgccccccatcgggggcaaccattgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaaaagcagcatctgttatagcaaaatacccacacaaaataaagagtggagctgaagctaagaaattgcctggagtaggaacaaaaattgctgaaaagattgatgagtttttagcaactggaaaattacgtaaactggaaaagattcggcaggatgatacgagttcatccatcaatttcctgactcgagttagtggcattggtccatctgctgcaaggaagtttgtagatgaaggaattaaaacactagaagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagccaaaactgttacatcaggttgtggagcagttacaaaaggttcattttatcacagataccctgtcaaagggtgagacaaagttcatgggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaagggtttcacaatcaatgagtacaccatccgtcccttgggagtcactggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacctcatgtactatta

SEQ ID NO: 205885 - DNA, 1286 bp, Homo sapiens
agcgccgtgcgccccgccccccatcgggggcaaccattgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaaaagcagcatctgttatagcaaaatacccacacaaaataaagagtggagctgaagctaagaaattgcctggagtaggaacaaaaattgctgaaaagattgatgagtttttagcaactggaaaattacgtaaactggaaaagacttttttttttcttaaagattcggcaggatgatacgagttcatccatcaatttcctgactcgagttagtggcattggtccatctgctgcaaggaagtttgtagatgaaggaattaaaacactagaagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagccaaaactgttacatcaggttgtggagcagttacaaaaggttcattttatcacagataccctgtcaaagggtgagacaaagttcatgggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaagggtttcacaatcaatgagtacaccatccgtcccttgggagtcactggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacctcatgtactatta

SEQ ID NO: 205886 - DNA, 1238 bp, Homo sapiens
agcgccgtgcgccccgccccccatcgggggcaaccattgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaactcgcaaactttgagaagaacgtgagccaagctatccacaagtacaatgcttacagaaaagcagcatctgttatagcaaaatacccacacaaaataaagagtggagctgaagctaagaaattgcctggagtaggaacaaaaattgctgaaaagattgatgagtttttagcaactggaaaattacgtaaactggaaaagattcggcaggatgatacgagttcatccatcaatttcctgactcgagttagtggcattggtccatctgctgcaaggaagtttgtagatgaaggaattaaaacactagaagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaagggtttcacaatcaatgagtacaccatccgtcccttgggagtcactggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacctcatgtactatta

SEQ ID NO: 205887 - DNA, 965 bp, Homo sapiens
aggaggcaaaggttgcagtgagccgagatcgtgccactgcactccagcctggcaacagaacgagactccatctaaaaataaaataaaataaaataaaataaaataaaataaaatagagatttctccataaataattagaaaactcatgttaaaaatgttttcttcccgggctcgattccctgccaaaaaaaaaaaaagttttcttattcaggcatgatgttgttcctggtactctggatgctgaggtgggaggatcacttgagtccaggagttcaaggctatagtttgccatgattgtacctgtgaatagcacagtctccagcctgtgcaatatagcaagactgtgtctctaaaaatattgttaaatattttcttgccattacaaagtaattactctttttcttattccctaattatgattctacagccaaaactgttacatcaggttgtggagcagttacaaaaggttcattttatcacagataccctgtcaaagggtgagacaaagttcatgggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaagggtttcacaatcaatgagtacaccatccgtcccttgggagtcactggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacctcatgtactatta

SEQ ID NO: 205888 - DNA, 1120 bp, Homo sapiens
agcgccgtgcgccccgccccccatcgggggcaaccattgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaactcgcaaactttgagaagaacgtgagccaagctatccacaagtacaatgcttacagaaaagcagcatctgttatagcaaaatacccacacaaaataaagagtggagctgaagctaagaaattgcctggagtaggaacaaaaattgctgaaaagattgatgagtttttagcaactggaaaattacgtaaactggaaaagattcggcaggatgatacgagttcatccatcaatttcctgactcgagttagtggcattggtccatctgctgcaaggaagtttgtagatgaaggaattaaaacactagaagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagccaaaactgttacatcaggttgtggagcagttacaaaaggttcattttatcacagataccctgtcaaagggtgagacaaagttcatggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacctcatgtactatta

SEQ ID NO: 205889 - DNA, 1326 bp, Homo sapiens
agcgccgtgcgccccgccccccatcgggggcaaccattgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaaaagcagcatctgttatagcaaaatacccacacaaaataaagagtggagctgaagctaagaaattgcctggagtaggaacaaaaattgctgaaaagattgatgagtttttagcaactggaaaattacgtaaactggaaaagattcggcaggatgatacgagttcatccatcaatttcctgactcgagttagtggcattggtccatctgctgcaaggaagtttgtagatgaaggaattaaaacactagaagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacaggtgcctcagagtttataatcaatggtgatcagtcttacacaacagtgaatttcactttttaagtgatagttgggtattttcagaataagttttgttttcgccttcctgaaaagtctgaagagctttgtactgattgaattctgcgaaaggcaaatttctcgaaaaggatacctattattcttccatgagttgctgggaggacagtctaacatttgaaagagaaaacattgaatacaatagttttagaacgatttactgtctgtgataaatactttagaaatactataatcagattttcattaaattttatcttaaaaaatgaaatattgagaaaccttctattagaaaacctgtgaaggcaaaacattttttattttagaatatatgcctttggaaggtgaaacagctgactctttgattgcttttttttcccatgagccatttcaagaacaggaaaactctttgatttaaggaaacagataaatacaactgatcattgtttttacaatcgtaataccttaaacagtggtttctaaaaatatgtttcatttgataagatgaattttctattagagggaaaaagtacttgctcagaac

SEQ ID NO: 205890 - DNA, 762 bp, Homo sapiens
agcgccgtgcgccccgccccccatcgggggcaaccattgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaactcgcaaactttgagaagaacgtgagccaagctatccacaagtacaatgcttacagaaaagcagcatctgttatagcaaaatacccacacaaaataaagagtggagctgaagctaagaaattgcctggagtaggaacaaaaattgctgaaaagattgatgagtttttagcaactggaaaattacgtaaactggaaaagtgatattttcaataagaatatgagggctcatgccctagaaaagggtttcacaatcaatgagtacaccatccgtcccttgggagtcactggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacctcatgtactatta

SEQ ID NO: 205891 - DNA, 1208 bp, Homo sapiens
agcgccgtgcgccccgccccccatcgggggcaaccattgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaaaagcagcatctgttatagcaaaatacccacacaaaataaagagtggagctgaagctaagaaattgcctggagtaggaacaaaaattgctgaaaagattgatgagtttttagcaactggaaaattacgtaaactggaaaagattcggcaggatgatacgagttcatccatcaatttcctgactcgagttagtggcattggtccatctgctgcaaggaagtttgtagatgaaggaattaaaacactagaagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtaacatacttcctaatcttgggttatttttgccctgatgttaaaattgcctaatatatgggaagaatttggattaaaaagatgtaatttgtggtacttcatagactcactaagacctagtagtattagttaagggtatttgtttatagatgggaatatgtaactaggggaaattcatcctgattttattataggatgatattttaatgactagttttaacgacgtttattaaatgactttaagtatattgaaatgctagtaatggttgtctttggccttttggctggatgatagtgaagttgtgggtagttttgttaatttacctttctttttcctttttttttttttttttgagacagagtctcactctctcgccacgctggagtgcagtggcaccatctcggctcactgcaacctccgcctcccgggttcaagtgattctcctgcctcagcctcctgagtagctgggaatacaggcgtgtgccaccatgcccagctaatttttgtatttttagtagaaacggggtttcaccatgtttgccaggatgg

SEQ ID NO: 205892 - DNA, 908 bp, Homo sapiens
tccagggtttttccctcaaaagcattaattaacatgtcactttatttatcttctatacagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacaggtgcctcagagtttataatcaatggtgatcagtcttacacaacagtgaatttcactttttaagtgatagttgggtattttcagaataagttttgttttcgccttcctgaaaagtctgaagagctttgtactgattgaattctgcgaaaggcaaatttctcgaaaaggatacctattattcttccatgagttgctgggaggacagtctaacatttgaaagagaaaacattgaatacaatagttttagaacgatttactgtctgtgataaatactttagaaatactataatcagattttcattaaattttatcttaaaaaatgaaatattgagaaaccttctattagaaaacctgtgaaggcaaaacattttttattttagaatatatgcctttggaaggtgaaacagctgactctttgattgcttttttttcccatgagccatttcaagaacaggaaaactctttgatttaaggaaacagataaatacaactgatcattgtttttacaatcgtaataccttaaacagtggtttctaaaaatatgtttcatttgataagatgaattttctattagagggaaaaagtacttgctcagaac

SEQ ID NO: 205893 - DNA, 1430 bp, Homo sapiens
agcgccgtgcgccccgccccccatcgggggcaaccattgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaactcgcaaactttgagaagaacgtgagccaagctatccacaagtacaatgcttacagaaaagcagcatctgttatagcaaaatacccacacaaaataaagagtggagctgaagctaagaaattgcctggagtaggaacaaaaattgctgaaaagattgatgagtttttagcaactggaaaattacgtaaactggaaaagattcggcaggatgatacgagttcatccatcaatttcctgactcgagttagtggcattggtccatctgctgcaaggaagtttgtagatgaaggaattaaaacactagaaggctcacagctggattcatgcccagtaaagggacacctgaatggaactgagtcacttttagacttaatatgggatgttatgacaattcttaagttaaaaaatgcagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagccaaaactgttacatcaggttgtggagcagttacaaaaggttcattttatcacagataccctgtcaaagggtgagacaaagttcatgggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaagggtttcacaatcaatgagtacaccatccgtcccttgggagtcactggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacctcatgtactatta

SEQ ID NO: 205894 - DNA, 1191 bp, Homo sapiens
agcgccgtgcgccccgccccccatcgggggcaaccattgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaactcgcaaactttgagaagaacgtgagccaagctatccacaagtacaatgcttacagaaaagcagcatctgttatagcaaaatacccacacaaaataaagagtggagctgaagctaagaaattgtccatctgctgcaaggaagtttgtagatgaaggaattaaaacactagaagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagccaaaactgttacatcaggttgtggagcagttacaaaaggttcattttatcacagataccctgtcaaagggtgagacaaagttcatgggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaagggtttcacaatcaatgagtacaccatccgtcccttgggagtcactggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacctcatgtactatta

SEQ ID NO: 205895 - DNA, 1241 bp, Homo sapiens
agcgccgtgcgccccgccccccatcgggggcaaccattgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaactcgcaaactttgagaagaacgtgagccaagctatccacaagtacaatgcttacagaaaagcagcatctgttatagcaaaatacccacacaaaataaagagtggagctgaagctaagaaattgcctggagtaggaacaaaaattgctgaaaagattgatgagtttttagcaactggaaaattacgtaaactggaaaagattcggcaggatgatacgagttcatccatcaatttcctgactcgagttagtggcattggtccatctgctgcaaggaagtttgtagatgaaggaattaaaacactagaagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagccaaaactgttacatcaggttgtggagcagttacaaaaggttcattttatcacagataccctgtcaaagggtgagacaaagttcatgggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaaggacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacctcatgtactatta

SEQ ID NO: 205896 - DNA, 460 bp, Homo sapiens
ttaaggtcgaataatagatcccttcagttataatcagtgataagcctgtgagttttcagcctcttactcccacgtgacaatgtaacctgcttacctgcattcttgaggcagagaggcccttgctgcagggtctttaaagactgcgtgaccattcacaggacacttcacagaattaaggccatgaggaagtaatgctgctgctcaaggaaataagtgtccatcatttttcttgaactttcttctgcataagacaaacttgtacattgcttaggaaaggcatttctctttctgtgccaacttttgttgctgtcttgattaggagtgaccatatgccagtggttaataacaaaaataatgcagtctgtctgacttattatttaaagctttttttaacttagatactctgaaaagcccaaagaagatgaatacattgaataaacagaatggagtattttcaaag

SEQ ID NO: 205897 - DNA, 510 bp, Homo sapiens
ggctgtggcctcagtctgtcccatttctcagaaggataaagctgagggccagagggtttctatgactgcactgctgcaaaagcagtgagcggcagagcccgcccgggacaccagggtgccctgactcctccgcccgggatgccagggtgctgactccgcccacccgggacgccagggtgccctgactccgcccacccgggacgccggggtgccctgactccgcccacccgggacgccggggggccctgactccgcccccccgggacgccggggggccctgactccgcccgcccgggatgccggggtccctgactccgcctggctctcgctgcgtccggctcctcggctcagccccacccctgcacccaccctggtatttttttcaatattttttttctttctgaaaagcagtattgacttttatctgctaaagaaaaatgatctaaaaagtgacagccctgggaaaatattatgctataatttttaaggaataaaagaggatgcagtaag

SEQ ID NO: 205898 - DNA, 351 bp, Homo sapiens
ttcatctgttgttggacagggtctgtgggatggacacccgcagcagggcagtgatttttacccctagtgcaattggttcctactgctatgtgctttctccattggctggggttggaccgcacagtctaaactgacccaattggctaatgtttgaaattgaacacagctatctaggtgggaagggaaaggctattcgttatagcacaaggcacgtctaggcttgtcagggcacggcaagggtgggaaggattgtttaccacacatgggtaactacagaaactagagaaacaaagaatgggaagaacagggaattaaaaccttttgaagaggaatttatcatctctgacaatt

SEQ ID NO: 205899 - DNA, 412 bp, Homo sapiens
tggctgaaattgtgacacctttgctttctgacggttcagtgtacacactttgtttcatgtacagaaatggtgaaaaatatgatataaaattaccttcaggctatctgtataaggtgtatatgaaacataaatgaatttcgtgtttagacttgggtctcatccccatgatgtctcactatctatatgcagatactccaaaatctgaaaaaaatctgaaatccaaaatacctggttccaagctttttgaataaggagtacttagtcaaaatgagttcacaatatacatattgttttataatttgacctttcccatttaatagtatatcttgaacttctttccatatgttattgtttatttttaaattttttttgaaaatactttatagaccaggacatacttttcaagttgcct

SEQ ID NO: 205900 - DNA, 424 bp, Homo sapiens
acactggagaatttcaagaaaatgaagcagaaaaccataacacttggccccatggaaagtgaaaagctaccagccatattctccgtcctgtaatctctcagtttcatgagcctcgactttacttccctgtgtatatctgcactcgaagactctgcctatgaccttttcagcctctggatcccaaaaaagatgttctacctatcagatacgtgttgaagagtttccttggtccagtgagctgtgacttgtgagaatggagatcacaatgtatattattccctgtgcctacccttttatcctagagtatcaaccaacataaattaatggtgctgatgtaagcatggaaacaatgatttacaaaacacaacaacaacaaacaaaaaactgttaaactgtgattaaaaagaaaatcaacaaacaaaaa

SEQ ID NO: 205901 - DNA, 924 bp, Homo sapiens
  misc_feature (770)..(770): n is a, c, g, or t
  misc_feature (924)..(924): n is a, c, g, or t
tattcttttagatagcaagattttaaaaaataagtcaaaataccaaaaatcctagactagaaggtaatactatcaagaaagggtaataatgatgacctcataatctggtagcatgggtattctgtggagacttgggggatgacttagtccctggaaatatccaaaaccacaggttgaaacattattgcaacattgagggttttaaaaccctctaggaacactgagggcctcaagctaaatgtgaacatgaatatcttatggaagatgagagagtcctctatcgcactggagcaaaaagatgcagggcgaatgtagaaagcagagttttttgttttttgtttattttttagcctacaatttataccttctctctctctcccccattaaacacaccaggaacacttaataaattcataatgctgaattggcaaccaaatttgtagggaagggtgtggagcagggaggtgaaaaccaagggattccataagaaattgcctctgctacctcatccatctcttaaagcaaataatacatgcagcactcaggctaatgaggtctccaaagaatgtatgtttttgtgtggttataacaaattaaaaaaataagtcatcagctcagcaggaaagtgcttaaaatcttgttttgtagtctttaatgctgttctgaaattaaatacaagagctttctcgaatatataatttgtcctgtcattctaggtagtttccgtggttggatggattgccttggtatggaaggttggtgtgtccccncaacttcctttgatgtagcttaacccggtttgggggcccgatgataacagggcggagccctgggtccattatcgcacaggtgtgtagagcggccttttggcaaaacttctggacccggaaattttttagacatcttcaaaaagataggcggggn

SEQ ID NO: 205902 - DNA, 498 bp, Homo sapiens
gtgctgggattacaggtgtgagccacagcacccagcacgcaatttatttcttggctggagttccacttgtattggtgcaaagaggagaatatttagagtttaaaacaaatggttcataaacaaacaaacgaaatgaatctgtatataaccttaacaggaagaggctattttagcctctattgttgaatgaccttacataaaagctttccgcagagagagttgaaatacttacaattattttatcatgaaaaactatgtcttttaatgccactgaagtaactttgttgagtctaaatctaacacatactaaagacttttgattgtttgagaaaaggcttggtccatagggatttttatttgtttaaaaatatttaataaaggccgggtgtgatagctcatgcctgtaataccagcactttgggaggccgaggcgggcggataatttatgtcaggagttcaagaccagcctggccaacatgatgaaacttcatctccact

SEQ ID NO: 205903 - DNA, 214 bp, Homo sapiens
tcattgtaagttgccaagatgaacaagtcacctttgatatcatattcaactggcatttggtatggaaaaaaactttgtaatttacaagtcttggactggcaacattgagctacattagccaagcacaaaatctggaaagtctaatggcagggcagcctcttctcttcacatacattgaaaaaacagctcttcaggaccactccctccctgctta

SEQ ID NO: 205904 - DNA, 391 bp, Homo sapiens
tttgcaatttagctaagaagctgtcttgctttttgagaggggaagttccaatattgtaagcctaggtttctgaatatatttttgttttttaataaatgtagaaagaatgttttttgttaatcctggcatttgtctagagcaaaagcaaaataaatgaaaagtgaggaaaattaaaaggctcacgttataacatgtgctgtctagagaataaaaactcatttgtgcaaagttggtatggcttttatgaaaatatttcagtccgagcaccttgcctgtttgctgcagtgctgactgactcatgattagggatctgtgttgcctttattgctctcggtttgccctatggcttgatttattaatatatttaaatatacaattttaaccttatcat

SEQ ID NO: 205905 - DNA, 336 bp, Homo sapiens
tgaaccagatctagaagggacattcatcactgtcactgggatgctgttaattaaaactcgagcatacaaccattcctaagaataaaagaggcagtgggatgttgcttatttgtgagttcattggaaaatcactagcttgtttttgccacaaaatattttttatgttgttacccaatacccccccccactgagacacacacacacactcaacacaaatacaactagagcaaaaaattcattaaataatcctctgtgtgtgatatagtctcatagtttctattctattttattgttttaaagtgctgtcatgacccattaaactgttattatggctga

SEQ ID NO: 205906 - DNA, 548 bp, Homo sapiens
ctgtgcactgtttagggaatgctatcagtctgaaaaagcagcagactcactcattttacagatcttgtaagggtagattcctctctgactttcgattgcttttttctccaaatccccattggatctctgccacgcatatgtatgttaatgataaggcggggatttggtcttgctcctgtggctctcaggattccacccactgacccctcgtccccagctttatgtgaaataactactctgcctgccctgattcctgttctcagccatctccagaatgtaagtctgtatctatgggacttggaatgggagttgtggtagtgagtgccattagacaaaaatgaccagacttggaattcttactcattgcaatttctataattaaaagtaaatctttctttggttatttctgtcgccttcaaatgcagttattcatcgtttaatgatggggatatgttctgagaaatgtgtctttaggtgattcatctttgtgtaaacatcatagagtgtatttacacaaacctagatgatgtagcctactacacacctag

SEQ ID NO: 205907 - DNA, 474 bp, Homo sapiens
accacctaacacttagctcaaaccctgtgctgctggggaagttcccttctcctctactccaacttcttgcttcggggcggactgtctctagtctgtctgttgtctcccctctgaatcttcttgcttttcattttccttttctataagctttcttatcaaaaggaaaaattactgattggaccaattgacgctgaacatgccttaaaaactagtaaactattccaaaaatctccgtgatgatttcatgttccgtttcttcactcctgagaaaagctgtgctcctccccttacccttgcagactatcctgcctggtggtctggcatcttcccgatgtcccgtgggctgcagagatggaatcagggggtgagggggaagcaaagcaaggcagagctgggtacagcctagaagaggttaaataaggtaactgctcgagcgaaagccatacgtactggaacgccatcgggaaccaaatt

SEQ ID NO: 205908 - DNA, 365 bp, Homo sapiens
cttgtttttttttttggcataagaagcccatgtgaaaacacagttgaccctaagcctatgaaaaatgacttgtgtgtgggactggggtggctcataggagaaggaggatattcgtctggatttttactggtatgtatatatttttgggtactggagatggggacagtgagtatttgaagctcacagcaggcccattttgcaagttttcaggaaactgaaattcagagagattaagtattttgccatgaatcactttgtagtaagtgggagagctgttgcaaacccacgtctgtctacatccacagcctgtgctcttttcatatacaagggaatatggaggagaagggaagtgatggaaggcttta

SEQ ID NO: 205909 - DNA, 434 bp, Homo sapiens
gaaaggtaagggaagggagccaagtaggtcccctgtaaggactttgacttcagagagaagaaaggttttacacaaaaagatgatctgattattataaggatcattcagatgctgggttgagaacagacaaggggacaacagcagaaacgggggtcagttagcaggctgcaataatatatgttgtgcaaaagtaattgcagttttgccattacttttaatgtaatgcaaactacttttgcacaaacccataatgagatgagaagtgatacaggctgggaccagagtggtagttctggaggtagtgaaaaagtgatcatagccaagcatgatggcacacccctttgtcccagctactcgggacgctgggcaggttgaagctgcagtgatccaagatctctctactgcactccagtttgggcgacagagtgagacct

SEQ ID NO: 205910 - DNA, 479 bp, Homo sapiens
ggcctggcagcgcttagcgcggcggagctacaaggccaaggtcacagcgggcccaggcacgagcggccccaacccggcgtgagcgtctcggataggcggcggcccgagcccaggcccggccgcatgctgtttccccgcgaagtgcgaaaatatcgcggaggggccgctgccgctggctcagacccaggggacccggtgacacgttcgtttttaaccagcagctccaggactggatgtcgttatctttcctggctagcgagtcatgtcattgtgtcaaaactgtcctgcaaaatacgcagaagttctgaatcacatttacttaactgtcgtcagcacacagtttaaaaatatacacgaggccgggcgcggtggctcacgcctgtaagcccagcactttgggaggccgaggcgagcggatcacctgaggtcaggagttcgagaccagcctagccaacatggtgaaatcccagctctactaa

SEQ ID NO: 205911 - DNA, 309 bp, Homo sapiens
ccagagcatggagctctatgtctaggtctttggtaaatattccagttgccagatttagtggtcatttctttgtctctgatccactttacctccctccagcatttgccagtggccagcacctcctgaaaagatagtccccctcgcttgtgcttctgcttctgcgtggctagacttgcctagttctccttttatgtctctctcctgtcattctcacttccttctgctgctgcttctgcttcctgcccgataagtctaggcgtttcttagggctccacccttgatcatgaccttgtcttctccgggacattt

SEQ ID NO: 205912 - DNA, 780 bp, Homo sapiens
atccttttcaaaactattattttctttacagcaaagttctaaaaacttggtttcttttgatttctccccctggcaggaaaatgacacatttggggccaaggcatgaaagcgtggcctcttgggagaagggggagggctattgctttcgagcccgcaaacagttgcaggtgcaaaaaatgtgcacacaaaaggggaggtctggtaggggccccttttcaaatgtaaccttttaagttcaatacatctctttgctcttccttttgtgagctgcgtgcttccctcccacgctctaatgcacatcccggtcttcaatgtggcctccagaaggaatcttcatgtttgttgtgaagttttccgtaattacataatcgttgaagtctgtgagttcgtgttgaggtggctgaaaaatgcgagcttgaggattacagtaacataattagatcgcttcctgtaagaacccagcgacttttccctgggtccgtcttcgattggctgccctccgaggccttcctcctcccgagtgaatcacagcccgctcagtgggcatttctgccggccaaccgctccaaggtgtttcgcggcatctgtttgtgttgtgggtgaattctacaaacacactctgttgatttgattatgaaggaaggagcaacaaagccagagggctgtggtttcttgaatgcctttgtgtctatgtggtgacagaaccagtgcttagtttgtctgggccacggtaccttgactcatccggtggtgtctagaagccttgattccttgccttgg

SEQ ID NO: 205913 - DNA, 507 bp, Homo sapiens
gggtttcaccatgttagccaggctggtcttgaacctcaggtgatctacccccctcggcctccaaaagtggacttggtgtcttcttgacaccactatttagctttctaacaggcatctaaacttaacatgtccaaaacaagtggacccacctgcctgcactaacctttcatatttgctaaatgacaacttaattgaagctctactttgttctaactgctttcactacctccaccactaaagccctggtctaagcctgattatcactcacctagattagtgcaatagcctcttatcagctcccttgcttccatcttttccccctaaaatctgttcactgatggcagccaaagtggttctttaaaaaatacaaatcagtttatgccattgttttactcaaaaccctccaatggctcccatcttactcagagtgacatccaaagtcttcaccatagccttcaaggcctacatgcttcctgtattcactctacgtctctctggtcagccccc

SEQ ID NO: 205914 - DNA, 657 bp, Homo sapiens
agggcccttacatatttgcagacacccagcatatacttgcaatcttttcttcttcaggttcattaccctagtccttttagttgttcttcatttgacataatttcattattcactagtgaaccttgctgcccttccccttgataaaccgaatttgtcagtgtcattcaagtataactgacctcacagaacgtgataccacaagcgatgtggtctgattagcacagagttcagtgaatgaatcctacactaggattggatgaaatttacttagccataccacactaacacttatgtgatttttatgtttactatggatagactatttctcctgtgtccacttcttcctcttacacagttgttatttcaaaactgaagtacagattcttacacttaccctcaggagattcatcatgttagtattagtctctcttttcaggctttatgaatgttaattcagctaactcatttttgagctatctgtctcattttgtgccatctgcacagcataagtttgatttctgttgcttttattagtagttttactaaatacataaaagtgaaatagtgaaacacagagtcttgtagcatccactgtgggatcagtcttttagacaagaatgatgcagttgctgagtcaaatgaataaatgaataaatc

SEQ ID NO: 205915 - DNA, 364 bp, Homo sapiens
caatacaacatacagcggtaaacaaattcaacataatctctaacaaaattctaatagcgcaatctttttacagaaatagtttaaaatttttaaatttgattaaaaactatagcaaaacatccattaaaaagaagatgcattatactttctgatttcaaaacataataaaagctacagtaacaaaaacaatgtggtattgacacaaaaatagataaacagatgaaagaacaagacagcccagaaatgaacccttctatatatgatcaaatgatcttccacaaagttgccatgagcacacaatagagaaaagatcgtctcttggaaaagtaatgttgaaaattggataacactgataaattaagtt

SEQ ID NO: 205916 - DNA, 491 bp, Homo sapiens
acccatagaactgaaaaagtaccctgacctcactttcggatgtccttctggttttcccattggctgaacccaccagaaaggcagagggcagcaaagtgtcacggtagtccgcaggtcgcttcccagggcacacagcaggatggtcaagggagtaagtaaatcagataggggcaaacagaggatcactgactcaagatgtggttttaattaatagaaatggaggctgagtgcagtggctcacacctgtgatcccagcactttgggaggccaaggcaagaggactgcttgaacccaggagttcaagaccagcctggggaacatgttgaaaccctgtctcttgaaaaaatacaaaaattagctaggtgtggtggtgcacgcctgtagtcccagatacttgggaggctgaggtgggaggatcacttgagcctgggaggtagaagctgcagtgagctatgatcacaccactgcactccagccctgtctcaaaaaaa

SEQ ID NO: 205917 - DNA, 219 bp, Homo sapiens
ctcccaaagtgctgggattacaggtgtgaaccactgagcctggcctccttattcttaatgaccacttggaatccaatgacagaatctgccaccacaacttccagcctccaggggacggacacccactttcaaggatttcttcccagggacatgaccctatgccagcccacaccacagtcttggtcatcactcctgtttccatggtgttaacagcagcag

SEQ ID NO: 205918 - DNA, 388 bp, Homo sapiens
  misc_feature (2)..(2): n is a, c, g, or t
  misc_feature (4)..(5): n is a, c, g, or t
antnngaaattcccgggtcgaaccaagcgttcgggaaaatccagttaccttgccttttggcagcctttaaaatccacccagacgtcttgtctgggggccctttcaacatcttcaaagccaacactgtcacagcaagtatttctcacactgccatctccctggtactgcctcttctgcctctcccttccacttattaaggccccttgtgattacagtgggcccacatggataatccaggaccatcaccccaccttacaatcagctgattgacaaccttaattccctttttccatgtagcttaacataggctctggagatgaggatgtggacatctttgggggaccattattctacctaccacatccatgtttcctgttcatttcaataa

SEQ ID NO: 205919 - DNA, 338 bp, Homo sapiens
ggtatctgtcagcctctgtatcccttagaattagaaacaatactaattactctccaacactcgatcttgatatatcattgtatattcaagaagtggaaaataaaaattaatgtagagtctaatgggccacatggatcaagaccaaaaaaaagtacaaaaagaccaaaaagtatatcctcctaagatgggaagatattgtgtctgattaaatattacatatggaaaatggactttgtatgaggttctgtatatgatgatgcacatatgggattatttagaatgtaaaattgctgtgattgaaacagaattcctgaatccaaattagacaaatgtcagtt

SEQ ID NO: 205920 - DNA, 460 bp, Homo sapiens
aaaagaaaaataatagaaaagcagctttgtagaggaatgaaatgtcctgaaactccctactcccagagaaatgtcttccctggcttacttggatttattgaggcaaatccttaacctacttacatgctgtttgtttgttcaacctggaaagaaatccatttgcatcgcacccacccacccaaagaggactggagtatgctcccattcaggagagagctctgctgtagggatggtacactctacaattgctgaagaaagccagttgaatgatcaacagggaccactgtaatccttcaatcataattacaaatacacagactttgaggaaaagtaaaccattaattagaaacatctataggaacaggtggaacagatggtccttgagagattaataatggcaatagaagttaatttaacatttccattaaaattattaaaaacatttgacagaatattgaaa

SEQ ID NO: 205921 - DNA, 419 bp, Homo sapiens
cctaaccatttttatactctagttactaataatggttctcaactctcttagccttgacacttcctatttcatattctttgtaatgcttgctttttatctaaaattaatgatgaacataatctgcccacgcatataatgttcaagaaataaatgtgcatatgagagtggaaatgaaagtaatataaacatctaaaatcatgtattacatttctgaaattcaaaaaacttcaaacatttttcctaagacacagacatttgggagcaaaacctggtcttaattgaaataaatttaattacagtttttatacaagtggtgaatttctgtgttttgctgcaaaaatgttagtatgtttggtcacaggctactgttccagactccactggaacagtagtactacttaatatgctttgaaatgcaa

SEQ ID NO: 205922 - DNA, 368 bp, Homo sapiens
ggaatactacacagcattaaaaaagaattaattattgagacatgtaacaacatagatgagttagacaacatagacttatctattatacatttgcttatgctttcatttggacaaaagatatactcagaagagatcacagtagtatctcttaggcctagaagctcttaggcaggccaattaaacatctgagagtaccactgatactttcttcaccaatttctcctgatcacttagcctcggaaggacagtacagcacatttttcaggatactgggcttacagtcagagacccaagttaaaatactggctttgccactacttgcaatataacttttaagaaacctaagatctctaaattttattttctcc

SEQ ID NO: 205923 - DNA, 750 bp, Homo sapiens
catcgtggaggtgaaggtgctagacgtgcagaagcggcgggtgcccaacaagcattatgtctacatcatccgggtcacgtggtccagcggctccaccgaggccatttaccggcgctacagcaagttttttgacctccagatgcagatgttggacaaatttcccatggaaggaggacagaaggaccccaagcagcggatcatcccctttctgccaggtaagattctcttcagacgaagccacatccgggacgtggctgtcaaacgcctgataccaattgatgaatactgtaaggccctcatccagctgcccccctacatctctcagtgtgatgaggtgctgcagttctttgagacaagacctgaggacctgaatccccccaaagaggagcacattgggaaaaagaaatctgggggtgaccaaacctcagtggaccccatggtcctggagcagtatgtggtggtagccaactaccagaagcaggagagttcggagatcagcctcagcgtggggcaggtggtggacatcatcgagaagaatgagtcaggttggtggttcgtcagcactgccgaggagcaaggctgggtccctgcaacgtgcctcgaaggccaggatggggtgcaggatgagttttctctgcagcctgaagaagaggagaagtacacagtcatctacccgtacacagctcgggaccaggatgaaatgaacctggagagaggggctgtggtggaggtcatccagaaaaacctgga

SEQ ID NO: 205924 - DNA, 560 bp, Homo sapiens
gagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcg

SEQ ID NO: 205925 - DNA, 899 bp, Homo sapiens
ggcccgtagatcgatcaaacaggtggtcagagaaggtttaagggggcagtgagaaaagacttgaaggaggtaagggagtcagtcagccatgaaatctggggaagagtattccagaataaggaggacaaaggtcctagaatagcaatgaggacagggaagctggagggaagccaacaaaggggttagctgtaggtgtcaagggacatgcgtggaaacaaggggtacagattatgtagggtttatgcgacactataaggaatctgatttttactttgaatgaaacaaggatccacacagagggttggggagactgtcatgctcagttttaccaaaataactgtggctgttgtattgaggacaggccttagcgaggacaagggtgaaagcagggataactgttaggaggctacaaaagaaaccatggaaagaaatatacacttcctacaaacttggatcataatggtgcagggatttactttaaggcaaaaataaataaaaacaaatttgtcagatgttaataggaaataactgtaactggctcttgtcattatatgtacattgtacatataaagcagcaaacaatgacatcttttaactactcacctcaagagaacatgttcctttacaatcagctattcactgttaattacatataatttgttgaaaaagttacttttatcaactgagaatactataaatctgctgtgtgaggtagctaacgcctgtaatcccagtctttgggaggctgagggaggaggatcacctgaagccaggagtttgaggctgccaagtgagcaatccagtctaacctggatgacagagggagattctcaactcaaataaatgaataaataaccttggattgctgtttctcaggtttgatcgagctacggtaccgg

SEQ ID NO: 205926 - DNA, 512 bp, Homo sapiens
atccagctgcctattgtgccttcggtcatggaagccatggcactacaagctgggcatggctactgaggcctctttgctacaagatggagaaaaacctgggtcttctgtcatataccacttggaggaaggggtagcctcccgtctttagttccttgctaaataccatggtgttgggggacccatcacccctctcccagaccctgtggctacctgcagagccccttgagatcaaatggagtgaaaaacaatggtttgtacaatttatggatgataccacaagcattgtatacaatggagtttgctggagagcttatgcgtttcatcctttaaccatgatgcttctgataaggacaggaacacaggtgtcagtacagttggccaaacttcaggcattcaccttagcactgtatgccctagccaacaattggccccatctgcacatttttacaggttcttgagccactgcctaagagttgccccatttggggaaagaactctgagaatctctaacc

SEQ ID NO: 205927 - DNA, 383 bp, Homo sapiens
tctcagcctcccaaaatgctaggattacacgcgtgagtcactgcgcccagcccccatgttgtttttaagagtctcatgttctaccgactgagccagccagagctatgttgtatttaaataaatatcgttctacatcttcctttctagttttatgccatttattttttattctttccacattacactggttagaacttccagtacaatgaggaaaaactggtaagaatggatatttctgctttgtgatagatcttaggagacaaggattaaatctttcactccttctagtgttgctacacagaaactatagagtcctaggaggctgggtgcagtggctcagcactctgggaggcctagacaggaggatcccttgagcccaggag

SEQ ID NO: 205928 - DNA, 345 bp, Homo sapiens
tttctggctgtccctccttgctaacgctcgccagagaaatattccgtggaggtgttaaaacaagactagtggaaagaaatggtaacttaaaaagaaagaaaatccatggcagtgaagaacagatttcatattagtactgtcataatattctctaatgtatcatataaataaaaatctgtttagaccagaattttaataagtcaccaaaggaaggttttgaatcctacagtttatgtatccccctttgcgatgtaaatgttcacatctcaagtgaagtagagtggggagacgcttcggagactagaggctgttaattagtgaggtatattttgatcagggcaagaa

SEQ ID NO: 205929 - DNA, 491 bp, Homo sapiens
aatttcttttttatattttatagagatggggtgtcttactatgttgcccaggctggtctcaaactccaaggctactttttcacttaaaatattttttaatatctttccaatcttttaatttgtttatcccacaaatacttcattccaaatgcacatgtaggaagactgtcatatttggctatttattgagctcacttactagttttaataggtttcctctggttttccaggcaattctgttatctacaagtagtgatgactttgactgtttttccatactttttgctaacttaattcttttcctggttttattatgttagttagacttttcaaagtaaagttgaataataatgaactcttactcctcatcttctggattttaaagggagtatctcactttacagttaagtatagtcagccgaaattccttatatgtgggttccacatccatgaatttaaccaactgcagatcaaaagtattctttaaaaaa

SEQ ID NO: 205930 - DNA, 217 bp, Homo sapiens
ctgggaccacaggcacccaccaccacacctggctaattttttgtagaaacagggttttgcattgttgcccaggctggtctcaaactcctcaaatttctgttgtaatttcttcttcagcctattagttactagggagtgaattttttagttcccacatatatgagtttgagactgtattttagtattgacttctaatttaattgggttgtgtttagag

SEQ ID NO: 205931 - DNA, 235 bp, Homo sapiens
agcattctctgttgaagtgattttaagtgtgatttttccttaatgcatacgaaatacggtttgatttgcagaactttgatttgtacacatcctcttgggaatataactgtgcctaaagctggctacatctgtacttttgacttgattgtttttcctgataagttagggaaaacacacatgtaaaatgaacttaattttaacttgcagtaaagaaacatttttcagaaagcattca

SEQ ID NO: 205932 - DNA, 609 bp, Homo sapiens
ctgctttattaaaattaggtgacttttcaagactccatgcaaaaggtggcatgcatagctctggccatgcaatagaaactaaagtaaggttcccgtgtataatccaatcacacagctgccccgccttggtctcacaccaggtctgcaagatggcagcccctttggtttgccctccagccttctcttaagtcctggagccgctctggtaattgagccttccttctggcatcctctggaaggctaattgaatacagcaggaggcagtcacagagctttttagcatttctacttcctttcatttgcacacttttccaataggaagcaaagctactcaattcaggagagaactcccctctcttcctacttaacctttctcctgcatacacaatcgggctactcaaaggtatgctgtttcctttccgctaaaagtttcctcctaattacctcgaggcatccaggtgtggctgaaaatatgctcaaccccgggtgtaaatatctgcacctaagggcagtgagtagcagagcaaaacagcttgtgcagggcgcagtgtgcttaaaacaacctgcagctatttatcgggtgactcagacaggatgcaggggccagat

SEQ ID NO: 205933 - DNA, 447 bp, Homo sapiens
gggctgattaaaaagcaccgcactcaaaagaagcaatctctatttttttttaaaatattgcatatatatacaatggtgtatcatgaaaatttcaaacaaagatgtagctaagctcttggtatttcttcatgtgatggtctttgtgatacaatgtgaagggaaaaggcaaggtgcaggaaagcatatgtagtttgctaaaatttgtgtgaaatgggagaaagattatatacatatacatttagattgacttgcatatgcataaaatgcctttgaaagaataagcaagaaactgatataaatagctgcctgtcaagatggggtagcataagagagagacttttaactttttgagttttgagccaagtcaaaacataaaataaaagataattccaaggcagacaaaacaaacaaaatcaaatccttcaaaataaaaaacttaaaaaaaga

SEQ ID NO: 205934 - DNA, 313 bp, Homo sapiens
tagagaaaaaagagtgaaaagaagtgagcaaagcctccaagaaatatgggactatgtgaaaagaccaaatatacgtttgattggtgtaccagaaagtgactgggagaatggaaccaagttagaaaacactcttcaggatattatccaggagaacttccctaacccagcaaggcaggccaacattcaaatttccaaaaatttccaattcatagacttaatcaatgcagaagctcaaattatactttgagatgccactaagtttaaacactgtaccccctataatcttaggaaagtaaatataaaatagaggaaa

SEQ ID NO: 205935 - DNA, 513 bp, Homo sapiens
ttaagatattgctactggcaattacaataagattatgtattatttgccaaatctgttgtatatactaaaattgtcatgtctgtgctttatttttggtagtctggtgggtgacaaaatgaatcaacagaataagaaattacacaatcaagatttgttaaactttgccttggattatggcctcactacattttactagagttggctcctctccttgttccatttctcacacttgcagatgagattggcattttccaattggtgacatatacaataggaaacaaatattttaggaaggcattctttcctcttttttagggagagtacttgttgtttgacagtctctttattcattctaaagtcatattaaccttccttagaaattctcaaccaaattgagatgcaaaagaaaactatgtggctatttaactttcctttcaatttactttccaaaatgatcaccaagattgcaaagaaggcaaataaatttgatccaaattaatttatattcttcct

SEQ ID NO: 205936 - DNA, 243 bp, Homo sapiens
tggttcccacaagtcaagtggacggtccgtgtccatccttgtccttgtttctccctgtacccagctgcctctagcacccagccttccttatcttatgctactcacggcagagagcagattgtggagagcacacagagagataaggcgattcaggcagagtgggtagttggcctgtggcgtggccctcccaaaacctctgggtggagagtgcgccggctgagcccagaaagcctcattcttatg

SEQ ID NO: 205937 - DNA, 397 bp, Homo sapiens
tccccccaccgcggttcaaatcaaaaagcgctaagtcctggctgatttctgactcagccagtcaaaagagggacacgcctccctaactgcaggagggtggggaagggcagctgcactcagtccgatggaggggaaaccagtaaacccgtcccttggcactgtcacttggcaatttctgaggtttaagacgacacggcgttctcccaggtcctggcctgtaaatgccagggaaacgcattgtacttgtgaagagagagaacacagagtttcgaaactgctctaaagcccatgtctcaggctgcaagaatgttatcagtctcacacatcgtgcccctgcctccaaggcccccatcaccacatactgatcttgccctgatttgaagcgggcgggagagag

SEQ ID NO: 205938 - DNA, 233 bp, Homo sapiens
agattgaccaaaggcacacacactgccacccctgaatctgtgcttctaatgtctgcaacattggtggcacaagtagtcttcagttcagaatgaaagactataaaatgaaaagcattctttcaaaagacaagactaaagacaagaggcatctaatcaaagtggaggatcatacaggctgaaagagaacgaagagaattgtaggaaaaaataatgtttgaaaaaccaaaaatttt

SEQ ID NO: 205939 - DNA, 401 bp, Homo sapiens
gaaaagcaggatggttagatactgggaagactatctttttaatttttttacaccaaacatctaaaattattcctattcagtgccttggtctcacccttgggaaaatttccaaaataagctaacattttccccattgtcttcccgcctaaggaatgtgtgctgtggcttttaggtcaatgatagccttgtccttcaatttcatctttactcagagtaggcgtgctgtgtggtgcaaatccatacatgtttgtttgaaaatccttttagaaccttgccttgttaggacctcctacacctgtgtcacagacacagaagtaccgtgtttaagtattgagcatacactagttttttgtgacagaatctcactccagcctgggagacagagtgagagtctatctcaa

SEQ ID NO: 205940 - DNA, 272 bp, Homo sapiens
tcaatgccgctgaattcatctttgtcctgaggcgcggctcttggagagccttgtgggtgactccgatgcgccgcagcacccgcatttactctccgcttggtagaagcagctgtgtcctcacccctgcggtcacccaagttacctgtcccctggagaacggtggcgccctgctcgagtttcccaaaactcgccttttgtgactgtgttagcgtgaacttgtgagccgagtttgcactgagagcgcgataaacaggtctaattttttaaaagta

SEQ ID NO: 205941 - DNA, 303 bp, Homo sapiens
ataatcccagtgtattactaaaggaaatataactactctttttcctctgtttttttctcaacatgtaatttctttacattttcatttcttctggtttttttctcaacatgtaatttctttacattttcatttcctcagtgaatacaatccataaaccagtttaagctaaagtaagccatgagccagtgatcttcccattttggcgttgagataaattcgatattccatttgttaaaagtacagatgtttggacattaccacaaacctactgaaccagaatttgtgaatgtgaggttatagcat

SEQ ID NO: 205942 - DNA, 258 bp, Homo sapiens
tctcgcgttatcataaccatgagaaagacaaaacaagaatctctcaggggctctaagcagcccaggactgtcttagcctcagtgtgggtgtctggggtgtggaggcggggggctgccaaagtcagaggtctctccctcctcatgcagaagaacctagcaggagtgtctaatcttttgtcttctctgggccacactggtagaagaagaactgtcttgggccacacaaaatacactaacactaacaacagctgatgagct

SEQ ID NO: 205943 - DNA, 682 bp, Homo sapiens
tgctggggattacaggcatgagccactgtacttggccaggagctagttttgactgatgactttttaatattccagccagccctacgaggcagattctcatgtcaccctcattatgcaggtgaggaaaccgaggcccacctggcagtcctggcactgcgctatgctccctttagtgatttttttccatcgggtcattcattccgtggatgtctactgagcagtcaggtagacctaatagaatatgccatctgagtcttaaggttaaatggaggaagcgggtggaagcaagtatgtccaaagttctgaaaaactcaggagtgagtgcagaaccagcctggggaagtccacagcgtcagacaggcagggaggctgcttgcctgcgtttttccgtgcttcctcctatggtcaccccacatgtttctgacatctctggatgcttgtgaacaggagcctttgcctacaactttctagtgttaggttttcagttgtgtcgtcacgtgtcttgtaaggcaacaaccctggtggttgccattcacctggcacgtagtgatgattgtgaggactgagtttatgtgtggaaagtgtagacgatgcctggcacgttgtaagtgcagtaggagtgttatctcttattattgtggttattctgttaacatggatggatgataggtggtgtttcatt

SEQ ID NO: 205944 - DNA, 290 bp, Homo sapiens
tataataattcaataacccttacaatacccctgtgaggaagagacaggtactactattatctcagtttaacttatgggaacaaactgaggccaagaagtgttaagtaacttgtccaagggttactcagtttgcaaatggtaaagtcaagatgtgaacccaagcagtgtggcaccacagccctcttaaccagtatgttctactgcctctcacttgaagtgtttagaattacggtgcataactttcaaacccctggaggacaaaagaaaacaatctagcaaaacttaagaaa

SEQ ID NO: 205945 - DNA, 621 bp, Homo sapiens
aagtgtgacctttgattgtctgtttgtgctcttttagactttttgatgtaggtgtttaggaatatgaacttcccttttagcactgactttgctgtattccagaagttttgataggttgtatcactatttttgttcaatttgaagatttttttaatttccatctcgatttcatgatcattcaggagcaggttaatttccatgtatttgcatggttttgaaagctccttttggagttgatttccagttttattccactgtggtctgagagagtgcttgataaaatttcaattttcttaaatttattgcggcttgttttgtggcctaccatgtggtctatcttggagaaagttccatgcactgttgaatagaatgtatattctgcagttgttggatggaatgttctgtatatatgtgttaagtccatgtgttccagggtatagtttaaatccattgtttctttgttgactttctgtctcattggcctgtctagtgctgtcagtgacatattgaagtcccccactattattgtgttactgtctatctcatttcttaggtctattagtgatggttttataaatttgggagctccagtgttaggtgcatatatgtttaggattgtga

SEQ ID NO: 205946 - DNA, 759 bp, Homo sapiens
aaaaatgactatccttgatatggtttggctatgtccccacccaaatctcaacttgaattgtgtctcccagaattcccacatgttatgggagggacccacggggaggtaattgaatctgaaatgctcttcctatctttctatgcttatttatcagtcctctgctaattcttttcaatgattgattcaatgatgaattcccatgctattctcatgatagtgaattaagtctcacgagatctgatgggtttatcaggggtttgcacctttacttctctctcgttttctcttgccactgccatgtaagaagtgccttttgcctcccaccatgattctgaggcctccccagccatgtgcaactgtaagtccagttaaacctctttttcttcccagtcttggatatgtctttatcagcagtatgaaaactgactaatacagtaaattggtaccagtggagtggggcgctgctgaaaagatacctgaaaatgtggaagcgactttggaactgggtaacaggcagaggttgaaacagtttggagggctcagaagaagacaagaaaatgtgggaaagtttggagcttcctaaagacttgttgaatggctttgacaaaaatgcggatactgctatggacaataaggtccaggctgaggtggtctcagatggagatgaggaacttgtagggaactggagcaaagatgactgttgttatgttttagcaaagagactggtggcattttgcccctaccacagagatttgtgga

SEQ ID NO: 205947 - DNA, 139 bp, Homo sapiens
tgaagttgtaatagccctgacgtatggtttacctactaagataccctcaggagttctcatctagcaagtgagatacaccttatttatcatacatagccagctctgctgtcccagaatctattggaaaatgaatcacaca

SEQ ID NO: 205948 - DNA, 512 bp, Homo sapiens
gtttttagaaagatgttttaaaatagtttactgaatgtacttaactgtgcacttaaaaatggttaaggtgatgaattttagggtgtgtacatttttaccatgaaacatttttattaaaaatttttagaaaaaggcaaaaaaaaatcatttgctgatcaaagaggaagttagttcagagagagagagggtgggccagacccaagataactgtttgaaacaataggaaaaatgagacagtgtcagcaattttgtttgtttgttttttcatcagtctattaatctttcttgtctctccagagctgatttagacacagaagtgccttggtgtgtgtttcggtttgattacagatttgtctggtgaacgtggcaaggggaagagaaaggaaggaaagaactggcatttatcagaggtctttgggccagcatttcctcatgtgttttcatttaatctcgccagcaatgctgtgagttagttttatgatctccattgcgcagatgggaatactgagtct

SEQ ID NO: 205949 - DNA, 379 bp, Homo sapiens
ggttaagggcaatggtttcagggtcaagcagccaagcagctacttagtggctgtgttctctcatcgccatttgggggaactgtaacagccacacctcatggggttgctgtcaggactgggatacatgcaaagatattgaatgactgagaaattaactcaacaaatggcaactgtacttaataaattaatttgacaaactatcctaacaggaattttacctttccagatatacttgtgatagttaaaaatattatcaatttaaagcatgctacaaagcaggcaaatctattagttatagacttgtctatatctacatttacatcaagtaagttttcataacttattaacattcacattcctaatttcatttttgtaatga

SEQ ID NO: 205950 - DNA, 446 bp, Homo sapiens
attctttctcttctgctgactaatgggtctgagcaaagtgttcacttatttcaagcttgaaagacttggaaaggtgactgtcaggactagaaagtaacattaacacttcaagatggcttatgagatttctgtggggaaatagattccttgaaactggcagtgtctgggtatacttttataggatggttcttagttccctcaaatgaatatgccttggacttagcctttggcatgcttcctttaaagctgctcaagccttaagctcaatcctgtgagaacacttctagaaacttcagtttcactttttgacaccctgagtatgtgctcagtgctctaccagaagaatccgtgcatgtctaatgggtattcaccagtacctccataagtaacttagcagatacagattaagatgctctatgaataaaacttgtgactgaagttttaac

SEQ ID NO: 205951 - DNA, 466 bp, Homo sapiens
actctcactcagagcagacaccagctggaatgctctgagccacgcagaatcccagaaatgtctcgattaaggtgattgaactgcatcaaatcccatcactagtaaggggcagcaaccctgtaccagcagggcaaggtctcagagcagatactcaatggacaatcaattcaccaaaactttcttctgaaggttccctcaacttagttatcaacaggttttcatttattctctaaagaaatcagaattaatattgagaagatattaagtgaagtaatatagaaaatccaggacagtgattggcatttaggaaaaagacgtttgtcttgtaatattaaagtttctagctacaattttcacaaagcatgcctctttgctttctctaggagtgtcacagccacagaggggcacatcaacctgatacaagagaaatggagcgaggagaggtgactgtctcaggggagtgata

SEQ ID NO: 205952 - DNA, 538 bp, Homo sapiens
tctaaatgtggacactcttcaatttatctctccggcctggacttctctcctgaactgcagactcatatatcacccacccacctagcagctccacttggatgtccaacagacatctcaaacttgatgtgtccagaaccaaactcctgatcttacccaactcccagcctgatctttccctggccctccctatcagctcagggcacctccttcctttcagttgctcaggatgaagtatttggggttgtgcttgactcttcttgtgtcagcaaacctgactgactgtactttaataatatatccagagtctgaccacatctcatcacatccactacgctcattctggtctaagtcacaatcgagtttttcctatacataccagattagtgtaatctccttctacatggtgctactgccccagactccccatggttaaatgagaaatgttgaattggatcacttcactcctctgttttaatccctctaagggctttgcatctcaccctgagtaaaagctaaggtgatagcaaaggcccccaag

SEQ ID NO: 205953 - DNA, 229 bp, Homo sapiens
gacatgatttgagccactatttagtttaaccttatcatgtaagacatgaagaaactgaggctcaggaaattcatataactgaattcatgacacagagccagcctagaaacctaggtcgtctgtcagacctggctgactcctgggacaaagtcattaggacaggtcttgtgcctggttggtcgtcttctcatggacccatctgcccctgccaatccctgcatctttttca

SEQ ID NO: 205954 - DNA, 235 bp, Homo sapiens
aagatctctgaacaacattcctctgttaggaagagaaagcagatatttccatgagaatgtgagggggatgaggagagtggagtatgctgctgtgatcaattatccaaacacaacctggttaaatccaactctctgtggctcctgcatccacacagctgcatgttatgcagcacacaatgaggctgactgcttccacttgcactcatgaccactgtcctccaatgtccttagtact

SEQ ID NO: 205955 - DNA, 534 bp, Homo sapiens
cagtaaagattagtttgcttgaattattctgtattgggtggctggagacagatttaactacaacatgaagttacaaggtttaattctcagctacataaactttacgtgtgcttacttaatgaaggtaagagtaagttccttattctctaggattagtgccaaagctcttttgaaagagtcttttgtatttactagtgagatcatagcagcggaagcaggctctcagcaaatttaaaatctgctaatgataaataggctttgaaaataagaacaaggctggacgcggtggctcacacttgtaatcccagcactttgggaggctgaggtgggcggatcccttgaatccaggagttcaagatcaccccattgcactccggcatgggtgacaagagtgagactccatctcaaaaaaaaaaaagacgaggaattctacttttggtattgaaagagtagattacatcaggctaaccctcccgggaataacaattatccacctgtaatcccagcactttgggaggccgaggcaggtggatc

SEQ ID NO: 205956 - DNA, 338 bp, Homo sapiens
taaaattaaatagctgtttttcaaaattttgtcttcgagaaaagatatttatgtggcatgaatatagaaagtacctctgctatgccccttaatttttagtgatgtcctgtactgtttacattgcaaattgtaactaataagttggagaggtctagatatctatccagatcttcatttaaattttggttatatatggctctgacttgatttatatctcctttttatgtttcattctctgtcagttttctgaagctcgtttttttatgtcacaagctataaatttgatttgtaattataagaatttagctaaacaatataatctcaagaaaagcagagat

SEQ ID NO: 205957 - DNA, 401 bp, Homo sapiens
gtgcatggtagaggagatgtactgtatgcaagtgaggagaaaacagaaaaagaccctgagattctagcttagtaaatggaagactgatataaaaaataagatatggatcatgtaagaaggaggacagatcatataaaaagaaagttgaaactacataaataacacaaaaaagaataatagacatatgagaaccttggcaacattcatcttcaagaaagaaactgacaaaaaggtacactaaacaggtacattcagaagacaaaccagtagtgaatagggtcataaaaggctcaaaacatctgctgataagttacctataacttacagagctttctcagggatgtcttccattgatactctgggttaagcccgcctaataaagcctttaatttcaccttgta

SEQ ID NO: 205958 - DNA, 380 bp, Homo sapiens
aaagtcaatcagtagacaatcagaatcaagacttgcagcttcttaatggttgaattcatgtttggcttaacttcttactaagaataaagcagaactatctgacagaacaagggtcctgagatttcctcccagtttctgcaagtgtggaaagtaagaatacccgggaggaagcccaactttatagaagtgggctgccattcaacttctaaagaatatactttaatacttaaatatactttaagcatatttcacagagtgaggcagacctgcagtttatttatttagcaaatattagttaacaaagtggtcccactttttaaaattcaaatacttgcctccgagagactgatccctaattcagtttgtcacccacagacctg

SEQ ID NO: 205959 - DNA, 663 bp, Homo sapiens
ctagaggatccctcggtgggtcgtactgtgtctttttaccataactatcttggagatctttccatatcagtaaattgaaaacaccctgatttttaaaatagctgcacagaattcactatacaagtatagctttatttcaccagccctggtcactttgtttctactttttaactgctatttgcaatgtagaaatgaataagctcataaatatgtcatttctagcatattctaatatatcctcagaatagactcccaaaaacagaatggctggattaaaggatgtttgaatttgcagtcttattattctttacagctaaaatgcccaacacaaggattgcaccattgggtattctcacggcaatgtatgaaatctatttctccaacatgtgacaacaaagcatattatcaaactttcagattcttgccaatctgaaaaatattacttcagactaattttgatttgtattttataatgaatgagggtattcatttttttttcatttatttaagagctatttgtatttccttgtctgcaaaattctgtttgcatcttttcctcagttgtctactgggttttcttcttgttcatttctaggagttcttttctaaataaagtaaattagccttttgcctctgaataagtttcaaatattggatccccaa

SEQ ID NO: 205960 - DNA, 247 bp, Homo sapiens
tgtccttgaaagccgcagggaccgtgcctttcaacatccctacccccgccctcccaacggttgtgacatgggaggatatttcttcacccttatttcagaaaatgttatcacccaaaactctttactataatgagcttgtgtactcttaaaacaaggcatggtaatgacaatttcaaaaataagatgtaaaatataaaaaaagaggcaaggcagaataaaattaaaagtgatggaaatgtaggattga

SEQ ID NO: 205961 - DNA, 381 bp, Homo sapiens
caggctggagtgcagtggcgtgatctcggctcactgcaagctccgcctcccgggttcacgccattcccctgcctcagcctcctgcttagctgggactacgggtgccctccaccacacctagctaattttttatatttttagtagagatggtgtttcactgtgttagccaggatggtcttcatctcctgacctcatgatccgcccgcctcggcctcccaaagtgctgggattacaggcgtgagccaccgtgcccagcccctgactttttaatgatcaccattctaactggtgtgagatggtgtctcattgtggttttgatttgcatttctctaatgaccattgatgatgagctttttttcatgtgtttgtgggccgcatcta

SEQ ID NO: 205962 - DNA, 692 bp, Homo sapiens
taaacagaaagtgttatcatctctgagcctttaacctattggagacagtatctaagctataagggcaagatatttagtaatttttagaactgaaaggaaatttagacatcatctagtccaatggtttccaaatcctaccatcaggaagaaaagaatctcaaaggcataacaatttatatatgcaaaacaaactcttacttgtgtgttttcctgtatcttcctgcacatgaaatactatgccttattagtattctatcaggaaaggatgtgacatttcgttatgcattttatatttaatcacatttagtatgtgagtatccatttagatatgattaaaactattggtacgatttgggacttaatgctttctaattatagaaacttacataatatatccaaccctaatactttcagagtgatttcataccatctcatttatatttcactgtctagtaaatttgaagtaatacctgggtgaccgatgatttttaataaggcaagagaaggatatccaaattggcatatttcagccgggcacagtggctcacacctgtaatcacagcactttgggaggccgaggtgggcagatcacctaaggtcaggagttcgagatcagcctggccaacatggcgaaactccatttctactaaaaatccaaaaattagctgagtatggtggctggcgcctgtaat

SEQ ID NO: 205963 - DNA, 687 bp, Homo sapiens
taaacagaaagtgttatcatctctgagcctttaacctattggagacagtatctaagctataagggcaagatatttagtaatttttagaactgaaaggaaatttagacatcatctagtccaatggtttccaaatcctaccatcaggaagaaaagaatctcaaaggcataacaatttatatatgcaaaacaaactcttacttgtgtgttttcctgtatcttcctgcacatgaaatactatgccttattagtattctatcaggaaaggatgtgacatttcgttatgcattttatatttaatcacatttagtatgtgagtatccatttagatatgattaaaactattggtacgatttgggacttaatgctttctaattatagaaacttacataatatatccaaccctaatactttcagagtgatttcataccatctcatttatatttcactgtctagtaaatttgaagtaatacctgggtgaccgatgatttttaataaggcaagagaaggatatccaaattggcatatttcagccgggcacagtggctcacacctgtaatcacagcactttgggattacaggagtgagccaccgcgtccggccaagagctttatttttcaagtaatttcaacatgattacatgtgaaccaaatattatcttttactcatataaactaacccctactgggt

SEQ ID NO: 205964 - DNA, 368 bp, Homo sapiens
ctaaatctgctatgaggctgttttatatcccgaacagctgaatgtatttcaattaggatagtaagaagtacagttaaagtagaagacttcatagattctttatgttgagtgttgccatagaggatggacatagaatcaacttcgactgctatttatatatgaataaataaggataatcattctggaactgttcctgtaaagtgaaatccttctacatgttagttgaaactctggtttttttacttatccaagtctttatctcagtgtacaaataatgtgaatgaagtctttctcacttcccttcaatttggtgttgcatggctttttagaaataaatagcatttcatgtccttcgcccaaaaaaagat

SEQ ID NO: 205965 - DNA, 665 bp, Homo sapiens
tacatgaaatgcttatggagtacttagtatgccagtactgaatatggagtatcattccaccactcctatagatcagtattactatttccctccttcacagatgaggaaactgaagcagggaaaagttaaacaatttgcccaaagttacacaagcagtaagtggtaggtaaataaggcccaacccaggatccacagctcaagcttataacgactctcctaactcacactccttcagctgtgtcaacctgaaaggtttagctgttcaagagaaaaaaaactagtttcttgcaagcattccaaggaggtccatcttgaagcccaacctgacagaatgtgaccagtagacttggccaagcccttccttatggccccagggaactcccaagctatggcaccacaggaagcctatgcaagctgaggacccaagacaagttaaaaacaggttcaacggaaaaggctgagaatcactggcccattctgtacccatgcctttaaaaataatacccagctgcgcacggtggctcacgcctgtaatcctaacactttgggaggtcaaggcaggtggattacttgaggtcaggagatcgagagttgcagtgagctgagatcgtcccactgcactccagcctgggcaacagagcaagactctgtctcaaaacataaat

SEQ ID NO: 205966 - DNA, 504 bp, Homo sapiens
tacatgaaatgcttatggagtacttagtatgccagtactgaatatggagtatcattccaccactcctatagatcagtattactatttccctccttcacagatgaggaaactgaagcagggaaaagttaaacaatttgcccaaagttacacaagcagtaagtggtaggtaaataaggcccaacccaggatccacagctcaagcttataacgactctcctaactcacactccttcagctgtgtcaacctgaaaggtttagctgttcaagagaaaaaaaactagtttcttgcaagcattccaaggaggtccatcttgaagcccaacctgacagaatgtgaccagtagacttggccaagcccttccttatggccccagggaactcccaagctatggcaccacaggaagcctatgcaagctgaggacccaagacaagttaaaaacaggttcaacggaaaaggctgagaatcactactgatctataggagtggtggtaccgagctcgata

SEQ ID NO: 205967 - DNA, 499 bp, Homo sapiens
tggtctagagatccccaagtggtctcagctcaagcttataacgcactctcctaactcacactccttcagctgtgtcaacctgaaaggtttagctgttcaagagaaaaaaaactagtttcttgcaagcattccaaggaggtccatcttgaagcccaacctgacagaatgtgaccagtagacttggccaagcccttccttatggccccagggaactcccaagctatggcaccacaggaagcctatgcaagctgaggacccaagacaagttaaaaacaggttcaacggaaaaggctgagaatcactggcccattctgtacccatgcctttaaaaataatacccagctgcgcacggtggctcacgcctgtaatcctaacactttgggaggtcaaggcaggtggattacttgaggtcaggagatcgagagttgcagtgagctgagatcgtcccactgcactccagcctgggcaacagagcaagactctgtctcaaaacataaat

SEQ ID NO: 205968 - DNA, 404 bp, Homo sapiens
ctctcctaactcacactccttcagctgtgtcaacctgaaaggtttagctgttcaagagaaaaaaaactagtttcttgcaagcattccaaggaggtccatcttgaagcccaacctgacagaatgtgaccagtagacttggccaagcccttccttatggccccagggaactcccaagctatggcaccacaggaagcctatgcaagctgaggacccaagacaagttaaaaacaggttcaacggaaaaggctgagaatcactggcccattctgtacccatgcctttaaaaataatacccagctgcgcacggtggctcacgcctgtaatcctaacactttgggaggtcaaggcaggtggattacttgaggtcaggagatcgagaccagcctggccaacatggtgaaacc

SEQ ID NO: 205969 - DNA, 253 bp, Homo sapiens
gaggttataagcaattccatgagccaaatccctaagttgggtttggttcacaaccagattttcttttctgcaaaatgacagcctacacttgtaaaagtccaaacttctcctagatgttatttaaatgttatagctctcaaaaacagttccaaatgaatgggcttcattttaaaagtatgtactacaactgaacaagcatcagaagtattaaaatttccttcagatgttttatgcttactgatatgactttgtt

SEQ ID NO: 205970 - DNA, 425 bp, Homo sapiens
atccccatgccaataacctcctccattactctgccttttaaaaaacttctttttttttttgagacaaagtccagcctgggcaacagagtgagactccacctcaaaacaataataaaggattgaaggtggtaatttgaaagtacaaatgaggaggggcccctgggtatctctacgttggaatgtttatatcataaatatttattgtgagtgatggtccttttatattggatctgaattgtccatttagtcctttaaaattggaagatggcatgaacagggcaagagtataataaactatgctgataaatgaaatcgttctaattcatttattcatttatacacccaaataacattctttcattgcatatctattatgtgccaggcatgcattactaaaaaagatttcccactcaagaaattaccta

SEQ ID NO: 205971 - DNA, 303 bp, Homo sapiens
taaatgtaatgtggtatcatgaatgggattctggaacataaaataaaaagaagtaaaaactaaggaaattagaataaagtatggactttaatactaatgtattaaaactggttcattaattgtaatgtaattcatgtattacagtaatgtaaaatgttaataatagagaaaactggatatcaggtaatcaggttcttagaaatttgcctatgcttaatacatatcaaataagcattaactattatggtttttaaaataattctccaggactgggcacagtggctcatgcctttaatcccagca

SEQ ID NO: 205972 - DNA, 453 bp, Homo sapiens
cctttaaagtgctgaaagacaaaaaaaaaaaaaaaacctcagtattctctattcacaaaaagtgctttgaagcttgaagacaaagatgtttttcagataaaagaaaactaagagaatgtattgccaacttacctgttgtacagaaaatcctaaaggaggccaggcatggtggctcacgcctgtaatcccagccctttcggaggctgaggtggacggatcccttgagaccaggagtttgagaccagccagggcaacatgttgaaacccttctctacaaaaaatacaaaaattacaaaatacaaaaaatacaaaaatacaccagacatggtggcacatgtccttagtcccagctactcagaaggctgaggcaggaggatcatttgagcctgggaggcagaggttgcagtgagctgagatcacccagcttgggtgacagagcaagaccctgtctca

SEQ ID NO: 205973 - DNA, 621 bp, Homo sapiens
agagtgccagcttacaatccttttattgtacctttcagcattgtttgcatatcatttgaagctcgggaagcatttgagtttgtactaggtgataggcacttggtgatacagagatgaattggatgtgatccatactgtcattgagccagaaacaaggttattctctggtgccgcccacaaggggcttatggaatatggggtaatagattcttcccctgctacattggttattttatgattggttccctgtgactcagaaagataaaattaggatgcttcttgtaagtctttaccaaacttctaaagtaattatttcgaaatatttttagcagttgaacaactttttaaaacaaactcctacatggaatctttatatataaagcagataaaagggaagttatttggttaaagtttgtgagcctgtttcctctttgtgtgttttccccactccctatacctgcctgtgacatcctctactttcccatggttcctaaggcatcaggctgaatactagggcaccttgaaatatagtttggaaagaaatgttctaagacaggattttccaactaccaaatttcttatagaggtctaagctttacctagatgatcttaattttagag

SEQ ID NO: 205974 - DNA, 647 bp, Homo sapiens
ccatggatttcctatcttttggacaattttatttttccagggctgtgaaatgacattttttttcagattccatttaaattacatcctcagcaaataacatgtcctcagcaaagcctaactttagaaatacagctactgataagatttatttttagtttcctctttacagaatctgtgccatcactgacgtgaaatagaaacacaatagaattaagtaaatgtacaactggtgattttggagtactgcaccttaagtattctgcaccatgaggtgaccttgtattcatagtcatcttcaaaatgggcatctgaatgactgtgtatctttatgagaaaactggacatggttgagaaatcacaggaaggagatagcagagatttctactggtgtagtgctggagaagtgtaattttgtgttgatagctctaaagattttaacttcggcttatagataagactatatagctgactgtagcaagtataacatacttagcatttgtactttcatgtttaagagggaaggagatcagtcactaaatatgaatgctgcatatgttagcaatagagatagtgattttgtaactttaattgcacttgccttaaatctttttccaaaaagaaattatatatataaacaaataagatga

SEQ ID NO: 205975 - DNA, 494 bp, Homo sapiens
ggtacataccagacattaacttgggataaatgagagaccaatcctgtcctctagtagttcacagtctagggaagcgagacaaacaaataatatactcaagagggataaatgttatgacagcgagactgtgggagtgtaaaggaagaccacctaactaaaagcacggtaggggggaatcagagagattcccttaacattccacttgactgaaaagtgtcgagaaaaaagtaagcttaaatgtcacataggaaatactaattcatgtttttgttaggtacttacttcaataacatctatttctatacaattccttagtttttaaaaatgacactgttgacaattatgttatccacatttgttagatagtattgaaaataccagccagtaaacaatagtcttttctgtacccttaactgtttgttgtaacatgcagttatttatgattttgcttcttgccttgtaaactaatggcctcgtttaaaatgaatgcttcc

SEQ ID NO: 205976 - DNA, 324 bp, Homo sapiens
ctgtcaccttgtcggggatcagtctgctgtgcgtgctcagactcttcccagagccagcagcaagaacccgaggcattaataaacttgagatgtagcttcgcttaactcgtgcagagggtttccgtgtcacttatgtagaaactagggcctaatttcaactccctcaactcctctgtcccaagactatccacgtcacctacttggtagcttgagttaaacaagaaacctttgaaatctccagtggccgacacgcagtgggaactccatcagttttctgttttctcccttcttccctcaataaaaattaagttgaactgactaaga

SEQ ID NO: 205977 - DNA, 576 bp, Homo sapiens
aggtgagctgacggttgtgtggaagcgggggatgaaggtggagggaagtggctgggttcaagaggtacttaggaggcagaagtggcaggactcagtgccagatccgttgtggggatgcttggggttctttaaggtgggatagtcagtgacctggctaacgagccctcaaagagggctggagacaggggggaagctcatgaggctcagcatccaggtctggagctgagtcctggccgggctcttccgtgagtcatctgcacacaagttctattagtgagagtgctggacaagatttcctgggggcaaagacccacctccaagagctccgtgatgtgccagggagaggggcatgagtctgagaagagagaaggaacagccaggggctggcgtgttgatggtagaaaccattacagagttcgcacctggtgggtaactgtggaatgtcacctggagacaggacaaaaatgtcctgtttattaaccgaggggggagagctggaaagacaagaagttgtggaaggaagaagggacattaaagatggggcctgacgggaaacagtggttcccagtgatgccc

SEQ ID NO: 205978 - DNA, 462 bp, Homo sapiens
gcattattggattattaaggctatgaagattaattgatttctctggttaactgagtgtcagaggatgatttgtttccattctgatgatgacatcttttaaacatgcctgatccatctttatactgattaaaattgaaactttttgtcatttgcaggcctaaggtgcctctctttgattacaagagattgaaactgcatgcatgctctttctggaaagtttagttttgtttttaataagccaattatgtcaatgttttctaataatttgctccttttttcataataaagtgctaaaactcaagttagctttaaggttctagacaattggacagacccaatgtgttagtattctttactttccatgagcacattttgtaaaatagtcttacatattgctgtacactgtaagaactcaaacttgtttctgaaactttaatcataataaaaaatatgaaaattgct

SEQ ID NO: 205979 - DNA, 584 bp, Homo sapiens
atatttgccaggtcatcaaaagccaatttccaaatgttgtcattaaacaattcagaagctgtaaacactgtgaggaccaaaaccgaacacattgcagggcagacttggccgggggtgcctgtttgtacatcagaagctcagaaccctaagaacaccctcaggaagcagggacttgatgccaggaagggtgtcactggagacccccacaaggggcctaaggcaggctaggggtatggggaggcttgtttgtgaagtcaggtttaagctgaacctcaatgttttgaaaggcaggtttgtaacaagacgggtcaggtattccaggctctggggatggcaggagctaaggcagagaggagagaagagttttatgggggccagtgggaggtcaaagctgtataagcacgaaagagccagagagccagattttggggtcagggagtggtggaagtcaccaatgcaaacacattcagggtccagacaagtactgcaaatgagacaggcaatggagtgaaaggacaatggtgtcgctgtgactcagttccactcaagtttccaggtgtaaatgtgggatcctctagtttctc

SEQ ID NO: 205980 - DNA, 1189 bp, Homo sapiens
ctgaaatacattatctattttttgtattggctttctcccaccataagcactgggattttgtcaggtctgttgactgctgtatccccagtgttagaacagtgcctggtcaatgtttgttgaatgaatgatgcagtaattgtatcaacttacattgtttctttctacctctctatttttagttcagagccctttggatgagacaggcgtttctgaacaaaggcattcttccagacttaattaggttccctcttctagggttaagtgcttaatctttgcagcatcttaaaacggtaaaaactaaattctattctttgatgccatctatgtaatcagtggttaactttcacacgcttctttcctgttggaataatagatgaaaagaccaagcgtggctttaagtccttctgttttataattcctggacacatttctcaaatttctgctgcaggttttcttgttatcccataatcttgacaggttttctctcacctcttggattcctgctgtcagaccttgttaggcttgttaattttctgtatagcatggaatgatggttttctagaaggttctgacaaacccttactctcatttatcttattgctcctctggtacagaatctttcattcctctcctatgttcccttgtatctttttttccccctaaattacctcccttaattccaagtgggtggaaggaaaaggaatggaatttggtcttaaaggatgaataatgacttcgttggaatatcagtaaaggaactctagtctgcgggaatggtacgagcaaacacatagaagtgtgaaatgtgtaatgtgtttggcaaaagtggtttgggatggctggagtgtgtgtttatctctagtgtgaagtctggccagaaaggtagattgtgatctttttcttttttttctttcagacagagtctcactctgtcacccaggctggagtgcagtggtgcaatctcagcacacggcaacctccacctcccaggttcaagtgattctcctgcctcagcctcccaggtagctgggattatagacacctgccatcacgcctggctaatttttgtagttttagtagagacggggtttcgctatgttggccaggctggtctcaaactcctgacctcaggtgatcctcctgcctcgacctcccaaagtgctgggattacaggcgtgagccactgcgc

SEQ ID NO: 205981 - DNA, 613 bp, Homo sapiens
ctgctctgtgatggcagcagtggcccatgtggagcagttgctacggagacactggctgcagtgaggaggagtggctggggctgtgcgctcctcgaagctggtgggagccaggaaagggtgggagccccaccccttctaaattggcaggcaggagccccgccctcccaggcacagctgcagccatccagccatgactgcaaacctgggcatctttgcactctcagaggcccagcaagcccccctgcccccacaggctcagttgtacctggtcccaccacctggcgtctctccactcccagagcccactccaacctcggatccaagttgaggctgaacccaggcacagtcggaacccggcctggtttgtgcaagctcaaggcagtgctgacatgccagccccctgccacctcagccccctccagactttgggcactgacgagcacaagagggaggttgaggtgggtctaagtgtggctcagcactggcctgaaggcactcctcagctcgaacagcctcggcaatgtgggcacagctaaccacagtgcatctctctcagctgctgagagctgaacagacgttgggatgacttgcctgcagaaaggagctaccgact

SEQ ID NO: 205982 - DNA, 582 bp, Homo sapiens
acagatgtcatgttctttttttgtttaaaatcaatctctgggccgggcatggtggctcatgcctttaatcccagcactttgggaggccgaggcaggaggccaggagtttgagaccagcctggccagcatggcgaaaccccatctcgactaaaaatacaaaaattagccggttgtggtggcacacgcctgtaatcccagctacttgggaggcagaggcagagaattgcttgaacctgggaggtggaggctgcagtgagctgagggactgcgctccagcgagattccatctctaaataaataaataaataataaataaataaaatcaatctctgacccccagacataccaggtctttgctgattccccacctgtctttcagatgcttttcctaccaccctgtcccttcttcaacctggtgtaaggatggtatactatataattaagagggaaaaaagaatttaggatctattatatggtcatctccccttatccatgggggtacctgaccccagtggatgcctaaagctgcagataaaactgaacattatatagactatattttttcctacacatgcaaaattt

SEQ ID NO: 205983 - DNA, 257 bp, Homo sapiens
tcctttctacccatttgcccctttgatttcttgacttataggttattttgatgtgtcatgttttcaaatattttgaggatcttccagagatcttttgttactgatttctaatttcattacattgtgttcacagaatatacttcatatgattttaatccttttaaatttattaagatttgttttatgacccagaatttgatgcatcttagtaaatgttccatgtgcacttgaaaagactatattctgtggttgttggg

SEQ ID NO: 205984 - DNA, 309 bp, Homo sapiens
ccttggcttttctcaagcgctggtagaaaggctgctgggtctgagatcacccaactgatgttgcgtcaccataaaataagacttcttgcctgtgagcagctcaagttagcaggcatatttgagtgtcttccacagatccccaatctggaaatctgaaaaccagaatgctcccaaatctgagaatttttgagcaccaccatgatgccacaagtggaaaattctgcacctgacctcaggtgactacacagtcaaagcatagtcagaactttgttttatgcacaaaatcattaaagtgttatataaaattac

SEQ ID NO: 205985 - DNA, 212 bp, Homo sapiens
agcaaatactgcccaacgtcctctggggggcaaaactacctctcattgagaaccactgccctgtatcattctaaggttaaaagattttcagggccgggcgcaggggctcacacctataatcccagcactttggaaggctgaggctggctgatccctggagcttagtagttcgagaccagagtgggcaacatggcaaaaatcccatctctact

SEQ ID NO: 205986 - DNA, 365 bp, Homo sapiens
ggtgggtaggttgtgtgggagacaggggaattcaatgaagggagattctttagcctttccttcaagtacatctttctcctgagtacatttacttccatcacaatggactagaagagatccttgcttagtggtgcagaacccttgagacctaatttagcttttataggaaattcaaaaagagaaagacggcacaagagcaagagaacagaacaaagatatgagtttgtacagagaatattgatacttgtggactgcttctgtaactcttttaaaataaattttctaagtaaatgctgacgtagacttttctgttagtggaaggctgagctcctcccgccaaacaatgcgctgcccaaatcatcttt

SEQ ID NO: 205987 - DNA, 746 bp, Homo sapiens
tccatgttggtcaggctggtctcaaacgcccaacctcaggtgatccacctgccttggcctcccaaagtgctgggattacaggcatgtgccaccgtgcccagctaattttgtatttctagtagagataaggtttctccacgttgaggctggtctcaaactccgaccttgggtgatccgcccgcctcggcctcccacagtgctgggatgacaggcgtgagccaccgcgcccggccacctgtgcctatttcttgacgatgacatcagttatggggcctgatcaccgatgaggcatctgccttggactttatgagctgacccacctgtaatgaacctgctgttagtccttgaggaggaaactgaggcaagctgtggctccgtggaggggactgagccacattcgactgtgctgtggcccagagtaggatggctgaaggtgagggaagggcaaggggtgccctgaagtgactgaggcagcctccagcaccacgggcctcagacagccccacctgcaaggaggaagccttaggcagaaggtgctctgggcagcgcttaccccagcgcggcatcagcacctgtgggtggcgtgggaatgggagttctctggaccggcccagctcaggaagttagaacctgggaggaacaccagtgaataggaccagggcaggctacccctccccaccgtgagcggcccctccctgccgtgggctgctgtggccgagagcagccccgtggaggggcatgttggg

SEQ ID NO: 205988 - DNA, 342 bp, Homo sapiens
taattaagtgaataaacttggacaaagagttcacctctctataccacaacagtctcatctataaagttgggattccatcggacttgcaatagagggtggttgttacaaataaacaaccaaatacatgtagaatatgtattaggcccaaagtaaggattcaatatatgtaaactattattgttgctgttattactgaaatctttaatttagttacttttcagattgtacattcattcttcaggaatgagaatcgaaattcaaaatatgaacaaagacaattatctagttaggagctgaataatcacagtcattttccttcattcaatagctactcaaatcttg

SEQ ID NO: 205989 - DNA, 938 bp, Homo sapiens
caaaaatccttgtggggaaaatgtatgtatttttttgccctgaaagaacaggtttgtcgaacagattaaaattctacatataaaactgttgaaagagtttatggatctacaaattactgctgggatatatggaattcttatttttcaaaaagcctatgcactctgagaaattctagacagcatatgaaactataagagaattccaccttcttgcttaccagtacagactcttcttaacagtgtcaaaactaacccttctcccccaaaaaagtagggtataaacaaagagaaagaaagggaaatcacaaacttttagaacttccccaagctaagagttgaacatggataaactcactgaagtcctcatattgctccatgggccactctaggtacataagctaggatgtcataggtcagagagaagcccagcagagaccacatcaaagttcaaccttgttccagacctttgtaggtagaaaataaggttaagtgaaacatggaaggtaaccatggaatattaccggttcccggtcagtcactcttgattagcaaacatggcccaaagctgtagatcaaggacttcctgaataatactggttctggagacagaagctatgagttcagtgctacataactctctctgtggacagacagctctgccaaagctattacattatatttaagtatatgtattaagtatatatctaaatatatattatacttaaaatattagtttaaatttaatgttttaagtacaatatatataccaaagagcacaaagaaaaaaaaaggtacagcttgatgaatttttacaaagtgaacacacccctgtgaccatgactgagataaagagattagacattaccagtatcccagaagcctccatttgccccttcctaggcactactgacttgatttatcttactgatttgtggact

SEQ ID NO: 205990 - DNA, 309 bp, Homo sapiens
gagacagggtctcactctatctcccaggctggagtgcagtggtgcaatcatggcttactgtagcctcgaattcctgggaccaaagatcctcttgcctcagtctcccaaagtgctgggattataggagcccagcctcaaggcagagaggcagagatttgatttaattatcttccatgtggttaactaattgttccaacaccataaattaaatgacatatcctttctttttttccttgaaatgacaccctatttacatgtatcttcctagatttttagtctgttgttttgatctgcctgttcctgctgcca

SEQ ID NO: 205991 - DNA, 456 bp, Homo sapiens
tagagtcaggttggaatttggtatctcattgccacaaagggtctcttttgtattaagatctctgttttaatgtttagactagtcattatgtctcacgaaaatgtataaaaccaagctgtaacccaaccaccttgggcacatgttctcaggacctcctgaagctgtcatgggtcatggtcttcacatttggctcagaatgtatctctttaaatattaaaaaagaaagaaaataaaaaatgaaagcaggctatagagcaaaaagtacaggatgatctcagcttcgaaaagttctctctatatatacatttttaagagtgtttcaattttctttcatgcttttcaaagtttctacaaggaacatatattactcttgtaatcagatatgaaaatgatggaaggaagaaaggatgaaagggggaggaggaggaggactcaggtggtgtggggtaccgagct

SEQ ID NO: 205992 - DNA, 803 bp, Homo sapiens
acactttgggaggctgaggtgggcggatcacttgaagacaggagttcaagaccagcctggccaacatagtgaaacctcatctctactaaaaatacaaaaaattagctaggcatggtggcacaagcctgtaatcccagccaattgggaggctgaggcacaagaatctcttgaaaccgggaggtggaggttgctgtgagccgagattgcgccattatagttgagcctgggagacagagtgagactctgtctcaaagcactattactgtataagaaagagaggtgggatactggggacaacttgcagtatctatccaagagttaaatgctcaataaatgttagttatcactaccaccaccaccaccatcattataatcatcatgatcatcatcatttctggtcttagcctataaattcctccacgtcctcacttcttatttgatccccttattctccattttagcccatgttagcttgtgctttgttctattgcatgatttgcctctgtccctgtcttgagacctttttatacccagaggctggcaatgtaactagagtcctacaataagctcctgtgtgatgaaaatggatcttaaagctggtgaggacattgacagtttagggagactagagcataaagtcttagcaatctacttggcagcttcattgacatactacaggaaaaggtgacggaaggaagaaaaaagtctagctatcttgaaatgtaggttaagcacttgcttcattttgttgtattctttccactcacttttgtgaacttccactgaagatgtcttgaatctcc

SEQ ID NO: 205993 - DNA, 389 bp, Homo sapiens
tgcctttgggccattggtgctgctatcaacattcatgtacaagtttttgtgtgggtgtatgtttcattcctcttgagtatatccctaggagtggaatggctgggtcatatgataactccgtgtttaaccttctgaagaactaccaaacgacttaccaaagtggctcccctgttttctattttcactggcagtgtgcaggagtggggttttttataatgcccaataatcggatttattcaggaagcaagtagcttccagcttatttactgagcttttaaagatatacttaatgtcgtttcttaagaaaaaccaggtctttatttactatgagactccaagtgctttaatatagttgaaactaaagaaacataaatttttcattctgcctc

SEQ ID NO: 205994 - DNA, 266 bp, Homo sapiens
aattttattattttaaatttattaagatgtgtcttatagctcaggatgtagtctatcttggtgaatgttctgtgggaacttgagatgagtatatattctgttgttggatgaagtagtctgtatatgttaattatatctatttgattgatggtgctgttgagttgaactttttgtttttactgttcttctgcctgtacatttttaatagaagtttttatttttaaaaaataaaaatatgttttgccaaattaggaaagtataattag

SEQ ID NO: 205995 - DNA, 337 bp, Homo sapiens
catgttgaaatttgatccccaatgttggaggtagggcttagttggaggtgtttcggtcatgtgaccagatccctcatgaatacttggtgacatctccctggtaattagtgagttctcactctattagttcccacaagaacgaattgttttaaaaaagcctggcacctccctcctcacctggttccttcctctcttgccaagggatgcctgctctcctttgcctactgccacggtggaagcttcctgagccctcaccagaaacagaagcctgcgtcacacttttcatacagcctgcagaaccatgagccaaataaactgcttttctttataaactact

SEQ ID NO: 205996 - DNA, 287 bp, Homo sapiens
aggcaccatggactggatcatccataggactcaacctaggcacttagggaatgtcatcttagctctttagcaggtggtgtcaggtatcatctactatgaagtagtgaaatgtttttcctggcagacctggaggattttcatcattctcaaaatgtccagtttaaacctagtcccaatgagtctgatggctccaacactgaaaagacagaactgcttatttggggacctgtcctacctctcctaaaagatgtcattgtgcttactaataaattacttattctagtgca

SEQ ID NO: 205997 - DNA, 460 bp, Homo sapiens
ccatgtttagtagaagttttactaagaaattgtacatgctcctgttacagcatgatgaatacagtgtcacattttcttgatgacctcagtccacttcacaagcatgtagtaaaacagctttctttgctaagctgtatacatctgatggctcctatgctcttctagtatgttattttgctttcagatttcagatttgcaggaagcacactgactcccactcttgcatttatgatggcttctgtaccccgttttctaggcactaatgaagattacaaggggaaatttataaccaagcttattaagttgataaatatcattttacagaagtagttgagtttgtgtagacaaactcatgggctgtgtaaccactacttaatgttcagggtctcttattttttctgctttttattattttctgggttgatttagttttcctaataaacctgtatgttgtcagtca

SEQ ID NO: 205998 - DNA, 542 bp, Homo sapiens
agaaatcaggatgatggcagcgtataaggaatctggttatgcttccaaacttacactaaagttactgccaatgggagggtaaaaggtgaggaaacaatcctgggagccacgcagataaacaggtgttaggcacgaggcctgtgacccaaattgaaagatgttaagacataaatgtgaggaattatcagaagcaattcttagagcattaataaattttccctctcagttaaaaacaaccaattaacaacaataacagtgtttctgatttacatcctattatttctaacttggacaaggtactcttctaaatattagcgacaaacatttctcaaatcaactttacctgtcaaagtttgatattcaatttagatctgggtctgacagatttcaaagctccatgactcaagctataggattcaaaatccaccatctattttcttctcttcttaggtaaatggtgagcaaggacaaccacaaattttactagcctcagattagagattcccatatatgggaatcagttcaattttatttgatgtcag

SEQ ID NO: 205999 - DNA, 378 bp, Homo sapiens
ttgtggagtagctgtcatataatgggcacattaatagtcttttagagataaaaagacaactccaaaggtactaaaagtctagtagggtgaatgaaataataaaagattgagaagagcataaaggtggcaaaggaataagaggttgggagtcaaagtttccttaaggaagaatcatctgagctgaatttcaggaattttatagttaatgcatgctgggcttaatacctaggcgatgagttgataggtgcagcagaccaccatggcacacgtttacctatgtaacaaacctgcacatctaccctggaacttaaaaaataaaattaaattaaaaaaaaaaagatttttatttcatgctcaccaggtcaaaggggaagaaga

SEQ ID NO: 206000 - DNA, 355 bp, Homo sapiens
ggattgtgctggatgtggagtaggcgctcagtaaatgttttctattctttggccacttctgactgactttgctgccttccgatcacttctttcctcaccactccactaaaagcatcagtcgtgcaaactttctggggttttgtcacagcactttcagaagctggaggtatactagcagcatttctgtagtagtccagacttccttacatatagaagttgactcttcatgtccctcacctttgtgacccttgagctcagtagtcaaggaggtgaaagcataatggggttccaggtagtgcctgaaactacttttctgaagaagtataattaaaagtaatcttgttttgagaattta

SEQ ID NO: 206001 - DNA, 466 bp, Homo sapiens
gagactccaactccaataaaaataaaaaaaggaaagaaaagaggaaatttggacacaccgagacagcagggtcacttgtgtacagggaaaggccatgtgagaacacagtgggaagacggccatctgcaagccatggagagaggcctcaggagaaactgtcagaagtgtttgaaccagagcaactccatcttgaatagaagctaggtagaatgaggctgagacctactgggctgcatttccagacagttaaggcattctaagtcgcaggatgagacagaggtcagcacaagatacaggtcataaagaccttgctgataaaacagttgcagtaaagaagccggctaaatcccaccaaaaccaagatggccatgagactgacctctggtcatcctcactgctacactcccaccagcaccatgacagtttacaaatgccatggcaacatcaggaagttaccctatatggt

SEQ ID NO: 206002 - DNA, 987 bp, Homo sapiens
tgcacccggcccactctcttaaagtactctcttggcttccatttgctcactcggagaatgtaaaacacagtaggaggagactatcttgatttcttttgtggacatttctctatttgtcccttgaatgctgacagcccttcgaattctgttctagaccaggcttcctagcctgcctgttttcactggacagttgcatcttttcccacatgctgttatttacgtgctaatcacttacgcatttgcagctctagtctgtcctttcttctaagcaccacctctgcctcctggatgtctctactttgatgtccacaggcatttcaaatgtagtatgtcccaacctgaactcattctccccgctctccaatcagctactgaatattcttgtgtatcctgtctcagtaaatggttcaggctgccatctactagttacaaagtcagaaatgtgaacttcagttgtttaccattcctttcactttcatctccaagcattcaccattctcttgtgattatactttgaaaggtgtctcacatctgaccatttccttcattgctactgatgctatcctgattcctggccactctcatttcttgcctcaattattataactgcttcagagttcctgtggtcttacgctttcttgaatacattcatcagttgtgtcatttagcaagctttacatcgggaagtaacagaaatataacaaaattggcataaacatttgggtatctgttaaccaagagtgtgaagataaggtagttccagagtagcttaattcagtggccacaatatcattagtgatgcagcttcattcatctttcctttctgctttaccccatgggtcagtggctccctcaggccagaatatgactgcagtggcttaggcatcaccccgcactgagccacctgtagaggaaaaagcctgaaaggttcctatggtgtgtcccatttgtaagagtgaggagaacactctcagaagccttcctgta

SEQ ID NO: 206003 - DNA, 369 bp, Homo sapiens
tcatctacatcaagtcataaaagggaaaatagaagcaggcctggagcgtgggaaacttttttggtccaagcctggaagttgggtgcatcagctctgatcacattccattagccagaattcagacacctgacctcacctgtttgcaaggaaggctgggaaacagaagaggtgtactcaagaagaggaaataggtttggcaaagagccagccaggctctgcaaataatggacatcctccaaggaacaatgattgggcaaagagaagatgacttaccctccaggactttgttctgaataagcagcttgtcctggcctggatttccgagcaagtcccattgtaaaaccacaattgctctttcttcaagaagaa

SEQ ID NO: 206004 - DNA, 484 bp, Homo sapiens
cacttacagaaagttatccagggtgatagataagctttggatatgctcaaaatgtatattattgtgtgcttaaacaaacaaacaaacaaacatgtatttgaggctggatggggaaattttaaattacaaagtgatgattaggttaaatgcctggcatgtaaagaatgagtcatggaagaaacgtggaattgggagattgggttcatttggctctgtctagagtatctgaactagatagctatttaacttctgtgactcttacttttaaaaatatctgtaaaataagggttttataccagatcaacattgcctaaatagtattacgattacgagttctgatttctagactattattaggcactattgatataaagtgtttgtagttaaatatgtttatgaaattgaagaggtctctcctgctggactttgtggactagatgtcatgatatgtgtctccaaagtgggaagagaacagggagaattt

SEQ ID NO: 206005 - DNA, 376 bp, Homo sapiens
caactttacccttttaattttgattatatcattcataataatcatgtagtataattgactccaatataagcaaagtaagcaaagtataactttttaatttttaattttttggataaatagtaggtatatatatttatgaggtacatgagatgttttcatacaggcatgcaaagataaacaaacacatcatggagaatagggtatccatgccctcaagcatttatcctttgagttacaaacaatacatttatactcattaggttattttgaaatgtacaattaagttattattgactatagtcacactattgtgccatcgaatagcaggtcttatttattctattttttgtaccctttaaccatccccaccttccct

SEQ ID NO: 206006 - DNA, 681 bp, Homo sapiens
cttctctggccaggtctgaaggcgcccggttccgggaggcccagccccagcccagccagcctgctggccccactcaggtgcatgagaggccctcatgcctcctgggctctcagcatctgcattggagtctcaccacccttgggaggcccactcccctctgcccagctgaggacagtggggctcagggacagtgagagaggagacatgcggcgcccccattgtgcagatgaggagcactgggttggttaaggagtttcccttggtcacacgctagcaagaggctgggccagtgtccagacccatgtctgctgagcgaggtgctgcggttggtgacatctccggagtggctttttgtccacattcacagcagcgcaggccaaaggggcctggtcacaccaggctctgcagccccgggccctctcctggggacacacattgccacgggagctgccaaatgcccagcaatgtgtgaaccttggccttgttctggagggtcctggggtgtcccggggcattgatggggtgatgggcacagtcaagtaagagaggcaaggccccaccagggaggggtcgggaggcttgccctctgaaggccctgtgtggcccctggccaacctgtggccttcatcaggcctcagtctccccatttgtccaaccggggggttaggtgagattgtctcc

SEQ ID NO: 206007 - DNA, 621 bp, Homo sapiens
aaaagacaccaaataaaaagttctagagcaaaagcttacagtaactgaaataacagttttactagagagtcaagatatacttgagcagggagaagaaagaagtagtgaaactgaagataagacaagtgaaatgattgagtattaggaacataaaaaataaaagactgaagaaaaataaacagaacctaagggacctatggaataccatcaagtggggcaacataaggattatgggaatgttagaagtagaagagggagatgaaggggtagaaaaaatatttttaaaaattaacagccccaaatttgatgaaaatcattagtataaataaccaagagctcaaaaaatccaaataggatgaactcagagacccacaccaagacaagttacaatcaaactgttgaaagacaaagacaaagagaattttgaaagcaacctgagagaggccctcctcgcttgtcacatacaacatatccttatcagcagatttctcatcagaaacataagaagccacaagacagtgggctgatgtgttcaaaattctaaaagaaaaacaaaacaaatcaaaatctgttaaccaaaaatttcatgtctggaaaaactgtgtttcaaaagcaagggag

SEQ ID NO: 206008 - DNA, 321 bp, Homo sapiens
attgaaactacagatcaaattagaaagaatagacttctgaacattactgagtcctccaatcaatgcacacagtctatctctccatttattcagatcttcctgacttctttcatcagtgttttgtggttttcaacatacagatcctgcacacgttttcttagacttacatccatgtacttcatttatttggtgctgttgtaaatagtattcctttttaaatttcaattgttcattactggtatataggaatataatttacttttttatattgacttgtgtcttgcaaacttgctaaattcacttattagttccagaaccctt

SEQ ID NO: 206009 - DNA, 167 bp, Homo sapiens
ggcttctcgtgcttcctcagtgtgctttaaccacactgggagcattccggggaaggaggtttctctggattatttggtttgaagcccatctttataatttactagtgactttggccaaattgctatatttctcttcgcttcagttttctcattgcaaaatggggata

SEQ ID NO: 206010 - DNA, 215 bp, Homo sapiens
ccttttgtattccctcatctactatacgtactgtctgtactattacagaaatagtactatctgtactattgatatctatctggactatctgtactcctctgccccctgcatcctgcccaggatcatatgttgcatgtagttatcacgttgttttagtttcctttaatctggaatctttaccctttatcatttttgatcttgatctttttgaagag

SEQ ID NO: 206011 - DNA, 483 bp, Homo sapiens
atatagaactaaacctgtcacataacaacaaatgactttgtttttcctgtcatggtgacccatcttctatttgtgtcacttgatgtgggcaggccaaggaaattgaagcctcccctgatgaccataatcacaattgtaaatttataagtctgcataaatgaaattgttggaactgtttaaacataatcccatcatctagagacccgccatttaaactaggactgaggaagaaaatcaccgacatcacaagctgtgcatccccttgcaggagcagctcagatcactcccaggaaaattttaaaactccccgaagaaccacacatgtgctagcttaatccaagctcaatcaacaaatagtattgaggatgatgacttaaaacagcagtttggaactgatgttttagtttatgcttgaatctcatctatgtattaggattggaaataaaagacacaaacccttgaagggcagggacccactcgggt

SEQ ID NO: 206012 - DNA, 362 bp, Homo sapiens
aatgattcaaataatagcagattacccatcagaaatcacagggccaaaggaagtggtacaacatttttaagtgatgaaagaaaagaatcgtcaacccagaattctatatccagtgaaaatatccttcaagaataagaagaatcaatgcatttgaagacttaaaacaacaaaacaacaactaagggtatttatcaccggcagaataaaagaatagctagaagaaatagtttgtacagaaagaaaatgataacagaactaagaacttagttctgttgcaactaagaacatcagatatgaagaaagatgtaaagaataaatataagtttaataaataattttttccttgtgatttaaaaaatgtg

SEQ ID NO: 206013 - DNA, 264 bp, Homo sapiens
gcatcttggatgggaagaatagtgggataaaggcctgcaggcagaaaggcttcattctgtgacccgctgcctgtccctcaataggaaatgcataatttggggaatggggcaagatagacaatcctatacttactgttcatttatcagtcaattggcaaatacatcttgttttttgttttattttgcttttgagaccatgtcttgctctgtcacccaggctggagtacagtggcacgatcatatgggaatggagagggaagcccc

SEQ ID NO: 206014 - DNA, 211 bp, Homo sapiens
tgttttctacataaagcaggctaatctgtatatgacacttgccataacaaagattttctctcttgttcactaagtagcatcttcagtatgtagaaaattcaaactacaaacaaattttaaaaatggggttgctctaattcattttactgcaatcagagaaaggattatgcttccataggttgggttgagtttttatgtgtagaattaggaa

SEQ ID NO: 206015 - DNA, 333 bp, Homo sapiens
agatacatcgtaactacttttctgaagttggaagaatgctgacttccaaaaacatctggccccaaggatttcagacaagaaattgtgaacccataagttgtttttcttaaatttgggagtatttattgatcccctaaggaaacgaatgattcgttcagttccttcttcttcccttacaaagaaaacaaagcggggggagggacaagcaaaacaaatgtaaactgtgactcttattgctaataagctgtggcagaagctgttgggggtctgagtcttcaaaaggagcagatcttttggaggacagaaatctggatctgtacctttcctgcaatt

SEQ ID NO: 206016 - DNA, 268 bp, Homo sapiens
catccataataatacaatttaattttaaaaattctattttggaaggcataattcaacaagtaatataattctaaacaaaatgtgctcacagaatcaaatatgcttaagcaggaatctttattttggttttagctgagcatggtgttgtaaaagatgaaatgcataatgcacatggcaacagacacgtcaagggaaggagaaaggggacaggaatttttgctgggcagggtgggcaaatgtacatattcagtaagctacaggaacagta

SEQ ID NO: 206017 - DNA, 466 bp, Homo sapiens
tgcagtccctgagtagatttgcatttataaggcacaagagcagcattgaggtttatgaggcataagagcatttgaaaaaagtgtgctgtgatagtaatccacatggtagaagttctctcatggcatgaataagtgcatatactatactttctctacatttgtaccttgttgattaaaaagttgtatgtggctgggtgtggtggctcatgcctgtaatcgcagcactttaggaggccaaggcaggtggattacatgagctcaagagttcgagaccagcctagccaacatggcgaaaccctgtctgtaccaaaaaatacaaaaattagctgggcatggtggtgcacgactgcagtcccagctaccatgtggctgagatacaagaattgcttgaacctgggaagtggaggttgcagtgagccaagattgtgccactgccagcctggtcaacggagcgagaccctgtctc

SEQ ID NO: 206018 - DNA, 498 bp, Homo sapiens
cgtttggtttgcttttgcttttctagttcttgaagatgcatcattaggttgttcatttgaagtttttctacttttttgattaggtgcttattgctataaactttcctcagtactgcttttgttatatcccgtagattttggtctgtcgtatttccattttcatttgtttcaaatatttttaaattttttttcttatttgttgatccactggccattaagcatattatttaatttccatgtgttcatatagtttccaaagttcctcctattattgattttattccattgtggtcaaggaagatacttgatatttttcacatatttttgaaatgtttaaggcttgttttatggcctaatatatggtttatcattgaaaataacacgtgttgaggggaagaatataatatgtatccttcagccattggatgaaatgttctgtaaatatctgtaagatccatttactctatagtgcagattaaatctgacatttctttgttg

SEQ ID NO: 206019 - DNA, 118 bp, Homo sapiens
ttaaatttaaaccataatgatttcaaattatttcaacaatggtaataagaacaataaatttttgaaaatcttttgatgctgaatataatacagcctgtgtaaatatccaacagcctga

SEQ ID NO: 206020 - DNA, 364 bp, Homo sapiens
cccccctgcaatgcactgggtgagtgcagcaaggacagtagcagaaattgggggcataaaaggaaatctgactcaggactctgcatttcagaacattggcagcatctcagaggcaatttctaaatttcagccttcatcatttccatttatttcacaggtatgtgtcttaaccatgaacagttgtacctgtgtactaggaagaacctcaagttagagaagaaagcactgagttaacataaggtgcttcagtaatagttgtacagtagcaaacaattaatcatttgctccactctgtatttttaatcttccagagccaaaaagctatgaatcactttaaattgtgaatggctgctccaagaagaaa

SEQ ID NO: 206021 - DNA, 438 bp, Homo sapiens
agaccccggtgaggagctgcatcacactcattgacaacacactgtatcagcagtggtacgagtcctactatgtgctgctcctgggccacaagaaaggggccaaactgattcctgaggaggaagagattttaaacaaaaaatgatctaaaacattcagaagaagtatgatgaaaggaaaaagaatgccaaaatcagtcttctggggaagcagttccaacagggcaagcttcctgcgtgcatcgcatcaaggctgggacagtgcggccgggacattgtggccaagcagatggctacgtgctagagggcgaggagtcagagttctatcttaggaaaatcaaggcccggaagggcaaataaatcctcatcctttcagtctccacccatgtaataaaggtgtttattctgtcaaaaaacaattttttaatgagttcaaagacc

SEQ ID NO: 206022 - DNA, 387 bp, Homo sapiens
ttgttaacagataaatattcaataatcaaggtaccaaaatatgactgccccgatatggctgcgtcattgcatactgcacgtcagagagccttacagtacgaatgagtgacacaggttactctgtgggtggaccttttttctcctgcctggaatccgtactcagaaagctgagaaaatgtgtccatgtgacaatctagtggattgccctgaatcctcagcttaccaacatggtacccagaagatgtctgaaggaagttttattaaagtaacagaaaatttcataactatatcctctaagggagatcacaataacctgccatcccaaaggaggctccgttctggggattaagacagtttgaaggggccaggcgcggtggctcatgcctg

SEQ ID NO: 206023 - DNA, 945 bp, Homo sapiens
aggccagcccaagcaccagaaggatatccagggccaccatcaggcaactatatggcaatacatttccccatccttttccctgcccctaccagcaccctctgcctcggacagctgcagcatggctgccaggaacctggtcctcatttcttcctttccctgtgttatccaaggatgatggaaatatgctctgatacatgcagcattttcgtcctggggccacatatgcccagcctttgcaagagccgtctgctagaaacagggaaggcattctgctcatgactctcggcaagtcatttgaaattccatgagtgtccctgcctgtggagcctgcttctcccaccactcctccaaggagacggctcaaaggcccgagggtcgcctgtgtgtatgttactccctaaccagcacacacctacctcatggtgccttggctctttcatccctaaaagtggtaataaaataacttcttcaaaagtttgttgtaagaactaaatgggatgatatgtctatttggcctagagctaaccaaagaggaggcactcaataagtggcagctgttctgatcataaccctcaggtaaggaggcagaacagcacagtattacacagatgggcttcagcatcaaactgcctgggttctagtgcaaattcaatgagctagctgctgtgtgactttgggaaagtgacttaacctctcctctttatattatttaggggatggaataatctttacttcatagtgcagtcgtgagcatgatatgagccaaaatatattaaaagcttagctcagtgcctggaacataataaatgttcgctaaatgatagctgttaatgtcagcatggttgtggttattgtgatcgggctgtggttgcaggaagacaagagtggaaagaggctggcaagacaggtcaaaaggccttggctctaggccctgttctggaacaa

SEQ ID NO: 206024 - DNA, 380 bp, Homo sapiens
gaagaatgtagacttccttgtgggtgacaaggcatggaagtccctgaaggacacgccagccattctcttttatttgcccatctccttagcccattcttaactctgtcacaagagtctaggccctgaatgccttactccccagtcagacccactctggtcaggtccccaaaactggcactgtctccctgactgccttactgggtcacctatctcccagggtgtttcagaactcctttggttaggtgtgtaattgtcccaccagttcttctgaagatgatttataaaagcaaatctggcaggtctttcctgttgtttttttttccttcctgtgagagggtaggatgggaagagtgggagaaacatggagggaggaggaagaa

SEQ ID NO: 206025 - DNA, 464 bp, Homo sapiens
agggatatttagccaactctctcacatatttgagaagcccttttgacatgctttggtattaatttgtcaaataattgatttattcaatagtcactaatttagtgttcacttcttgccaggcactgtctgggtacagagggtataaagataaacaatactcagtttggaccctggtgtagtaaagatgcagactattttaaataattgtaaacagtatgatgggtgtgacttaagagggggaatactcaattctccagatttggagggaggttggtaagtgatgaggattgatcacaagagaatgcttgatatgggtcttgaaggataagacttgcccaagtggataaggggcgaaaggcatcccaagaggagacagtaacgtgtgtataaatgaacgaaggcgtgaaataggatggagtgttttgaggaaccacaagtagccttctctgagtaagagcataggt

SEQ ID NO: 206026 - DNA, 378 bp, Homo sapiens
cctcccctccccagttttaatggaaatatcagtacatttaattctcctgcatgtgacaaaattctaagaaaaaccttctccgatagatttcagaattatcactatggttctcaattagaaaccagtggtggtatttgaggttcagactgaataagaagtttgggtggatcttttgagtggacaaaatacacgtacacataattattgcctacttctctgcttcatattcgtgttgaaaactctaggcctataaaaattttatgtcatgtatctttccaagtcatcagacaccacctgttatggttattgctctttgggggaagggggcattcagtgacattttgttcaccattccaatgtaatcgcagtgacatgtta

SEQ ID NO: 206027 - DNA, 215 bp, Homo sapiens
atcacttgaacccaggaggcagaggctgcagtgagtggagattgcagcatcgcactacagcctgggcaacaacagcaaaactccgtctcaaaaaaataaagttcttcccttagaactagtcctgttgggctagtctttctgggattttggtttactctcctccacccattggaagggcttaaaaccgaatagccagcaccaagcacagctctgca

SEQ ID NO: 206028 - DNA, 443 bp, Homo sapiens
caaatggtctgtcctggacccaaaagccactctcctcaggcccttcctcctagtcccaccagccaaaaaacttggggaccccaaacctgttcttcactctctggcacctgtgctcatgtgcctgctgcctcaggaaaggacagaaaccctccccgatccaagttattagcaaactgcccatctccacaaaaatttaaatggacagattgttaaatgcacacagctcacagccagctcctttcaaggtagatttgggcccaaacatttcggcacagccaggagatgtccccaaatcccgaaatgtggtttgagtcccagtccctcatctctccagcctccaagccctcacctatgcaatggtgccttgcccggctcacaggttatgaaaaggggtgagacgagacagtgtcccctaaatacatctgacagcacttttgaatgga

SEQ ID NO: 206029 - DNA, 376 bp, Homo sapiens
cacaacagccctcctgccggggacaatgctccttatcccacaagcggggacctgggctctgacaggaggccacacacttacagtccctcccttagtgaccggcagagctgggatttgaacacccctggtgagactccctcgtccagaccccttcgttgtacagcaggtttgcctcacatgccagagtcggggtggcctcagggcacagccaggagatgtccccaaatcccgaaatgtggtttgagtcccagtccctcatctctccagcctccaagccctcacctatgcaatggtgccttgcccggctcacaggttatgaaaaggggtgagacgagacagtgtcccctaaatacatctgacagcacttttgaatgga

SEQ ID NO: 206030 - DNA, 534 bp, Homo sapiens
tcaatagatagcaactatgctaagtggagaggagaaaagagagaggaagcccattcccaaggagtattccctccattcccttggagtattctcaaggagggaaagaatatgtacagtcacatgccacataatgacattttgtttaacttcagaccacatatacaatggtggtcccatgagccgtcacacccagcctgttttttatctttcatagaatatttttactgtattttttctatgtttagatacgtttagacacatgaatacttaccattgtgttatatttacctagagtattcaatatagtaatatactgtacaggtttgtagtctaggagcatcaggttataccatatagcctaggtgtgtaataagttataacatctaggtttgtgtatactatgatgttcacactatgacaaaatcacctaatgatacattttgcagaacatattcccattgttaagcaacatatgactatagctcaatatgtatgtattattgactatgaggtagaaaacgtggagagatgata

SEQ ID NO: 206031 - DNA, 548 bp, Homo sapiens
tcaaacttaatcagcttaaactttaccctataattgtggaaaagtaatttttagaaaaacctgtaattgtgttccatcttttgtcagttcttttctctaatctagtagttttcaagtggattttgcccatcagcagatattgtatgtggcaatgcctacagacatttttgtttatcacaactgaaggtggggcagtgcaactggcatctagtgggtagaaaccaatgatgctgctaaacatcttgcaatgcactggagagtcccttgcaacaatcatctggcccaaaacgtcatagtgctgaggttgagaaactcctttaatgccatcgttctgaatgttaactcattactaagatacagcaatggaaagttgtccattgttgacttaagagcccctcattctccaggtatatgggttcttaaggtgtggcctagggaaccctggggtgacgcaaaaaaaatatgaataaaaacacagatgagaacccaactattctcttaaattagctatgaagagatgtactactcttctcactaaaaagaaaata

SEQ ID NO: 206032 - DNA, 649 bp, Homo sapiens
aaggcaggagaattgcttgaactcaggaggcggaggttgcagtgagcccagatcgcgtcactgcactccagcctgggtgacagaacgaaaatctgtctcaaaaaagaaaaaaaaattatgcctgtgagttagcacccatcattatccccagcccactccagatgggaacactgaggcacaggggatggaggtaacttaccccaggtcacatggctagtagggcagcctgtctccagcactagtgctctggaaaatgagaactttcaggctgcctggagttgggtggccgcatagacttgaaggatgaggggctgtggaggggagcacttggagccggctgatttcttagagcagccagaccttggcgtgtgtctgtatgctgtgtgtgtgtgcctgtgtgtttgtgtgtgtgtctgtatgtatctatgtgtgtgtctgctaggtgtgtgtgtgtgtgtgtgcctgtgtgctgggtgtgtctgtgtgtgtgtgtctgtgtgctaggtgtgtgtctatgtatctgtgtgtctgtgtgctaggtgtatatgtctgtgtgtgtgtgtgtgtctgtatctgtgtgtgtgtgtctatgtatctgtgtggctgtgtgctaggtgtgtgtgtgtgtgtgcctgtgtgctgggtgtgt

SEQ ID NO: 206033 - DNA, 829 bp, Homo sapiens
atttattttctcatagttctgtagctagaagtccaagatcaaggtgttggcaggcttggtttcttctgaggcttctctgtgtggcttgcaagtaaggcagccttcctgctgtgtcctcacatgatttgtcctctgtacaagcacatccctggtgtctttttatgtgtctaaattttgttacaagatccatcagataattaagtcccactctaagggctttaacttaatcaccccctttaaggcccgattttcaaagatagtcacattctgaggtactgaaggttagggaatccacatatgaattttgagggtatatatgcagccaataacgtacggattctgatcaattagtagatgtgatgatttcactactgtgatgaatgaatgaacttgtaatctttaaattactgtggtttcttcctgaatgtgattttgaagtacataaatcttctgtttcaaaaggcacaagaaacaaaagagtaaaagctgtagccattcatgtcatttgaatgtattttggacatctttgaaattatttatctctagggccaggcgctgtggctcacgcctgtaatcccagcactttggaaggcctaggcgggtggatcacttgaggtcatgacttcgtgaccagcctggccaacatggtgaaaccccatctctactaaaagtacaaaaatcagccacgcatggtggtgggcgcctgtaatcccagctactcaggaggctgaggcaggagaatttcttgaacctggaagacagaggtttcagtgagctgagattgtgccactggactccagcctgggtgacagagcgagactccatctca

SEQ ID NO: 206034 - DNA, 156 bp, Homo sapiens
gtgtaattgggatggagaaaggaagggcagcatgcaggaagtcatgtgataggaatagagctgtgtgccaggggtggcaagttgactctgttggttggtaccaagagtttgccttactgtagttagacagagttagtttttgttctgaatgagaca

SEQ ID NO: 206035 - DNA, 197 bp, Homo sapiens
ccaggctctgaggctccggcctcacctttccacggggtagaagtgaacctctcctgatgacagcagtcgcaaagggccgaccatgatgatgaaaccccaggcggagacgggggaagcagcacgggatcccagcctcaggcctgcacggacggtgttggttggggtgagtctcaccaaaagtcgtgccgccgtccgtg

SEQ ID NO: 206036 - DNA, 1492 bp, Homo sapiens
aggtaaaagataaaagatatctgtggtataactggtctttaggaagatgaagtaactgcatctttcccaccattgtgtgtattcttaataccaagatttgggtccttgatctgacatttattttctgtgtgactaacttctctgagctgtagtttgctcatatacaaaatgggaataataatgcctactttatatagtgattgtgttgctagtagatgaagaaaatacctggcctggcttggcgttcaatcactagtgattggaataaattctgataccatgtgttgagtgtcagattgaagtaggagagtgtggcgatccaggctcttaaccttgttctactgactcaaacctgggaaagcattttatacctgggcctctttttcctcagttctacaaacagggaatgaggtagaaagttggtctgtaattgctgatgtttcttcctgttctgtgtctccaaaggcgcattggtctgtggtccaaggagattaaagagtcaacagggacctaagagaagtctcaacttcggtcctgcttaagcctgcagcaggaacagttaaaaacaaaaagccgctatctatagtaaggtgttagaagtggctgggagtatgctgcaggggcagtgacctgcctgtcacccagcatttggaaaataaatgtcaaagagaagatcataatggcctagaaggttggaaactgagtagctagcaagtgtgagagagggaccatgagacataggacccagattgtgctctatcacccactcattgggtgttcccagtcaagctatttctctttgcatcctccatatccccatctgtaaaaatgagttaggcattgtattctccaagtgcctcttcagggctttctgaaatttcattggccccttttttctggctcttgtgtttgtactctagcttttgcctttggtactgaggatttcatttatgagaaggctttttaaccagccaggctttgtctagccctagagtatttagaatgctcctgaaactatgatttcaggccattcaatttgcatctagaaatgccttggttcacctgatcctactccctcatttaacgattgagagataatgcaacagagaagaaagactacaggcttgacaaatgacccccaattcagattcctgccagtactagcttaatctttctgaaccatatcaccatcatttaaaagtgcaataatgggctgggcgcggtggctcatgcctgtaatcccagcactttgggaggccaaggaggaaggatcacgaggtcaagagattgagaccgtcctggccaacgtggtgaaaccccgtctctactaaaaatacaaaaattagttgggcatggtggcgtgtgccagtaatcctagctacttgggaggctgaggcaggagaatcgcttgaacccaggaggcggaggttgcagtgagcagagatcccaccactgcactccagcctgggcgacagagtgagaccccatctca

SEQ ID NO: 206037 - DNA, 422 bp, Homo sapiens
gaggatcgcttggaccttgggaggctgaggctgcggtgagctgagataacaccattgcactccaggacaggtgatgaaatgcgatcgtttcaaaaaaacaaaccaaaagcaaaaaagagactggataggataaaaggatgtaataataaaattgagatttgtaactcaagaactaaaattaggaacaaattaaatgacaatctgtaacactaatgtttggggaagtgttgtactattctctccagcaaagtggttaacagcatgtaatgacatagtatgaaccctctttgagaagagtgaaaattatatagggttagctccctataatacttagtgaatctttaggtcatctcccagttaaagataaaagaaatgctcaattttatgtatattgtgcttaacagtctattactctttccatt

SEQ ID NO: 206038 - DNA, 900 bp, Homo sapiens
tttaagagatggaggcctcactctatcatccaggctggagtgcagtgctaagatcctagctcactgtaaccttaaaatattttttttgtagagactgtgtctcgctttgttgcccaggctggtcttgggctccttgcctcaagtgattctcctgcctcactcttccccaaaatttttgaaatagatttctttgcatatgagattttagtatataatggcactattatttcaatatcgggaaaattatgttttgacaattggttatccaccctctccaagaaaaaagttagaagcacatttacaccttacagagaaatatgactatcatatttgacatatctaatcataaaataacatgttagaggcaaatgtagaaaaaaggaacgtattatcaagtaggacatggagtcctagaagccataaagaaatcgagaacaagttgggctatgcaacgatctaaaacttcagcatggtgaaaggcaccaaaaacttgtaaaagacagttgaagggaaatgtatacaacttatagaaaataacagaatgctgttacatatacagagcagtggggaacaacttgccatgcacactgataggcgaatcaccctgaagaatccaaatggataaagaaaattcgtgaaattcttaacctcattaatcagaagaatatgaatgaaaccacattttcctggctcttggtagattacaatataaaatttggataatatccagtaatggtattagtgtgggaaaacaggtacttgatcactattagcagtgtaacttcgtcccctatctcctcggatggcatgacctatcaacattataaacgtgaatttttttcaaacagtaattccagatctaggaattttatcccattggaataaataggtagatataaa

SEQ ID NO: 206039 - DNA, 960 bp, Homo sapiens
ttgggaggctgaggcaagtggatcacctgaggtcagaagttcgagaccagcctggtcaacatggtgaaaccccatctctactaaaaatacaaaaattagctgggtatggtggcacatgccagctactcgggaggccaaggcaggagaattgcttaaacctgggaagcggaggttgcagtgagctgagattgcgctattgcactccaacctgggtgacaagagcgaaactccatctcaaaaagaaaaagatatttggaagtttaagggactgcaagtccctaacgttatcttctacattatctatttattttgaggcataaatttgtctcgctattactagataacagattttaggctcctatttatgaaatgttggaaatcattttcagtaggggcagcttttaagtgcccattttcagtagacctaccctaaatagctgaatatccctagtttgattttgtctaactagaaagacaagaatctccttttttcctcaggaatctttcagtttagcagaatatcttttaatcaaaatgtaagtaactaatatacctttctcatattgacttaaagttctctaatggcccctttgtttccttccatatttaaattagaattggcaaattaatagacttttcaccaagcagcctgcctctgcctatatttagatatttctccttccatttatatccagtgctttactcagttattgtactaaaattgaagctaccctcaagtcttcctttccctttttctgtaggtgccatcatggtttctgtcttctctgtttgccatttgcagagccctcagggaatcaatcagctgaaccatcttcaaatgtagggacagtagatactgataacgcaaaaataatccaaccctttctgcagtagcccaaactgttttgagttgactctttattaaaataaatactataacttacatagttagctttctgg

SEQ ID NO: 206040 - DNA, 501 bp, Homo sapiens
gaattccacttggaaaatggcaaacaccataggctctgaagattgaagcgtattatcatgactaactcaaagggtcagaggagacactggcttccaccagcaagctcaacgtcttttggcacatctgaggtggggatggaagctgcaagagcctagattttgacaccacttaacaaagaaaagccaatgtctttcattcccctctgtgcctttcagtataccttggccatgtggaatgcaataggttctgtacccaggtcttgacctgggccagctggtcttgagccccgtaggacgtagtctgtggcctgctgcatacttggatagtgtggggtgtataaaaagcaactcatcctgagggagaaaagcatccaactgtcataagcttgagtctccatgcaagtctccactattttataaattcagttctttatgtgaacatgcgaagaagacatattgaaaaattagccccacaaagaaataaatacaaaaatccccact

SEQ ID NO: 206041 - DNA, 377 bp, Homo sapiens
tgatcaagagtctttgaaatgcaacacatttatgaaaatgcaaaggttcatttcatcacagacctttaaaagtggcagaaaccctaaagagcttatgctccaaccttctccctttactgattagatcattagtgatacggttccgcaagtcttcagactcctgactgcctatccaagactcctacctaccacaacacatttcaactaagtggatcaaaatacagtcctttctacatgtaacataggaagtattttgttgttgttaattgagatattattaacccaaatggtactagatctcacaaacaccgtttaagtctcaaagttactgctatttccattttcatgtattgaaaaatacttgttacgcactaata

SEQ ID NO: 206042 - DNA, 562 bp, Homo sapiens
gagactcagaaggctgaactggctgctgctgctcactgatggaaagttcatgctccataggaggaactggaggctcaattggggcctcctgttgggttgcagaaggttccacctcctctggaaactgaattggggtctcctgctgggcttgggaagattctgtctcattggtaggctctgaagttatggtaacctccacatctgcaggtttaactgtaatgttgggcaagtgataataagcttgatcctcacctggaggttgaactgacacctcatgattcggtagagttagactctccatagaggactctggaggcagagctggggcctcctgctgcattgaagaaggttcttcctcaaggagctgtggaagctgtgctggggcttcttgctggagtgaagaggactggatgtcttcaagggtctctggattttgagtttcgggctctagatggaattgagaaggtccaacttgctcagagggccctggaggctcatgctggacttcacccggagttctggaggcaggctaccgggatacggtgtatctgtactggaatat

SEQ ID NO: 206043 - DNA, 307 bp, Homo sapiens
tattcaaaaggaaggaaaataatatagatcagaaattgagatatacataaagaaaggaggattataagtgaaggaaaaaatgtaggtaaaataaaacctcaattgatctaacacataagtttctttaaaataatagctaaaatgtattcagtggtcatagttcatgtataaatgaaatgaatgacagcaatattataagagatacaaggaggaattagaaatattttgttattgtaaagtacttgtgccacccatggagttgcatagtgttatttaaaagtggacttgaattacttttaaatgcaca

SEQ ID NO: 206044 - DNA, 624 bp, Homo sapiens
gtaacatactcttaagggtaaattaatttaaaaaaatcactattactaacatcatgattgtacaaccagttttacaattttgtacaacctttagttactaaatctgatttttgtgtatacttttcaaatctttctttaatgcagtgtcttaaaacaaacataaatgcacaagtccagcttgatcagtttttcagtagttttccagcctttcttgattactaaaaaataaaaggaaagaaaattttgagaagaaaacagtccacttaaagaaatctccctgctggaactggttctttatataccatatacaattaagttattgccataggaagaaagtgggctgtttttgttctttcttcattttttttcctcttagaggaatccccttttgatttaaggcaacaaacatttcccctccattgtgtgtccatttagctgaggcatatgtgttgtaatggttttccagaattagtcctttgaagttacaatcttcattgcattctttctgttaaaacaaacaaacaaacaaacaaacatgttccaaatgatttttagagaggctcaattaaacgaagagtaagcaggtaatatttgttagaattgaaacatacacaacttttttta

SEQ ID NO: 206045 - DNA, 453 bp, Homo sapiens
agatatttgcgctcccttatgctaaatgcagtaagtcagttacagaaagacaaatactgcatgacctcagtttcatataaaatctaaaaaagttgaactcctgtacagaaactgagagtagaagagtggttaccaggggttagagggaggggaaaatgggtagatgttgatcagtgggttcagaccaacatctacccataccagtcagaaaggtagttatataaattatgcagtagccataatgtaaactactatggagcaatttaaaagaatgaactagatctgtttgtcctgattgataagatatcttactaaattgaaaacaagttgcatagcaatgtagacaatatgattctgttaaaacccatggaaataaaagttgagtatgtacacatctaaatgtaaatgcctaaaagggggatgaacttgcagttgaaatggaggtgttttaat

SEQ ID NO: 206046 - DNA, 396 bp, Homo sapiens
tgggctattctggccatcctataaggtcaggggctggggtctcttacatccccatgtttcttacagcccagtgcaggggctgggtccacagagagaggagaagggactcaaccaggactgggtgagggcaggctggagtgaggggtccctatttccctccctgattctccctcctccccaccagctaccaatcgctccctcatggaatggggcaaacctgctctagccggactcggtgtgacggcggggtgggggggcggggtgacaggagttatcagagtcataaaatggcagctgcaaagttcaagttgaaggcccaaggccttatcactcctgtttatggtgtcctgacttcagcctgggaaggagaaatctctgaaaagggaggcaaaaaaa

SEQ ID NO: 206047 - DNA, 468 bp, Homo sapiens
ttatggggctgcatggagcctgcagtggtgctgcaggaagagtgcctggccctggcacacagcacgtgcccactaagggggagccggcgtgagtactggggtactggagtcccgtccctccagaagcccagaggtcacagactacagtggaaggagggagtcttcaaagggcagtgaaggggctgggcacagtggctcacacatgtaaacccagcactttgggaggctgaggcgggtggatcacttgaggccaggagttcaagaccagcctggccaacatggtgaaacctcacctctactaaaaatacaaaaattagctgggcatggttgcgggtgcctatcatcccagatacttaggaggctgaggcaggagaatcacttgaacccgggaggcagaagctgcagtgagcaaagatcacgccactgcactccagcctgggtgacaagaatgagactctgtctcaaaaa

SEQ ID NO: 206048 - DNA, 500 bp, Homo sapiens
tattgccatacaaaggctcatgatccctaaggaggggagaataatgagaacaggcctcccagggagcacacacgacagacgaggtccattcaccacacagggagtgcttcccaaatattaaagtccagttgctcacttaggatggaagcaggcctctgtggaaagtgacatctgattaagtttgaggtgtgccttttatatgagtggttctctccagagatggtgtccaacacagggagggatccacggtgacatataaggcccccggaggctagaggagttcccaggggtgctggtgttggcagggcctttaggctggaaggctaacaggctaggagcacctgagctggggatctttgcagaaggggctggcagagctcagcctgctgtggctaagccctcaacgtatctgtcaaactctagagctgagatgtccactggggtgcagtagctgaggtcagtaactcctatagggtctgacagtgtgtggtgtcgcattc

SEQ ID NO: 206049 - DNA, 406 bp, Homo sapiens
ccttgatttcagtcatgtctggtcgtggcaaacaaggaggcaaggcccgcgccaaggccaagtcgcgctcgtcccgcgctggcctccagttcccggtagggcgagtgcaccgcttgctgcgcaaaggcaactacgcggagcgggtgggggccggcgcgcccgtctacatggcggcggtcctcgagtacctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgttttgcctaacatccaggccgttctgttaccaaagaaaaccgaaagccacaaagccaaaagcaaataaat

SEQ ID NO: 206050 - DNA, 365 bp, Homo sapiens
  misc_feature (290)..(290): n is a, c, g, or t
  misc_feature (297)..(297): n is a, c, g, or t
  misc_feature (307)..(307): n is a, c, g, or t
  misc_feature (330)..(330): n is a, c, g, or t
  misc_feature (347)..(347): n is a, c, g, or t
tggcaactcaatggaaaagtgggtaaatgacttagcagacaccacatcaaagatgatattcaaatgaccagaaaatataaacacatgcttaataccattagttatcacaacactgtgataccactgtacacccaccaggatagctaaaatgaaaagacaaataatagcaagtgctggtgagaatgaggagtactactgggagagatgtaccatggcaccaccatcatctggtaacttttgcaggatatactaacagagcatttgtgtacctgagcacccactccaaatcnaatcccnccggccgccntggcggccggtaacatctactcnggcccatccccccatantgattcctattacatccc

SEQ ID NO: 206051 - DNA, 416 bp, Homo sapiens
gctggaaggtcccctcaggagctcagggaaggggcatagcagaaggagcttggctcccgggggcccacccagctgcatggggtcaggtggggcaggctttgctctgatcagccatgtgcctgccaaaaatggggattccagcatcaaaggaaagggagagaaggtcactggggaggctccccagagtctctgccacagcgtatagacagaagggggatatgcgcagaggaaacgagagaggagttggggggcgaggacctccccaagaggcagagggaagcctctagaagatgagaaggggccaagcactgggggcccaggagggcaggttccaaaagtgggagccatgagtgctaaggcacagaaggctctaaggtgttctgagggcagagaaggcacagggggccgagcgaggg

SEQ ID NO: 206052 - DNA, 633 bp, Homo sapiens
ggacatgtgatgagaaatttaacattggtgtatctaactctgacatttttcacgaagtgattttttaaaatgtggtaaaaaagacaaaatataattcaaacatatgcattatatgtcaaagtatgcttcgctggcatcaagtagactcaccttgagatacaatcttggacaacctccatcttcagaatatctactttttcaaaccgaaactctccaaccaaaaatcaataacatcaaaagtttgcaaatacaagccgacggaaaataaatacatgaattctaccacagtgaattggaccgcactgggaaacacagatgaagaaagtcaataccgctttgtccttcagtgcctggctcctttttcagctcgtcttgctactctaggcattatgcctgaaaagtctcccaggtgcctgtgaggctctaattccctgggtcccattgccatgtctctggatttgcgaagatccaccggaccttctgtggaactcccgtgtcggtgaacttttgtgccacgtcccctaattctgcccatggtcatctgcagctgcacgagttagggtcggtgttccttggacgggaagagacaggcaggagtcggaatgctgaaccagcacactggggcgttttctc

SEQ ID NO: 206053 - DNA, 328 bp, Homo sapiens
ggagaaagggaaattctttatcttgatttgaacaatggtaacacatgtatgcatttgtcaaaatagatctaactgcacatttaagatttactgcagggaaaaaagagatttactgcaggtaaattatatttccataaaggaaaaaacacaaaaaccaaatagggaatcagaaaaaaaaaaaatgcttgccaagggctgggcgcatggtggctcatgcctggaatcccagcaatttgggaggccaaggtgcaggaaccacttgatctcaagcgttagaaactagcatgggcaacatggggaaaccccatctctacaaaattacaaaaaa

SEQ ID NO: 206054 - DNA, 200 bp, Homo sapiens
gggaaaagtgaggacatttattggcttgccttcctacttcgatgtcaatgtaaattattaacctagggaggagttttatataactcccaaattctagctgagtaggagatagtgcagtcagccaaccagcaaatgagaagcagatttagaagaaagattgtgaattcagtttctgaatgttgtttagggtgtatatggta

SEQ ID NO: 206055 - DNA, 262 bp, Homo sapiens
tctcaggatagactgcatcctcttagtatctgtcaaagatgtgctctagccagtatcaaggaaagcaagagagtgacttgtagagacaataactctattgctacagtttccaaatcccatgaactttcttagtagccacatcacactgctgactcatcttgtactttgaagaaattaaaattcttcactttgggaggccaaggtgggtagatcacttgagcccaggagttcgagaccagcctggcaacaaggcaaaacccca

SEQ ID NO: 206056 - DNA, 438 bp, Homo sapiens
tatttactattcattaactggaaatggatcaccataaagtctttatactcaacgtcttcacattgagtaggctaaggaggaagagaaagaggagaagttggtcttgttgtctctagggtggcagaaggagaagaaaatccatgtataattggacccatgcagttcaaacccatattgttcaagagccaactgtataatatagagtaaagacggttagaataagggtaagcataggaaactataagagatccttttcatctgacatatatgaaagtgtgggagtcagggaagtctccttggaaggatgacatctagaatatcctcatctagactagctgagcaaacatttcacgcacagaactgtacaaggctattctgacacagagagatttaaatcatacccatgcacaagctctctcacatagagaagtctgaaca

SEQ ID NO: 206057 - DNA, 1257 bp, Homo sapiens
cgtaaccctgctaagaaggctctgcttttttggctccatcataatgactgtaaagtgtcacaagatagtgaaaatatgattctttaaaacaaaaacaaattttttttcatctacacatcgtacccaaagttaacaggagagaattataacattttcaaactaacactaaacaaccagtattaccaaataacaaaatgcaactctgcagacacaagtcaaacctgcttagacagactcccacggccaccaccactggggaaggccacctccacatgcaagggtttaggttctctcaccacacgacgcacagaatgggaacattcactctttgatcacaacttcctacatctccactttgtttcctcaacattttcttcttggatcctgtagttctcttatttctgcttcctgcatatcccctcttcacctcctgccttcatatccatcagtggccatcttagactccacagttgaccatttacatcactccagcgactcatgagcctttgttgctcctctatcagttcactgcgtggactgccgtgactgcctccctgggtgaacacaagtatcccccgccacagaggcaagggcagctgggctcacggaatcaagatcaggaactgaacacagcagagccagcctcagctgggcctcggtgctgcctgccaccctcccatattctctacaaactcaccttgccattctttatgatgactatgtcaaacttctctgcccccaatgtatcctacctcctcatactcaaactgccatagcctcatacttcacagagaaaacagaaccctcagcaggaagctatcctgagtgcccaatgcccagcacacaaacctgccctagcctgcatccattccgagtttctcctcagctacctcgcactctgcactgtctcttctcgccccttctcccccagcctcactgcctttgccaggtttccctccatcccgctgctagcccccatgtcatcttgctcttcccatcacagatgaaattctccacagagccgctgtttctctgttttcattttctaacctcccactcactccttacaacctgtaggcttccatctggtttctgcacacggctccagcatagtggctctaatgtcacatcaatgatttccatgtcattaaacccaacgcaaaactttcagtcctcatctgacttgaccctctcagcagaactctccctccttcttccacactctcttccctcgactctcatgacttcagaatcttg

SEQ ID NO: 206058 - DNA, 434 bp, Homo sapiens
acagtgcagagatgacttgtgccaactcatgagttttgttacttgaactagtcctctgtttttgcaagagtgaatgaatgaaaggttgactggcagctccctgtcatgaagatgttttgaatgttggctgcaaaggcaggtaggactggaagattctcaaggtcatcagaaaggtcacattttcagctgccaataaataactttcaagtggtttcttacagactctgtctcttcctggtgttgtgttcctcttgcctcttctctgcatgcctgccttgggagtgcaccacacagtcatgtcatgcgctggcacctcagatcccaggccatccaaagggaatcaacttggtctctgtttttttcccctagcagtgctagaaatgagctttcagccccacagagagagcgtcgggatcctctagaataccgcacat

SEQ ID NO: 206059 - DNA, 367 bp, Homo sapiens
ataaaaatgatcaaggatactagtataagagatcaggttcgtcctttaagtgttgtgtatggttatcatttgttttgaggttagttgattagtcatgttgggtggtgattagtcggttgttgatgagatatttggaggtggggatcaatagagggggaaatagaatgatcagtactgcggcgggtaggcctaatttctctcggaccaatgcataggtccgagagaaattagagcaatagaaaagggaatcctctggccaaaatcctacatgtttccagcagagctggtagcagaaccacttcccctgattccagccttagcgttcttcacaccatacttaaggcctttatttgtggaaattgtcatt

SEQ ID NO: 206060 - DNA, 368 bp, Homo sapiens
tttaaaggaacatatctattatatgaagtgggcaacacctgtatgtgaggcacattgacgagtaaactctgagctgctgtcacaagcagttaaaagtaaaaggcctttgtcaaagcgagttaacaaagtctattgtgtgacatggaatctttgacacattcatcatgctggtgtggactatctcaaaactcagagctggtggactctagccagcttccttatcatgagtacaaatgagtctgtttccacgaggacccgcatcatcctctctgcgctgttggctttcattggagatgaccccacagacctgttcccaagcatgtgggacctgaaatctagcaaaggtaataaatttgttctggtgcagt

SEQ ID NO: 206061 - DNA, 585 bp, Homo sapiens
atctcccagtttcatccataatgtcaccaatgacaggatttccttctttttatggctaaatagtattctgctgtgtgtgtgtatgccacaatttctttacacattcatccgtcgatggacactaacgttacttccacatctcagctattgtgaataatgctacaattaacatgggggtacagatatctcttcaatctactgatttcacttcctttggatatatacctagaagtgggattgctgaattgtacagtagttctatttttaattttgagaagaacctccatattgtgctccataatggctgttccaatttacattcccaccaatagggtacaagagttctctttcgccatacccatattgatactttgtattaacaaaagcttttgaagaaaaaataaaacgacttgtaaaaatcaacttagatatacagtttaacaattaaaattcattttccaactataatttttgtattttttgtagacatggtatctcactatgttgcgtaggctggttctgaacttctgggctcaagcaatccacctgcctcagcctccctaagcactgggactacaggaatga

SEQ ID NO: 206062 - DNA, 398 bp, Homo sapiens
agaccatctggccaacatggtgaaaccctgtctctactaaaaatacaaaaattagctggatgtggtggcacatgcctgtaatcccagctactgaggaggctgaggcacgagaatcgcttgaacccaggagacgtaggttgcagtgagccgagatcacaccactgcactccagcctggcgacagagcgagactccgtctcaataaataacctttcactttaacaaaatgagaaatgttacaccaaaatcaagtctaactttgtcagcataattcttgctctttaattttcatcttaatgttttaagccacagactgttatgttctgttttcttaaatgatggttgtagaggaaaagagtaatgcatataaatttccaaatctactatcttaggtggtcg

SEQ ID NO: 206063 - DNA, 104 bp, Homo sapiens
aatagaaaccaaaaaaaacctagatgtttgtcaacctgtgaaagttgcattaggcttttgctgtggaggaacaatgagtaaacaattacagtctaatgagaagt

SEQ ID NO: 206064 - DNA, 224 bp, Homo sapiens
gagaagtgtctttcttacctgcttttttgtggaaatgcttgttttgtactcaagtccttgataagctcttctgaatgcattcccaaacaaacatctgacagcaacaactggaagccactaccagatgcacgtatatatccttcctctgacatggaatcgtaatacagccatgttgtgacacaatttcaggtttcgattagaaatagtttacagtccagcagttt

SEQ ID NO: 206065 - DNA, 619 bp, Homo sapiens
ggccaaggtgcaacttccttcggtcgtcccgaatccgggttcatccgacaccagccgcctccaccatgccgccaaagttcgaccccaacgaaatcaaagtcgtatacctgaggtgcaccggaggtgaagtcggtgccacttctgccctggcccccaagatcggccccctgggtctgtctccaaaaaaggttggtgatgacattgccaaggcaacgggtgactggaagggcctgaggattacagtgaaactgaccattcagaacagacaggcccagattgaagtggtgccttctgcctctgccctaatcatcaaagctcttaaggaaccaccaagacacagaaagaaatagaaaaacattaaacaccgtgggaatatcacttttgatgagatcgtcaacattgcttgacagatgcggcactgatccttagccagagaactctctggaaccattaaagagatcctggggactgcccagtctgtgggctgtaacgttgatggccgccaccctcatgacatcatagatcacatcaacattggtgctgtggaatgcccagccagttaagcacaaaggaaaatatttcagtaaagaatcatttgacaactggtgaaaaaaaaaga

SEQ ID NO: 206066 - DNA, 379 bp, Homo sapiens
tgtccccctcaaagccactgccttatcattgcttcatatgtgtaaagtcagtgggtgtgacaaacaggcagagctattcctccaggagctcttcctctgggcagtgctggcctagagtaagcacactgtgaatgcacggttggaaccagcacaggcagtgccttgatttagaaggtgctgtcgttatttccagtgcccaggcctgcccctccgattttgtctgtctttccaggcctagcaccaccacctccacagcactgtactcacacataaggctctgggaacgaagtgtcacaaagtcacagaactttttctacgtggcctagcccttcaaacaaggatgtctggagggtagagagctaaaaactaaaaataaaaa

SEQ ID NO: 206067 - DNA, 234 bp, Homo sapiens
tattaccctagttcaggtctctatctctcacttagattactgcaacacgttatcattggtctgtttcctgtcagtctcacctccctctctttctccactcagcacaacagggacatctttctaatacatgagaattgcttgaacctgggagatgcagagaagtggccagattagagagagatttagggttcagactaaccatcaatttgaatggaagttagacaaagggaaaca

SEQ ID NO: 206068 - DNA, 407 bp, Homo sapiens
aagcttcacttgattcggtagatggcatcttcaaaatgaaggggccctcagatactatttactcccattttttcccaacagttaaaaattttggttttccaactcatagaatattgcaagcaatagacattgaacaccaggaagggtgagagggcaggagaggggtgaggggtgagaaattacttattgggcacaatgtacattatttgggagacggttacaataaaagtccgggcttcacaactacacagtatttctatgtaacaaaactgaactggtaccccttaaatttatacaaaataaataagaaatggaaggccaatgtaagcatgctttctcgaaaaaagaaagaatatcaaagtaatatatttagagtggtgaattgagaacctggagaaagagccaga

SEQ ID NO: 206069 - DNA, 318 bp, Homo sapiens
cccgagctcctttaaggatcgctggtacccgacgcagctctcgcgtctaaacggcacggcgggcgctccacagttggcacccccgtggcctcgggagctcaggaggagctgctgcccaaacaggaggagccctcgccaaagctgggggtcagaaagggaactcacatttatagttccggctgcgagccaggcctgctggccacttactgagcagtgttttatttaagcctcaccacagtcccagattggaattgctgtcttcggtgaagactagggcaccggcgctgggaggtgaagtcacttgcctgcgatgcctca

SEQ ID NO: 206070 - DNA, 655 bp, Homo sapiens
ccctggaagcaaaaaagcaaactaaacgtaaaacaagcagaaagaaaaaaataaaaagaattatagaagaacttaatgaaatagacaataagaaaacaactgtgaaaacacaataaaatcaaaagccagttctttgaaaagatcaacactactaacaagcctgtacctagactgattaacatattaatattattatctcaacagatacacaaaatgtctttgacagaatctaacactttttataagaagcattgaacaaactaggaatagaatggaacttctaactaccaaaaaaaagcatctataaaaaacctacagccaacaacatagtgcaatttgttgcaggatgtcagagcataagaagggtaggaagggtaggtaggagagctgcccagttcgtgaagtcagaattccaaaaaagtgataaggcgtctacctgaaacaacaaggaagaggcaagtgggttgtgctttgacataaagtttctgagtatgtgcaaggtaaggaaggttaggtacactaaaggcttctctgtgtagagattcagagcctgaaaagggtgagaaggcttctgcctggaggagagggcaaacgatcggaggcagctggacctagagtgggggttgaaaatcattcatttggtgtgtggcttgac

SEQ ID NO: 206071 - DNA, 417 bp, Homo sapiens
tctgtctgagatagctttgccactcacaaatgaaaagtttgctcacagattctcttatttgaagtttactgattaatatagttggagactgcacacggggtcccattgtcataaattccttagtctatctgggattcctggtctgtcatagattccttagtctatccagagcaggcaagtctggatacctctgctgttccttcagcacatcaccccccagcgacctacatgcagctcatcgggaccctaggagagcttcccatattcacagaagcaccattatggttacttattgctatgcaaggaatatcctcaaacttagcaacttaaaacagctattttcttttgcttgtaatttgcaggtcagggatttgggaagggtttgactgggaagttctcgcttagaatctctcaagt

SEQ ID NO: 206072 - DNA, 384 bp, Homo sapiens
agtttttagttcacgttcccttttatccagcaagcctactttgataagctctcctacagaaatacaagcatcagaatataacgacatatattgaaagtgtttcacgcctgtaatctcagcactttgggagcctgaggcgggcggatcacctgatgtcgggagttcgagtccagcctgaccaacatggagaaaccccatctctactaaaaatagaaaattagccggacatggtggcacgtgcctgtaatcccagctacttgggaggctgaggcaggagaatcacttgaacccggggggcggaggttgcgacgacgagccgagattgtgccattgcactccagcctgggcaagaagagcgaaactcttaacaacatttttcacttg

SEQ ID NO: 206073 - DNA, 202 bp, Homo sapiens
agaggaggtggccaggtgcaggagatggctttaaaaaggtagttggccgggtatggtggctctcacctgaaatcccaacaactaaggagtctgaggtggaagaatcacttgaggctaggagttctaggctgcagtgagccaccagggtgccactgcattccaaccttgggcaacaaagtaagacccctatctctttaaaaaa

SEQ ID NO: 206074 - DNA, 278 bp, Homo sapiens
aggacccagccaaagaccaattaaaggatgagctgatgggtcttggcctctgagatctgctaaataccagtggctttaagaagttttataatttgtcacgcattcttcttaagtgttttctaagtggtgcccaactgagaaaggggaattgtaaaagcaacgttctacttcaataggaaacgcagaactgggccctgattcacagggacagacctggtctctggcgagctctgggcctgtggagcgacctggctcactggagaatgggaccctcaggc

SEQ ID NO: 206075 - DNA, 294 bp, Homo sapiens
gaagtctagtaggaatttcagacccactactcactgaatggctgtgtgacctccggcaagttgcttcattctctgggaccttatttgctcctctgtagagcagggataataaaatgaccctgtgctgttgcaaggatcgagttagttactacagtatacataaggcacatatgacaacagctggcacttcagaagaatgggatccatgtgcttcatctatctggaagacatgacgcctcgtaccaagaaagtgctgagtaaagattcattaaaagagtatctttaagttattgc

SEQ ID NO: 206076 - DNA, 288 bp, Homo sapiens
actcatttttaattggataggaggaacctacaaagatgactgacaaagaagtaggagggacaatcgtatgtattaggtttacctgactgaggcggcgaatgactcatgagagcattttcatggaatagtgggacaaaggctgaattgcaagaattgctgtgtaaatagaaggaatgaagaaaaagagtacaaaagcatatgatttctgagaacgttttgctataaaagagaaaagatagaagatgtttgaatatatttaatgtcaatgaaaagatgccagtagaaagg

SEQ ID NO: 206077 - DNA, 545 bp, Homo sapiens
tcaaaggaaacctaaataaattgatatatatttcatgtgcaaggatagcaagactcagtattgttaagatgttaatactccccttcttgatctatagattcaactctactccaattaaaattctagcaggttattttgtagatataaacacatttattctaaagcttatatgaagacgcaaaagactcatagtcaaaatgctgaagaataacaactcagaagactgacactacccaactttaagacttactctccagctaaataattgagatagcatggcattagtgaaagaatatgcagattgatcaatggttcagaagagagagcccggaaattgacctatgcaaatatagttagctgagctttgacaaagaagcaaaggcaattaaatgaaagaatgcagtctcttcaacaaatggtgcttaaaaattggatgtccatgtacaaaaaaaaagaatctaagttcagactttacacccttctcaaaaattaaaactcaaaatggatcaaagatctaaatgtagaatgcagaatcacaaaacttc

SEQ ID NO: 206078 - DNA, 190 bp, Homo sapiens
ccaaacatcttagaaatgaggagtctcccctccttgcaaaagcaggctgtttggggccccagtaattttatttgcagatgctctgaaaagcactagtcaactacgttttatgtatttcacaattcttccctccatatacagatgatccttcacttacgatgggggtcacataccaataaacccatcttaa

SEQ ID NO: 206079 - DNA, 214 bp, Homo sapiens
ctagctgatactaggtttccttacaaccaccatatgctaatgtctcccgtcaataaatatctgaagacttgtgtgcaaaacgacagatttgaaagtgaaatagattggttgccattagcaatatttgggaaaaattctggtctctttattgggggagtaaatctgtaactccagaaaggaaatgggaataaatattctgtagtgaagaaatgaa

SEQ ID NO: 206080 - DNA, 747 bp, Homo sapiens
taccatgatccccagctgctccgagagatcaaaggacacaagtgttacagaatcctgaggtgtcacttttctgcctgaaacctctggctggtggcacctttacctgtgttttgctcgggcccactgggttagttctgtccactcagctcatgctagtggtctggatcccacacctgccaagggcgagctgggtacagagcagtgaagggtgtgtgagcaagcgagcatgggatctggccactgcacacagccaagcatgccagccgcagtggggtgggcagctccaggcacaggtgccagctccctgtgaggctgcagctggaccaggccgactgcaaacagcttccactgtgggtatcagggaatgcagtggcacccagaagcttggagatgcaggacctgcagagccccaaagaaggtgtcacagccctggttggaggagctcctaggtctgtgttccctgaagggacacagctcttctctccttctctcttctcttcttcttgcctgcaatttggcaagaaaggatagcgtttcagccctgtttatgttacacctctttcagccctgctagttggcaggtcctgagttcttgtcctgagtccaggaaaaatgaggtatgtggacaagtagaaggtgagcaaggtgaagaggtgctttattgagccacagtacagctcagaggagacctgcagtgggtagctcctttctgcaggcaggtcatcccaacgtctgttcagctctcag

SEQ ID NO: 206081 - DNA, 386 bp, Homo sapiens
accctgatgctgaagggtgaagcacagtcatcactgagaaagagacaagtgccataaacttagaggagtctcatttgcttggcctcctgcattttctcaggcaatttcccatgatgcactacagaagtaccactatgctagaccattcccatgatagaaatgaatcaaaagatttaggaaaagtcataaagaaagtaattagggactcgttctgtatagtgggttagccacccagaagtgggttggagtcagtggattagccaactggaagtaggttggtcttcgctcggagcgcgggtggggccacggatgggtgtcgattagcccaggcagagactatagccatcactgaaacagcaaggcctgcaggaacctgcagtctatgg

SEQ ID NO: 206082 - DNA, 431 bp, Homo sapiens
gaagtcaaataggcttttttatttttaaagataagtatttagtgatgtaggattttgccatttatacttttgggtacaattctcttttactaatatataggaaagatttagagacaaaaataataaaacatattactagtactctataaataggtttataaagtacatgaatctgcaaatatattttccaaattgttttttcaagctttcaacatttccttttcctatacttatctttagtctcattttaatttattctcttcctacctggttctttgctatttaaggtctctataaaacttgtatttaaaattaggtctatccagtctgtccctggatctaaggaaaaaataaaaataaaatgaggcctgcctgtggactgtcctcaggcctgccatggctttaatttttaggcatgacttaaagctatc

SEQ ID NO: 206083 - DNA, 309 bp, Homo sapiens
cagtctctctgttcgaagagctggggtggtttctacttctagctggaccctgagtgatccttcaggcaggggtctctgcgactggagacatgctgtgtgcatgaggtcccatgtacactcagattgcatcccccatccctgcccagccctgagaggcaggcgagacagtccccctctcaccatctctggggtgggcctggatttattggctgaagaattacaccctctttgatggtatgcagtttaattccgtagatcaaagctatgtctagattttaaataaatgatagggatttaaaattgtatata

SEQ ID NO: 206084 - DNA, 480 bp, Homo sapiens
gcttaataggcccttactaaagctattcagcatttcagagacgagaaggcatgaagctacatgtaggatgcctagcagttggttcatctttttgaaagccaaggagtctcctcttcacctgtccatccttgagcagcagagctggggcttttaagagaagcatttgtagaattcagagtaggaatgagggaagagactagttgtctcggaggctcaggggagcattccctggtcttctgagattgacacatcactgccaccttctgctgcctttctctaggcctcagagctcagccaggctgtcacaagcttgctgggtgccaccctaatgtctggtgccagggctgaaggtagccctcactccagggagtttacagtgcatgagagactcatagttaaataatagttatggtgctgtatgataagtgatctaaaagtcaagggggggattccagaggagtcagagaaggcaggaagaga

SEQ ID NO: 206085 - DNA, 400 bp, Homo sapiens
aacaaagcctgttgatgccaatgtagcattaagtttcagtatgtaaaagactacaaatgttgactctacttattcttgtctatggaactggccttttagccagtcacagacatcacatcaggcatcctgaagtagatgctatttcattagcatcactttctgccagcaaatgacattgtcttggagcagagccagactacaggcatgagcaatgtgttagagattctggactggatttctccagggaatgggtaaggttatctagtctagtacatggtgaaggctgctataagtgacaagtggaaaagcttcatataccttatgttgttggaaaaactagatctttaaaatctctttatatcaattctttatagcttgttcatgtacatgtacacattat

SEQ ID NO: 206086 - DNA, 497 bp, Homo sapiens
tcctagtcttctctctttggagctcctgatttaggacaaggagatcccctgccctctgcatccctctcttggagcaccagtgtagtatttttattggaatggaattgatgtagtcctcctgagagctgatgggttgaggcaagtctgttgcagtcctttgtcttcctggtacatcctcagagaaatgcactgtaagtctttgcttgttccctcctgtttcaatttggcttcagggttggtttccggtgccatggatgtaatttcacttaggtgaatttatagacataatgcctttggtcatggaggacaatagcatttccttagagaaatttcttcatatagttctgacctattttgtttttcatttgcaaaggcagcatttccaggcttctaatatcattattgcacaaataaccttcactagagcccatattgtttgctgcctgaacttggatgaaataacttctttgaaaaaatattttcgaaaaagatttttt

SEQ ID NO: 206087 - DNA, 571 bp, Homo sapiens
tatgtggaagccaattcacatcagacacatatctggcagtagagaattaaaatcctcaaggaatccaagtaatggttccaggattgtggaccctaccccactgacagactgccacagggaggacggggtatgtctgtggtacaggcctgagccacctaggaggcccaagcagacatgcaacctgggtatccaaaaagcacgtggaaggaagcacacacacaggcactggctatgaggatggggctcactgattccaagcacattcatggcagccaactgcatgacaggcactgggaaatggtgcggggcagagtgatggtcagtacaaacacgtatgcatatctatgtgtgcatacgtatccacaaatgtgtatatgtagaacatatagacacacactgaaatcaaagtgttatttcccaacactttccttcactacacgcaatgcagtctggtatttttattctttgttttttgttttttgagaccgagtctcactttgttgccaggctggagtacagtgacgcgatctcggctcactgcaacctctgcctcccaggttcaagcgattct

SEQ ID NO: 206088 - DNA, 245 bp, Homo sapiens
gggtgtgaggaacacgcatgctgttgatggggggtgaactggtacaaactttctggcaacatctactgaaactgaaacgctgatgcacattcctctagactctgctagagaccgagcagaaacattcttatcccaccttacaaaggagaactagattcagaacagagcagtaatttgtccaaggccatgtggccagtacatggaagccaggtggtgacaaaaaacaagcaagcagacgcctaaag

SEQ ID NO: 206089 - DNA, 449 bp, Homo sapiens
tagctgggattacaggcgcccaccaccacacccggctaatttttgtatttttagtagagatggggtttcaccatgttggccaggctgttctctagctcctgacctcaaatgatccatcctccttggcctcccaaagtggtgagattacaggcgtgagccaccacgccctgcctcctggaacatttttcatcccctagtccgccaactagtctctacaacaaaatttcctagagttgcttgtacatattgtctctaatctttcccttccgttgtctgaacccactcctgtcaggcttttgtccccaccattctgatcggatagctcttgtaatggtcactaatgacctccatgttgctaaattcaatggtcatttcatcttatttgatctgtcagcagtatttgacacagttgctcattccatctctctttgaaaacctttcaaagactt

SEQ ID NO: 206090 - DNA, 234 bp, Homo sapiens
atttaacaatatttttattttatatatcaaacattgctcatctataaatctgtgactttttgtttctttttggcttttgcagatcttttaagtgaaactttaaagaatgtctatcttttctgtagcaatatgctctaccctggccttgtctccttagtaggaaatctgtcatacctattatcttatatattatacagcctttcaaattaaatcaattaactgaatcagttagtt

SEQ ID NO: 206091 - DNA, 348 bp, Homo sapiens
aaaaggacaatacattgctatgatctgaatttttgtgagcctccccacacacaaccccactccactccaagtttatgtgttgaaacttaatccccagttcactggtgttggcaggtggggcatctggtgggtaattagctcatgagcagagctgtcatgaatgtgattagtgtcattataaaagagacctgagagagagctcattggtgccttctaccatgtgaggacacttagaaggtgccatctataaggagtgggccctacccagacaccaaatctgccaaaacctagatcttggattttccagcctccagaactgtgagcaataaatttctattgtttataaat

SEQ ID NO: 206092 - DNA, 257 bp, Homo sapiens
aataggcaactcattaggactctttactcatctcttccctgccccagctttttaaacagggtatcctgttaaaaggaacccagactgatggcgcatgttattcttagcttccctttgtgggctgaaggaaaaagtaatagttgagagggaattatggctttcagccatgaggacacaggattgcctcagagagagccaatcaatttttttccctgaagataaactctgcagacaggggtagcgtttttcctgtcatg

SEQ ID NO: 206093 - DNA, 436 bp, Homo sapiens
atgtgtgttgctgcgtaaagatgccatacttaatatatgttgttgatttgttggcattgaactcacggctgacagcactattgctcattcatgaacaaagcttatctaacacacaggtttcctccataaggcacatcgcagccttctcacgcttagggaactacacagcgtttcagcacttcactagggaccattttgaacagtgaaagcgtcaacaaaaagcacaaaaattcaaaaaacgtggcactgacatagaccactaagcaggcagctgttttcagcatgagagctgagagagttgtcctgttcagcctccgctggcaacgtgcacattggtcaatgcaaatttttcaccactcagcacatgtctgcaaataaccgcaggagtgctgatttggaggttgcagatcaatcttagcaagaaggtgaatttgca

SEQ ID NO: 206094 - DNA, 245 bp, Homo sapiens
tgcgtgaaagtgagctcagatgtaacctaaacccatggaacttggaaaaagaagcatctgccgagaggagcggggttgatcttgatttgctttcagggagttgccacggagctacttatactttctttgtctaagaaacatttattttacaacccacggagcaatgctggggatgtaactatttcttgattgattcctgtggcacagcatcgtctgcagagacctgcattatgtgaagcagcatc

SEQ ID NO: 206095 - DNA, 629 bp, Homo sapiens
gtttgaggaactgaaagagggcaggatcacgcatactttataggctatgtgaagaattttggtctttatcctaaaagcaatgagaagctattgaagtgtattttcaacaggggaaggacattatcaggtttgaatttttaaaagataatttaatagctatgtgtagacttaggggtccaaggttgggttgagaataagagtggatgcatagtatagtcaattaagaaaacactgtagttgtctaggttaaagtattggtgttttagactaaggtagtggcagtgcctgagatgggaaggcttagacatacatgagagagatttaggagttcaagttcacagttcatgctgatgactgggcagggggtgaggaagagagaggggccaaggacaatgcctcattttctggctggacaatgtaagcattgactggcacaggaccgggtttggaaggaagaacgtgagctcagttttgggcttgttgattttgagatggctttgagaaatctatgtggatgcaaagctgtagggttgggagtataggcctggtctgggaatataaatttgggaatctggaatgtggatagtaatcgaagacaggaaatggaagttattggcatgggggtcctc

SEQ ID NO: 206096 - DNA, 457 bp, Homo sapiens
caagaatttcatgggaggtaacatcattaataagaaagccaggctcacttatagaagagaggtagaaagagcatttgtgaaaaataaatcgaaaatataggaaagttttataaaaacaggggaaaataacagaataaccataggatctggtagcacaaaatggcaaaggctgcctctatgactcattagggttattcacaaatattctggtttacaaagcagatacaaacatggacttgcattagccaattgaacgtaatcaagtgacgtgtcatttccagtggtcgctttgcatgctatgcacagctcaccatgtctcttgacctaaggcaattctagaggcatgtgtcatatggagctttggtcatcagggtccctgagtgatgctgaagagcagaacccccttgccaacccaatatacacatttgcctgagtgaaaaataaaccttttttttgt

SEQ ID NO: 206097 - DNA, 354 bp, Homo sapiens
accataggagagaattttacataagatatatctgaaattagtgaaaatacatgcacaagtacatacaacacaatataccgtgttgtcaaagctagaaaacacacactgccatctgctgcctatcagagtgcaagtgatagacctctccggaaaacagcttaatagtgcctctcaaaattaccagcgtatcaacccttcagcactccctcttcagggatatagctacaaatgtgaggacagtaaaaaagggcaaataaacaaggttattaactacagctttgctatgataataaaaatgtataaacaatgctagtgtccagtagggtagtggctaatattacgcatcagtttaaa

SEQ ID NO: 206098 - DNA, 580 bp, Homo sapiens
agtattagttatttctctgccaggctttggtatcaggatgatgctggctgcataaaatgagttagggaggattccctcttttttttattggaacagtttcagaaggactgtataacagctcctctctgtacctctggtagaattcggctgtgaatccgtctggtccgggacatttttcgattggtaggctattaattatggcctcaatttcagagcctgttattggtctattaagagattcatcttcttcctggtttagtcttgggagagtgtatctgtccaggtatttatccattacttctagattttctagttgatttgtgtagaggtgtttatagtattctctgatgggagcaatatgcgcgatcctcccccatcagcctcctgaatagttgggattacaggccatatgccaccatgctgggcctcaaagatctttgaaaataatttgtgtctgctgaaaatctgtattgagttgtgttaaacaactccataggaattctagcagaggtcagcgtgtgccattgtgctctgagttagtattaccttccttctggtatatttaggtactcttactttt

SEQ ID NO: 206099 - DNA, 484 bp, Homo sapiens
taaaatttggagaaagataggaggagagcaacagcttgtttcacttcctctactccttccacactgcacgtgttttagaaaccgggctaatgaaatttacgttctattttcgaggctgtgctcagttatttctcaggaggtccagtaaataaagaattaatctatttgttttgtctttagtcaagttatgaaactagcgaattatttacattaagtggatttgttgttgctgtcgttgctgaaactagtgaaagaatcgagttttgtgctatgagtcatgggagcaaaacgtgagtatttagaagtggagaggaccacgaagaaggaagccctggtgacttgaagaaatcatggagagttctccggattcccacaaacctatggggtttagattccagctaatacttacacgggtctcagaaggacagagggcaagggttaacatctggctgatattaaagtctctgcacctcttaatatttta

SEQ ID NO: 206100 - DNA, 139 bp, Homo sapiens
aagacatcagcatctaatacagatattttacattgtaaatcttctctgttttagagaagtttgaaatcaacatattctgtatttcctattgtgtggataaaattctgatcgtttcaacatcagtgattatgagtaatga

SEQ ID NO: 206101 - DNA, 1716 bp, Homo sapiens
ttcctatattttatcaatgaatatttattgagcacctcttttattctagccattttgctaggtatcccaaggaaagcctactgtgttctgaaaaattggaattcattaattaaattaaacaggactaacatactatacttttccatccagagaaatgcaaaattataccttgattcaagacaaaatagtttgtccctcccagccatagagaaagctgagttgtttgttacttttagatcttaggtacagaatctgataaagtctaggtggttctgtataccagcccttgaatttataatcgtagagacttgccttaaatatatgatcagtttaggtaagttcgagaaattctgaagtgtcaattatgttgtattagtccgttttcatgctgctgataaagacatacccaagactgggtaatttataaagaaaaagaggtttaatggactcacagttccacgtgactggggaggcctcacaatcatggcagaaggtgaaaggcctgtcttacatggctgcaggcaagggagaatgagagagccaagtgtaaggggaaactccttataaaaccatcagatctcatgagacttattcactaccatgagaacagtatgggagggaaccccccgcccccatgattcaattatctcccaccaggtccctcccacaacccgtgggaattataggagtttcaatcaagatgagatttgggtggggatagagccaaaccacaccatatataaaaatagtatagataatagttatatggagtactacccactgaagggatacatgtttacctgttcccccaagttaggtagccagaagtgttgtgtttgcattgttggcacaacctgtcaacattaataataactaatttattaagtacttctgtgtgccagggattgttcctaagcttcctacaagaataaatttatttaatcttcctaagaatcctgtgaagtgggtacagttgagcatcccaaatcccaaatgctccagaatccaaaactttttgagcactgacatgatgctcaaaggaaatgctcactgaagcattttggatttttggattggggatgctcaaccgtaagtataattaatgcagatattctaaaatctgaaaaatcctgatatctgaaacacttctggtcccaatcattttggataagggatactcaacctgtactacttactctctccatttcacagatgaagaaagtgaggtagggaaaaagataagtaacttgcccaaggttacagagctggtaagtggcagagccccaggcagccttgctgtatagcttactgtctcctaaccattattctatgctacctttcatgggccctcatgttaagagtaactcttcagtttagcaaattattctgcattatatgatgagcttacatataatagcaataatagaccagaagcggtggctcacacatgtaatcccaacactttgggagaccagggtgggcagattgcttgagttcatgtgttcaagaccagcctggacaacttagcaaaactccatctctacaaaaaatacaaaaaaaaaaaaaattagccaggtatggtggtacatgcctgtagtcccggctactcgtgaggctgaggtgggaggattgcttgagcccaggagttggaggttgcagtgagccaagatcgtgacactgcactccagcctgggcaatagaaccagacattgtctc

SEQ ID NO: 206102 - DNA, 477 bp, Homo sapiens
actttatggaatttatatccctgtaaagtcccctcccacactgtaccaaggttagtctatgtgaccaacagaatatggtagaatatggcatgtcacttccaagattaggttacaaagcatactgcagcttcgatcttggtgtctgtctgtctgcttgtcttcctgtctgtctctcttggatcatactctgggacaagtcagctgctatgtcatgaacagccctatgaagaggtccaccttgtgaccaacagctaatgagaaactgagaactgccaaccaccttgtgaaggaggctgttctccaactgcttgggctttctccagccccagtcatgccttcagatgcctacacccctggctgacagtttgactacactctcaagggtgactttgagctaggacaaccctgttaaactgctcctggattcctgacccttggaaactgggtgacataataaatatttgttgttttaaactc

SEQ ID NO: 206103 - DNA, 412 bp, Homo sapiens
ttttagctcatcagctatcattagtgttagtgtattttatgtgtggcccaagacaattcttcttcttctaatgtggccaggggaagccaaaagattggacacccatgttctagaggcttaccacattcccatgacttatggcacctttcttcaatctttaaagtcagtaacattgcatttttctcatccttcttcagtagccatatctacctctctgactcttctgcttccttcttccacttaaggatggttattattaaattggatccacctggataatctaggctagtcttcctttaaggtcagttgattaacaacagtaattccatctgcaagcttattgccccctttactatgtagcctaaaatattcacaggttctggggattaggacatggatctttttgttgggg

SEQ ID NO: 206104 - DNA, 460 bp, Homo sapiens
ggacgctgtctagagcagaatgttcaagctgaggtcacccaggaccaggaaggagcaggcagaggtgctgccaggctgtgtgtgtctgcagtgccccaggggtagagggaggcagatagctgccttcccaccaagcaggcgtcagcgtctgcagcgcggtatggatacagcaatggaggggcacaaggattcctcctctagggtaagtaggatgcttgccaacttggaggattttagagcagatgtttgctgatgggccatgaacatgctgagcagacggcatacggcagcgctacgacatgcacaggtggcacttggttactgacaagctgagggtaggcacaaaacctgcactctcagtggcatgtccaggcaggtgtcctcactggctccgggtctcagttcatctcgacgctctgaccccccacattccagcagaacttggggactgtggagaggg

SEQ ID NO: 206105 - DNA, 884 bp, Homo sapiens
  misc_feature (376)..(376): n is a, c, g, or t
agaaactctccatttgttttccaaagtgtttgtaccgtttcacattcccaccagcaatacacagatgctcctgaactacgatagggttaggtccaaataagcccatggtaaactgaaaataccatgaatcaaatgatttacaatacccaaataaatccgtcaagttgaggagagtactgaatttgtatagcttgtataccatcataattttgaaaaatcataagttgaatcatggacaaggactgtataagagttgtaattcctccatatccttggcaacatgatatggtttattttttgcaattctaataggtgtgtattgggtattgcactgtagttttgatttccctaattactaacaatttaaaccatcctntttcaatataaaaaaaaaaaaaaaagaaaaaaaaaaaaagaaaagaagagagagaaaaaagagaaacaaaagaaaaaacgaaagagagggagacccgcaagagagagagaagagagaacaaagaagaagagagaagacagaggaaagaagaggggaccccgaaggggaagaaaggaagagaagggagggaggggggtcaggcgggacggccagaccacactctgcgacaccctcgcgagcaaacctctagtgctgaaaaacagggaaccagcgcagagcacaccactgtttcggtggccaaaccacaaccatcactagtaaacacacacgcattaccgaataccatcaacgtcttttcaacacgacccacactcaaagctacaacagtagtatcacaatatgagcaccatgcgcacaaaaatgcgtcttaacatccaacaactgcacacaatgccattgctcccagtgacaaactcgtgaatcacacggccactcacacactgaaaga

SEQ ID NO: 206106 - DNA, 711 bp, Homo sapiens
agtaggttcttgggccccatactagacttcctgaatcagaagtttctgaatgtatgcctaggaacatggatttaagcaacctgtattggccattcttatgtatgctgaggtccgaggaccactgccatgatcatggaaatctcatccacatcaatttttgccttctaaaaaagcgtgtacgtttatgggacaagaatgtcatgtcatctgtgtagctccccctgaacctgatctttgttgcagtgtggagtttgctacacatgcttggctgcatggggccctggattatccacaggaacttgattctagaaataccaaagcactgttgtttcacagcagcccgacgagtaggccctgcatggaatgaggcttttgctatgtcttcctgcatggtcacctctagtcatttgagagcttccattgcatgcagatcacacatagtaggagatgccatcaatttatcaattatttcaagcacactttaaattcatcttccttctgtctacctgagaattgctaatgttatattattcactgaccacaaggaaaatgagaaaattggttgctatcatttcactatctatagaagacaaagcactgtctttatttttacagtagaagtgctctaaagaatttctgtgtcaacttgagatacttttcacaaagacaagaagcattttacttttctgagagaaaagagaataatttaaa

SEQ ID NO: 206107 - DNA, 3701 bp, Homo sapiens
agcggtctccctgccgagaaatgggccggcccggctgcgcgcgggcagcagcggtggcggcggtggtccaagatggcggaactgcagctggacccggcgatggcggggctgggagggggcggcgggagtggggtgggcgacgggggtggcccagtccgcgggccccccagcccacgcccggctggccccacgccccgcgggcacggccgcccggctgccgccgtcgcgcagcgattggagccgggtcccggaccacccgagcgggcagggggcggcggcgcggcccgctgggtcaggctgaacgtgggaggcacctacttcgtgaccaccagacagaccttaggccgggagcccaagtcatttctctgccgcctctgctgccaggaggacccggagctggactcagacaaggatgagacaggagcctatctgattgacagggaccccacctactttggtcctatcctcaactacctccgccacgggaaactcatcatcactaaggagttggcagaagaaggtgtgctggaggaagcggagttttacaacatcgcgtcccttgtgcggctggttaaggaaaggatacgggacaatgagaacagaacttcacaaggccccgtgaagcacgtgtacagagtcctgcagtgtcaggaagaagagctcacgcagatggtgtccacgatgtccgacggctggaaattcgaacagctcatcagcatcggatcttcctataactacggcaatgaggatcaggcagaattcctctgtgttgtctccagagaactaaataattctaccaatggcatcgtcatagagccgagcgaaaaggcgaagattcttcaggagagaggatcgcggatgtaaactaagaccccgaaaactccagaccttcaggagagcagtcagcagagcccctctgtgaagtgaaaccttactcctgtccagtgaccgagccactgcaaagcacagctgatcctggccccctgtgaagaagtgttctggtcaaaactaaaggaactccctccccacctgcaggactccgaagacagtgcgacttctggctgcagaataccttttcagaaacctgctttcatttgcttagccagtattagaacagatctttacaacagcagctgggctgggttcccagtcggagcctttcggggatctgggggatgagggcggaaggcctagctccttggaaatggcctgtactttaaggacgctggagccaagaggattgttcccgtgccgtgccatggtttcaccctatgtgtgccacaatggacgttagcagctgcttcggaacaccgtccctcctatgcaccctccaagacctgcagcagatgcaaagggttctagctgcagtttgtcgaattgaggttttaggtaaagcatagagttgccagagtaccccgcattcccatgaatagagcctccaaggaaagggaggatggggtgtcctttgttgtggttggaggttggtgatcattgctctggatttggggctcccggctgccaccacatgcagctttgcctcagctttctccagcagccgggaccctctggagagcttgttttccctccaagaagaggtttgagacaggcggcatcctgcactgagtcagacaagtgggagctgtaggaactgcacctgcagcctcttcttactccccattgaccctgtcttccttccctggctttttcaactggaccaaagatgaaggcacttatggaccctttgatggcttggagtggggaaggctgtttctttgaaagttgccaaatgtgttacgttgtgtctcagagagagttatttctgtgactctcttggaaatgccttgactgaatgtgcaatatttgtgtctcttggtttctaaccttggcggacctgctcccctctgtactgtccccagtggtatgtatgtatgtgctaggcagtctggggaccccctgtgtctctgaccacccccctgacccccgccattactttcttttctggagtgccatgctggcgaggatccggatgcggcagcaccctctttcgggctgcatccacagagtttgtgtccacactttctctccgagcatgtgggtctcgctgagcagtcatggaatgcggtagagccaggggaccctgtctgccccgaataactttcagtagtatggcagatggcacagagaaagggaaggggctctggggacttctccttctatgaaagccgcctcgagccaggtgctcctgggcaccttcagaagtgatgtcctgtgtgctccacagctcacctgcttgccaaggtacgtctgggtagtagtttctggaaatgactgcagactgtgccaaatgtcttttgagcttctgacctgaccatgcccagatggcataacttttccctaggaccctcagtctccttgtttctctgtatctgtagcatagcatagaacccggtatacaggggtttctgctgacacatcaacgtctaaacacctatgcgccacattttacagctgtaaagtgttagatgaactgccgtcctcagtaaaagcagccaccccttcaagagtcacaggcatccatccagtcgtatctttcagagaaaaaaaaagttagatgtagccaaggaaagtagtgatcacgggaaggactgctctgagccgggtaggatggaggactttggaagaggcgctccttggccaggtccaatgagtaacatcagactgacagaggaaaagcagcttggtttgcggccttgtgcccagtctcgttgaggcgcttgtccctgtctgctttcctggggcatgcctgatcagcgtgggctggagctcctagaccaaccccagctttctcaccaggttcagcaaggaggcctgggggtcagacaccaatgttgagcacctcctgagggcgccgtttccttcattcctcttagattccatagttgccgccatgaaaagactgctcttgagccccaaggcacaggcacgtgctctgggaaatagacaggagtggtatttccgccctctcggagggctggtgttcaccaagtttccctcctcgctgcaacccaatgacacctgtattgttccagcgctccaggactctgggttcttaagatttctgggagcgttgttcacccaccccctttaggaaccaggctggtgttcttgcttgaaagcgttgtgccctctgagtgtctggctgatcacatcagagaggtctgcgtggcagtttggggctgtcacgtgaccagtgacccacactctctgctgcccagtactgccaagtggggagggtcctgcctttttctctgccccaggtctgggacgcaggtgatgccagccaggcccaggagtgcccagcatcccccaactgatgacacagtagcactgattctgtcttttcctcagaatctggcctttttccatggcaatgaggtggggcccagcctcctctaaagtgactttgtttctgcacagttgtaactgctcttggggatgtcagtgaggctgggagcagggagccacgggatgctgagagaggaggcccgagaggacaccccaccctccagcgtggcctttgatccagacttagggacgaggctgtcactggtgggcaccctctgttcctgtttgtgtgtttgaatagtctgaaatgctgtgactttttttgtgtgaataaagatatgaaacttctgaatctc

SEQ ID NO: 206108 - DNA, 3582 bp, Homo sapiens
agcggtctccctgccgagaaatgggccggcccggctgcgcgcgggcagcagcggtggcggcggtggtccaagatggcggaactgcagctggacccggcgatggcggggctgggagggggcgccgggtcccggaccacccgagcgggcagggggcggcggcgcggcccgctgggtcaggctgaacgtgggaggcacctacttcgtgaccaccagacagaccttaggccgggagcccaagtcatttctctgccgcctctgctgccaggaggacccggagctggactcagacaaggatgagacaggagcctatctgattgacagggaccccacctactttggtcctatcctcaactacctccgccacgggaaactcatcatcactaaggagttggcagaagaaggtgtgctggaggaagcggagttttacaacatcgcgtcccttgtgcggctggttaaggaaaggatacgggacaatgagaacagaacttcacaaggccccgtgaagcacgtgtacagagtcctgcagtgtcaggaagaagagctcacgcagatggtgtccacgatgtccgacggctggaaattcgaacagctcatcagcatcggatcttcctataactacggcaatgaggatcaggcagaattcctctgtgttgtctccagagaactaaataattctaccaatggcatcgtcatagagccgagcgaaaaggcgaagattcttcaggagagaggatcgcggatgtaaactaagaccccgaaaactccagaccttcaggagagcagtcagcagagcccctctgtgaagtgaaaccttactcctgtccagtgaccgagccactgcaaagcacagctgatcctggccccctgtgaagaagtgttctggtcaaaactaaaggaactccctccccacctgcaggactccgaagacagtgcgacttctggctgcagaataccttttcagaaacctgctttcatttgcttagccagtattagaacagatctttacaacagcagctgggctgggttcccagtcggagcctttcggggatctgggggatgagggcggaaggcctagctccttggaaatggcctgtactttaaggacgctggagccaagaggattgttcccgtgccgtgccatggtttcaccctatgtgtgccacaatggacgttagcagctgcttcggaacaccgtccctcctatgcaccctccaagacctgcagcagatgcaaagggttctagctgcagtttgtcgaattgaggttttaggtaaagcatagagttgccagagtaccccgcattcccatgaatagagcctccaaggaaagggaggatggggtgtcctttgttgtggttggaggttggtgatcattgctctggatttggggctcccggctgccaccacatgcagctttgcctcagctttctccagcagccgggaccctctggagagcttgttttccctccaagaagaggtttgagacaggcggcatcctgcactgagtcagacaagtgggagctgtaggaactgcacctgcagcctcttcttactccccattgaccctgtcttccttccctggctttttcaactggaccaaagatgaaggcacttatggaccctttgatggcttggagtggggaaggctgtttctttgaaagttgccaaatgtgttacgttgtgtctcagagagagttatttctgtgactctcttggaaatgccttgactgaatgtgcaatatttgtgtctcttggtttctaaccttggcggacctgctcccctctgtactgtccccagtggtatgtatgtatgtgctaggcagtctggggaccccctgtgtctctgaccacccccctgacccccgccattactttcttttctggagtgccatgctggcgaggatccggatgcggcagcaccctctttcgggctgcatccacagagtttgtgtccacactttctctccgagcatgtgggtctcgctgagcagtcatggaatgcggtagagccaggggaccctgtctgccccgaataactttcagtagtatggcagatggcacagagaaagggaaggggctctggggacttctccttctatgaaagccgcctcgagccaggtgctcctgggcaccttcagaagtgatgtcctgtgtgctccacagctcacctgcttgccaaggtacgtctgggtagtagtttctggaaatgactgcagactgtgccaaatgtcttttgagcttctgacctgaccatgcccagatggcataacttttccctaggaccctcagtctccttgtttctctgtatctgtagcatagcatagaacccggtatacaggggtttctgctgacacatcaacgtctaaacacctatgcgccacattttacagctgtaaagtgttagatgaactgccgtcctcagtaaaagcagccaccccttcaagagtcacaggcatccatccagtcgtatctttcagagaaaaaaaaagttagatgtagccaaggaaagtagtgatcacgggaaggactgctctgagccgggtaggatggaggactttggaagaggcgctccttggccaggtccaatgagtaacatcagactgacagaggaaaagcagcttggtttgcggccttgtgcccagtctcgttgaggcgcttgtccctgtctgctttcctggggcatgcctgatcagcgtgggctggagctcctagaccaaccccagctttctcaccaggttcagcaaggaggcctgggggtcagacaccaatgttgagcacctcctgagggcgccgtttccttcattcctcttagattccatagttgccgccatgaaaagactgctcttgagccccaaggcacaggcacgtgctctgggaaatagacaggagtggtatttccgccctctcggagggctggtgttcaccaagtttccctcctcgctgcaacccaatgacacctgtattgttccagcgctccaggactctgggttcttaagatttctgggagcgttgttcacccaccccctttaggaaccaggctggtgttcttgcttgaaagcgttgtgccctctgagtgtctggctgatcacatcagagaggtctgcgtggcagtttggggctgtcacgtgaccagtgacccacactctctgctgcccagtactgccaagtggggagggtcctgcctttttctctgccccaggtctgggacgcaggtgatgccagccaggcccaggagtgcccagcatcccccaactgatgacacagtagcactgattctgtcttttcctcagaatctggcctttttccatggcaatgaggtggggcccagcctcctctaaagtgactttgtttctgcacagttgtaactgctcttggggatgtcagtgaggctgggagcagggagccacgggatgctgagagaggaggcccgagaggacaccccaccctccagcgtggcctttgatccagacttagggacgaggctgtcactggtgggcaccctctgttcctgtttgtgtgtttgaatagtctgaaatgctgtgactttttttgtgtgaataaagatatgaaacttctgaatctc

SEQ ID NO: 206109 - DNA, 1130 bp, Homo sapiens
gcccctcctttgtgtgagcttccagggtctgctcggtccagcccagacaggtactccatggaggcagtagatatgaacacagaagacggttttgcatttgaggaggaaagtgacttcaatgggaacgcacacccctcagacacctcggagctatttgaggtgaaggcgcaggccagccggatgcagcgcctgctgggtccttctgagaccagctcactgagaaacagccagtctgaaaacagctccctcaataacatgccactacgtggtgggctgtctgtgcacacatgcagctcagccagtcaatctgaggccagctccatggtcaacttcccagcctactcagtccgctctgagtccagctcggccttccagttctctgacatcatcgaccagttagagcagctcagctacccacccacgacggccgaggactccagcagcacagagtcagactcatgggactctgaaaccgaggcccccctagacataagccttttcttcagcaacccttttgcacacacaagtggagaaagagtcccttttgatttacagaacaatttaaagaatttgactccaggagagcaaatagataaaaacccatcttgaccactctgggttcctttacaaggcaacccactcacccacgctgtgtggtttagagctcagaattgtttggtttaaacacagaaagtgactttcatttcatggatagatattcaatttttttttaatttcctgatttattatacttttttgaatgtcaaaaaatttgacctttcacttggaatgacgtaaaagctatgcctccggtcttagacctgagtactccagccagtcctcctagaggaccgataaattagtctttgtagtttatgttttttgccatatgctttgattcaagtaagaactggtgctatacattctgaatgttacacaattctgttcatgttgatcttcaatagaatatgtgtattacactattgatgctgcttttcaagatgagccctgttgcctataattaactaggacacaggttttgtctcacttgtccagccactgcgctacacaaaaccttgagtatgcctctacagccctaaccctgggaaagatggccataggccatggcc

SEQ ID NO: 206110 - DNA, 172 bp, Homo sapiens
aggagtgacgtgacctgtggatgctgaggaagtgctagtgacaggaagaggcgtggtgtcacctgtggatactgaggaagtgtcggtgacaagaagagaggtggctgacctgtggatgctgaggaagtgtcggtgacaggaagaggggtggtgtgacctgtggatactgagg

SEQ ID NO: 206111 - DNA, 556 bp, Homo sapiens
tgtctaagagtaattttactgttatttccccttcacttggcttgagaaagagatgtcatctcttgcatagggagaagagcttgcaggcttacatcattaacactcatctcctggtgctgctgactctcttgtcaccctccccagcattctcaggtgaatgggggaaggtagggtgaggcgatgctgtggacagtgctatctggttctactgcttcttagaatgccccgggggacatgcttcagttgctagcagctttgtatagaatgtggtacataatacttctttgtcttcagttttggacccaagtcataggacaagttccagtcaacaccttattatgtaatcagtacaaccaacagatgagaagagaaaccacattgttgataggctattgaattatatggcagatgagcaatctaaaaaaagtatcctaaatttgggttaaataattaataaaaaagacatttcatctatagtaatagaaaaaaaggcaagaatagtggtatgggtttatgtctattggtgtcaaaaagtccactttatagaatatatatt

SEQ ID NO: 206112 - DNA, 423 bp, Homo sapiens
cagaaagtccaagcatgtcatgaatggtctgtgtaagtcacaagaataggatttataagaaaaaaactgaaaacttttatatgatcaagttatctaaaattaatgagaaattataatggtctctccagggattgggcttgatgtaaaaaaagaaaacacttatacactaaataattagaacaataatattaattttcttaagggattgatttactcaataaattacaggagattatagttttcttaacagaaagttcaacttttattgcatcttgtttttggttttctctccccttttaaaggacgtgaaataggaacactcttcttcaattcattttcagctcatataagttttgtttccccttgagttctgtttgttgtagcctgatgctaaaatgttttcttaaaggtctaaaggaaatg

SEQ ID NO: 206113 - DNA, 366 bp, Homo sapiens
cctaaaatcctcataagtttctgagcagtaggggcactaggaggctcttttgttccaatatttggtgtctgccccagttcctccgacagagttcctaatacccttgtagataggggtactagaagaatcttttgttctatgatttggtctttgacccccattcttgtcacagagctccaaaatcccttggaatttcctgggtgataggagcatcttttattctgatgaggcgactcttagtgggctcctggatggtgctggtcaccagaaagaccaagccatgaccataaacttggagctttcagtcccagccctatccttcagggagggagaggggctggggattgagttaataattgaccatgc

SEQ ID NO: 206114 - DNA, 206 bp, Homo sapiens
gccgggttgtgtgcggcctcgcgctcccctggctaaatcgggaagcgaaagttggatctcagcccctcggggagcaactttgtcggccctggcggcagctgcttgttctacgcgcccgggcagccgggggcgccgccctctgtccctcctcgctggccgcgccctcgaggggctcccggcccttggaggccgcccttctccccggg

SEQ ID NO: 206115 - DNA, 763 bp, Homo sapiens
tcccgacaggcatcacccagagcacacccagagcagcctgcagcggcgtggaaggggcttgcactggccccaaggtgcaggggagccctgcctgcctgtctcctgctaggcttgcctgggctcccgcctacagaccatgagaattcttctagcatgggaagagagtctgaccaaagtgacaacagccatcccctgactgcccagcactgttcacttcttcccagatactcctaccagaccaggtcagcccttcttttactggggggccagaaacgtccccccaatccagtccaggactccagatgatgcccatttctctgccagtcccagcaatctcccttctcagcatctggcatcctgggatgtaccctaaagttcactggctcagagcaccctaactatggctgcggcgaggggggagggcgggatcaggtcggcgtgctgcacatgggtcctggggcgggaacagtattctggctatgctcctgcagctgggccctcacaaggggcagcgtctgcaccctctcaaggctttgcagataagggtttattgaagagggaggtgacccacaccatccccactgagggatctggttagggggctccccccagaatgtaggcaagagggcagcatcttgatagtgagggttggtcacccgggaaccacagtaacgtctgcagggaccttcccccagtggcacgcacttcccagaatgctcacggtcaccctcagctttcaactgtggggacctaacgcgtctcc

SEQ ID NO: 206116 - DNA, 346 bp, Homo sapiens
aagggcttttaaacaacttcttcaggctaatctaagatactagcctcaacagtatttttgagaagcgagttttatatgcaaattgtattatggtttatattccatgtatatccaacaaggggaattagctgactgaggatgagaatagggaaaggcagggaatcaaaggacagtgggaagagagagggaaggacgaggatcctagaactcagtggtattgaagtccacagtagtgtttgtttctttccatgtatgctttttccactccaagtcacaatattaacaacaggattattttgacatattacatttctctttaggggaaaataaatggacatgcttatgg

SEQ ID NO: 206117 - DNA, 583 bp, Homo sapiens
agcctggggctgtgcccaccaactggccctccttcagccctcccctccacagtgcctactctccccagcagggcagcccttgagggctggctcctggcttcagccttccctctgctgcatatacctcacctgtctgcttacagggcatggctctgtagcaggccctgtgctcgtcctagtaaagcagtgatgaagcagactctattcctgctttcagggaccttctgggcaggtggacagaaccattagctgaatgaccacaaacagcatggtagctgttattttctattaataatagctaacatctatagaatttctgctctgtacctggccccactgtctcaagatgtacaggacactgtgggagccaagaagatgacgtctagaggaggtgacatttttagagctggatttaaaggatgggtttggacttcagctaatatacaaagagacttgagctttctatgaatttttgcccatttgatggatgaaaatgagattatcatttgatttgtgtttctgtgtaaggtcgtacatctttttgaatgtttacaggccatttgtatttctttttcactgaact

SEQ ID NO: 206118 - DNA, 273 bp, Homo sapiens
actcctgtcctccgtggcgcttgggtgacagcagagcagagccgatgtgcctgctcctggtcatgggctgttcgtgctgtcatcgctttcatttgccccatccccccaatttggacttacccagaatccttgggcaagctagatggctgccaaagtttacttagcgagatgtgcctgcgtgacttgagtagagacctgcttctgagaaagtcagaagtgcattccaaagtcaggagcgtgacctccccggaagcccagctaatccaggtttta

SEQ ID NO: 206119 - DNA, 492 bp, Homo sapiens
tcagttatggccatcaggtgacgtgtaaaatgtttgtccctgaaattcaagtggcccctgcaaagcgatactcctaagtttgccttttataggaccagaatgattgttaaaaccagaagccaaattcattaatttcttgctgtgatatataacatagccatacaatactacacatttagtaaatgtcagcagtattaatagaactgtctgtaatataattgagtaagatttctgtgtataaaactaaattatgatggatgagttactcaaaggatgaaggaaaataacctttaagtagtgtcaaaggctgggcggcactgggttgtatacagagaatgaggtactgagactgaagcactagtagctgggctaatgtgcaaagacaggagatatatgggctgatgggccaggcctctaggagaaccaggcaatgaaaggttaacatgtagctggaggtctgcaatgagtttagcagtccagagcagattgctt

SEQ ID NO: 206120 - DNA, 435 bp, Homo sapiens
atggccagaggtgaaatcctgacagcgagagttgctttgtaaattaacttatgagggatatagtggattaaaatgtctttattgcaccaattatgaaaaattataggcaaaatacagttaaaacaagcaaaatatttcagcaagaaataaagcacacagctttgcactcctaaaaaatctatatagtgtatagaagataggctataaagggctataaagtttagtttatgaccagggaggttgttcagaaggatgatagttgagaggaagctaacctttattgaacttctctctgggatcagaaactatactatgggctgggcgtggtggctcacacctgtaatcccagcactttgggaggccaaggtgggcggatcacctgaggtcaggagttcaagaccagcctggccaacatggtgaaaccccatctctact

SEQ ID NO: 206121 - DNA, 455 bp, Homo sapiens
aacaacccagatgtccttcagtgagtaggtagttaaacaaactatggtactttcagcactactcagcaacgaaaaggaacgggctaatgattcattctacaacctggacgaattatgctgagtgaaaaaaagccaatcccaaaagtttcagactgtatgattccatgtatgtaacatttttgaaatgacaaaaatcatagaaatggtgaacagattagtggtttccaggaggtcaggaaggtggggagtggggagtgcaagggagggaagtggatatggctataaaaaggcaacacaagggatttgtttgatggcaatattctgtatcttgtctctatcaatggcaacatcttgtgccatacttttgcaagatagcacccttgggggaaactggataaaggggacatagtatctctcaggattgtgtcttccaactgcatatgaaaatacagtta

SEQ ID NO: 206122 - DNA, 475 bp, Homo sapiens
aacatcatggtctggattcaagttacagcattcatggtaatgctcagaaagataataacatactccaagattccactgaaatagtggttgctatttttttttttagaaaatagcttgggactctggtgataatgcaaaatgggcttgctccttccaagacaatctcctcatgaaaccatttgtcaaaaattagtgttctgggactgggcacagtggctcatgcctttaatcccagcacttagggaggccgagacaggaggattgcttgagcccaggagttcaacaacagcctgggaaacatagtgagactctgtctctacaaaaaattttaaaaattgactgggtgtggtggcatgcacctgaggtcctagctactgaaaagggtgaggtgggaggatcctcgagcccaggaagttgaggctgcagcaagccatgatcatgctgtagcctgggtaatacagccagactctatctc

SEQ ID NO: 206123 - DNA, 321 bp, Homo sapiens
gtctttcttgtcttagggcctgaagggtaccaagcatggacttgtcctgcgacatatacacaggcatggaccacagtgggcctggagggttggggtcacagctggtgtgccaggaatggcccatgggacacagggtaatttattttcctgtttgtttgcataggtgagtgttatcacatgaatgttacctgccatccttagttgtgggtatattttggaactggggttggaggctgcttcagtactgaggagtcaatcgggatgcttcacttctccaaagagatggctgttctaatcaagatattacttaggtggcctgga

SEQ ID NO: 206124 - DNA, 533 bp, Homo sapiens
gaaggagacgttgccttggaatgtaggggatttgagctgcagaggaaagagaagacacattaattgcctagtaaacccttcctcaaggacagcaggaacgcaatagattcttacaaaatgaaataccatgtctcaatagtccccagtgtccattctcttgcttgtctttacgtaacaattagtgattcagctgtttggtggtctcttcacacggacgcgcatgaaatttggtgccttgactcggaacaggggacctcccttgggagatcaatcccccatcctcctgctctttgctctgtgagaaagatccacctacgacctcaggtcctcagaccaaccagcccaaggaacatctcaccaatttcaaatccggtaagcggcctcatcttactctcttctccaacctctctcactgtccctcaaccactttctcctttccactcttcaatctctcccttctcttaatttcaattcctttcattttctgggagagacaaaggagacacgttttattcatagacccaaaactccgg

SEQ ID NO: 206125 - DNA, 449 bp, Homo sapiens
aaagactcacgaggagttagacttaagaaagagacatctcagcaaatactcgcaataaaatgtgccttaaattctatatcagagatctggccaaagtgctgtgggcatcccagcagaaagccagtaattatatctgggttgcctaaaacagaaaactatgaggacgctgatgaagtagttaaattgtggaagagaacaattacaaaacagtatgtacatggccaggtgcagtggcgtgcacctgtagtcccaactacttgggaggctgagctctacagtaatgcttctcaaactttcagcaacacctaaagacatagattctggggtgagaccgagagtctccactggtaacaagtgctaagtgatactgatgctgctggcccacggagcaagcctggaattgcaatctaaatgtaggcattgtgacgggatcaacttgcaaccatcgt

SEQ ID NO: 206126 - DNA, 226 bp, Homo sapiens
taatcagagctgaactatgtggatggtttcggtgaatatttcattcaggcagggtgaatccttgccaattaatctcaccccgtacttggtatctccctggcagataccacacttatgcctgccacattgtctcttcctgggtagattgccagcttctggctcttgagccccgttcttatctttcacatagaacgtcccctttctgttcacataattcagcgtctga

SEQ ID NO: 206127 - DNA, 653 bp, Homo sapiens
ctgaggaagctgagggacctgggtttcagggctcagtgcagagatcaccccaggaggtgggctgctttccccccagggggctaggacctgagatcgtgtcacctgccctccgtacagccctgcacctgcatctgtgccgtggagtgtgttgatgggtgggcaggcgctgctctttcccctgacctgcagccccacagctagccctctttctcatgccagccttccgtgtcctggccctgctgctggagctgcacatgccaggctctgcctaaatgcagatgactccaccaacttttgctccactcctcacccccagaactgttgttgttgttgtttaccaactatgaaggacccaccacaggtagagaaccgagtactttgcacacttggagcccctgctttcaagacctccacagcctacttatctaatagtcattgcatgaattcctacatatgtacatgtataaacatgaaagcaatggcgaaaatgcatttccaatcatacatatgcctaattgtgcacgctcaccgcaggatagacacaaacgcctccaatgggcacacgtatgtcaccaagacctccccgcaggaccctgcttggctactctgagagcggctctcatggcctggaaagaagcccacattgacacagg

SEQ ID NO: 206128 - DNA, 395 bp, Homo sapiens
aagttcggcacgacgtggacacacgaatcccatcctgtgtgccagacactcttctaagctctttacctgtttgaacacacttgatcctcaccctgagcttacaggtaagggatagtattgtcctcattctgcagaggaggacacaagagaacatgcttgattcctgcatgcacagagggctgtgcagcctctggcaaaagggcagcccaggattgggctacttgacataagaacagtgacactgtttgcctcagaccctgggaatgacagaggcccctgtatatacactttcttcacttggatttacttggattttgcctctagcaggatctggttgtttctgaagctgcaaaatctaaaccgttgcaaaacaacaaaagacgaaaaaaaaaaaa

SEQ ID NO: 206129 - DNA, 133 bp, Homo sapiens
taaaagcactgagaagcatagaatgcaaatttagaaaagagcttaagagacatatcagacatggtaaaaggtttaacacacatataatcaaattttcctagctctgttcacggaaagggcctgggagctgcaa

SEQ ID NO: 206130 - DNA, 554 bp, Homo sapiens
attcagtaaatgttttatggtcaagcttcccttactctttttcttaactccatctatcctttccatactattgaaagagaaaacaagagggaaggctgtactggaaacctacctcagcttctaaatgcctcagatgaaatatacaggttatgtggcagtagaacatgggcaaaacttcttgtagtgagtgaggactgggatttggtcaggaggattttgcttgagggtgaagagggatgggacagaaaccgttagttaaacaccttagatctgtcagaagaccctggaggatttacttggggcttgtttcctgacaccgttatcatcagcctctatttttatttcctggttatcttaatctattttctttaattttctgtttctaattactaacattattttagctgaaattttattgactatcaagaacatgtcacttggaatcatgtagctgatgtatgcatattggataaagaaaacccacttataaattaaatgaaagaaatggtgtttcttgctctcaacaaagttcttcaataaatctgtacaacaaa

SEQ ID NO: 206131 - DNA, 465 bp, Homo sapiens
ccaaagacttttgtccgcaagtttccaggacagtttgtttatggtcagagtcttagagaagggaatgaactgcagggtccacttacaaaatttacaatttgagaaaccctagttgcctcagcatcagttatgcctctttgcacctgaactgggaccaaatgaacagaagcaacagtgaatgagtgttgaagagggtgtgggatatgatgaggtttctcttcaaataacctgatcaatcttttatcctttagttcttggtacccccctccctccttttttcccttttctccttttttttcttcctgcctttgttagatgcccaggcacgccgcgataccaggcattatcaataccggctcacattcctttccttattaaaaaaaacaacaactaactttctagctaattaacagacaccccttcccctttcctctctgctttcttttacgtgcccaccttatctta

SEQ ID NO: 206132 - DNA, 395 bp, Homo sapiens
ttcctcagtaaggacagacttaacagaattacaatgtttcctttgcaaaagatgagtgttaaaagggaacatgcagaaaaatgatggcttacatgggatgaataaagacttagcatgagccatcgtgtccagccggcctctcttttagaagactctgtcccattgtcctttaagggcatgtcacttccctggaggtcaaaatcatgtcatactagtttttgcaatccacagctccttgcacaattcctggcccagggagtgggtacatcatcaatgtgtgaggaacagactgccatgaaatagtgtaaaaaatccacatagtacacttgtgagaaaagagataagaaccagaattttccaagcaaagggatagagagctacaaggtggaattcag

SEQ ID NO: 206133 - DNA, 230 bp, Homo sapiens
gtgcagaagagcaggaggctgagctgaacctatgccagcccaagaccaggccagactctgctgtccttgtgagggaataggggttcctgattttgtagcttttcacaaaatggaagagacagaaaacaagttccagatcttgaaccttccccatgtgtttgaaggcagtcaagggtttcctgattttacattcaagatacttacactcagggccgggcatggtggctcac

SEQ ID NO: 206134 - DNA, 453 bp, Homo sapiens
cccagcatcaatcaatactcctcccatttggctcatgtatgaaggctcttaaattgggagtttgcaaaaatggccccaatttgccctccaaatattccttgcagattaaagtactcccaccagaacaccgagccatggtgtggactgcttgtgcaattaaggggatgcagagatgaagttggaagcactttctgtgttatctgtctttatgttttgctggtgaagttgggagaccactttcacccctcaccagattgtatcctcaccccatctgaccttatttctgctcacaatctatgtccccgaatgaaatccaagatgatggacaagatcttcctcatgacatgaagcatctgctcagctggagactgaatttgatgtaaattcaaggggccatgcacacaggtctgtgagtgtcactttctggtttggactcaggtcaataaaacactg

SEQ ID NO: 206135 - DNA, 343 bp, Homo sapiens
agttggaaatagaagaatgagaaaaatctataatcaggccaaacttgagaactttcctgtgcttcagcactgtaattctgctgacctaatgttctcaaaagaggcacttttactttctattgtgcatgtatgattgttgttttttgcttttgagggggcttttgtgtttgtaataatgaagcagaagaaaagtgcagtagtagataaatgatcacaacatgttatgcaattttattttataaaattttaaggggaaaagtttaactctttgtaaatcatttcttagctctggtaaaatgcttatattactcctctaaaacatgctcaattcaggcctttgtct

SEQ ID NO: 206136 - DNA, 499 bp, Homo sapiens
agtgtggtttgaactcctgggttcaaggaatcctcctacctcagcctcacaaagtgctgagcttacacgtgtaactcatagtgaatgaataaacaaaatgtagtctgtatatacaatggaatattattcagccttcaaaaggaatgaggtcctcttacatcctacgatgtggatgaatcttgaaggcattatgctaaatgagagaagcatgacacataaggactaatgctgtatgattccactcatgtgaaatgataatatatttataataggtctatccaaagagacagaaagctgactagtggtgccagacagtgggaggcaagaggaatgaggagttacagtttagtgggtatggagtttcctttggaaattaaaatattttgaagctagatagaggcaatggttgcatagcattgtgactttattaagtaccactgaattgttaactttaaaatgattaatattatgctatgtaaattttaactcaataaaagag

SEQ ID NO: 206137 - DNA, 387 bp, Homo sapiens
aagttgcttcatgtagtgcttgctaaggagtgactatatcaaaggctcacaccactggggaaaaatggttacacatatctccgagggtaaaagtgttaaatactgaggttactgctagttttatgatgaaaagacctcaacagaaagctacttttctattatctctcttgacttttattcaaacacaaaaaacatttgagatggaaaataatgcatgcaaatagtagtatgatttctgtcctattgaaggtcttgaaggtctctaatgatctaattgccaagttcagctgttaccaagttcaacttttgctcagtcttcattctccttgacctctttacagctttacactatttacactgcctcattcctagaactcttctcgaggc

SEQ ID NO: 206138 - DNA, 238 bp, Homo sapiens
taaactaacacttaccaatgtgagaaatcaagatttatggggaaatcaaaccaaaagcaagactgaaaaaatattcactatctattcttactctctcaatatcatagttgtaatcaagagccaataagtcagtctggttactcattcctacagcttctgatttcctttttttcctctggggactttccttggcctgcagccgcgctggcgcccaggccagacaggtgcagcgtagaat

SEQ ID NO: 206139 - DNA, 344 bp, Homo sapiens
ctgctgagaagaaaattaaaaagtatatccagaatttactctgcacagtcttctgatgcggaaatcttaggcatttaacattcttaggttttgtgtttcttagagtacattgtggcagaaatttgttaggaaaggtaaaaacgtgcaattacacgtggaataacttggtgaagcagaggtgagatactaacccactgccatttaacactgcagagattattttatagtggtggtgggagaaggtcctgtggctgagtgctcacaggtaatgtttttgaaggatattttgaaaacagtgtaaatttttgtttgagaacaaacaataaaatctttttcaagtgaaa

SEQ ID NO: 206140 - DNA, 304 bp, Homo sapiens
gtagagacaggatctcactacgttgcctttaagtcaaaaatttgtctaatatgagtatggctacccctactctttattcattattatctgcatggaatatctttttccatcttttggctgtcagcctgtgtgtgtccttaaatctaaggtgtacacatgataaaattggagcttttttttttaattattcattcagccactcagtgtgctttgatttgggagtttagtccatttacatttaaagtaattactaataggaaaggacttatattgccttttttgttgaatattttctctccgtgtt

SEQ ID NO: 206141 - DNA, 992 bp, Homo sapiens
  misc_feature (652)..(652): n is a, c, g, or t
  misc_feature (664)..(664): n is a, c, g, or t
  misc_feature (713)..(713): n is a, c, g, or t
  misc_feature (716)..(716): n is a, c, g, or t
  misc_feature (733)..(733): n is a, c, g, or t
  misc_feature (736)..(736): n is a, c, g, or t
  misc_feature (738)..(738): n is a, c, g, or t
  misc_feature (744)..(744): n is a, c, g, or t
  misc_feature (751)..(751): n is a, c, g, or t
caaaccacaaagacattggaacactatacctattattcggcgcatgagctggagtcctaggcacagctctaagcctccttattcgagccgagctgggccagccaggcaaccttctaggtaacgaccacatctacaacgttatcgtcacagcccatgcatttgtaataatcttcttcatagtaatacccatcataatcggaggctttggcaactgactagttcccctaataatcggtgcccccgatatggcgtttccccgcataaacaacataagcttctgactcttacctccctctctcctactcctgctcgcatctgctatagtggaggccggagcaggaacaggttgaacagtctaccctcccttagcagggaactactcccaccctggagcctccgtagacctaaccatcttctccttacacctagcaggtgtctcctctatcttaggggccatcaatttcatcacaacaattatcaatataaaaccccctgccataacccaataccaaacgcccctcttcgtctgatccgtcctaatcacagcagtcctacttctcctatctctcccagtcctagctgctggcatcactatactactaacagaccgcaacctcaacacaccttcttcgaccccgccggaggaggagancccattctatancaacaactattctgatttttcggtcacctgaagttatattcttatctancangttggaataattccaantgnantactantcggaanaaagaccactggatacaagggacgggccggcgcacgacaaccaggcgcgcacagggataacgagcgagcacaccacacttctccgcaggaaagcacaaccacaacatcatcacccggaacagaaaagcaacaacgcgcaaaataaggacgcccccaggagccaaagagtcgtcgagaaaaagacaaaacacgagagagagatacaaaaaaccacaaacggaccagcacagaaagagcagac

SEQ ID NO: 206142 - DNA, 638 bp, Homo sapiens
  misc_feature (298)..(298): n is a, c, g, or t
  misc_feature (310)..(310): n is a, c, g, or t
  misc_feature (359)..(359): n is a, c, g, or t
  misc_feature (362)..(362): n is a, c, g, or t
  misc_feature (379)..(379): n is a, c, g, or t
  misc_feature (382)..(382): n is a, c, g, or t
  misc_feature (384)..(384): n is a, c, g, or t
  misc_feature (390)..(390): n is a, c, g, or t
  misc_feature (397)..(397): n is a, c, g, or t
ggctctagaggacccccgctcactcggcaaatccgtcctaatcacagcagtcctacttctcctatctctcccagtcctagctgctggcatcactatactactaacagaccgcaacctcaacaccaccttcttcgacccctgccataacccaataccaaacgcccctcttcgtctgatccgtcctaatcacagcagtcctacttctcctatctctcccagtcctagctgctggcatcactatactactaacagaccgcaacctcaacacaccttcttcgaccccgccggaggaggagancccattctatancaacaactattctgatttttcggtcacctgaagttatattcttatctancangttggaataattccaantgnantactantcggaanaaagaccactggatacaagggacgggccggcgcacgacaaccaggcgcgcacagggataacgagcgagcacaccacacttctccgcaggaaagcacaaccacaacatcatcacccggaacagaaaagcaacaacgcgcaaaataaggacgcccccaggagccaaagagtcgtcgagaaaaagacaaaacacgagagagagatacaaaaaaccacaaacggaccagcacagaaagagcagac

SEQ ID NO: 206143 - DNA, 331 bp, Homo sapiens
agctgaaagctgacacgcataattatttcctgttagatactgaagaaaaaaaaaagcccaggagatattgtcgagactgtttctggggtgtgattgggggataggagatgaccatccagacccacaggaaatgggcattcttgctgaaagtcatgaaagcaactgattatctgctaagtggaactccagggagcatgttcatccttacatcttacagaggaggcgactttgccatccaattagtcctattaccttctcactggatcacaaaggcatttatgggaataagtcattttttaaaggaagagagaagtgcatttaacatgaatag

SEQ ID NO: 206144 - DNA, 485 bp, Homo sapiens
gtagtagatagagacaagttgctagcaggctggtaaagaagcattgtaaatatgctggtttttaactgtgttggtaaatactgagtggaagacagttccgaagatacagataccaaatagatgtttctgagcttagtggtcttttttatctggtgtcattttgttgatatggtataacaaatattgtggaattaaaattcaatggagaagctttgggcaaattaccttatttaaacatgttttataagttaagttctatatatacagagatgtttgtcactttctcagtcaggtactgtaaaacaagtactaggctataaataacatcattacagaaaaacacactgtattctggttgtacaaattaagtgaatgtcatcttactttgaaacatggctccacaattacccccttgtgcattttccccatgtatattgtgtaaagaacattaagaaaatttcttgtataattttctttctgccact

SEQ ID NO: 206145 - DNA, 527 bp, Homo sapiens
ctgggcttcacttcttactccaaccactcactagtttccaaaaccttgtaaaagttcttaacctctctcagattcaatatttgatcaataaaatagaggtaatatcagtctctgggttgttatccgaattaaataatgtatgttaaaagctcaaccctttgaaaacatatataataaatgacaaaggagaaaaaggaaaactctgaaagtggtttatatattcaggatatctttacaataatttgctgacttgggagtttaaccattagtagaattagctcagtggagttaagtggtacaaacataggctttaggatcataaatgtgccactcataagttgactaactctaggcaagttacttatcttctcgcagtttacttcctcatagaaaattagctaatatctttttcctctagcaaaaagaaaacaaaatctagataatatttaccttatgacagtggtttttcacgctatgttcctaatccttagagttcaaaaaaatgaagcaaaagtccatgaagacat

SEQ ID NO: 206146 - DNA, 220 bp, Homo sapiens
tgacttactcatcaaacacttataaacttatgtttacaaagtataatgctaaatactgtagaatttacaaacatgtcttatcttgaagggacttataattcacatggtaaataaaacaatctgaggtagtcttttttaaagtccctgttgtaaatattaaaatacttatttttactttggatagtttatatgttatctctaagtctaataaaactgcgta

SEQ ID NO: 206147 - DNA, 287 bp, Homo sapiens
gacagccctaactatgtgcaatgacctgtgagcatgcttcttggtcagaccagaatgcaaaagggatctaagtttaagccagagaggaatagggtaatacaggagagagatttttccaggagcaggaacctgaagaacatcagacaaaggagaaaagaaacagcctttagattagtgtcccatgaccagaagcccagctaggaaagagtttcccctcttggtggaccagggaccaggcaggaccttcagggtagagctatctagtcagtcacatatcagagatctgg

SEQ ID NO: 206148 - DNA, 429 bp, Homo sapiens
ttctacctttgcttcctttactttatccagataatcttgcctcatggttctcatactgaaaatgtgggggccatccagagtgagcttactgtctcttctgttcatctcagaatttctcaggattgaattttgtttacttttgataagataaagagttacatgtattcttaaacttagcaccatttgcccctgttgttgatcctacctttttttttttaaatttcctgaccttctttagtacataattgttacagcgtcttttatcttctcatgctagaccttttcctttgtttctcaaccataattaggtctcccttattcttaatgtagctgcatagttttctaaatcactataactatatattgtttgagtgtgtgtgtatgtgtatgtgtgttgcactgggctatacaccttacaaatgtttcatt

SEQ ID NO: 206149 - DNA, 403 bp, Homo sapiens
ctacagggctcacagctcagacctgcctctgcctgggagtgacacggtcccctctgctcacgtgccatggatcagagctgccatgtggcccagcttagggagaccaagaagcatgggagactccccggctatttgacgagcaggacctgtccatgccatctcccatctgtgccctgcatctgcgacttccaaagagcattggcctgcactgtcctatgaaatgctaccacaagccctttctggcaagtgcagttaatcctgttcggtgggttaggaaaccaaggctctgagggaggctttcagtgccacagctgggaggtgagagttgtgagttgcagatgtctcagccatcccgagcgtgaccattctgagtggcgggaagcttttcactcagcactgagta

SEQ ID NO: 206150 - DNA, 557 bp, Homo sapiens
gtctctgcacacgtgatgcggggctcggtcacgttgccccctggaagcttgaggatgcgccaggtttgactctgcagggcgtacgcgctttagggatggaaggaagaggaacgcggcaggaaggcgagccccaaggtggagaatcgcctgggcgcgcaggctgcggcggcttcgcacagccgccctgggcgctgcacgggtccgcgcgcaccctgctgcgcacccactcgcggccagctccctacagaggagtggagtgactgctcgactaccacccctcttttagtgtgagcgtctggagtcctgaccgccccagccagcccagctacgatgaactgtctaagaggatgtggcaagacccagaagtatgggtgaccttatgtcagaggaagtggctttcttattgcagcaaaaattcccgtaccaatgtcagtgctagggtaatgtaactaaacttttatttatttttattctgccctcccctttctgtttgttatgaaccataaaatattcaacacaattatcttgaaatctaaatataaaatttaaaacataaa

SEQ ID NO: 206151 - DNA, 751 bp, Homo sapiens
gtctctgcacacgtgatgcggggctcggtcacgttgccccctggaagcttgaggatgcgccaggtttgactctgcagggcgtacgcgctttagggatggaaggaagaggaacgcggcaggaaggcgagccccaaggtggagaatcgcctgggcgcgcaggctgcggcggcttcgcacagccgccctgggcgctgcacgggtccgcgcgcaccctgctgcgcacccactcgcggccagctccctacagaggagtggagtgactgctcgactaccacccctcttttagtgtgagcgtctggagtcctgaccgccccagccagcccagctacgatgaactgtctaagaggatgtggcaagacccagaagtatgggtgaccttatgtcagaggaagtggctttcttattgcagcaaaaattcccgtaccaatgtcagtgctaggatggagtttcactgtgtcacccaggctggagtgcagtggcacgatctcagctcaatgcaacctctgtctcctgggttcaagcaaatctcctgcctcagcctcttgagtagcctgagtagctgggactaaagatgctgcagttagctgggggtccactctacaccctggttgcctcagtttttcctgtacttggaggtatcagcagtgaatgctatgaaacagcaaagatggcagcctgccccttcccctggaagctccatcccagggcggtactgtcctgttgccagcatgagcacacagtatgtaggggg

SEQ ID NO: 206152 - DNA, 370 bp, Homo sapiens
gaaacgggctttagtggtatctgtgacattttattcccccccaaaaaaagcatgcacagtctgatgaaaatggggcaaaatgttaacatctgtttaatctcatagtgtgtgactttcttgtatttctaaaatacttcctaatttaaaataaaattttaaagagattacaagtgaccaaataaaccaagaaccacatacttgtatggtgttcaaaacaaaatcactaaaatctagagaactaatctcagttaacaacaaaagccatccgaaggctcagttatttcccactgactcacatacagattagagtaagatttacttcacaacaagagcaggctcatttatgtggcaaagttccgttgaagcttca

SEQ ID NO: 206153 - DNA, 747 bp, Homo sapiens
tgtcacttgctggcaggccttcacttcagatctgacctgaaacaacacacagaacctctcctttggcttagatcccatgtgaggcttcctggcatgttcggataaatggatggcttggatcgaggctgctcctgacttcaagttgtagaccagcctcctggcctggtctcctcagctctggaggctggcctggaagctccagatgattccaggagcacagcctgctccatgaccgtcctcaggcgccagctcctgctcctcctgtctcatccgggggcggtgaattccccatattcatgggttatgactgggctcagactgttccttctgctcagagggcctgtcccggtctcccacttttccatgttgtgaaccatggtgaaaatgttgagaattccttcccatacttcccaggagcttcattcctccttcatctgggttctggaagtaatttattctcaaccatggttcctcctgtttgttgggtgccctttatgtacaaggcatttgacaagcacagtctcaacccacccaacaaccctattcaaccctatttattacagactctaatcggtgaggaaactcaactaccttgctctgggcttagccagtaaatagtggaatttggattgaaacacttttcctcttttacctcttacagcacgtcgcacattgtgtcagtctgccgacttcatttctgtcttccacactagactaggaactcttacgtgtcttatctgttgatga

SEQ ID NO: 206154 - DNA, 372 bp, Homo sapiens
cacaggcatttatgtgtgcacatcaaacccactaactcataccatgccaacaactgactagactttcattaatccaggatagactaggcctgtgctaagcattttagatggtttctttcaattaattctctcaacaaccctatcaaataggatcccttgtacatgaggaaacaggacagcagaaattctgaaatctgtcccaaatcacagttagtaagaggcagagtcttcaagtgaatgtaggttcactaagcttcagaagttaagcccccaaatactatactatcacctttcatgacaaaaaccgcaatcacttttgcaccaacctaatacaatggcagtcaagctaataacatctctcctcagtgacca

SEQ ID NO: 206155 - DNA, 347 bp, Homo sapiens
tgtcacctcgggccttcgtggtatataactagccaaagctggagtacaatggcgtgatcttggcacactgcaacctccacctcctgggttcaagtgattttcatgccttagcctccccagtagctgggattataggcacgtaccaccacacctggctaaatttctatatttttagtagagacagggtttcaacatgacctcaattgatctgcctgacttggcctaccaaagtgctgggattacaggcgtaagccactgcactcagcctcataaagaatgattaaacctctgtcctctaaaacaaatttttaaaaaggaatgcatcatatgtagaatactttagttat

SEQ ID NO: 206156 - DNA, 299 bp, Homo sapiens
gctgtgttctctccattcttcagtagaactacgaagcacacacgtttcattgagtcacaggagaagcacccaccatcatgagtaaagccctgtgcggacacagtgggttaaaaacagatatgacatggcctcttcccatggaggccacatctgggagttggaggagagacatacacttataaccacaggtagcatttacaaaagcgacatgaactagatgctgtgagaacagaaggcctgagatggtaaaatttggccaagggagctgagaaatgcttctatgttgaaatgacacttgg

SEQ ID NO: 206157 - DNA, 587 bp, Homo sapiens
catgaaatttgagcctaatgcaataaaggatgcccataaaattcttatctaaagaatgtttcgaaaattgttgtacaaggacatcatcatttaaagtgatatgaagaaaccttctcagctaagcatatgggctagattagagagaaaaataaaggacccatctctgccctggaaaaactgctggtagcatctttcaaaaagctctctgtgtttgagtacgcaccttgatccataggctcacatttgatcccaactggcagctgcttcttggcattaacattggattcccaacaagtaaatcttaccaagatctgactttctgcagatataatattattttgtttgaccatccttatcttcaagggctaccaagaaggaaccaagaatttatttacctccccaagggaaaaggttttaccaatgagacactttctcaccatgaccccaggaccccatatgccctgttcacttgagtgccctgtgtggcctgacagaagctcatgctggtcacaggattccttatatgactagcctccttcctgaatcccaatttcatggtggtggtcatgacaggtgtcctgtatccc

SEQ ID NO: 206158 - DNA, 475 bp, Homo sapiens
agagttcatagtcttcacttgacttccaaagggactcagaaaaggttaggaacaactgatttaggcagagggtaaagatacaaaagaaagtgggtcataatattaggatttggaaaactccaacagttagaggtctagcagaagacaggttagcaaataagactgacagacagcagccgtgggtgagaggggaagcagaacactattgcagtacagaaattaagagaagaacgcatctgaagatgtagaatcatcacttgttatcaatgcttttgggaggttgaagagggtgataatctctcttgacctagacatagattccatggaatggtgatttccatgaggccaaattgagggagttgagtgggaggtgaaggagtagagacaatccaattaaaaacttttgcttataatgggagcagaggaatggggctgttcctagagggagatacgtgatcaagacatggtttttata

SEQ ID NO: 206159 - DNA, 218 bp, Homo sapiens
gtccatgggaaacccactccccggacccaaccacctcccaccaggccccacctccaacactggggattacaattccacatgagattttggtggcgaaacagatccaaatcatattacatgataatgtgatagaagataaataggtagtacaattagaaaagatggtcagaaaaggcctctccaaagagcctacatttgggctaagacttgaatccccc

SEQ ID NO: 206160 - DNA, 412 bp, Homo sapiens
cagctggcccgcaagcgctgcaggcagccccggttcccgctcccgcctctccctccacacctccctgcaagctgagggagtgggctctggccttggccagcccagaaaggggctcccacagtgcagcggtgggctgaagggctcctcaagtgccaccaaagtgggagcccaggcagaggaggcggtgagagcgagccagggctgtgaggactgccagcacgctgtcacctctcattatgatttcatcccctccctgcttcatagatgccttgagatagaggttaggcaccccaaatctgaaaatctgaaatcctccaaaatctaaaactttttgagcactgacatgacactcaaaagtagtgcacgttgtgcacatgtaccctagaacttaaaagtataattaaaaaaaaaa

SEQ ID NO: 206161 - DNA, 621 bp, Homo sapiens
aagaattctaggttggaaattcttttcccttagaattctgaagccctggctccgctgtcttccagctcctcgtattattagcaagtaagctgccattctgagagttatccctttgtgtaggacctgttttatttttttttcccccaggagcttttaggatgttttatccttactgttatgaaatgtaataattaggtttcttggtatgtggatcaattaattgttctggacacctggtaggttcttctaatccaatacccacgtccttcagttctggggggaaattcttttactcttatttttcatttctttgtctttttactatgctttctgggagagtttgtcttttttatctttgaatcctctattgagtttttcatttttgacatttccagagttcttttttttcgtgaatcttcttttttacagcattctctttatgtttcattatacagaaactcttctctttctttttttattttattttattttattattattatactttaagttttagggtacatgtgcacaatgtgcaggttagttacatatgtatacatgtgccatgctggtgtgctgcacccattaactcgtcatttagcgttaggtatatctcctaat

SEQ ID NO: 206162 - DNA, 295 bp, Homo sapiens
gaacttttgtttggaactttatttttgataactacagagaattaagaaataaaaaatatctttttcttctgtatatggaaatcttttggaaacacaacagtctgattaatagcttaaagttttgatagtattaaaatttgttttacagaacataaagcctacattttttttaaacacacccacctttaagtatacagttatttgaaaaatggcaactgcacatggtcttgtaaccaacatcacaaacaaaatataaaacagttccatcaccataaagttttcttatgcccatctg

SEQ ID NO: 206163 - DNA, 422 bp, Homo sapiens
agggaataagagaacaaagaactaaataaaggaaaaatcttgacagtattttagttataaattagggtgaccatataatttatcatcgaaactggaacatatcaagatagagaatggccattaataattatgttgtaggcctggcgcagtggctcacgcctgtaatcccagcactttgggaggccgaggcgggcggatcatgaggtcaggagattgagaccatcctggcttacacattgaaacctgtctctactaaaaatacaaaaaattagccaggcgtggtggcgggtgcctgtagtcccagctcctcgggaggctgaggcaggagaatggcgtgaacctgggaggtggagcttgctgtgagccgagatcgcgccactgcactccagcctgggcgacagagcgagactccgtctcaaaaa

SEQ ID NO: 206164 - DNA, 408 bp, Homo sapiens
actctctcatcgctgtgcgggccggttcattttccctgcaaaaccaggacagtcattgaattggcctcttgtacaaagtactgatatttatacaactttttatgcatgtgaaaatgaagtttccgaatgaaagtgactatcaaattcatggaaacagtgaatagcagaccccggatttgaaactacatgtactaacatgaaacccaatgttgtttctaccgcagtacagttgactcgcaaatcatcctccctccatcacagatgccaaggacagaaatctgctaccaaaacattttctccgaaatcccttatatgtgtattaatggtttatcgctcccacttgaataccaatatacaaattgacattttttgtttgttttttaaagttaacatatgtttctctccttg

SEQ ID NO: 206165 - DNA, 675 bp, Homo sapiens
cagacaagacactctgagccccggtcaacacacctactccttccttgttcctcttctcgattagatgtacctataatagcctctttgttgtgatcaactttcccaagccactccttcctctctattccagggactctcaaggggtggagaggttgaaaaaacattcaacggtatattttatatttagaggaaaaaagaacaaactccaagtagggaagaggaactggatttttatttttatcgaaagaggggatacaccagttcaaagctgaggaaaaccttggagactggttcccttatcatgtcctcatgatagaagaaaaaacagacattcagaaaagctagacaatttgcccaaggtcacaaaacagatataggcttcaaatgcaggcctgtctgactccagaacaatctttcatcatggaatgaaaagttctaaggcagaggtacccaatacaagtttttgcagtgatagcaacattgtctgtctgcattgtctaaatatggtgagtacaactgagggacaaatatctaattttaatgaatttctacttaaattgccacatgtggctgtggctggcagagctaccttagtggacagcgtcattctagaatttcactaagttggttctatatcactaccaaaagcaggacccagacaggtgcagcgtagat

SEQ ID NO: 206166 - DNA, 470 bp, Homo sapiens
gatgctccatagtaagacataaatattcctgttgaagttagtttgtaacttcaagtcagaaatggaatatatcaatggtgaaacagtaacattgatttttcatgtggagaggacattttttttccaggctgcgaagctgaattctgccgaatttaaagagaaatgctggttattttctaattatattcagttttgtttgtcttatgtgtattccaacaatgtgtgcatcacagctcttctttttctgtgttatggctacagttttcttgctgttgtctttatgccatgtcatttcacatggtaatttagtaagttttgatgagaaatttgatatttttagtgcactgaaaaattggttttaattggtgagtttgcttaccaatataactgtcagattgttaagataaaaggcatacgctgtccacaggtgagaggattaaatcacttagcattgtttttaactgtttgta

SEQ ID NO: 206167 - DNA, 422 bp, Homo sapiens
ttacctcctttagagaagccccttccctttccaggtctttttctgatcctgaagagtttagctgagagtctggtaccttttaaaggtatgaataggaagcatttgccatctattgcctctaaggatggccacctataagacttcatctacataataagaccgttggtctccaacaacaccccttatctttgcccagacactcctttctattgattccaggttttttagataataacttaaacccttcaaccaattgccaatcagaaaaatctttgaatccacctatgacctgtaagtctcctgcttcgcttatggtgctgctatctggagtaatagctttcatggtgaacttatcaatttattggatcattgggaacacttcacctgtcactcaagaaatgacgtcattggccgggtgccat

SEQ ID NO: 206168 - DNA, 399 bp, Homo sapiens
aatagcttgtgtttacagagtaagtcagctgtggacccgtcaactacttcttttatttacttagcaaactggtattgagcgcaacctagatgcacacagttcatatataaataaaagatctagctgggcacggtagctcatgcctgtagtcccagcactttgggaggccgaggcaggcggatcacaaggtcaggagttcgagaccaaccaggccaatgtggtgaaaccctgtctctactaaaaatacaaaaattagcagacgtggtggtgggcacttgtagtcccagctcctcgggaggctgaggcaggagaatcgctttaacccaggaggtggaggttgcattgagccaagatcgcaccactgcactcctgcctgggcgatagaacaagactgtctca

SEQ ID NO: 206169 - DNA, 558 bp, Homo sapiens
gcaatggaatttaataaatgttgtggatgattacagacatacgagatcaatgccctgttctctctgcctgcgtttgtcaagggagtaaggtgaagttgatgatccctggcacgtatgccttgtggagcaatgccattgtggataccctcatctaaatagtgatttcctcctggggctctactcactcaccaataggatttggggtgctcaggaaaccctgtttgaaacatagttcttcctcatctattaccttgtaatgtgtgaaaagtattagtctatttctgtcttcttttcctggtaaagagggatacttttatccttttgaatcagatactaactaaattgaaaagagcacattgtattcagaaaactagactgttagcaggaccgtatttttaatcgtgataaactgcatcacgatgaaaaggattaaacaggatcagatcatcagaaactaaaaatgtcaactaattgagttttcattttaggcttctgagtcaaagatttcttggaatatttagcaacatataattaaaggagatactatctaaactttta

SEQ ID NO: 206170 - DNA, 336 bp, Homo sapiens
agattctagatattagcctttgtcagatgtatagattatgaagattttctcccactttgtgggttgtctgttcactctgctgattgttgaataagatgtcctttccccactttatgtttttgctttgagaaattgttgacagttttaaaatcataatgagaaactaaaattggagttaagagttcaccaatgtgctttttccaaattatgaattgttcaaaaagtttccattttccacctgttgagatcttcattttgaggtttttattttctactgtgtctaatctacatcccacttttccaggtgagtatagagggctttttaaaatcaattag

SEQ ID NO: 206171 - DNA, 360 bp, Homo sapiens
tagacgatccccttcgcggtatcataatcaacagagaacaccttaaaacttctccactaagatcagctacaaggcagggatgtccactctcaccagttctatttgttcaacacagtactagaagtactatcaaggacaatcaaacaaatttggattgcaaccaaatcagaaagaaaaatactctgtttgaagacaacatgatcttatatataggaaaccctaaagactacattacttaagtgctaactttgcaggatacaaaatcaacatacaaaaatcagatacatttctataaacaaataatgacctaactgaaaaagaaactttaaaagaaataatttcatttatgataccgcgaaa

SEQ ID NO: 206172 - DNA, 157 bp, Homo sapiens
aaaaaaagggtccctaaggtgctcttctcagtgtcaaagtatatgtgaaactctgccttgtactgatatttagaaatggtaagatcattttactttttatgtaagattgttaaaaatttctgctgaaagtagataaattgtaaaaataaaaaaaaat

SEQ ID NO: 206173 - DNA, 360 bp, Homo sapiens
caccattcactcactgactcaccagagcaacttctagtcctgcaagttccatgcatgataagtgccctgtacaggtgtatcctttttttttatcttttacatcatatatgtttagatacatgaatacttaccattgtgttacaactgcctatgatattcagtacaggaacatgctgtacaggtttgtagtccaggagggatacactgtaccatatagcccaggtgtgtagtaggctatgccatctaggtttgtgtaagcaccccctatgatgtttgcacgaggatgaaacagcctaacaatgcatgtctcagaacacatcctagttgttcagtgacgcatgagactgtataacattctag

SEQ ID NO: 206174 - DNA, 481 bp, Homo sapiens
ggatgcagttggatcagaaggagtttttgctagaagaaaaataaatcccaaagcacaaactgtactaatgttgggttctgtggtatcatctccatatccataaatcacatttgatttggatgccactggaaatttaatggcttaggaagggatgggtttcatatgcagagtgaaactttaaaaatactacttattggcctggcgcagtggctcatgcctgtaatcccagcagtttgggaggctgaggtgggcagatcatgaggacgggagattgagaccatcttggctaacatggtgaaaccccatctctactaaaaatataaaaaattagccgggtgttgtggcaggcacctgtagtcccagctattcaggaggctgaggcagaagaatggcatgaacccgggaggcggagctagcagtgagccgagatcgcgccactgcactccagcctgggcgagagagcgagactccgtctcaaaaa

SEQ ID NO: 206175 - DNA, 715 bp, Homo sapiens
agctactcgggagaccgaggcagagaattgcttgaacctgggaggtggaagttgtggtgagccgagattgagccactgcactccagcctgagcgacagagtaagactccgtctcaaaaaaaaaaaagtattttacccatccacaggcagcagacaaggaagtaccttctgtgactgtctggcaaggtcagaggcatcagggaaggtaaaatactgaaactatatttttaaaaataaaagtattcccttttgagtgtgaattaggaatcaatgccccttctcactacttttgtgaaaaaaatcacagctcctgcagcaagtctatgcctgggtaacaaccaacccacaaaatccaagaggaggtccccctctcccgcctctgtgaggcttgaggagcagtatgtatctgggccagcctggtcctcagagtgtggaattaacacctttcctctagcaactgtttgtgctgctgagaacagcacagactctctggcagcctggttctctccagagggaagcctgtgaagcagaagaaacatatggcatctgcactcagggcgcccagttccatccggccttgctataaaatgactttgcctttccttttttaaaattacaaaaataattcaaccaatacataaacatatgaagtgaatcacggagggccttcctgcgatatctttttttgcctaccatttgtcatggaatgggtaaag

SEQ ID NO: 206176 - DNA, 511 bp, Homo sapiens
caggaggtggctttctctttccttctactggtggtaaattaagtgactgtcctactttgtagacatgcaatcgttttgtacctctagaccttgggcagtcactggtgatgacactaattgaactaacacagaaactgctgtcacctgatgtgcttggtttcattcctgcctgccttctctacaacgtgacttcatttcatgaatgtggttgccattatgacagtgctaggatgctgatctgtacaccatgagtgactgcgaactttcagactctcaccgcaattcatggggagactttggtgtatcctgtttccagagttgtcctcttctgtgatcctcaaaagaagagaaaaaaacgcatgtggcataaatcaacaggaaagaaatgtttaccactggaagatggtgagtgcatgagtcaaataatctagaggcactgccctaatgagaaaaaaaaaacaatgattctagaaaataaaactttaaaaccaataaacgtctttacacggaa

SEQ ID NO: 206177 - DNA, 183 bp, Homo sapiens
ctccctgtccctgcataacatttcctctgacttcatttaaccttaattacctcctaaaagccctatctccaaataggtatcatatggaggctggggtttcaacacacaaaatttgggaggacttaattcagttcagagcagagtttttagcttaacaatattttaggacaaacataagtttaa

SEQ ID NO: 206178 - DNA, 382 bp, Homo sapiens
gtgtttggaattagggtgaagggaagctttccagcgcctaccacatcgcacatcaaaccatctgcaaagatctgaaagcatttttgtagtattttgatttttatagctttcattgtaacgggatttaacctgtaacatcttttcatcagagaactgcagattacacaaatgaaaatatcataaatccccatttgtactttctgtactttgtaccaaatgtacttaactgtatgctaaatatagtattgaatatgtatcagtgcaaacgttaagagccttttgcaaatagatttatgaacatggatacttattttgtttacttttatattacatgtactgtttatacaaaacatgcattaaaacgtctgtaatgttatttcag

SEQ ID NO: 206179 - DNA, 344 bp, Homo sapiens
aatatacaatggatatgtcttcataacagattagactgccaaaatggagatgaaattgttcaacaaaatctgtgtcttcaacaaaatttcatcccatgttgtattaataattcccaggtatcccagggaaggaactggtgggaggtgactggatcatggaggcggttttccccatgctcttcttgtgacagcgagggagttctcatgagagctgatggttttaagtgtggcatttcttcactctttctcacgcactcttgcctgctgtcatgtaagacatgcctttgcttctcctctgccttctgccatgattgtgtcttgaggcctccccagtcacttggaac

SEQ ID NO: 206180 - DNA, 370 bp, Homo sapiens
caactgttttcctacaaaaacttagtctcctattaaccccaacccactttgtccactctaaaatccactgcatcctagcgtttatatttcatgtgtattttgttgttgttgttgttgagccagctcgggctctgtcgcccaggctggagtgcagtggctcgatctcggctcactgcaatctctgcctcctgggctcaagccatcctctcacctcagcatcccaagtagctgggactacaggtgcacatcaccatgcttagctaatttttgtattttctgtagagacagggttttgccatgttgcccatgctgatttcaaactcctgagctcaaacgatccgcctgctcagcctcccaaagtgctgggatt

SEQ ID NO: 206181 - DNA, 368 bp, Homo sapiens
ccacaacctctgcctcctgggttcaagtgattctcgtgtctcagcctcccgagtagctgggattacaggcacctacaaccatacccagctaatttttgtattttagtagagatgggatttccccatgttggccaggctggtttagaactcctgacctcagatgatctgcccgcctcggcctcccaaagtgatgggattgcaggtgtaagccaccgcacccagcctcacttttccatacttctgctaagcagagaaactattggacttctgacttgagaagcccttgggaaatgagcccttgtggtatccaaggagacagtaaaatttttccaaaagcttcttaccatagctattaccacattcgtgct

SEQ ID NO: 206182 - DNA, 557 bp, Homo sapiens
ttagatttttctgcatactttgtaatttctctccacttttttcttcttctttaattttccatctatactgtttttctcctgcctgaaaatccccttaatatttttaaaaatgtgtctttgttggttacaaattatctatttttgtatgtctgaaaatgtctttatttctcctttatttttgaaaagtctttttgctaggtgttttctttcagcactttaaaaatagtattccattgcaatttggtttatattatttctcctgaagttggatggaagtctaattgtggttcattttatttttccttcgtctgcttttcagagagtctttttgttttcatctggcacaggttttacatgtgcatggagatgtttatctttcttggggttggtagggcttctggggcatgatatctgttgtctgttttggaaaattctgtctttcagtatttcttcacattttgcctctgctctattctcttttctatctttttggggggactcttctttcacttgtgttaggcctaacctctgtcctgcagatcttttaccttcttgtt

SEQ ID NO: 206183 - DNA, 490 bp, Homo sapiens
tctaaaagttgaattgtaactaaactttaataatgcaaacaaataatagttaagcaatataaatattgccagaaatatatcagaaatcgttgttggtgttttttgatttcctgatggagaaagaaaaatttaggtgttttcttgttatcccaatcagtaggaagtacttgagaatgatgagtctaagaatttagtcacctgtgaagtagaagacttttccaaaaatattttattgttattttcccatactttaaaaacttatttttatgagatgattaaaaacagttaatttggcttatgtgtgctagaatattttctgtgaagtaaaagacatttccaggtattgtttctacagtttaagaagacgttcactttgaatgaaatgattgtaaagagttatatggaatgtgtatgctagactaatgttctcccgtatgtttgatgaagacatttgctaagctaattcattaaacaaaaaatcttatgaaac

SEQ ID NO: 206184 - DNA, 381 bp, Homo sapiens
ccttgctttggctgtctgaaattataaaactaaagtaagttctactgtagaagtgtatgcagaaaaaacaaagtcctcaaaaaatgaaaagacaataaagtatcattctgaaaatcatctagcataaaatttagttatacttcctgcctatcatgcttctcttaaactgcaaaattttagtatgtagtcataacagaaagggtattttataatcaccccagtttctccttctaaatgttttactacaaaataatacagggaacaaaaagattaagctttgccaattttgaaaaacttttataggaagaactgtttcatcatttacttatatatctaagtgctggccaggcacggtggctcatgtctgtaatcccagcactt

SEQ ID NO: 206185 - DNA, 551 bp, Homo sapiens
cagagatttaagaacagcttatctgggtagctctgacttggtgtctctaataagatggccataaagattttggctagggctgcaatcctctgaaggcttgactagaaatgtaggattttttttttttttaattatactttaagtactgggatacatgtgcagaacatgtaggtttcttacataggtatacacatgccgtggtggtttgctgcacccgtcaacctgtcatctacattaggtatttctcctaatgctatccctcccccagcccaccactccccaacaggccccagtgtgtgacgttcccctccctgtgttcatatgttctcattgttcaactcccacttataagtgggaacatgtggtgtttggttttctgttcctgtgttagtttgctgagaatgatgatttccagcttcatccatgtccctgcaaaggacatgacctcattcttttttatggctgcatagtattccatggtgtgtatgtgccacagtttctttatccagtctgtcattgatgggcatttgggttggttccaagtctttgct

SEQ ID NO: 206186 - DNA, 494 bp, Homo sapiens
ggcagaaagactgtggccctaaaggagttcatctctcagaatttagaatatagaccctacaccaggaacccataaagagttgccctctggtattcacagacatagtatatgcaccttggaccatttccaaactcaaagatccagacctgctagggattttgggttttgccaaggcattataccgtattaagaggctaacatagtacatcatggtgactatagttaataatgatatgttgcatacgtgaaaattgctgagagagtagattttgtgttctcactacaaaaagaaaggtaagtagctgaggtaatgcatatgttaaataatttgatttagccgttccacaatgtatacatatattaaaacatgctatacaccataaatatatacaatttttacatgtcaactaaatttttactttgtattaaaaaaggctaatggggggtaactgcagctaatgaataaacatccaataggtccagcattcccatgt

SEQ ID NO: 206187 - DNA, 230 bp, Homo sapiens
cctgaggccaaattagccagtataacaaagtctaactgttacgagaaaatgagaacagagtcagagacaaaccttgaagggaaaaagagccaggaccgggaggatacttcaggagagagatgaacaaaaggagttattaggtagagttggaaactactctacggttcctttggaactattatggagatggacggcacacagatattttagaaaagtattgtgctgactgt

SEQ ID NO: 206188 - DNA, 108 bp, Homo sapiens
aaacctagaagcctgcacggtggctcacacctgtaaccccagtgctttgggaggccaagccaggaggactgcgtgaggctgggcaacatagcaaaactgcatctctac

SEQ ID NO: 206189 - DNA, 537 bp, Homo sapiens
caagtagtatgggttttatcactttcttccaaaacataaaaaagtgaaacttactaagtttcatatgctgttttaatgggcaggttctctggaaaggatgtaagtacatatggtggaaataattatagatgactcacggccatcagtggaaatttacacgtcctttggaacttcaatactgagcatctgagaaattgcaaatttctactatagaaaagacgatcagaaaaaataccgttttcttttttttgccattatcattttttaactatctccttttttgtgtgttaagcatggtatctcctttttcctatttcttttccttttcttctggttcttatcttttgttagatcaatttctgattttctatggcagatagagagctggttttatttttctagactattcagtgaaaaagaattcatattcctctttatttgtgaatattgtatgaatgaggtttgaacaggtatattttgaaaatttctttttaaattaaaacacattttatacttttccacattgagatcctaaat

SEQ ID NO: 206190 - DNA, 463 bp, Homo sapiens
agaggcatgctggctttggtggtggcctccaggatccagtcacgtagcctggtgactcgggcatagacccctggacgccgggcttccgcacacccgattccccagctcacgatgccagccagaaagaaccggccagagggctcctcgcagaccaggggtcctcctgagtcaccctaggaaaccaacacacaccctcaggatgggtcggcagcagccagtccagacaccagtgctacgaggcccaagaaggagctctgagctgggacagccaggacctctctccacacaagctcacagagcacctggggctgatcattgacatctcagaacctgtttcctcttctgtggaggaaaaaaaacaaaacccaagacagttggactataggatctctaagatgtctttcagtcctacctctggcaggccaaaacgtgacccaaataaataacatcccctcctcttctt

SEQ ID NO: 206191 - DNA, 683 bp, Homo sapiens
gaaaaggaggtattgggagataatgtcaggagctcaatctgacttgtgaggttgacacatccgtttgatagtgagatggagagcaagtaagcagttagatatagaagttgagagttaggggagaagtacaaggtgaagatttgaatttgagactcatcagtatatggctagcatttaaagctgtgagactagattaactcaccaaggcagtgaaggttgaaagaaaagagaagaggtctgaggaaggaactcttggggactcctaatgttaagaggttggggaatgaggggaaagtaccctactgaagagggaaatctccttggcctggtgacttggacacccggtgaagaaaacacttcaaggagaagtgactgactgtgttgtatgctggtgataagttacgtaagatgaggactgatgattcacccggtttggcagtgtgacagccattggtgaaatggtggagtgaagcctgagtgattcaaaagagaatagaggagaatcagaggcagtatatctaggtgagtcttgagttttgccacaaagtgaaggaaggaaatggggtcatagctggaaaaaagaatgggatcaagagataagtttttacttgttatattttacattgggagaattaacagcatgtatatgctgatgggaatgattcagcagggaggaagaaact

SEQ ID NO: 206192 - DNA, 397 bp, Homo sapiens
aggtgatctagaggatcccgtatatgggtgagcccctgaggcggagctgaggcaggagaatggtttgaacctgggaggtgtcaacagagcaagactctgtccaaaaaaaatagaatgcatgagttatatttctggctctgttacttacgtgaccttggttactttcttaaatgctaagccttagtatactcatctttatgatcataataatagtatacatttcataagactgtttaaatgagacaatgtacatgaagtccactttaatgataggttttattttattatgggagcataaaatttgagtgaatttttttttttttaaagacagagttgggctctggtcacccaggcgggagtgcaagggcacgatctcggctcaccacaacctctgcct

SEQ ID NO: 206193 - DNA, 376 bp, Homo sapiens
tgatgtagtgtccagtttcatgcacgctttaacagacttcatgcaagtaccaattagaaggtgttttgtcccagcctatctttaatacctctcacttctgccttagagctttctgaccccacaactggtgcccagaggaatgttctctgcactcatacttgttcatcctgaaagtgtcaaagagtgaaggcctgtggaccaccttggaccaggggggtacaaagacctagggacaactgcctttgtcttgccagtcaacagttctgggtcttatttcataagactcctcaaaagtgcctgggaagactaagcaccagtatgggtggacatctggatagctcatccctctactgcctttcctttcttccctgcttcc

SEQ ID NO: 206194 - DNA, 506 bp, Homo sapiens
ccttccttccttccttccttcctttctttctttcttgtctttctctctttctctctctctctctttctctctccttccttccttccctttctctttcttttttctttatttctttccacggagtctcgcccagcctggagtgcaatggtgcgatctcagctcactgcaacctctgcctcctgggttcaagtgattctcctgcctcagcctcccaagtagctgggattacaggtgcatgccaccacacccggctaattttttatatctttagtagagacagggtttcaccacattggtcaggctggtcttgaactcctgaccttgtgatccgcccgcctcagccttccaaagtgctgagattacagacatgagccactgtgcccacccgaataatatcttaatatcatgccattgacatttattctctaattatttcagaggtggccttcagaagaaggcctccttggtaaaattgctattaaggatatttcactgaaaaacaaatt

SEQ ID NO: 206195 - DNA, 721 bp, Homo sapiens
gccagcagatagagtggacggcaagccttgattgacttaagggttggtggccggtgggtttcaggctttaggggttctgctgttcctctcgctttcccttgttctaagggagttgtccttcaagggtgtgtcttcacaggccctgagctttagtttcatctgccagtcctctccgtgttagctcttagaggctgctttctgcttggtgtccgccctcatgcccagtttaggtgctgtcagtgcctgggggaggcgagcagctggcccgctccttcctggctgcctcttctgagggatccagcctcagttcctgtcacggccgctcacgtctggactgcaccctcgctccggctggtctctgtgccttgagggagtgcgtcagctagtggggcttccagtgcttccctctggggcctctgggcctgggggcctcagggcttccatgatgacttcaagccttgtgtttattttttgctgtttatctgcagcttttataattaattccactagggggtctgagtggatccacagaggctgccttgtcccagcaggaagaagtctcttcctgttcttgtgcctggcttgtgtttttaattggctttccgttcttcacgcaggttaattcagccttcccgtgctcacccacaattcaaccttcccatgctcacccacaattcagccttcccgtgctcacccgcagttcggccttcccgtgctcacc

SEQ ID NO: 206196 - DNA, 210 bp, Homo sapiens
tcgcttgaacccggtggtggaggttgcagtgagctgagatcacgccactgcactctagcctgggtaacagagcgagactccatctcaaaataaaaaaaaaaactaggtggatgaatgaaatttccttcattacctcataaacacctgaaggaagccacatctccatctcatctcagcacccagcacagggtgtgcacatagtcggtgtaa

SEQ ID NO: 206197 - DNA, 455 bp, Homo sapiens
ttgagatttggaatttaatacactttaggggttttataataaattaatgaaactgaaatcaccttgatacaaaacaatactgacattttatatcataaagcaacttttccacatgcttgctattgtaagaaatatgttaaccatcttgtaaaatgcctaattcctagggcaagaaaaattcttagccagaggtatttagaatgtctatttcattacttgaacattttctctttttttgaaaactggaaaatttgggacatattccccattacttgagataatacttattgagtacttagtgtaggttagcaactgttctaagagttttatgtaaattataactatttaattctcataagtttatatatgtttaatcctccttataatcatgagagtggtgttaattatcctccctccaagtttgcaaataaagaggttgatacaaataaagatta

SEQ ID NO: 206198 - DNA, 532 bp, Homo sapiens
ccaacccctacagttgagaattattttgggatgatatgcaccatggaaaatgcttccgatacaatattgagtgaaataagccaaatgcaaactcgctacatgagaataacagccacagagaaatatgcaaatttcctcatgcaaatagcctcttcccggaaaagaatatggaaaaatagaaacagcgatgtgtaacaggtggagttgcaggagacccttttaccaataaacttaatcaggagataatgtgcccagaggtggagagggatggaagcaagtgggcagaggtgcacgtgtcctctgagagaaggtattcactggacattaccccatgtactggaaaggagccctccttcctatccgggtgccccagcatcagtcacagggcacaactatgtcatgtttgtcgtggctgtctctgatttttttttttttttcttaacatttttctttggatgtcatctgatccttctttttacttttcacatcacaaataccagtacaattaataaaataaaaatattttcatcag

SEQ ID NO: 206199 - DNA, 584 bp, Homo sapiens
agccaccgtgcccggccgtatattgccttttcataggaacgttgacatagttaaaccctaccttatcgtatgatcattcttgtttcagccacttttagagacaccacgtttcgaggagggcttttgttgttttctcggtgtactttaatccaaatggcaaatttttagccaggtggttattttttaagaatatttactttttttccagagtataaaagtaatatgtaaaaaggatctcacatatactgagcacttactatatttcaggcaccaagacacatgctaaaactgcatgacctcattccctcctcatgacaatcctaataaggaaggagtcattcctatcttccctttcaaaaaaagaaactaaggctcaaagagataaaatacttttatccaagttcccacagctaccaagtggtggttgtggaattcaaaccatggctctcaaacttcagagtccaagggtgcagtggcacgtgtctgtagtccagcactttgagaggttgaggcagaagaattgcttgagtccaggagtttgaatccatcttgggcgatataatgagaacccatctctaaaaaat

SEQ ID NO: 206200 - DNA, 377 bp, Homo sapiens
gctgagttgtgaattaaacattttctgtaagagagagagtctataagatctgtttttattttataagatagaagaaagttttatagtatgtgtagtatatggagtgatagtcttggaatactatatgggttaaatttatactgattcatagaattaatctgcctaattggaaccccctcaggagctgatgagcacaagcaacacagcagagcccattaactcccattttaatctaattttaatgtaaaagccaatgagcaaataatgtttactgtattaaattttgctctctgcatcctgtatgactgaagtgaactgcctcaggtgacagagatagcttggggtcagtgaagtttcccttcgtggtttactcttat

SEQ ID NO: 206201 - DNA, 285 bp, Homo sapiens
gtctcatttccgtggtctgcaaaacgccaataaaaaaatattgttacttctaggttagaatgcaaagagcttggaataccagtgagatggcctggcttaaaagaatttggtcaaatccatcataattccagacgtagccaccataatttgacaagacatagagcattaaaaagcataattttcctaaaggaaaaaaaaagctcctttttcttaccaaatattgtgactcaagcttaaggtaaacctcgggctcaatttatgggaattggatgacttgttttatgg

SEQ ID NO: 206202 - DNA, 800 bp, Homo sapiens
tagattcaccaatgattaacattcttgttttattgctttgccttgacatttgtttttttctttcccttcttgcctcctcacccatttccattgcctctcctcctccctcctgctcctcttccctccctccatcctttccttcctttcttcccatcttccttcctttaccctttcttcttctctttcccatttgaaagttgcagacttcttgacactttacccctaagtatttcagcaaggaactcctaaaaataagaacatcctacgtaaccacaatattatctaatatatagtacattttcaaacctccccaattgtcccaaaagtaacttttgtagcttaaaaaaaggtgatccaatcaaggttcccatatttcatttcatttggtttacacaagtaacataatacactctcattgtgaaaactttcacaccaaacagataaagtgaaagcccctcttgacaatacccacctgcaattccactcccctttccaaaggtcacttccttattagtttgatgtatgtccatcagggcctttgccttgcccatctaattttgggaggttttctttttcccaaatgaaatcatactatatttttcatgttctaaaaaatatgtcttgaaaacttttccttcttagttcatgtaaaaccaccttgtattaaaaaatgaaaacagcccggcaggaggtggctcactcctgtaatcccagcactttgggaggccaaggagggcagatagcttgagctcaggagttcgagaccagcctgggcaacctggtgagatcccgtctttcca

SEQ ID NO: 206203 - DNA, 356 bp, Homo sapiens
tgctgagattacaggcatgagccaccatgctgggcctatatttacgtgaataacagtggtagaaatggttctagcaagggcagaaataccagtcagtaaaagtaacaaaataattattctctctacagtatttacatctgcaaattctgaatatcctgggatactgtgattaagttgaatatggggataaaatcaaatattgggagaattatggtcctgagaaagctcatttcagtttggctcaagcgatcctcccacctcagcctcccaagtagctgtgattacaggcgcccgccaccatacccagctaatttttgtatttttagtacagatggggtttcgccatgttggccagg

SEQ ID NO: 206204 - DNA, 566 bp, Homo sapiens
tgctcatccctccttgcccctcatattttaaaccaactgttgttcacagtacagtttgcacgacatctttgttcaaacatagctcagtttttctggcaccaaagcaaatttgggttaggttcgtgtatgcagaggcaacctatgaggagggcccataaggcaccctccacttttgcctgaggagatacgaaagcagaagtaatgggatctgtacttggggcacagagagggtttcagaggatccttgtgaaacactagttaaaagatgacgagtggggagaagtgcgaggaaagaaggaaattagtctgactggctttctgtcctgcaccattgattcaatggagactggcgggaggaaaaagaaagaaagaaagaaagaaagaagaaacagacaaaataaaagctttggaattgctatagaaaggattagattagatgactagctaagaccttttctcgtgtctgtatttggggaagagaaggcatgaatttccccttttagttaggtaaacgtatttttatattgagaacctcttgcataaggacaggtgaattaatatactca

SEQ ID NO: 206205 - DNA, 322 bp, Homo sapiens
tctgggcaacaagagcgagactctgtctccaaaaaaaaaaaatccataaagcagctgggcgcggtggctcacgtctgtaatcccagcactttgggaggccgaggcggtagaatcgcttgagcccaggagttcgagaccaggctgggcaacaaagcaagacactatctctacaaaaaataaaatagccgaatatcgtggtgtgctcctgtagttccggctactcaggagcctgaagcagaaggattgcttgagtccaggagttggaggctgaggtatggcaccactacactgaaatctgggtgacagaacaagtccctgtctt

SEQ ID NO: 206206 - DNA, 826 bp, Homo sapiens
caggctggcgtttcccagtggggctggaatatccaggggtcagacaggaaagtggatgagtgggaatgtggaactgtggagttttttctcttaaaaagaccaaaggcggctgggcgtggtggctcatgctggtgatcccagcactttgggaggccgaggcaggcagatcatgaggtcaggatatcgagaccatcctggccaacatggtgaaaccccgtctctactaaaaatacgaaaattaggccgggcgcatggctcatgtatgtaatcccagcactgtgggaggccaaggcaggcagatcacctgaggtcaggagttcgagaccagcctggcaaacatggtgaaaccccatctctactaaaaatatgaaaaaatagccaggtgtggtggcacacgcctgtaatcccagctacttgggaggctgaggtaggagaattgcttggacccgggaggtggaagttgcagtgagctgagatcgtaccactgcactccagcctggtgacagagtgaggctccgtctcaaaaaaaacccaaaaattagctggccgtggttgcgcatgcctgtagtcccagctacttgggaggctgaggcaggagaatcgcttgaaccggggagttggaggttgcagtgagccaagatcgcgccactgcactccagcctgggtgacagagtgagactccgtctcaaaaaaagaccgaaggcctcactcccgcaggaagacattgatctgtcctgtggctgctctgccgtgcggtggttttgcctaaagacccgcttcctcaggggctccagcctcttttaagggctagtcgtcgcgccctttg

SEQ ID NO: 206207 - DNA, 528 bp, Homo sapiens
acccacccgcctcggcctctgaaagtgctgggaatacaggcgtgagccaccgtgcccagccgatttacctttaaggcttaaaaaaggataaaaagaatacttttacataagttaggtactcatttttaaggataacaaattcttagttggtgtttactgcaggccaggcactcttctaggtggtgaaaatgagcataaatcagagtctactcatgtctttaagaaactcagcatccaatgggggcagcatatatgtttaaaaaaaaaaaagtacctcaatgtgatcatcacagtgtttgagatcccaggcttaatggtctcatataaaggatgagtgatcaaggcatcgttgatgtttcaggggagccaggagatgatgaggcatggcttattaaggagctatgagacagctcgtgtacattaaggaaattgaggcaatttgttatgactggtacgtagggtctgtgataggcaagatacgacatgtccttggtctcatgaagcttatgttctatagcttacttactt

SEQ ID NO: 206208 - DNA, 308 bp, Homo sapiens
gggactggatatagaagaatgaaacttccattaattgatacactggaagaaaggccacatacaaataggcaaatataccgtagaccctgcatagaaggctaattagctaaatgtaaggtgcaaatgctcaagcaacaaccctgaaagtgtgtattcctcctttctgctctggcgactatgcctatttattctcctcaatgaaatgggcatattaactccagcctatttaatatgtactacaactactcttcaatgccccataacattttacacaagtaaaagctgcctaaaaatgagcagcatagtca

SEQ ID NO: 206209 - DNA, 301 bp, Homo sapiens
atgcggtagtagttaggattatataaatagttaaattaagaatggtttgttagggttgtacggtagaactgctattattcatcctattgtgctaattagctaaatgtaaggtgcaaatgctcaagcaacaaccctgaaagtgtgtattcctcctttctgctctggcgactatgcctatttattctcctcaatgaaatgggcatattaactccagcctatttaatatgtactacaactactcttcaatgccccataacattttacacaagtaaaagctgcctaaaaatgagcagcatagtca

SEQ ID NO: 206210 - DNA, 1528 bp, Homo sapiens
cctgctccacctcattcaagggggagcagtggaagtctgtttcccacttccttacgcccaagaaaagggctcaacaaaattaccaagagaactcactatgggtccatgaagttgggtgggtaccatgtctgtgtaacacctgaaaaatataaagtgctggctggctaattgctctgaggacaagagagaagttgtcactccgctggaatcagcccaccctcccctagtctgagcaaaggacgtgggccacatacaacaaagaaccagcagaaggtcaccctgggcctactcactgggcaaaagaggctgaaatgagaagctcccattattatcagattcttaggatctatggaaggaataagcaaccaaacggaatgaagaggcatttggtctcatcaggggaaaagcaggtgaccactcctgagcacggcggtggctgtggtctctgaaggatgccccttgaaaacactcaagaaagaataagctctggccgggcgcggtggctcacgcctgtaatcccagcactttgggaggccgaggcgggcggatcacgaggtcaggagatcaagaccatcctggctaacacggtgaaaccccgtctctactaaaaatacaaaaaattagccgggtgaggtggcgggagcctgtagtcccagctactcgggaggctgaggcaggagaatggcgtgaaccccggggggcggagcctgcagtgagccgagatcgcgccactgcactccaacctgggcgacagcgagactccgtctcaaaaaaaagaaagaaagaaagaaagaataagctctaacacctgcacaacatcccagagagctcctgcactcattcaggaagaagtttcctgtcctcatttccttcctttctttcatgtgctccaacacaggagggatcagaaacaggttacagagcagaaagagaatcatcaagtgatgaaaagtgagaagatgcccactgtggccaccctcccttcctccactgcaggctttctccctgcagcaggcctgtactgggagaaggaacttaggctttaagttctgttatgctttaggactgaagactctaattgctgaattcacattctgttctgtagtgtgaagtgaccacagaaatatcaggcccacctgaattttcatccaggggcaggggtgcaagacaatacaaagagccagtggaagataaagaataaagggattggctacacatcccacaaggtgtgcttattcaacatgacaattacagccagctgcctacccagcatcacttatctattcttcttccataaaggaacctacccctacataacaaatatttgggagaccagtcccgagattcagaggtaggtcagattggtctaaaagtaacccctttctcctttcaagagatttgcttaagaatggctctataagcataactgggaccaatgccaggaaaggactgctgaggtcctgggtcaagttcttcctccatcttctgacagtcctctcaaaagttggaggaacaccaaactgttaga

SEQ ID NO: 206211 - DNA, 886 bp, Homo sapiens
ctcctcctctccccagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagaaacccccagggctcgcccgagatgtgggccccgctgtgtggggggccgtggggggggacacatgtggtgctgttggtacatggctggggggtcttggccttatcctgctgaggtgacgaaggaggaagaacagccttggggacagaagaagacccagtggccacggggaatttaacaaccgaaagcccagggtgggaatgggacccgtttggaaccattcctggtcctgacaattaggttagagagcggaacaaagacaacggcttggtcacccaaaaatgatgaaccaggagggccaaaggggt

SEQ ID NO: 206212 - DNA, 593 bp, Homo sapiens
gctgaagatattgtgaacattgttgaaatggcaacaaatgatttagaatattacataaacttagttgatatagaaacagcagggtttaagaggactgactccaattttgaaagttattctgtggatcaaatgctataaaacaagatttcatgctcttttgtgataggaaaagccaatcgatatggcaaacttcaatgctgtcttattttaagaaattgccactgccaccttggccttcagcaaccacaaccataatcagtcagcagtcatcaacacagaggcaagacactcaaccaggaaaaagattatggcttgttgaaggctgagatgattgttagcatttttagcagtaaagtattttttaattaaggtatgcacattgattttttaaacataatgctattgtacatttaatatactattgtatagggtaaacataacttttatatgaactgagaagctaaaaacttcagtgatttgctatattgtgatacttgctttattgtggtaatgtgaactgagcccacaacatctctgagtcgtgcctgtagttgattactagttgatgtagaataaaagtacacaaaatttca

SEQ ID NO: 206213 - DNA, 664 bp, Homo sapiens
ggaggggcaaggggtgagggagcggggagggtccttttctctcctccctggccatgctggccttggcagaagggtcctgctcagtgctgctggcctgggaacctggccaggaccggagccgagctctgaggctgggtggccttttggggagcagtggttgaggtgtccccccaggcattctgacaggcatctccaatccctgttctctgcccttcccaaggccagctctgtgtccagggacactgtgctggggtacagggacagggcaccctgtggcattgtcctctctggtgtgtgtgcatctcatcctgtgtgggactgttgaggagggagtcctcacggagcttgaaacaataggaacattgatatggtttgtctctgtgtctccacctgaatctcatcttgtagctcccataattcccatgtgttatgggagggacccagtgagagatgattgaatcatgggggtgggtctttcccatgctgttctcatgatggtgagtgggtctcacgagatctgagggttttaaaaacgggagttgccctgcacaagctctctctctctcggctgctgccatgtgagacgtgcctttcatcttctgccatgatgtgaggcctccccagccacgtggaactgtaagtccaataaacctctttcttttgt

SEQ ID NO: 206214 - DNA, 570 bp, Homo sapiens
tgtttagtttgagtggatgctaatcctgcgttttcattctagaaggctacttaatacattattttcttagccaaacttaagtcaagccaagctttggttatggctagttataatctgtttttaataggaatcctcaaagtcaaagtttaaacaaacaaaagaagccatccttttcaaaatagttattgtaatgataatcccttttatagctttgttttatagttttaggccctcctctgaaaagtacagagcatttttattaatatttatataggcaaaaatcatgcatattgataaactaatatattttcaataaagttgaagtctatgctatgaaaagctgcttaaaaagtgaagatatatgatatggtctgggtctgggtccccaccgaaatctcatcttgtattgtaatttccatgtgttgagggaaggacctcgtggaaggtgattagatcatggggggactagatcattagatctggggattagatcattagatcattagaccttcttgctgttctcatgatactgagtgagttctcatgagatctgatggttttataaggggc

SEQ ID NO: 206215 - DNA, 224 bp, Homo sapiens
tgaagtccaacttatagtaatcaaaaaaacaatacagggtgtgaatgagaaaatatctagtgaaatagataacataagagaaaaacaatcaaaacttctgaaaacgaaggacagagagaattgcaaaatgcattggaaagtctcagcaatagagtcaaacaagtagaaaaaagaacttctaaaaaacaaggcttttaaattaacacaattaaacaaatacaaag

SEQ ID NO: 206216 - DNA, 3215 bp, Homo sapiens
ttgtatatttggattgctgctctaggttgaccctcagctaaagaaaaatgcttccttatttagttttattctgcctgcctgttagtttgaaaggtaccacttgtttgcttcatgcagttttttttttttttttggttaaactcagcctctatatgtgtttatatgctttcatattttcttcaagtcacttctggattggtaattcacgtaccagagtggccgatgccatatttcttgtttattcttttttttcaatttcatggccttccagcagttttctgggaatactttctgccagttcttgtttacttctctgtttatatgcgtcggtattggaatgctagaacgttaaagtacaaaatatagaaaatataaaatttctgttcatacttttacatcttaaactggaaagacatatctcacattttttaaccatttatgtgttaggtgatatgctaagttcattattcatgttacttaatcatttacaacaactctttggcgtatagatgccattttactggtgaggaaactaaggcttacaaggcgatgtagttcttttttaagggtcatacacttagtgaaagtgaggctggaattttaaccctgacagggtgaccctagagtgcagttacccgggtatactctctgaggagtcctgtatgaatcacgtcctgggaatttttccaaagtgaaatgaatgcttctggaagaactcagcacaattggcttgaattcctgtggaaattttgggcaaatattggaaccagctggaaatatagtaatggggtatcacatgccaaatctggacctgaccattttagcctgatagtcgacgggtattagtaagatgtgtcttcaaacccttatttattctcattggttacaataggtactatgcaggatgcactgtggaaagtaagactggatatgagattgataatgctcagtaaattgtgatgatatgtaattaacaaatgtaagagatatgattttcagtattgtagcattgtgtccaagtggcaatttttttttttttttagatggagtcttgcactccagcctggcaacagagcaagaccccgtctcaaaaaaaaaaaaaaaaaaaaaaaagtccgagtgtcttcctacctccaaatgacagcattagtgtcttagcaatggtttttaaccaagctaaaatggctggaatgccagatgtagaattcacaatatggataggaatgaagaacattgagattcagggaaaagccataacccaatccaaagaatctaaggaatacaataaaatgatacaagaactgaaagaagaaatggccattttaataaggaaccaaactgatatgataatgctgaaaaacttactgcaataatttcacaatagaattgcaagtattaacaggcaaagtgaacaagcttaggaatggatctcagagctggaagactagttctctgaattaactcaatccaataaaaataaagaaaaaaatgaagaaaacccaggagaaatatgggatcaagtaatgagaaaaaatttatgacccattgacattcctgaaagagagggagagaaagcaagcaacttggaaaacatatgtgaggatgttgtccatgaaaatttcccaaacctcactagagaagccaacattaaaattcaggtaaggcagagagcccttgtgacatactatacaagatgacatccccaagacacataatcttcagatttcccaaggtcaaaataaaagaaaaaaacgttaatggcaaccagaaggaaggggcagatcacctacaaaggtaaccccatcaggctaactgcagacttttcagcagaaactctctgagccagaagagagaaataatagtgggaggctttgccattccactgaccttattaaacagatcactgatacagaaaactaatcaaaatattcaggacctgaactagacacttgaccaaatggacctaacagatatctatagaactctccactaaaaaacaagagtatacgttcttctcatctgtacatggcatgtactctaaaatcggccgtaaaacaattctcagtaaataaaaaaaatactgacatcataccaagtgcactattagatcacacagcaaaataaaaatagaaatcaacactaagttcgctgaagaccatacaattacatggaaattttacaatgtgctcctgaatgacttctggataaacaataaaattaggccagaaaacaagaaattcttcgaaactaatgaaaacaaagacacaacatagccgaatgtctgtgacacagccaaagcagtgttgaaaggaatgttcatagcacaaaatgcccacttcaaaaagttagaaagaattcaaatgaacaacctaacatcaaacacagagaaactagaaaaacatgagaaaatgaaccccaaagctattaaaggacaagaagtaaccaaaatcagaactaactgactgcaattgagatgtgaaaaaccatacaaaaaatcaatgagtctagaagttggttttttgaaagtataaataagattgatagactgctatctagataattaaaaagagaagttccaaataaacacaatcagaaatgacaaatgcttctagacttgataaacaacttcagcaaagtttcaggatacaaaatcgacataaaaaaatcactagcatccctgtataaaaagaacatacaagctgagagccaaataaggaacaccatcccattcacaatatgtacaaaaaaaaataaaatacctagaaatacagctaaccagggaggtgaaagctctctataatgaggattacaaaacactgctgaaagagatcagagattatacaaacaaatgaaaaagtattatgcagccataaaaatgatgagtttatgtcctttgtagggacatggatgaagctggaaaccatcattctcagcaaactatcacaagaacagaaaaccaaacactgcatgttctcactcataggtgggaattgaacaatgagaacacatggacacaggaaggggaacatcacacaccggggcctgttgtggggttggggtcgggggagggatagcattaggagatatacctaatgttaaatgacaagttaatgggtgcagcacaccaacatggcagatgtatacatatgtaacaaacctgcacgctgtgcacatgtaccctaaaacttagagtacaataaaaaaaaagacaaaag

SEQ ID NO: 206217 - DNA, 1363 bp, Homo sapiens
gaaagaagataccaacagcctcctgaaactcacgagagtggacactccagtgttgaccacctaagataccactcctgctccaaagattacagctcccttgtcattctgactcctgggcttaccctacaccccagagatggagcaactactaggaataaaacttggctgcctgtttgccctgttggctctcactctgggctgtggccttactcccatctgcttcaaatggttccagattgatgcagccagaggtcatcaccggcgagtcctcagactcctgggctgtatttctgctggtgttttcctgggagcagggttcatgcatatgactgctgaagccctggaggaaattgaatcacagattcagaagttcatggtgcagaacagatcagcaagtgagagaaattcttctggtgatgctgattcagctcatatggagtatccctatggagagctcatcatctccctgggcttctttcttgtcttctttttggagtcgctggcattgcagtgctgtcctggggctgctggaggatcgacagtgcaggacgaagaatggggtggggctcatatcttcgaactccacagccatggacatttaccctcaccctcaaagggtcccctccgagcccttgtcctcttgctgtcactctcctttcactcagtgtttgaagggctagctgtggggctgcagccgacagtagcagctaccgtgcagctctgccttgctgtcctggctcataaggggcttgtggtgtttggtgtaggaatgcggctagtgcatttaggtaccagctcacgatgggcagtgttctccatactattattagctctcatgtcccccctgggcctagccgtagggctggctgtgactggaggggactctgaaggagggcggggcttagcccaggctgtgttagagggtgtggcagctggtaccttcctgtatgtcaccttcctagaaattcttccacgggagctagctagtcctgaggcccctctagctaagtggagctgtgtagccgctggttttgccttcatggcctttattgccttgtgggcctgagagattcctggcttttctgatggacctatttaggacaacctctctatccccagggagacctcccaaatggctttgaccctcagacatttctttactcagactaaatagcattcagtaggactggactggaccccaggtttcctttacatgagatcccatttctcaccctggactaagacaaagatatttaggttgagcagctattaattggagaattggtacagagacgctccagattttattcttatcccatttatgctactgtgtgtaataaaatgcccattttaccctcaaaaa

SEQ ID NO: 206218 - DNA, 379 bp, Homo sapiens
ctcccacctcagcttcctgactagccgggactacaggtgtgcaccaccacacccagctaatttttaaattttttgtaagaaacaaggtttcattatgttgtccaggctgatctcaagctcctgggctcaagtgatactccaaagttcttggattacaagcatgagagatcgtgcctggtctgttttgtttttaagagtagctctattttggtatcacccttagtcctggggaaaatcatttagtcctgtaatatggtctttatttctaagatgtgaggcctcagtgggaaggccgaggtgttcatccaatcactctcatttggcaggaattaaaatcaaaactccaaatctactgaagtgggcacccaccaaaatctct

SEQ ID NO: 206219 - DNA, 294 bp, Homo sapiens
aggaacatgctacgttgacttcagtctggcccttaacttgcttccataaaatgccatgggataggataaaacagctcatttagtttgataactaaaggataaaatttgaactctcgtttggtgtgctcagtatggcctttttaattctgtaaagagttggtagtgtcagtagattgaatgtaagtggaaaatgggctatttcagtagattataaaaattgccattgggcgaatggtagcagtgcccacagaatgttgaatggggactgcgaaggtcctggtgaattgtatgagc

SEQ ID NO: 206220 - DNA, 605 bp, Homo sapiens
ctggggtggtcccggctctgccctctcggtgccccggggccagcgaggtgtgctggaggctgaggcccggtccggcgcggggagcgttgagtgctgagcttgccaccctctcacccacttcgctctgccggggccgggggcccggcctcctccagctcccctggattaggtggaaagatgtggaaaacggtggttcgagcatctcgcccagcacccacccccacctcctgggccacccacctccacccaagtccatcatcgcctctgggcccttggacttactgtttcattccttgccagatatggagtgtcctagactttgaacccaattgactacgtcaccgtaattcagccttggaagttaaaggggttaaaggggaaaagagcttggtaaagataatgccttgggttttgattacaaagagttcagttttccagcaggaccagccctatctcactgggctttctttctacggtaggtagtgtttcccgatttggtggtaaaggtactgcctgaggaaggtcatagtaaatctacatcaatcactgaagtggggatgtggaattctcgttttcacttgaactccctcaacctctaccgtcca

SEQ ID NO: 206221 - DNA, 281 bp, Homo sapiens
tgcttctccatatattcatcagcaaaatgtctcccttaagaaaagggttgctatggggtgatttatgcctccccaaaattcctacattgaagatctagcccccagtacatctgaacatgaccttatttgggaacagggccattgaaaatgtaattagttaaataggatgaattattacgggagaaagatgggcctctaagccaatacgaccagtgtgtccttacaagaagggaaaatttggacatagacaccacatggagaaaacgaatgccaagtgaagg

SEQ ID NO: 206222 - DNA, 320 bp, Homo sapiens
attaaataatcctttcatacttgttttcctctaatgttttgctactattaactctgggcaggaccccagagtgatcccagtggaatagctatattacactgccagaagcagaatgggtgaaatacagtctcactgcaaactgctcactcaatacacatttatgtggcatctcctaagggcaagatgatgtagaaagattaaaaaaaaaaaaaaaagatatggctgggcgcagtggctcacacctgtaatcccaacactttgggaggccaaggcgggcggatcacgaggtcaggagatcgagaccatcctggctaacaacg

SEQ ID NO: 206223 - DNA, 427 bp, Homo sapiens
caatctttatgccttttatttcttttcttgcctaattgctctggctagaccctccaatacaagattgagtagaagtagtgacagtagatattattgtattattcctactcttaggggaaaaccgtcaacctttcaccattaagtgtgatattagcattagtttttcataaatacctcttatccggttgaggacattcccttctattctaagtttgttgaatgtttttattgtgaaggggttggattttatctacatatactttttttttgtattttgttttttttcacttaacagtatatcttggttatcactccaaatcagttcatagaggttttcccttttttgcaactgtataattctcttttgtgtatatactagtgaatgtaacttacatgtaaaattaaatatggttttaagaaatcaact

SEQ ID NO: 206224 - DNA, 277 bp, Homo sapiens
gttaagtaaacagttttgggtgaacaagagatttttggaagggagaatagtaaaacaagtatggctaaagcaaacacagcatacatatataaaacagcagaacaaggctaaagagtttttttcaagcaaagctaattatagttcattaccaaaatataagaaattatctcaccaagtcaatcaaatcacctagacacaaataatcacactaaaaattactgctaaaagctttttttttaaagctaaaaatcacaacagaattgtacaatctgaaatt

SEQ ID NO: 206225 - DNA, 155 bp, Homo sapiens
cacttaggttaagtgttttgtcttttctcttaaatagctatgattggctctaatgcagtgtctaggcagtgtcttgccacaggcagctcaaatggacacatgtgccacagatatataagacacttgtagaacacacttgaattccagggtgtatg

SEQ ID NO: 206226 - DNA, 352 bp, Homo sapiens
tgagagacacgtgtgtcgcaataaaactttgccgtctttaagtctgaggtgctctgtgtcaggcataaagaacaatacacaacaattgtttgcagttatcttaatctaaagctgtagtttcattgaaaatgaacaggccatgacttttaccaaatacttccagccttcccttatctgatagaccatcttttggaaacaaccaggtggatgttaatgggagaagtaattcactaaaaacagttaattcaaaagcattgttttggcatccaaatccaaaagccttgttactgtttctaatgttgaatcacactacagatctttgagaaagttggtaacattgcagttcatttaa

SEQ ID NO: 206227 - DNA, 344 bp, Homo sapiens
ctcctgtttaacctatgtacccataacgctttgagcacttcctacctttccagcatacacaaaaagttttctctgcaccagctttggaatcagctttttctccaatgagacctagctctttttagtggacaatggtatttagacaccaaaatctgggcactaaatgtgttcactgttacttacgtcatcgcttacagtctctctcagaggacagagctggaacacacatcacacacacacacaaaaacatttctatctacctctatctttaatatgtatatttttaaaaactatgatttcatattgacatctccaatgccaagtcaagaaatttgaaattcctc

SEQ ID NO: 206228 - DNA, 369 bp, Homo sapiens
gcagacaggaaaaaacagagagagaaagagagaagtagaaattttaagagcattcaggaaaatgttaattctaggtatttctgggtgatgcgatttttattttctactacattaaatgtccttatttttgaactgcctgaacagcatgcataaaatacttatttttcagtagactgaaagattaattaatgtttttcaaaatgccattaactgtacttatatgataatttaagattgaatttaaaatgtggggctagaactaggaaaatggcaaagtgggacaaatatatgctaggaccatgaaaaagaaaccttatggaataaagtttgatgactttccacactccttaagagggtacctgtgagctt

SEQ ID NO: 206229 - DNA, 460 bp, Homo sapiens
gcattcttgcccagttcatggaaagccttcttatttggattacttgggataattttacttattttactttgctgttgtagaatatattgctgctatactctttgtgtaagaatgcaagataagcttactcagtgcttccttaaattgaacacattaatcttcccaggaggtcaggcatttgtagtcacaggaagggataggaagttggcaggactggtatcacaagatacaggtcatcaagaccctgctgagaaacagtatgcggtaaacaaaccagccaaaacctgccaaatctaagattgcaatgaaagtgacatctggtcatccttattgctcattgtatgttaattaaaatgtgttagcttgctaaaacacacttctaccagcaccaagacagcctacaaataccatggcaatgtccggaaattaccctatattgtctaaaagggggaggaagcct

SEQ ID NO: 206230 - DNA, 515 bp, Homo sapiens
aacccaagagactctaatagttaggcaggaatatcatcgcctctattcagcctgaagaagttacagaagatggatcttcatgcctctacaacccttaagattaaacgttccctcgtaaaagagagtagggaaatatgtcagaggtgttcaaaatagggcaactccatcttgaataggggctgggtaaaatgaggctaagacctgccaggctgcattcccaggaggtcaggcatttgtagtcacaggaagggataggaagttggcaggactggtatcacaagatacaggtcatcaagaccctgctgagaaacagtatgcggtaaacaaaccagccaaaacctgccaaatctaagattgcaatgaaagtgacatctggtcatccttattgctcattgtatgttaattaaaatgtgttagcttgctaaaacacacttctaccagcaccaagacagcctacaaataccatggcaatgtccggaaattaccctatattgtctaaaagggggaggaagcct

SEQ ID NO: 206231 - DNA, 640 bp, Homo sapiens
gggcagggagcacccacaccccacgagtccagggatccgcggcgcagggtgggaggcacacacagaatgcccacaacgcggggaagagagacctagggtcccaggacgctgatggcaccaagccacggccacccctttcccccaagtgtgggttccaaatggtgattcaagggtcttcctggttccgggccctcttcactggcctacctgggcaacttcagggcagaggggtggttcccgtgggagaaaggccatgggaatgagcctgccccgcagactggttaggttaaggcctctggggaccgttagctcccaaggtgttccctcatactcagggctaccctgtgccttcctaaaggcgtggagggacagctagatggggaatcaggcaggggacagcctctggattcctatccaggaggaatcgggggaggacagggcccaaggtgccagttggcctcctgagtcaggctgggacaggcaatgctccttgtcagagctggggagggggttcaggggaaaaccagcagtcacaccagaggacatgcaggaaacacaagcaaaagcatgcgagggctgggggacatgcaaggcgggggccagcagcatgagcagtaccccgcggggcctggctgggccc

SEQ ID NO: 206232 - DNA, 482 bp, Homo sapiens
gtataacaccatttgtctttcataagtgttgcaaatatttttctccatttttcctttgccttttcatttatgtttttctttaatatagaaatttatatgtagtctcaattatttttgtgctttcacttctgggattatgtagaaaagttctttcttaactctgagattaaatatttatgtatcctttttttttttagtatatttagaggttatacttaaattcgtttgaaatttattttaaaataagatgagagttggtgactaactttgttttttctttttaccaaagaattagcaagttttattgactttgttattgagtaattcatctttttaagtcatattgctcatgtgttagtccctgtgtgtgagaggccgtttctggactgtctactctgttcccttgatctgcctattgtcttggcccaaggccatacaatataaattcctgttgatttataatatacttctttatctggcat

SEQ ID NO: 206233 - DNA, 732 bp, Homo sapiens
gcctgctgcctcctgggtctgcgcaccccacggcacctccaagtgagcctcccaggcttccactgactctgccccttcagtgcacagcccagagccgtgatttgccagctgggctcctgcgttcagagtctcccaacagaacaggttcttgtccagagaagttcaggaaatgctacatactttcccctgccttttagagacttgatgtccattagactgtgaaagacctcgagaattgcatgaagaaactggtttccaaaatgtccttttgtaaagggatacctgctacacatgtgattctgggaatattctgggaagcgcaggcctgttgagtaaatgcagcacctgtattcaccatggcatccagggcccttcaaatctcagtgttgcttgacctcccagacagctgctcccatccctgccatgtgcgccacaagcccctgctccagccgccacagcttctccgatcctggaacagtctgaccttgtactgtgcttactgcttgaggtataccttcccacctccaaagattctcttgctccttcgtggcccacccgagattcctgtcttgtgtgaagccttcttcaggcccctcaccaggtagggtcacgtgctgtcttccctggctcctgtagcatttcgttctgatcactcgaaggagccatcagtatctgacgtcagtactctgctgtctgataatccctccaggcaagttcagagtctctcctgtc

SEQ ID NO: 206234 - DNA, 485 bp, Homo sapiens
gttatttgaagatgaaaaagattctgaattttgtttaccacgattctacttttttgtcaaaaatgtctcaattgttttagaaattaatttttaaattaaaaagttttaagaattttgtatgctaactgtatttccattattaacttacttccatttccattatttcaatttttttttaaacaaaaaagcattattggctgggtgctgtggctcatgcctgtgatcccagcgctttgggaggctgatgccagaggatcacttcggcccaggagtttgagaccagccggggcaacatggtgaaactccatctctacaaaaaatacaaagtaaacttagttaggcatggtgaccagtgcctgtggtcccagctacttgggaggctaaggtgggagaatctcctgagctcaggaggtcaaggctgcagtgagtggtgatttcactactgcactccaacctggacagcagagtgagaccctgtctcaaaa

SEQ ID NO: 206235 - DNA, 370 bp, Homo sapiens
gctggccgtgagcgagcacgtagggctcctggcctgccgagggctggtggggtaccagagctccatagctagaaagccacctccagggatatagtcgtactactgtatacatatgtagtactctccagtgctttgtctcaagccagagaggggcttttgaatacctgagcagtgcttttcagtctttagtacactaggcatggtctggactgattgttaatataatacagatttctggtgcaaaatgtcaacagtgctgaggttgaaaaaccctgctgtcaagtaacaaactaaatgaaagtttcttggtaaaaggagatatgaaataacagattcaagagagaaggctggaagccaacaaggtctttaa

SEQ ID NO: 206236 - DNA, 577 bp, Homo sapiens
cactgcatcaagggatgcacaaaagactccactgggatacagaaagacaatctcagatcttctcttgatctggacctcaccatttcaaaatgcctcatttatatatttatatatgtttcttatttcttttcaagacagagtcttgctctgttgcccaggctggagtacaatggcgcaatcttggctaactgtaaccttcacctcccaggctcaagcaattctcttgcctcagcctcctgagtagctgagactacaggtgtgggctactgcacccagctagtttttgttttcttttttgagacagagtctcactctgttgcctaggctggagtgcagtggtgcagtctcagttcactgcaacctctgccttctggcttcaagcaattctcatgcctcaacttccccagtagctgggattacaggcatggccccatgccaaactaatttttgtagttttggtagagacagggttttgccatgttggccagggtgatcttgaactcctggcctcaagtgatctccccacctcagcctcccgaagtgctgggattataggcttgagccaccacaccctgcc

SEQ ID NO: 206237 - DNA, 212 bp, Homo sapiens
tggagtggaaacacatcctgtttggggctttattacataactatgtttattatatgattattgtttagatatgaaagaaaagatttagatgaaaatctaagttaagctctagtgtttgaaactgagaacttgatcatatgaacttggttaagttagaatagagaagtctgagaatagaaaagattgatttcagccaaagaaatttaatctta

SEQ ID NO: 206238 - DNA, 371 bp, Homo sapiens
ctcgtgaggccctggctaggcagctgccctctgcccccaaaatgaactctcctgaaaggactcctggattcctgagtatgaagaaactgagatgcccacgatgtacctcactgatgactgtgactggctcctggcccactctggacctcagctgactcagctgcaaagcaaggggtttgtttcttcagctctcagccttaattttctcgctagcccttccccagacccctgcctctcagacctaccaccctacctttgcatgtactcttccatcttcttgcaatattcttccgcactgttcttctccctctagcactccctgcatcacctcctcaaagaaagcttcctgaccttcccaggcactattggtt

SEQ ID NO: 206239 - DNA, 572 bp, Homo sapiens
tacattatccatttaagaatagatggatttgcttttagaattgtgctttttaaaaaaattgagtgtgttcatttgaacatctgtttcatcacttacaaaccaggcaaaaagatctgaaatcgtcaagagtaattaaaatttcattgtttacatttctggtgttaggatgttgactgttctcttgggggggtaaaaagcataatccctcagtgtctcaacctgtgattggttcctgaaacttgtgtgtttttttgttttgttttctggaaatgtttacttttgttacattgttcaaggtatgttttaggtgaatgttgttggtatgtgtgaatggtggaccagttaattgctgttggttattctggaaatacttttgcccctaccttagtgttcagaaattaggcttatttttcatatctagagattgtaaatttcttccataacactgtaacatggtggtttggttaaagcagtattatgttgaggaggacaagggatttgctgaggtaattctctgcctgtcaggctatatctttcacattgaacaaaaaggcacttatgagatacttagg

SEQ ID NO: 206240 - DNA, 466 bp, Homo sapiens
tgaaagaaaacatatttcttttttcaatttatgtgtattttttttttttagcagttactaagtgttaggaaatatatccttattaaattgtttggacatagctacttattaaacagaatcattaggtatttcttttggcttaagagttactgtgaaaaaaatcagagacactaaaggcattgaccaagaaaggttgggaacctctgctattgtgacatcttaagttttagctcctttttttttcttttggtaaagtctgaaagtaacgtctctcgtctagaatgtttcagaagaccaagttcgccctctagaggcaaaacggtggtcttgctactgaaggtttatacaggtatttttgatttttatggtagtttaaatatgcatgcacatacatttttatatctttatataaactaatgttctatgatattttcttaccataagtctctgaataaattactggttg

SEQ ID NO: 206241 - DNA, 200 bp, Homo sapiens
ttcaatctataggtcaattttgggggaagtggatatcataataacattaaagtcttccaatgcatgaacatggtgtagctgtccatttaaattaggtctttaatttcttcagtgacttttcatagttttcagtgtacaggttttttgacctcttttgtcaaatatttcatgttttggatgccactggaaatccattttga

SEQ ID NO: 206242 - DNA, 375 bp, Homo sapiens
tgatactcgtcgtactagcaccgtgagcaagcgtagttgttgatcctgagtagagaagaatcttcaccatgtcggccaggctggtctcaaacccctgacctccaatgatccacccgcctcgagcctccccaagtgttgggattacaggtgtaagccaccgcgcccggccagtgtatagcttcttgagtataggttaggcagtggctccagtagccctgttttacaatgtacttttcttaggtgttccaaaaagctcaacctagagtgtgtaaccttatccttcaacttagagagcatttggttggccttcctgacccaacaatcctgtaaccctttatattttatatctttgctgctgagtagattctattctct

SEQ ID NO: 206243 - DNA, 502 bp, Homo sapiens
atttatatataatattaaataatatatgtatatatatttatatataatatatatattaaataatgaaatatattaaataataaataaataaataatttatttattgttttgtagagatgggagtctcactatattgcccaggctcatctcaaactcctggcctcaagcattccttccacctcagcctcccaaacggctaggattacaggtgtgagccaccacacccagccctccctcatacattcaaatggccaactcccttggcttcctcaagtctttgcttaaatgccatcttctcaggaagtcattttctgaacactctattaaaaattgcaacctgcccccaaacacgtcttgcactccagcctgggcaacggagtgagactctgtctcaaaaataacataaaagaaaatagatattattttctgtaatcacagcagtgttactaaaaaatttaccttgattaccatccgtacgccaattttgtcagttgtggtaaaa

SEQ ID NO: 206244 - DNA, 280 bp, Homo sapiens
tattttttttctagtatgctcaaatacttaatcaaacttaggaaagaacaaataagcaatatcacaaataatattgcataaggagtaaaaacattctaatgcaaaaactcaaaaccataattcctaatttttttggctaaccattattttttaaggtgggataaacatatagttatatattttttcttttaaaaaaattttcatcacaggaattagtcggaagtaaccaaacgcactgctcaagaatattgtagaatttatttaagggcaatgttgatag

SEQ ID NO: 206245 - DNA, 461 bp, Homo sapiens
aatgttatacagatataaacatggattcctccaggtcaggaatccacagaatttgacagatttgtttttttggcctctcaaagcttaaagtttcttagaatatatcatttggatgatatcttttaggagaaacaataagagcataaagtgcaactggaatctttgtcctgaaagccacatgagaagcttgtgcctttagatttgccttattcttaaatactttgtggtttatagtgagaagaaagctcacagttgctcatcaggaagcaattttttatgcccctgaaaatactttttgtaggttaaagcagtcactttatgatgtgggaaccatgcttctactgtagctggaaggcaattcactgattcccattatacctgcatgaaggtttccttccctttctgtggatttataactaaaaaatgactgtattctcttctgatagtttcgcaaagtgaaa

SEQ ID NO: 206246 - DNA, 201 bp, Homo sapiens
cttgaaggatgaagaccagttaaattgtagaggaaagagaagtgagtgtgttgggcaggagaacagaacaggcagtggtcagacaggaggcggcatgacttgaaacagagtgcagtgccctctgactgggctgatgtgtttatttgagtctactgaaaaataacacagatgattcaaatgtttgagctgtataagaacaaa

SEQ ID NO: 206247 - DNA, 526 bp, Homo sapiens
cccagtttgggggtggaactgttagttcctctttttctggataaggaagttgaaaggctccagaaggcaccaaggtcagctgatctgccagtaggtacagtgtccacctgtcactcacagccctcccttgaccgcttcgcctgtctccccagttgagattctgtgtgtacttgaacactttgccaatggttgaacctgcaccagggtcactgtgtcagctgggcctgccaggccaccgtccccgagctctgtccaaggcagggccagtgttcataccttgcttccttgccagtgtcccacccaaggccctggaaaggccctggagtcagagatccggctaaatcctggcaatgccccatacctgctgtgtgactatgggccagcgactcagcctctctgtgcctcccgggttgctgtgagggttacaggagatgcacagagggccctgagcttggtggctggcatgctgcaaaggctagttacgtggtgcaaggatggcactgatgacaataaatgaatcgaacga

SEQ ID NO: 206248 - DNA, 440 bp, Homo sapiens
gtaatctcagctcactgcaagctctgactcccgggttcacaccattctcctgcctcagcctcccaagtagctgggactacaggcgcccgccagcatgcctggctaattttttgtatttttagtagagacggggtttcactgtgttagacaggatggtctcgatgttctgatcttgtgatccacctgcctcggcctcccaaagtgctggaattacaggcatgagccaccgtgcctggccgattgttaatattttgatgtatttctttgagtcttttttcttttgcttacatgtatgtatatttgtgtatatgtatatgtactttacataaatgagatcatattgtatcagctatgttataatgggaagatattttaaagcagattcaggcagtactgtagggaccacaaaaaatgctgctttttcatatgatagataaaat

SEQ ID NO: 206249 - DNA, 464 bp, Homo sapiens
aatttcacttctaggtatatacccagaagtattgagagtaggcttaaacagatatttccacattcatattcacaatagccaaaaggtagaaacaacccaattttccatccatagatgcaaagatttttttaaaatgtgctttgtatatacaatgggatattattcagccttaaaagagaagggggccggggcacggtggctcatgcctgtaatcccaacactttgggaggccaaggcaggcggatcacaaggtcaggagattgagactatcctggctaacacggtaaaaccctgtctcaaaatacaaaagattagccgggcatggtggcgggtgcttgtagaaccagctacttgggaggctgaggcaggagattggcatgaacccgggaggcggagcttgcagtgagctgagatcacgccactgcacttcagcctgggtacagagcaagactccgtctcaaaaa

SEQ ID NO: 206250 - DNA, 550 bp, Homo sapiens
ttcgactatacacgatccccatgccaataacctccagactagctggctactggaacctcttacaacttcttattgcatcaaggaaaaccaaaatgacccccaaaaacggctgaaataacagactagacttttaaggtagacctgggctgaatgtcttataacccaaagtaaccactttgtgaaactcacagattaaaatagctgcaaattctccatctgaccatgaccgaggagagagcagagaagacagagccaagaactcaaaacttctaagcagagatataccattcacaaaaatgtaccacccgtggcagtggcaccaggaaagagaaacttcataattttatttaaataaaagtccaactgaggaaagctccagttccaatccaaggaaatagaaagaagtgaccaggcggcaaccctaaggagctaaatttagtactcaacagtgccaagggccagcaagaataagaacagagagggttgggccaggagctgccaaaaaggtgtccatcagagaggagaagtcttgaccactactcattttatc

SEQ ID NO: 206251 - DNA, 398 bp, Homo sapiens
tcaatacctccctctactacccattattctgttctggatctcgaacatgctttctttactattcctttgcacccttcatcccagcctctctttgccttcacttagactgaccctgacacccattaggctcagcaaattacctgggctgtactgccgcaaggcttcacagacagcccccattacttcaatcaagcccaaatttcatcctcatctgttagtcatactcctattcaccattctcaactactcatacatgccctgctcttgtttacactgccggtttacactgtttctccaagccatcacagctgatatctcctggtgctatccccaaactgccactctaaactcttgaagtaaataaataatctttgctggcaggactatgctgaatctcc

SEQ ID NO: 206252 - DNA, 327 bp, Homo sapiens
tggccaggctggtctcaaactcctgacctcaagggatgcacctgcctcagcctcccaaagtgctgagattacaggcctgagccaccatgccctgctactgcacccagctactcaaggcacatatggagccaacatacttgaccatctgcaggggtccacccagggtaggggagctatgagcactggcgtcggagggagcccagcttattggcccaaccccgagatagacccatttcccagtgggcatagcactccaaggcttgtcactcacagcctctgcaactccaagtcttggtatgcctgaaacccatactccacatgagcaca

SEQ ID NO: 206253 - DNA, 432 bp, Homo sapiens
tgaagtctgaaaggaggactgaggagggagagagaaaagaggaaagtttcttagaggtgattagcacctgcttgatgccaggccctgtgccaggctctctcatgcatactcatttatactcaccatgatcctgatacgtagatcttaatgttttcattttgtaagtgaaggaactttgagaatatgagaaattacccaggttccatagttggtctcagagcttcctagttcaagcctggatttgaaatagggtggtagcagtgggaatcaaaacatttaatggtgatggaatttagaaaaatagagacttctcaagcacatttaagcctaaaagtaggaattgggaaatctgaatcttactggaaaagtgataaaaagtaaagtggacagagaactttagagaatcccttcatgaatttggtatttgttctt

SEQ ID NO: 206254 - DNA, 326 bp, Homo sapiens
attttagttaaaccttcacattagtggaggaaacgatgaactcatggcaaattaagctaccctccctaagttatttttcctcaacaaatcaaactcaaagacaagcttacaaaactggaaacacagaataaaagaataaaagaggacactgtctcctatgccatattatagtccagaattagttaatctaattcaaagtattggcaaggatgttccatcaactagaccaggtatttatcattcattaccatgtactgcttaagcatgtaaagtagctgaaacacaaatattttggagttatctccagacaaagagtaaaaacacaa

SEQ ID NO: 206255 - DNA, 398 bp, Homo sapiens
tttttgtatttttagtggagacagggtttcaccattttggccaggctagtcttgaactcctgaccttgtgatctgcccgcctcggcctcccaaagtgctgggattacaggcgtgagccaccacacctggcccaatttttttgtatttttagtagagatgaggtttcaccatgttagccaggatggtctcaatctcctgacctcgtgatccacccaccttggcctcgcaaagtgctgggattacaggcgtgagccactgcgtctgtcctataatgccactcttattttaataaaagtatattctttaggagggctttcaaattcttttatttctccttatgaggtggatgaagcaagaatcattgtgtcttatagatcaaggaggtctaaacagtgctg

SEQ ID NO: 206256 - DNA, 404 bp, Homo sapiens
gaaatgcataatctttttcttttttgagacggagtctcactgtcacccaggctggagtgcaatggtgcaatctcggctcactgcagcctccacctccctcccagtttcaagtgattctcctgcctcagcctccagagtaactgggattacaggtgcctaccatcatgcctggctaatttttgtatttttagtagagacggggtttctccatgttggccaggctggtctcgaactcctgacctcaagtgatccgcctgcctcagcctcccaaagtgctgggattacaggcgtgagccactgcacctggtctgaaatgcataatcttttaaaactgaaagccatttctaatagtgttcttaatttgtcaagaatcgtatgagaagtgccagtgccctttgcctgtc

SEQ ID NO: 206257 - DNA, 453 bp, Homo sapiens
gagatttagaagggccaattagccccacagtatcacctagcagggagctgtgtaatgtggctctttgagtagagaacaaaagagtacgtagttctcagtactctatttgatctccataatgcccaaataaagagtgtatgggcccgggatggtggctcatgcctgtaatcccagcactgggaggcaaaggtgggcggatcacttgaggccaggagtttgagaccagcctggccaacattgttagctgtcttttagtagagacagcaaaaccctgtctctactaaaattacaaaaaattaattagctgggtgtggtggcatgcacctgtagtgtagtctcagctactcaggaggctaaggcatgagaatcacttaaacccaggaggtggaggttgtagtgagccaagattataccactgcaatccaacctgggtgacagaacaaaactgtctca

SEQ ID NO: 206258 - DNA, 540 bp, Homo sapiens
agagaagataagaatatgaatgaaaccagtttactaagtatacatgactgtcccctttctttttttttaaaaaaataataaaacaataatgaggataataacaacagctcatgtttgttgagtgctctagtgtgccaggcattttacatttaatccttaccttctaaggtaggttttgttatccccattataagaagatactgagtctgagatgaaatagattgcccaaggtcatgtagctagggagtgttagaaccagaattcagacacaggtatgacacagatatttcagacactgaattcttaacttggtattatgctgtcaggtaatataataagtaagacttagttcctgccttagaggagttcttaatttgggtggtctcctgatcacagtatgtactgtgattatgttatagaggaatgaccaattgattttgctctagagtgtaaagacgtttatcttggaaggatctgcagaggtggtgtttgaaatgggtactagagattgagtatgatgttaacacatagtgaagaggg

SEQ ID NO: 206259 - DNA, 422 bp, Homo sapiens
gccattcgaagcacacccaagaataggaaaagacacaatttcaaaactaagagatcaaccattgaaattggataaatttagccttatgaaatactcaaacaatttttttttccccgtttctctgaggacctacagatgcaggtattgttttgcaaaccagctttgagaatcactgatttgtggtattatgcatgtatcctttgatgttgatactattaacaaatgagcatcatatccttaatcttgcaataagattgcgattagagtctaaacatgataaacgaaaaattaaagtaggccgtgtgtcatttctggcctagagatacttcatttgtttcttttttttttttttttgagatggagtcacgctctgttgcccacgctggagtgcagtggccatcttggctcactggaatctctgc

SEQ ID NO: 206260 - DNA, 722 bp, Homo sapiens
cgtgcctcaaggcagaatgaatatcaagtaccagatgatgatggaaagaattctgctggagttcagtggacacagctgtcttatggcctgaggtgtaaggatgacactatgagaaagggagccttgacttcacttttgaagaagtgtgcagggagcacgctgggaaaaggagggctggaaaagagatgagatcttgctggatcaactgaagcacctgccacctgcttggcaggacaggaaatcttaaagtcaatgctcctcacccttagcaccctgcaaccaaaaagaaaattcgaagggttcctcactctatttgattggagttttgaagaatctgtggcatcgattcctggtgctttgctgcccaggcacccctaatcttagcccccaccactagggggcctccctctagtctccttccttctaagcattgatcacagcccactcaggtttaataagcatgactatccatgtctaaaaaaaaaatgatactttatgacatcaatttgttgtgaacttttcaagcttttcttcccaaatagcatatggatattcaatttggaaaattttgatataggtttaaacaaaatcaaattcaaataatctgtaattatgccaaccccagaaagctaatgcttttgcttatttttagatatacttccaaatttataatattatgaatagtagtacacgtcagtaagtacacatcttatttcacaaaa

SEQ ID NO: 206261 - DNA, 245 bp, Homo sapiens
gagttcactgtcaaacagagattcccaagaaaccaaacagaaaaggaataaaaatgagaagcatgttttattaaatgtcttctacacctgcttcctttatcttttagacctgcttaccaaagcccattggatattttgattttttaagtcacaggcatatgaactagcttgaacatttatagtatcaaattattaaaggtaatgacctggtatttaaaaaatgatgttccacatctaggggatct

SEQ ID NO: 206262 - DNA, 627 bp, Homo sapiens
tttgatgcatgatagaaataaaaacaaaaagaaaatatgatttgcaatattcaagtaaatgatgtgtaatcttctccccacccccaagccttttggttcccttcctgtcaggtttggtatatgaaatttttgatcacttaaaacagttgcagtttataattagaacaattacctgctggaggggtaagcacatacaaacaaagtacagggactcgtctcacctcatgtattctaaaaacaagaattctgaacaatgcaagaatttttaatcactaccacttgggatgttttgaactaattagtcatttaggtaatacttttagagtgttattctactttgtgttaaaagaagaattaagcctggtgtggtggtgcatgcctgtagtcccagctactcggaaggctgaggtaggaggatcacttgagcccaggagtttgagtccagcctgggcaacatactgagatcctgtcccttaaaaaaaaaaagtgcaattaaccataattaaaatgttctacacaagaaatcttactattgcagaatgttataccacaacatcctcaaacataatagttcggactaaaaccaaataccttataattcttccctctcctttctctcttccctct

SEQ ID NO: 206263 - DNA, 901 bp, Homo sapiens
cccaggctggaaggaactcaccggctcatggctcaccaacccctaactacagctgggcaggcaaggagggaggctgcaatttcattcacttctttagattgatgttttgacatctttagaagcctctgttaaaatggaaatgtggaatctgagtagtgtggtcaaactggtatacgaggacattttggtggtgactcaagtctgatgaagcttttctagtaatttgtgccttccatttcctaggaacaagagtgagtgaggactaaggacacaaaacagcagcagtttcagccccactcctataatattctaaaagcttgtccttagatcttgatattcttctctcaggcagagagcttaagaatattagagaaatatcctgatacttttgcattttaaggtaagccacagccagaaagaacaatgggaggcccagaagcccacctccaaccactccaaccagatacaccaaggactctggctcagaccagatacagccaccttggtgatccagagaggcctcctgctgggtgcagtggctcaagcctgtaatcccaccactttgagaagctgaggtgggaggattgcttgaagccaggagttcaagaccagcctgggcaacatagcaagaccccatctctacaaaagaaaaaaagagagagagagtgagagaggcctcctatcaggaatcatgctcaagttccaattcaatttcaatgagagataagggagtaaacagcaggaaggagggagattccagaagaccccaagactgcattgttgggctgtcattgttcatgggaattactcacccatgggtctccatcgggtttcacccacaggtctgtgcaccatgtcttgctctctaggaaccagaacatctctatggttctttggatag

SEQ ID NO: 206264 - DNA, 281 bp, Homo sapiens
gtgattttcttgttcctgttgaaactgggtattttaatattataatttagtaactttagaaatcactttctcattcttctctagactttgctgttcttaattactgaagtcttcagtatccatttgtttttatgaatttttcaaacttttttttgcagtcttatgtgtggtcactgaattctctctctttagcttgtgtttaggtagtgttttaacaggcatttttcctggaaggccaggtttcaaacaaccaccaccaaacaaaaaagaaaaaggaaaag

SEQ ID NO: 206265 - DNA, 503 bp, Homo sapiens
ggagaaatacaggtgtgctatagggagaatgaaaagagccctttccaatttggaacagtttgcgtggaaggtggggccttgcccctatggcatccagatctgttcggtaactgcaactaacttttcttttcttttcttttcttttcttttcttttcttttcttttcttttctttctctctctctctctctctttctttctctttctttctttctttctttctttctctctctctctctctctctctcatggttcttgtatgaattctaattaagagacattacattcagaattatagcactcatggtgataattttcagaagactgtaacagcttctttgccacttaaggggtacaaagggtgcagctgtttccctgaaggaattcttaagttagtgactactaccactcaaattttcctagttgtcgctctgttacaggttactgaccgcaagtccatgttccagacattctttgccaacacaattaattacaagagagcca

SEQ ID NO: 206266 - DNA, 416 bp, Homo sapiens
gccttttgaaaaaaagttttattcagggttttcactgtggacagaattatatagttgcttacttaattctgatagtttgtatttaatccttgtataaataggtgaaaaagattcaggttttctttagtagtcaatagcataaagcgttgtgggaaaacgagtaattgtcaagtgaaacatttttattggtgaaagaccattccagccattcagttgaaccatcttataatggaaatatgatattcatagtttataaacattctatacaacagacttaacacttgttgtatgtatgtcaagcaaccaatcaaagtttaaatagctatctccatactaagaaaaattaatatatacagtattagtacacgacagtgcattctatgaaatacaaaatgcactcaagtgcatccaccagg

SEQ ID NO: 206267 - DNA, 191 bp, Homo sapiens
ctgaggatcccgagtactgtccgatatcgtaatctgcgttgtagcctatacctgtgtaactgtttctagaagtcctcgtgggctgtcagtcctgcccaggtgtgttgttctctcaggattctctgggaacattgctctgtactaggatgctcttaggtctgtagaccctgctttgaagggttcctcctgat

SEQ ID NO: 206268 - DNA, 669 bp, Homo sapiens
tcaaaatttaaagaatgatacagcttattaattttgaaaataccacaaactaacttacaaggaaaatagggacactgaagtgttatagaaactctacagtcatcttataaatttccagaaaacacattagaatcaatattgatataaaatatgattattaaatgctaaaaggtaacatttttacatttttattaatatcagttaaaaaacaaaattctactcaattcttaagctaaagtgttcttgctgtaatttcattgccattctcttgttgttcttcccataaaaataaatggctgggtcagaagtgaaatgacatgtgttccagtgttttctgtcattcagtaattatgcattaccattatgtccaaagattgccttctagttactttcttctagagttgctcaaaatgggccttgtgactctacaatgagagtttcaagggatgatgtcagaggccgatactccttggaggcagcagggtgagattagtcacgcctcacttttttccccatgtcttggtcctatggacattctgttcatttccagtatcagccagctcatcagacaggccctccttttcctttctccatttgactatttaggtttcgtatttattttgagagctttttcccatgagaatgaattgcccaagcagaccctatgta

SEQ ID NO: 206269 - DNA, 479 bp, Homo sapiens
atggaaacaaactagagaagtttgaaatcagagaggagtgatgcagctagcaaatgcctggtcagggatgtggagacttactactcaaaatgtaaagaggaataaaggaaaaataggagaaaaataaaaaggagaaacagtgatgcttcccttttgatttacttactcagcatacaatttatcccttggcttctgtgtaatgaataataggtaatctttatggaattgtctatacatgtgtatgcataataaaaccattcactcacagttgggaaaaattactgatgtgcatctctttctattcatttttgtaaccctagtgcctggtacataatatgcccttttaagtgtttctagaatgaataaattctatttaaagctgaaaaactttttattttattgttttattttattttaagacagagtctcttattttgagatggagtctcactctttcacccaggctggagtgcagtggc

SEQ ID NO: 206270 - DNA, 442 bp, Homo sapiens
ctgcctcataactcccgcctcttgcagcccaactgggccaccagattaacctttctaaaacactgctgctttctttaacttctcatttcaaaaagctcattgataccctaaagccaagaaagagtccaaacccattactcacaaagtcttctataatcttgaccagacttatttttctagattattttccatctgctttcctataaccaccacactgggccaactacttttcgccaaacatactttgcacttctacctcttctgttcccgtttcttcatttacccagagggcctacccgtctttcaaggcatagctcacatgtcacatgttctatgaagattggtggcatttcctcctccctcctccgagtgaaggaatttttataatagttttaaggggtagtagtgcagttttgttacatggaggtattggcatgttatg

SEQ ID NO: 206271 - DNA, 306 bp, Homo sapiens
tcatgaggtccttgcaatgaagtggtgcgaagcaggcattcagaatgaaacatcatgtatgaaacaagacagatgaaaagaagcaattaagagattgatataatttcactcttaaaagaagccaaatgcccactcttaaacagctcctgtatttgaagggggaaaaaacaactacaaacaaaagaaaggacagacagagactcttgagatcaccatacaattattgatccatgcatgggctttatcagagtaacctttaaatattcacagccttaatggataccataatcccttttcctatagtca

SEQ ID NO: 206272 - DNA, 456 bp, Homo sapiens
cagcattaagtagtggccatgacccaacccctctctgaggcagtttctcccaccaccatggggacatgtcctggatgggtgtgacactccgagggaatttgactctagctccccaaagaggtaaggagctggacttcttagttcccttctctctactcatcccctccaacctcccccttggccgctgtggttaatctccctccacacacacatgcacacacaggtactaatgaagtcctagtttgtgagtgagcagggaccttggaataagtcctttcctaaggtagggtcttaagttgctatccccctaggagcctgagtgcctagagggagggcgaggagacagccacaggcaagttgcaatattttctctacatattctgcctggaatcaagatgctcaggaaacggccgggccgccgggggctcacgcctgtaatcctggcactttgggagg

SEQ ID NO: 206273 - DNA, 415 bp, Homo sapiens
caaagactagaattcttaaattcgctatcaggttttttcccattaaacttgcctgagtttatttcccagtttattcttgaaatgtttatataatttttttgaacttcagagttattttagaagctattttgtagtagcaaaataaaacttgtgttaaacttatttttaataatacaaaacattttttttaacacatcacaaattatttataaggtatttagagcattctgttgtttggcccttaaaacaatcctgagagatgagcccagtattttttttttctaatttatgtagaaagaaactaaagagttcatatataagattggctggttttcttcctactgaatttaaaaggccattgattttagtgaacacataatcatatttctccttataaatttcacttactaaggtt

SEQ ID NO: 206274 - DNA, 509 bp, Homo sapiens
cctccctaaaaattatagtatacctagatatgagtaccaaaatatttgttttaaaatctgggtgtgttgattttcacagagagctaaaattagtccataacccacttaatattaactgacatccaccagagataaacatggtaaaattatatggctcaagcaactccacagtgcaaatggagatccacagaaatagagagttggacctttagaattctttttctaactttgtttagtatttacctcctttttaagataaaataactgaaccaatgaaaacaggtactttgaagctgaaactgagccttacctcctccaagattgagaatgtggttgaaaatgtcccttgaatttcccagttacacaattatttaacaaactttgaatgttatttgttcggctgctatgtgtaggtgaagaaaatgtgagccagagagactccatccaatgttagataaaaggaacacgcaaggagcattggaaaacatcaacctttaaggagtaggtca

SEQ ID NO: 206275 - DNA, 373 bp, Homo sapiens
tgtaggtcaggtctactcctgtaaaaggagaagtgtgcaggacagggtggttctggtagaagcaaagacaatttggtagtgaagagtggaagggattgtctacaggacatggaggctgccatctgacctcgacacactgcatttaaatcccctggggcccatcagacaagtcaccacactgatttaacagccatcaacagttcaaactaatccagtgatcctcaaagggtggtccccatgaacatcagcatcacctgagaatttatttatttatttatttatttatttatttatttatttatttatttattttgagaaagagtctcactctgtcgcccaggctggagtgcagtggcgcaatctcagctcactg

SEQ ID NO: 206276 - DNA, 297 bp, Homo sapiens
  misc_feature (286)..(286): n is a, c, g, or t
ccatttcctccccacactggttatgccctagaatgacgaattgttctaggtctctacccataactgatggcttcatagctcattcctctcctgtctggatcaccccctcctgtagcctacctcttcctgcttaactagctgctcatccttccaaactcagctcagaagcctggctcccttacacacttgagctgggattcatgtctgtgggctgtgtttccatagtaccctttgctgaagtttatcactttacttagcaccagtgtggagagagccagtgtggagngagcgtaccgg

SEQ ID NO: 206277 - DNA, 384 bp, Homo sapiens
tatcccctcatgcaactgcttctaattctccattagcatacctacgaagtcacagtaaaaaatgaaaatgaatattaccattgaaatcacagatgactgataaccttttgctaggatcttagaggcatgtgcactgacaatagaatcaatgaaggtgcctgtaaccccagcactttgggaggccggggcgggcggatcatctgaggttgggagctcgagatcagcctgatcaacatggggaaacccagtctctactaaaaatacaatattagctgggcatggtggcacatgcctataatcccagctactcaggaaggctgaggcaggagaattgcttgaactttggaggcagaggttgcagtgagccgagattgcgccagcctg

SEQ ID NO: 206278 - DNA, 505 bp, Homo sapiens
agtcctttattccaagaactcgccttcctatctcataatgccacaaggcccgcaggccaactccctttccctttccatgggcagcgagtaacaatttattagatcagaattgatccagaggaaacaccacagatgccaatccacgcccgtgacagaaataccaggcagtcctaattctccaaaccaaggagacagggctgaagatgctaagaataaactgcggggcctgcggggcgccagaaacaaaacaaaatgaccatcgatggacacggacagggcatgcaaatacttatcgatcagtgtgggcacagtgccagggggcttttccattctcggaagtattcactgccaggtgtcctgcttagagatgctggcaagggtcaccctgggcgggcagtctcctgttggggtgtcagagcaccccaacgtgcatcacaggcaccctggcacgaagcctctgccgcgaaggcttttgtcccagtaaaatccaaagaagacacatgca

SEQ ID NO: 206279 - DNA, 274 bp, Homo sapiens
tcagcctgctcaatgtgaaaacagtgaagatgaaggcctgtatgatgatccacttccatttaatcaatagtaaatatattttctttagcttactttaatatggtatatgatatgcataacatacagaatatgttattgactttatgttattggtaaggcttctggtcaacagtaggctatctgtagttgagttttagggaagccaaaagttatacatagattttcaactgcatggggattggcgcctctaatcctcacattgttcaagggtcaa

SEQ ID NO: 206280 - DNA, 513 bp, Homo sapiens
accaagaaagtttgacattttaggtagcttgataaatgctctcaattcatcttttagaaattgaaagtccctcaaaattcccttagaatctgacacttgagttttggatccactgctgaaatatacattgaaggacttcaaggaacctctgtagttgtgcaatgtagggaatgaggtggactaacctcacattcacctatttggcatttagcaccttatttctctttaatagtaagcatgtatccacctgctctgcaacacagtagtgtttatatattatgctagatactttgcatacagtgtttcttatttactttttgtaacaacactgtcaattggctatagttgctgttttcctaaggaggaaactgaagggcagaaatgttaaaacttatctaagctgttaaattgcaaccaagatatcagaacttatctacctgtttgcaaagtccaccccgtctccactataccatagtatttcagagtatgttttgaccaggaaattcgaaaaaa

SEQ ID NO: 206281 - DNA, 437 bp, Homo sapiens
agatctcccagacaattcaggcagccctccctctctgttcaaccttgcatcttccagtagaaatggaagccaacgcacaccccgtagaatattctagtgcaagccatgctatttgccaaggcctgaatctctgccacctcatgctccacgctcaagccacaactgagagttgagagaggttatacttcgacccttccctctcagacattctaactgatgattgagctcaaattcaagaattcgccctggctcggtttgaggactgccttagaactaaataccaagtggttgctggcttggtggctggagctggagaggaagaggcaaagaaagaagtctgctggtcaggcccctaggccagctaccggctgaagaacactttaatctgtgctcgaaaaagcatctcggaactccaggatgtgtccacaacctgtctg

SEQ ID NO: 206282 - DNA, 401 bp, Homo sapiens
aacagaaagttaaattactgttctgaggttcttaaattcagagtggagtttgtgcttgaaccaagtataatattacttgatgtacaattgggcagaatagttagaagtttggatgaaattttgtcctcttcctgtttctttttggcttttgttgctctggattttttttttttcttttttcttggacagggtcttgctctgtttcctaggctggagtgcagtagcataatcatagctcactgtaaccttgaactcctgggctcaggtgatcctcccacttcagtgtcctgcggatttatgctgaggtttgtcaatgttggatactattgtccttgtagcctgtgatgtgaggaatagcccaggggcattgtataactttgggaaatggaggtggggagatg

SEQ ID NO: 206283 - DNA, 524 bp, Homo sapiens
tagctggtgctcaaagcgtgcacctgagcctcatgttggttttctgctgtcagtcacttaaaacttacaccatggttttttcctcttgtgaactccagtatttaaggagattggaagctctgaatctctgggtttgcctggaagaagtatgtactttgctttgccagacctgagatgctttacaaatcatcttgtctgcccagttcagtggagtgagattagaataggtctaacatcctttgaaaacataggcccatggtgaggtttgcaggtaactgagatcacagctggctctgaagaaaaaatgcagcctcttgggagtggccagtccaggtacctataattgaggaagtgacctgattggggaggtgacttatttaccctgggcaattaagaagcatttattgaacacctactatgtgccctaggctctgtgctgtggggatgacaagatgcataaggctcaacttctcctcctaaagtatttacagtgggcttgggaaagcaaggcttatgtgtgtaaa

SEQ ID NO: 206284 - DNA, 469 bp, Homo sapiens
gtagcatactcacagttgtgcaactatcactacaatcagttttagcacatttttattgtctccaaaagaaagcctgtatccattaacagaccttccccatctttccctccctactcttaggtgaccattagtcagctttgtgtctctgtggtttgcatattatggtcagttgctataaatggaatcatagaatatgtggctctttgtgactggttcctttcacttagcatagtattttcaaggtttctttatgttgcagcatgtatcaatacttcatttctgtttatagccaaataatattccactgtacagatagaccacattttgcttatccatttgtcaattaatagctactactaattttttaacatgtttgtcctttctcctcccctccatagtagcattcttgatgacagggacccactcgtgacttttttaatatttcccactgggcctactattgtctctt

SEQ ID NO: 206285 - DNA, 367 bp, Homo sapiens
ttgaggggtttcatcagtttgtctttttttcacctactttctcttcagagtgggcctaatctcactgtttttacttgcttatatattttttaaaacctgtattatatttttcacttctagaatttctattatggttgttattgttgttgttatttaaataggtcttttttcctggttctctgttcgggatggggcagccctcttccctgctatcctcattcctgcagccttgacttctgcccttgacctgagtgttaaaccctagccctaagccctgtatgcagtactgctactcctgggactttcttgaaggcgctggtccctgggtgtaactgttatgaatttgttggctaacttccttccagtc

SEQ ID NO: 206286 - DNA, 560 bp, Homo sapiens
tatacaaaggatctagaatcatacaagtgtgtggtttgaccttgggtctgggttgggaatatgggcaaattatttaatctctccaagcctcagtttgcttatctgtaaagtatgagtaataacatctcagatattagtggtggtatgagaattgaaggagaccacacagtggcaggtggttttaaaacatgatttttacaaatgttacccatgactttccaaagcgctctgagattcttaggcttagcagcgtctgaattataaaagctgtatatttatgagcattagcctttcatgcactaatttccttgaccctttgcttgggctgatgcttatacatactgttcctggacttggtcagtgattaaggcccgaggtgaagaagaggtcagccccaactcttccccccttggcttctcagctctgccccatcctgcggctgctactctgaactgttcacacttagtttgcaaatgtgtgtcagaaagccaggtttccaacattatagagaaaaacccgctcatggcatctgctcagcttgctggggcatttgtaagggc

SEQ ID NO: 206287 - DNA, 97 bp, Homo sapiens
aatacaggctactgctgtcctcagattatctttacttggagaatgtttttgtagttgatcattgctgttttcaggaacttctagtaccagtacattc

SEQ ID NO: 206288 - DNA, 274 bp, Homo sapiens
ggagagaacacagcctaactataactaatatgcatatgataaatgtaaacaacacacaaatattaggaaaatatctgaggcaaggtatgtgcactattgaatgtcatctgagaactgaccaatgagattgttccagtgcacttattttaagaacataccaattatgaaaacttaatgagagttctatgaaaatcataacttataaaacatttaagatatgtgaaatgtgtgtataaaataattccatcactgtttcatctttaaccaccaaacc

SEQ ID NO: 206289 - DNA, 256 bp, Homo sapiens
agaaatgttcaaggatcaatggaaagagatgctttcttccgcagcgccctgcaacggtgggaggccacactcaggtgctgccgcccatctttttgccactgcataggaacagacaatgagcagcacctagacaggtggagctgagggttggggagaccagggggccgtcctgacggtgtcggtgaagctgctgtagccagtcatgtgctataactgtttaattacatattaaactccttttctctccattggatta

SEQ ID NO: 206290 - DNA, 303 bp, Homo sapiens
gggctaacatggtgaaaccccatctccactaaaaaatacaaaaaaattagccgggcgtggtggcgggggcctgtagtcccagctccttccgaggctgaggcaggagaatggcgtgaacccgggaggcggagcttgcagtgagcggagatcgcgccactgcacttcagcctcggcgacagagcgagactctgtctcaaaaaaaagaaaatataataactaattcaaggctctgtattctcaaagcatctgtgtcaaaattctcccatttttcaagattcctcaataaactaattggtaactgta

SEQ ID NO: 206291 - DNA, 693 bp, Homo sapiens
tggcaccactacactccaacctggacaacagagtgagaccctatctcaaaaacaaaaacaaaaaacgctatagtttatagacttacattacaaactaataaacacatccgtttatgagactgagttgctagactcagcctctgagggcaggtcttattttcctgaacacatactttggaaaagctactaaagctaatcagactcttattcatgaataagatcctcacaattcagagggaattcaatttaaaccactgaaagtcttatatacgctgtgtaattagctctaacttaacaaggatttatcctatttgctaaaggctttcccctcttctttctgagttatggtattaagctatgtctacataccctaaactcaggactgacaagtgatagtttcagcctgggtgtttcatcctccagagacttgggaacatgctgatactatttagaaaaggccagataatgcttggtgcacggtaggccataaggtccagattctagattgaatctttttacttttcattctgaacacccagtatcagtccatatgccttcacagtaataataaatcaccaaaggaagaatcaattactaagatgtactgaatctggttctataaatgtcttggtgatatggtctttttattaactcagtgcctgctgacagattttacataaagtgtaccgttat

SEQ ID NO: 206292 - DNA, 161 bp, Homo sapiens
aattaaagtttttttgcagtctttttccttgtatcgtcttgcttttttctggttcttctattctgtttgttttcatattggtcatgtaagagtttttccttgagtgtctcttcacccgggggtggaggggtcactttttaaaagtaaggcaccaagggcca

SEQ ID NO: 206293 - DNA, 272 bp, Homo sapiens
aacaaggagcagagagtctaagaaattgggtataattctggggcctgggacttgctatgcactgcagggatgacacacgaaggtgggaacatggccatagtggctgcatccagcccatcttagaggcaaatgggaaaaatggcaaatgaaaatcaggctgggtacagaggaagagtactaataccaccacaggcctcaccttaggtccctgggccactggggatcctcagagatgctatttgccttattttgaaaagctttatgaaaataaa

SEQ ID NO: 206294 - DNA, 271 bp, Homo sapiens
gcagttttcatcagggaaacaagactaagcaaaagcaacttactctaagcaacctctaatttcctattctcttacttgagaagaatctactcaaggataccctcgtagctcaggaacttctttgggtcattgctgaagacaacaaaatatgtgacctattccagtttggagatattcaactatatgccatttcagattccacccttaattctactgcaagtcacttgtggggctaaaatgctatatattcacttgaattaagtctcattaa

SEQ ID NO: 206295 - DNA, 375 bp, Homo sapiens
gcgcaaggaagagagcatgagcttcagcgttcagacctggattcaaagaccagtttctgggccaggcacaatggctcatgcctgtaatcccagcacttttggaagctgaggtgggaggatcacttgaacctagaagtttgagaccagcctgggcaacatagtgagaccccatctctacaaaaaaatagaaaaattagccaggtgtggtggtgcgggcctgtagtcccagctactcctgaggcaggattgcttgagcccaggaggtggaggctatagtgagccaagattgcaccactgcactccagcctgggtgacagagcaagacccccccatctcaaaaacaaattaaaaaataaataaataaataaataaatg

SEQ ID NO: 206296 - DNA, 375 bp, Homo sapiens
tcagatgtttcagattgcatttatacgtttaatatatttgattttttttttaaagaacttcagttgtcctacttaaaaaaaaaactttataaagctcttcaatgaaaaaaagtcttgtgaaaaactactacaagtaaacacagggggaagcactttaggacattggtctggacaaagattttataggtaagacctcaaaagcacaggtaacaaaagcaaatttagacagattggattgtatcaaactaaaaaccttccgcacagcaaaggaaacaatcaacagtgaagagacagtctacagaatgggagaaaatatatgcaaaatactcattcaacaagggattactattcagtatatacaaagaattcaacagc

SEQ ID NO: 206297 - DNA, 793 bp, Homo sapiens
tacaagtgggaggttgggtgacgattgctcctgggccagaaaatctaagccagtctcagcaagacctacaaggccagggccagtgctcctcagaggatattcatgctccaggaaagccaaggatgggcctccgtcatgctgagatgccgcagcagggacacctgtgtcccacgtggagctcggcttctagctgcagtcagtgcagaagctggcaggaggggtttatttctgtcctcggaagcttttggtaaggacacttcattcctgtgtcttggacacctccccctaggtctgctgccccctctgtggagacaggcagggcagctggatgtgccgtttgttcccagactatatccatgccaaagcatcccaagggcaggaaatgtgtccccgggggccagtgggggtctgggggcacagagggctgcagagtgagagctggctctcctctctgcaacttggacaaggctctgggaccctgtcctccccagcttcctcacctgcatggcaggatactggccaagtgtggctttcgaaccacaggagagggtgcagtcaaggcctcactcagggaccgcaggttctcttcccttcccagtccttccctggcactgcctaggtggctccctggccaggggccagtggtctagccagcaggccttataacctccccaccagagaggcagctgcagttgaacctgttgatctgatgctgagggccctgccagctcactgcagagtggccagttctggccagttttgctaggccaggcccatttggggtgaggagagg

SEQ ID NO: 206298 - DNA, 561 bp, Homo sapiens
aaatagaatatggtccttttcctcaagaattttatactttagtggcaaagagaaatatatgaagacatgattataattcactgtaatatgaattttactagaggcatatgtccggtgcaagcatgggaatgaagaaggagtgtcaactacatgtgaggcatcaaagaagtttccccaggagacagcacttgggcccatcttgatagatgagtacaaattagcaagtgagcaaggctaggggatataatagcctgtgcaaaggtttagggcatgatcaagcgacatgcagaaagtccaaatatgtttaaatggttaaagcaagtagtgcaagcagaaggcatagagtaaagggaatatggacagaacaaagaggcaagagatggaacccatcacattgcctgtggagggctttttatgacatacaatgaactatgaattgcaacctgtaggcaaaggagagtcattgaagattcccatgtaaggaaatgatacactcagattttagaacctaccagctttttagaattattctggcagcagtattaagggagtactgaaggg

SEQ ID NO: 206299 - DNA, 427 bp, Homo sapiens
aaggattcttcctgggcattttgactccatcctattaacgcaggcatccctgagacccacatagtgctaatttgcttactaccagcagacctacactatttctgaacaacagaaaaagcaagaccagcaactgaagtagtcagtgaccaaactttaaagttcttagagaaagagggagacaatgcactacttttccctactgattgaaaattagtaagagttaatagggagaggtggttgagtgagcatctcctgatttttaaaacatggtacaaaggatcctgcatccaagatagctaggcaggtgagcgtacctcatgtaggtgtgtttagagctcaggcaggatgaagcaggatgaggaggacttatctcatgaaattacaaggtgacttagactgggctggggtgggcagggataggagctca

SEQ ID NO: 206300 - DNA, 728 bp, Homo sapiens
tttggctttgcaagatacaagttagtttttcaaagtaggcacataagaaaacattcccaacagactctggtggaaaaaaaatatatatatacacatatatttgcttaaaaaatgaattatttgtattcaaaaggagaagaaactttcttctggcatttttggaggtgatctctgcacacgctggctccattttgccttccatcatgagtagaagcagcccaaggccttcaccacatttcctatcttgaaccttccagcaagaagaatcatgaaccaaataaactgcttttctttataaactattcagcttcatgtattcctttacagcaacactaaatggactaagacaaattgataaagaaaatgtgatatctatacatctctctgtctataaagataagataccaattacaatggaacattgttcagccataaaaagaagaaaattctggaatttcagatgtcatggatgaatctggaggaaattatgcaaagaaaaataagctagacacagaaagacaaatactatataatctcacttatacgtggaatctgaaaagttgaactcggaagcagagactgaatggtagttgccaggggctgggagcagggagaagagaattgaaagaaggaaacgggagatattggtcaaagagacaaacattcagttataaggtgaataagttctggagatctaatatatatagcatggtaacgatcattaatta

SEQ ID NO: 206301 - DNA, 406 bp, Homo sapiens
tgagatatgtagaatgtgaacacagcccacgctggtgtgagctgtagggtatggcagggcctcaggtggcagccaaatttgtaatgggcaaggcagtgaagagaaaaatcaaaagaaaaggctaagatgtagccaagtatggcctaggaagggatcagtgactggggcgtgactagaacataatacagaatggagataagtgaaggcaaaaatggatgacaagggaggtttgtacttttatttaaaagactgcagaaaaaccaggaatgagcctcatggatgcttcatttctgaaatcccatgcttaacattcatcactgtctcccatacatgattcgtcttcactctaaactgcctcctgtctctgtagatagtgccattaacatccaagttacccaggcttgaa

SEQ ID NO: 206302 - DNA, 729 bp, Homo sapiens
gtgaaccgctgcacctgtctggcatgtgtgatacatgcgtgaaattatactgtgtatattacacacatatgaatgaaattatactatgtgtattataattgtggcttacattttttcacttaacagtttgttttggagatcttttcatgtcaatatatataaatctacctcattctttataactgttttcatagtaaggacaggccatagtttatttgattgacctaataatgaaattagaaatggagatttctaggttttttttttctgtagcaaacaatgctgcaaggaataccctgcacatgtttgtgtacatctctttgtacatgtttcaataaatacccagaggtagaattttaattctgtatgttatcatggggccttcagtataatggaatttcccttgtctacactgctctctctgacctgggaaaatgcagtaaatatcttctagataatttagatttctgtagttgtctaaaatgagtcttatgttcttattttggagatttgtgattattcagtttggtgcagaatgaaacgtagaagtacatggtggtatcatcaacttggcatgtagctagctgcctttgcctagatggtaagaaataatagaaccataaaggctttggggtaatccattcaggtaggaaacgcaaatttatattactaaaattttatctcttggcccctctgtgagttttgagtgttttttcttaagggaatatt

SEQ ID NO: 206303 - DNA, 205 bp, Homo sapiens
ccatgattcaatcacctcccatcaggctccacccctgaaatgtggggattacaattctagatgagatttgcatggggacacagggccaaagcatattggtcttccaggtttattcattttgttgcagatgacagaatttccctctcttaatgctgaataatattccattgtatatatataccaccttttctttattcattcatct

SEQ ID NO: 206304 - DNA, 632 bp, Homo sapiens
aataacaacagcaaaacaaatgaataaaactcattatattcatttgcttttatttatttatatttaactttattattattattattattttgagacagagtctcattctatcacccaggctggagtgcaatgaggcaatctcgcctcatgcaacctccatctcccgggttcaagcaattctcctgtctcctccaggtagctggggttacaggtgtgcagcaccacacctggctaatttttttatttttagtggagattgggtttcatcatgttggccaggctgatctcgaaagcctgacctcaagtgatccgcccaccttaggctcccaaagtgtggggagccaccgtcccggcgtattattacttttagagacgaggtcttgctttgttttccaggctggagtacagtggctcaatcatagctcactgcagcctcaaactcctggccttaagcaatcctcctacttcagcctcccaaagtgctgagattataggtgtgagccactgcacctggcctctctattctctacttcctctttctagaatttctattaggcggatgttgaatctcctgaattaatctctaattttcttcccttccctttcccttctccttcccttcccttcccctt

SEQ ID NO: 206305 - DNA, 368 bp, Homo sapiens
  misc_feature (264)..(264): n is a, c, g, or t
taccttcagaggagcaataaagctggcagctgactctctaaaacaaatagttggaatggtggagtggctttttttaaatgctgaaaggaaataattaccaatctagatttatatacccagtgagaagattcctcaaaagtgaggatgaacttaagtttttggacaaaacaaaaaattgcagaaatttgtcaccagccaaccagccctaaaatatatcctggagggaattctccaggtggacacttgatgtggaaggacaaggantactcctgaaaggagcagaaacggaaagctaaataaataatagactgcctaaaactatctcttagagttcaaaatacaggtagacttaagatacatggacagta

SEQ ID NO: 206306 - DNA, 481 bp, Homo sapiens
cagaatatttgtatatcaaatcatattcatgttacatgatacttgaataggaaaatccctgacattcccaatattcattatgaaaagcattctgcttttgttcctggtacctaagttgtttacataatgcataagaatttgaccaaatggagagccaagggcagggccttagcacccttgctgagtgtgacatgtctcagaggttgttcatataatgtgtctttgaaactcccattttttctttttttctggaccaaagtatattcctaactaggtgtttccccagtcatcctactcacagggctcaaaaagaaaaggaatttgtttcctgagttggcatgatggtttctgaagctgtttctgaaattctgaccatagcaacaggaaattgaaggcaagatactagaaataagcacaaattagatacaactgtttagggcagatgttgacttaaaagaatatcttttttgggtcaaatgca

SEQ ID NO: 206307 - DNA, 362 bp, Homo sapiens
tctgaaggctgcatctgtcggttagaggggtgcttggtgaggggcttgtcctggagggaggctgtaaggatcaagccctgggagggattgtggctctgggggtagttaggggcgtgacctcagagcacagcgtgagaagctcagggctgagaactgggagccagcccggaggtggctcaggggttttgggaggttatagtatatacagtcttagaaacattgagttcatttatggggtcagagaaactcccaaggaatagatctttctgggggtgccaagaatctgggggcttcttccatggagatgatttgagagctattcagggtttctgagaggggctcagggagttgcagcggagaaa

SEQ ID NO: 206308 - DNA, 606 bp, Homo sapiens
tgcaggtccacaccaaggcccagccatcccagttagcctgtcttaactaacataaaacaccaagttaaaaacccctggtttgtaagaagatagtaaaaagcttagtggttgccaggggttggaggaagggaggaatagataggtggagcttagagaatttttagggcagtgaaactaccatttttaatactataatggtagatacacatctttatacatttgtcaaaacccataaagtgtacagaaccaagactgaatcctaatgtagactatggactttgggtggtaatgatgagtcaatgtaggtttgtaggttcaagaattctaacaaatgttccactgtggtactggatgttgataatggggtggctgtgtgtctgtgtggagagggggtacataggaactctctgtactttctgcttaattttgctgtgaactaaaaccgctttagaaaatgaaatctactgaaaacaaaaacaaaaacaaaaaacacaacaaaaccctggtttacacatttataattaatttttttttttttgtagagatgggggtctcactatgttgcccagactagtctcaaactcgtgggctcaagtgatgctccca

SEQ ID NO: 206309 - DNA, 616 bp, Homo sapiens
atgaccactcagagtagataccagctgcagccaggggaaataaccaacacccgcctcattcctctcccagttcctttcccagcagcagtgtggaggggagaaacacagcctcccctactccaggtttcaagcaatacagagtacactttttaaagctctcccctaaaactgaccactgcaccagatcaccacatctgcatcagatgtgatacaggtcactgcttaaaatgctcagctctcctaaaaccactgcatgaacagccaaagccaaagcaatgaggacctaagggaagctaaaatcattatgcaaaagcctgaacactatatattcaattgaatgctttctttgcaaaaacataagctcaggacctggaatggagtggcagccatagctgcttcctggaagttaaaggagatttttcaaagatgctccccagtgttaggcagattcatttaacacataagcgtatttaccaaacacctgccataggcaaaacattacgttgtacctattgaggaagaagatggatattttaacttgttttttgaatcaaaaaattccctgttcccaaaaatgacctgaggccatttccaaggatgaagaagaaaaccctgt

SEQ ID NO: 206310 - DNA, 606 bp, Homo sapiens
tgaggatcgcttgaggtcaggagttcgagacaagcctggctaacatggtgaaaccccctctcaactaaaaatacaaaaattagctgggtgtggtggcaggcacctgtaatcccacctacccgggaggttgaggcaggataatcgcttgaacccaggaggtagatgttgcgtgagccaccctgcctggccagccgtagcaatctttactggttaccttgctgtgcagtttgtcaagatgttccaggctcttacacatttcatgccaaaggactggagtcaaccagttcttttaaatccttaggctactttatggggaaatggtattttgtggaccactgcctagacacaagtagtatttgtgtctactggttttgtcattgtttctaagcttttttagacagagctgtttagtttttatgttttaagacaaaaatgtaggtttgtactgatgcttacaatttaaattcaggctgtatggttttcctttcttctgcctcatgtctgtttctcctttttcccatatgaaaatctcggaagttgcagtgagccaagatcgcgccactgaactccagcctaggcaacaagagcaaaactccatctacaaaa

SEQ ID NO: 206311 - DNA, 558 bp, Homo sapiens
cacataagctaggcacttggcccagtgatatgtcatagtcacccatttgagaagggaacagcgaagagaagagagtcacatcacctctctggtggacacagagatatctcacaatgctctctgtaggcagggccagggcacaagagttatataactcgggtgttagaccaagcaacatgtcacaatggctgatatgggccagacacagacaagggagtcacatatttgggtgtagggctcagttatatgttgaaatgccccctgtgggcagcgacaaagcaggagagaagattcacatcacctggatataaggcccggtgatacgttacaattcccctgtgagcagcgctaaagcagaagaatagggtaatatcacctaggggctgagtccagtgatatgtcacaattccatctgggctgggcccaggcagatgtgtcaaatcatgaaggttctgtgaaggtgcatatatcacaatcacacctgcaggaaggtccaataatgagattaacaatctcacacaggtccgggttctaggtatgagagtcaacacctgtgtg

SEQ ID NO: 206312 - DNA, 269 bp, Homo sapiens
aggccaactggttgggatgttaagttgaacaacaattccctgagttcttttgtttggtgccacggttcatgcagtctgggttgtaaatgctataatgtgcactccccccaacacacacttaggagtcttacaatctagtcacagaaaaatgacaataacaatgcatagaatatgatcaatatgtagactctagatgatatggtatataaggtattactattattaataatgatagtagcagctgctatttatctagtgcccactagatt

SEQ ID NO: 206313 - DNA, 706 bp, Homo sapiens
taaggtaataatcttgctcctatagatcagtctaattacatttagtcaggtggatttatttgatcacctcttaaaaatggcatcttcctggcaaactagaattctgttctgtgcatctgctgagttgacattcagtgtctgctggtaatggaaatagagtaattcttagttactgtagtcttcagctaatcatttccttcataaagtttaaactgactggaatttttcagcaacgtggatggatttggactggaagcagaagcccgcatgaccacatggcacattatgatcccctcggacattgaaccagatggtagttacagccaagatattagtgaagggcgtcagcttctcataaaagctgtcaacagagtttggactgaactgatacatagtaagaaacaagtcttagaggaacttttcaaagtaactctacctgtgaatgaaaggggccacgtggacatagctacagcaaggccactcattgaagaagctgccctgaagtgctggcagaatcatttggcccatgaaaagaaatgcataagtcgaggagaagctttagcgcccaccacacagtccaaattatcccgtgtcagcagtggctttggtctttccaagttaacaggatcaagaaggaatcgaaaagaaagtggtcttaataaacacagtctttccacccaggtacttttttagtttcattgctgat

SEQ ID NO: 206314 - DNA, 407 bp, Homo sapiens
ggctgccagagagaatgggtgagaaggtaaggattcaagagtctacgaacgacagatacacttatttttaaaccagaaacccacttctgggaatctttcctaaatacacactgataacatggacaagattattctttgcagcatcattcatgataggaaaagattggaaacaagcaagtatccatcaataggaaactagtacatacacacagtgggatatatggagttttaaaaagaacatgaggaatctctatatccttctagggaaagatctctttagggaaaagagaatgcacaatgcagtatggtgtttataatacgcctctttttgtgtaagagggagtaagaaatgagaatgtaggcttatttttatataaaaaacaccaaagggtacacaagaatgaaac

SEQ ID NO: 206315 - DNA, 820 bp, Homo sapiens
ggggatttgtgatgttttggtttccatggagctgccctctgggagcacgaggggtacaattggaacgaaggcggcgcacagttaactggaactctgcagccgtccaagcccaaagaaggtggggagcttgggaaagaagttcctcataatcggagcaggaggagcccgcccagcctcgctcaaaggaggagacgagactctgagggacaatttagaagtgtgtcctcaatttaagacacctaaatagggaactgtggggctgtgggccttaggagagaaaaggagagccccagagagagcacccctatgctgcggaagagggactaaagaagatggcagtccttccaggagggattggacagatattcaggcgtccggtggcctgcaggcccccatcagagtgggctgcaattggcccagacctgcttcctactttgttttctccggtttcacccccagcttctctcgcaagcaaccacctggtgattcctgacgaggcctgacttccggaaggcaagccacgccctccgggctcccctgcctctctttggctccagcttggcatgtataggagctgcccaaggaatgacagacttcttgttcttgaggtgttggcaaagcttcctgcactgctgacctatccaagtcctgccttgtagctgctcttgggcataggttactcttggctctgccaaccacccgtacaggactaattgcagttttacctcaacgtgcgctttttacaattaaaaactgacttaatggcttctatttccctgcctcaacaaaaaaaatttactctctctgaacccaaatctgg

SEQ ID NO: 206316 - DNA, 461 bp, Homo sapiens
ggttctgctccctgctgcattttcttattttctgtaccttcttgaacctcaggtccctctctgtaaaaagaggaattagaataatagctaaaatttctcacttgtttcttaaggaagttaggaatacatcttaataaatcaagaagttcaaacacatcatccatagcaacttgaagtagactcctattctgtttaaccatgccttttgagagtcaaaatccagggatgctccctacagccagtcttgaagaacagaaggggaactacatgccaccaggctatgggagctgtttcagcagcagatcattacctaatctcttcctgtctccccggtagagctgaacagagcctgtgagagaaaattccggatgttaagggaaggagaaagaggtataggtgtagggactaaaagttgatgtggtatcattcctatgaaaaaaataatcagattcatttttata

SEQ ID NO: 206317 - DNA, 180 bp, Homo sapiens
ttccctaacttttggtgcatggttaagctgaagcctaattgttcattgttcttctaagcacagcctttggttgaccctcctggaaataataagcaggtgttccacaaacacgcacttgggcaattatgtgatgtgtatctactaaccagcacatttcaatgttctcatacagaggcataa

SEQ ID NO: 206318 - DNA, 442 bp, Homo sapiens
ttcattcccccaaaaagaaacccattactcattaggagtcactccctacttcctacctgagcccctccccacaactcctggccctaggtaaccactactttactttctgtccctacagatttgctcattctggacatttcatataaatggtatcatatgatgtatcagaccatcaattttaataatatgtgaactgtctccaaatagaattctagtaatcctcacattctgtgagatgttctgtaagaccttgcaaccttcagtgagggcctgggatagtctgatttagtagtctaggtggtggcccaggaatctgcatttgaagttcctgatattgttctgatgatcacacagcgttagaaactactgctgtaccacctaagttttttttttttttttttttttttggaaaaaaagtcgggcccggtggccagggtttgat

SEQ ID NO: 206319 - DNA, 199 bp, Homo sapiens
tcgtccattctacgctgcactgtctgatttagtagtctaggtggtggcccaggaatctgcatttgaagttcctgatattgttctgatgatcacacagcgttagaaactactgctgtaccacctaagttttttttttttttttttttttttgagacagagtcttgctctgttgcccaggcttgagtgcagtggtgtcatc

SEQ ID NO: 206320 - DNA, 273 bp, Homo sapiens
gctgtgactacccatttggaatttcaccctgaacactctagccttgagaaatgtgtgtccatgaccgaatatacaaattgattcttttttccatgttcataatttgtcaaaaagcataaagatacataacctaatatccctttgaccgcctataaacaggagaaaacaaaacccatggtcttaagaatctcttccacgtcataattggtctaatcgtggcatcttacactattgcctgactgggtagtcacagcagcaagtgggaagcaggtg

SEQ ID NO: 206321 - DNA, 1158 bp, Homo sapiens
tggtcacaggtaccaggggcagcagtgaaggggtggctctaatgccaagtccagtgaccagtgccagggtgcccagtggtggcaacagtggtgttttcagtgtgatcttggacattgctcctgtctactcagctgctagtctgtgagctccctgatatcctttaagacagcgttttccagcagcggcactattaacgtttggggctaggtaatcgttgggtgtgtgagtgtgaagagggctgtcctgtgtgttgtaggctattttagcagcatcccggcctctccctgccaggtgcctgtagcagtcccccagttacgacaaccaaaaatgtgtccagacattgccagatgtccactgggagggaaaacctctctggtccacagcccttctccttattccagtcccacatcttcctccccttccccatcactgtcctcagagagatgctgttgacagctccttgaggtgattctctcaggcttgtgttgtagttctctgctgtcaagtctgagctgactctctcttccggattcttctttcctcacctgcgaccgacctggattcgcgactgaagttttttatggagctgtttctattttctttttgggcagccatactctctaagacctaaaagctgaatactcgcccggttactacctgataattctcatcgcttatgtttccaaaaccaaactggttatttccctctctaaccccatctctgtgtcaaacagtggagtacatgcttttggttaatccaattggaaggcttcctagaggaagtaatatctgaactgaatcctgaaagattaggggaagaggaagaaaaggacaggtgctgtgggaaaaaggggaaagtgtcagaggaagtaaatgaaaaaccatatacaaaattatcttctgtgacccgtagcacatgcccaatccatggtagatatcgaaacatagtggttacccagtctaatccatcccttttctttctttctttcttttttttctttttttttgagacaagtctcactttgttgcctgcctggagtgcagtggtgcgatctcggctcactgcaacccccgcctcccgggttcaagtgattcttctgcctcagcctcctgagtagctaggactacaggtgcttgccaccatgaccagctaattt

SEQ ID NO: 206322 - DNA, 215 bp, Homo sapiens
agatgtgggggtatcccaaaatggaatacaaactatcaaatgttactagtctaacgtatgagtgacattaccacactgacacagatggagaacagaactaacctaagtaacttttagaagtcagtattttgattggattctactaaaatgaaagaaaaaaactattgtacctagttgctatgtgctatttaataaatgtgtttctcacaggggta

SEQ ID NO: 206323 - DNA, 560 bp, Homo sapiens
ataggagctgtcattcattgccggtagagatgcaacatggtacagccactgtggaagacaggtcagtggtttcttataaaactaaacatactatacaattcagcaatcgcactcattggcatcaatacaaaggagcagctttattcacaattacaaaaacatggaagtaaccagtatttccttcagtaggtgaatgtataaacagcagtacatccagacaatggaagattattcagtgctaaaaagaaatgagctatcaaacaatgaaaaaacatggagacaacttaaatgcatataaatatgtgaaagaagctaatctgaaaagactgcatactgtatggttctaactatatgacattctagaaaaggcaaaaacagacagtaaaaagatcagtggttactaggagttaatgaggagggagggattaactggtgaagcacagaggatttttaagtcagtgaaactactctgtccatactccagtggtggatacatgccactatacatttgttcaaatctgcagaatgtacatcaaaaataaatcctaatctcaactatg

SEQ ID NO: 206324 - DNA, 383 bp, Homo sapiens
tcaaactgtgtcttactgctctctgtattcatcacaggacatggtaaatgcctagtgaataaatagtttctgaatgaagtcttaggaactgtagtatcagagacagaggtctagatgttggggcctgaaaactggctggcatgatacaccactagtttaactgaagtggttttgttaccataaactcatgtcactcccatatgcggttgatggaatgtagtatctttcatactgatgggaaagatccatcagtatcttttccaacttgccaatgggagttacaatatgattgtaactagatacagactggaatctgtgtagtagttacacattgagttagaggccaaattattcaaaatattacgctaagagaaaaatttaaa

SEQ ID NO: 206325 - DNA, 419 bp, Homo sapiens
gctggcaaggcaacatcgtaactttttccctaattacagaagcatactcctggtataaaattcggaaaatataaaccagacaaaattaatgaaataaatatctatttaatattttggaatatttccttccaaacattacaaaacttgaaattaaactctatattcagttgtgcatcccatttttttcacttaatattaaaagcactttttcatgttgttaaatcgttttttaaaacatgacttctaaagcttacacagtatttcatagtatgatgttccattaatttattcccccattgtcagatattttcactatttttgttttgttttgagacagtcttgctctgtcgcccaggctggagtgcagggcaccatgtctgggtaattttttgtaattttagtagagatggggtttcacc

SEQ ID NO: 206326 - DNA, 449 bp, Homo sapiens
attacccttgtttattgtatacaataaagagaaagagttacatattgatatagataaaggttagatacagacatctccctatttaaacctatcctttatgcactgaaatcttcctcccgcactgaaggttaactactccactgattatggcacccttaataaatatcggactctgtacttctagaaagaccattgaaaaatactagatctcctctaaggacccagtttccctatgactgacatctaatggcagaatgcttagggaaggggtggatcataatgggttttctatgccatgaaaagtcgttttgattttgtcttgacagtagtgagaaacactgaagaattattacagttgaaagtcttggtggagagaaaggtagaattgtgagattaagtgtagagaaaccaagttgtatgaattcaagaaaaaaaaaaattagatcacc

SEQ ID NO: 206327 - DNA, 477 bp, Homo sapiens
tgaagaaatccagagttcagcagcccagggctggtatggtcagtcttaagcatcagtatggtcagccttagtgcatggcatgatcccccactgctccacaccaagatggctgctggagtgccaggcgtcacatctgtgtttccaggcagagaaaaagaggaaagggtaaggacaaaaaggcagacctcttgtcaagtcaacccccttatgcccttatgcctagtgtttcattattggaacgctaagcatgtgggagttatagcctactgctcaaggacattgccagggtctgaatttttacttgtggaaaaattcaaaaaattgcagcctccggcataaatgcgttaaagagctttctcagaagcccggtccaactacttgcacttagtggccacacctgtgtgcaaaagaggctgggaaacgcaggtttttagctagacaaagtttttcttttccaagaatagagggcttttctta

SEQ ID NO: 206328 - DNA, 766 bp, Homo sapiens
gtccacccagccttgacaatgagccatatctaaaatattacattattagaacacctaccaaaatctcgaaagcacaggttgatgtccttagtattgctatgtatgaagttactaaaactggagaaaattctacttcagaaataagtactgtttaggttttatattaaaagttcagaccagcatatcaaagggtgctccttagtgaaatgatttagaattgttgcattccaaaagcaggttttctctttaatttttacatctctctctcaaaatattatacttcatgaaaaagacaattgatgtggatgacaacaacaaagtcttgaaattaagggcacactaattgtccttactggggttaggggaagagagatattattttcaaggaacaaaatattttcctttacaatctttcattcatgagaaaattggaatataaatttattacattgtgaaagtatcataaaccatatacctttgtatctaaatgcagcttcaaaaaagtaaataattgaagttttatttctcctctaaataacttgaatttttttctttaaaaatttatgtatttatatgtccccatttagttaagtggtagtgtaaatgtatgttgttaaaaacagtttctcagaattatagtaagcaatgaaagacaatatctaattaggttgttatcaaaaatactgtgtgtaaattagtccgtaatatagggtttggtgcgtatctatattcatgcttctatttcactcttcctcaaaacagtttt

SEQ ID NO: 206329 - DNA, 351 bp, Homo sapiens
taaacgttgagaatattatgtcaactgaaataagatagtaataaagtgacagatactatatgattccatgatatgagtcatcataagtagtcaaatagaaacagaaaggagaatggtgttactcaaggtctaaagagagggtaaaatgggcagttgttacttaatgggtattgttttaattttagaagacgtaaaagttctagagatctttacataacaatgtaaatactcttaacgactacaatgtacaacttttttgaggtaggttctcactctgtcctgcaggctagaatgaagtcacataatcatagctcactgcagcctcaacctcccatgcacaagtgattctcc

SEQ ID NO: 206330 - DNA, 343 bp, Homo sapiens
gctacaaatgtcgatctcacagaagtagagagctgaatggtggttatcaggggctggggcaaaggagtgaagggggaagtattggtccacggacacaaagctcctgctagacaggagaaatgagttcaagagatctattgtgcatcatggtgactaccgttaataatatttcatattcttaaaaattgctaagatagtgaatgaagtgttctcattacaaaaattaaaactaggtgatgtaatgcacgttaattagctagatatagtcatttcacaatgtgtatatgctccaaaatattatgttgtacataacaaatacatacaattttatccgtcaatgtaa

SEQ ID NO: 206331 - DNA, 969 bp, Homo sapiens
gagatggtcaccagggagtgtccaggtcagaccgccacagaagagtgcagcctcctggccttcagacccaactgggacaaaccctgagaacagccttggcagacctccaggggcagctggactccctgaggctggatgttgcagcctctcccaggcatccactctgcagctgaggccaaagtttccaacgggaagggagggagagtctccgagtctgggccttgccactcctcactcagcatctgaccatccccacctcctggatctacagggttcatagaggaggacccagaagagggaaagtcaggctgaggaacttggcctccctgctgcaagggaaatgacatcggttaccaaggaggtgaccagctatccttttccaagactgaaaagcagaaatacggccctgaggctagagggtctaagagaacaataggaagaatttcctgacaaaggacaatgttgcctaaaggactcaggaagctctgtgaaaacaggagactcccgagcagagcaccagacccttctccaccaggcagtgtttttcccatatgacaggtgagaaaactgaggctgagagacatgtaataacttgctgaagcagcaaccagcacaccatatagctgaaatctgtagatcagcagttaaaagtggtagggcaagtcctctctgactttcagcgctaagagcctaggattctgtgtttttctgcttaagcctgggaatcagagtcctacaaaagccgcgcctaatcctgggggtgtgggctttaaacccagagagaaagcatgttattggaatactcctgcacttttctccctttgaatcccaccacggaaagaaaattctgtgacgtgtacccagtatttattggagggtatttcctagcaagaaaatgagggcgattgaccaggcacggtggctcacgcctgtaatcccagcactttgggaggtcaaggtgagtggatc

SEQ ID NO: 206332 - DNA, 828 bp, Homo sapiens
tcacccagctgttatgccgcttctgcctgcaagatgagaaagacacctccccttcccaggagagtctccgagtctgggccttgccactcctcactcagcatctgaccatccccacctcctggatctacagggttcatagaggaggacccagaagagggaaagtcaggctgaggaacttggcctccctgctgcaagggaaatgacatcggttaccaaggaggtgaccagctatccttttccaagactgaaaagcagaaatacggccctgaggctagagggtctaagagaacaataggaagaatttcctgacaaaggacaatgttgcctaaaggactcaggaagctctgtgaaaacaggagactcccgagcagagcaccagacccttctccaccaggcagtgtttttcccatatgacaggtgagaaaactgaggctgagagacatgtaataacttgctgaagcagcaaccagcacaccatatagctgaaatctgtagatcagcagttaaaagtggtagggcaagtcctctctgactttcagcgctaagagcctaggattctgtgtttttctgcttaagcctgggaatcagagtcctacaaaagccgcgcctaatcctgggggtgtgggctttaaacccagagagaaagcatgttattggaatactcctgcacttttctccctttgaatcccaccacggaaagaaaattctgtgacgtgtacccagtatttattggagggtatttcctagcaagaaaatgagggcgattgaccaggcacggtggctcacgcctgtaatcccagcactttgggaggtcaaggtgagtggatc

SEQ ID NO: 206333 - DNA, 693 bp, Homo sapiens
aagaaactgaaagctaaccagacgcccattgccatggattgctgtgcctctcgcagctgcagtgtccccactgggcctgccaccaccatctgctcctccgacaaatcctgccgctgtggagtctgcctgcccagcacctgcccacacacagtttggttactggagcccatctgctgtgacaactgtcccccaccctgccacattcctcagccctgcgtgcccacctgcttcctgctcaactcctgccagccaactccgggcctggagaccctcaacctcaccaccttcactcagccctgctgtgagccctgcctcccaagaggctgctgatggatggctactttgctcagtgcccgacaacgaagaatccagaagctgtcccttcagtattcacttgcctcagtagtttgccagatgttaaggtagaccagatgacccagatatgaagaacttacctttggttttaatgggggaaaaaaaagaaaagtattttttatggttatttagctgaaaaaccatttggttcctgtgggcaggtgaatgagttttattagcaaaatactgtttcaatctttaagacctcagattacatgttcttgatcatattgcttcctggctcttgtttcttgtactgggtattttcatagaagaaaatttcttggtgggttttccaataaactatatttctctggc

SEQ ID NO: 206334 - DNA, 573 bp, Homo sapiens
atgtgcagggagccctgtggcagcaggggacagttaacccagggagcttagagtctacgccctcctggcttggaatggtgggcctggagctgtggtggagatgggctgaagaggaagtgatatttacaaagaaagaaggtgaacctaaatctgggctgtcccaagcttgtgctatccagtgaaaacatgaaaaccaaaggaggaagcgaatgaggagtggtaacgggaccaagcatccggggatgttcaaccccacgtgctcgagtctggttgaggcctggaccacacccgtccactgacactatcccccacccccactcccactcccaccgtggaagatttctgagaatcacaacattgtcaataacggctccccagaaaatctccttgaatagaacggaattcctctctgatggttcacaaggcacaggaaggtcttttctgcacttggagaaggggagcaggagctcatctgacagtatgctgggtgactgagggctgactgcctgatggcaaatcctccctgcctgggaccccagttccacagccccacagcactggggctcctgccta

SEQ ID NO: 206335 - DNA, 691 bp, Homo sapiens
aggtgccctagaggattcctaaatgagttggaattcaggccaaaaggcattaaataagaccaagaagaacactttataatgataaaagatgtatgtaattcacaattaagttttatctatacaacaaataacacaacagtaatatacagaaagctggaatcctagtagctattaggagaaatgcaacacatcgggagtcacacctttaatccacctgtcaggccatgacatctgggcaagaggccaaaaatgtaagaaaatagatctgaatcattatttaatcatgtaaacctgatcaatacatttactgactatataattagagacaaagtaaacttcaaaaattccaaaaaaaaaaccagacagtattctctaatcaaaatgcaataaaaatataaattattgacaaagccacaaaacaaaacaaaaagcccctctacctggaaattttgaaattccttgggtcacaaaggaaataaaactaaaattaccacatgtcagaactaacagatggctgggcacagcggctcatgcctgtaatccctgcactttcggaggccaaagcaggaggagctgcttgagcccaggagttcaagactagcctggtcaatataacaagacctcgaccctaccaaaaaaaaaaaattaattaatgtaaaaattagccagacatggtggttcatgcctgtgg

SEQ ID NO: 206336 - DNA, 882 bp, Homo sapiens
aacagaaaaataattctttttacatgatggaaacaatgtaatagaaacattgaagtctgaaaatcaaatgggttcatagagttccaatctatattgaggaaaatacacctacacacacacacaatttatacacatacatatttacacacacacacacacagacaacatgggatcttcctgagtatacaacaactagtctacattttccagtcttctttgtaagtagatgtagccacagatgaataatttttgctaataaattctgaaaggtatgccacttgcatacctgggccatggaaaattatgaaagctcttcatgttctctttttacacgcacggtagatggaatggaagccactcctaaggcaactttgtaaagcacacttgagctggtagaagaatcgtcagatgtgatgacaagctacagggaaaactgcctgctgccttgttcacctgccgcaaagatagagcatatttgtcatatgcttcaactggctggctagaagtgaaatggggagttggactggaaaactcgcagcacaaacctcacaaatgcagtgagtgcagtcttctttcatccagcgctcctcggccttccttggaacccctctaacatctgtacaccctgcctgcctcaggcgtgcctccagcttgtttatctgaaaggggaggcaaaggaaagaagagtggaaattgaagcggatagcaacaaagccaatcaataacatggtttgatgaaatgctctattctgtaagcacacacctagaaggcaaaagaaacttcaaagcctacataatttttcattttcccccaggacttaatgagcttgaatcatccagtatccaaacaaataaacagttctgtaggtgttaaaaaataaa

SEQ ID NO: 206337 - DNA, 513 bp, Homo sapiens
aacagaaaaataattctttttacatgatggaaacaatgtaatagaaacattgaagtctgaaaatcaaatgggttcatagagttccaatctatattgaggaaaatacacctacacacacacacaatttatacacatacatatttacacacacacacacacagacaacatgggatcttcctgagtatacaacaactagtctacattttccagtcttctttgtaagtagatgtagccacagatgaataatttttgctaataaattctgaaaggtatgccacttgcatacctgggccatggaaaattatgaaagctcttcatgttctctttttacacgcacggtagatggaatggaagccactcctaaggcaactttgtaaagcacacttgagctggtagaagaatcgtcagatgtgatgacaagctacagggaaaactgcctgctgccttgttcacctaaaatccctccccccgtctccctataacggagctaaaggcgtaggctgcgctccttct

SEQ ID NO: 206338 - DNA, 534 bp, Homo sapiens
aaggcaaattaaaaacttaagataatagagactggggtaaggaggagaaaagaggacaccaagtacttcctatacactaagcactaggacaagagttggttatgtgtaacagcacatgccagcctcccaataactctcttactgttaattctcatgacctatccccttctctgacactcagcggtgaaataaccagatcaaggtcagacagctagcaaaagacagagccaggtctaaaaaagcaaactaaataaaacccaaggccgggtgtggtggctcacacctgtaatcccagaactttgggaggccaagacaggcagatcacgaggtcaggagtttaagaccagcctgaccaacatggtgaaaccggtctctactaaaaatacaaaaattagccgggcatggtggtgtgcacctgtaatcccagctactcaggaggctgaggcaggagaatcgcttgaacccgggaggcagaggttgcagtgagccaagatcatgccactgcactccagcctgggctacagggcaagactg

SEQ ID NO: 206339 - DNA, 447 bp, Homo sapiens
cctgcctcgacctcccaaagtgttgggattataggcgtgagctactgcgcccagccgcctgtgttcttttaaaaggtcgtcttccttcctgcccttcatcacttgccctccatggcccttcatggcccctctgcttccctggacaaagcagagatgtgactggtgttcccagcatttgtccacagacaccattttcctctcaggccctgaggtgctggactacagagccggcctcccagccacctgccatgaaaacctcaccaggaccagtgggactctgttaaatctgttaacacccccacttcggcctgccctagacaacagctacatcttggaaaaaggaaatgaaactggtttaaaacctctcccaactgttcagaaggctcaggccccatttccaagacagaaggagccagactcttctgcgcatgtccctttatttatagt

SEQ ID NO: 206340 - DNA, 582 bp, Homo sapiens
ctgggtgacaaaacgagaccctgtctcaaaaaatgttaataattaatcttagcttattgtaactttttaacttaaaaaaatttcaactgactcctttgtaataacactaagtttaaaacacaaacacattgtataaccacataaaatattttgttttttatattcatattctataagctttttctatttaaaatttattatttttttactttttaaacattgttgttaaaaaggaagagacatacacattagcctaggcctgcagagggtcaggatcatcagtttcctagtcttccacctccgcatcttgtcccactggaaggccttcaggggcggtaacacacatgaagctgtcatctcccatgagaacagtgcctccttctaggataccttctgaaggacctgaggctgttttccaggtaactttttttcctatgagcagaaggagtatactctaaaagaacaataaaaagcatagtatagtaaatacataaaccagtaacagttgattgtcattatcaagtgtgtactgtacataattgtatgtgctagactgttacatgactggcagtgcagtaggtt

SEQ ID NO: 206341 - DNA, 214 bp, Homo sapiens
tttctacttgaactcttaaagtgggtggagtagatgtaggaacctgtatttcagagagatcctgcaatatgggtctccaagtgcccagtattttcaatgcatactcattagggacaaatcttagacatgagattaagccgaggggtaccaaatacatttctttcagatctaggagggatgaggtaccatccaaggtcacctctgatccttctga

SEQ ID NO: 206342 - DNA, 305 bp, Homo sapiens
cctttatactcaacatttccttcttttatgtccatgatgataattggatattgaaggatctagttggcttgaggggaggaggtgcgatttgacgtttgttatgaatgtggtctaaaataagactgactttgtgtctctcgattttttcatctatgaaagcccccattccatccccatcagtctgcacattcaattactgcaaactctagcagaataggacagtgcccaagaagcaattgtcgtctgcccactgcacctccaaggtaaacagatgcagatccaggctttgcaaggcctgaggcttg

SEQ ID NO: 206343 - DNA, 296 bp, Homo sapiens
tgattaaaatatggcttatagcattgctaagcatcataaaattgtccagaaagaaggactgatatgaaggggtggtgagacagcttgctgagcatctcctctttttatcaagtagattaacattttccatcgttaaaactgcattctatttcttttccaggtgtggacttttgaacatccctaaactgatcattagtaaaattaatgagttcattctctagaggttattgtctaatatctgaacaaactccacaataaactccacaattcttttattcagaaagcaaagatagacc

SEQ ID NO: 206344 - DNA, 341 bp, Homo sapiens
cttctttccatgaagacaagtggtttagtgacttgtacattccacaattttgccaagtgcaatacacagtgcttcttgtcccaattatatcatgttttttatttttgtttttttgagacagagtctcactctctcacccaggctggagtgcagtggcaccatctcagcttactgcaacctccgcctcctgggttcaagtgattctcctgcctcagcctcctgaacagctgggattacaggaatacaccaccacgcccgtgtgtatttttagtagagacagggttttaccttgttgacaaagctggtctcaaactcctgacctcaagtgacccacctcatcc

SEQ ID NO: 206345 - DNA, 476 bp, Homo sapiens
gagaggcccggaacagagataggaaaactgccaggtggacatacccacatcaaagacaaaaatgagaaaggaagtctatgtaccacctggtcaaccagtcgagggagtggagaaaggtggcagggaggcaaaatggatgtccgttcccttttctccccagcactgacccacagcagctagggaacctggcaggaagatgacatgggtccctggacgagaggaagaggactgccacaaggctggcccaggaaacggtaaggtgtcagcggaccatgcggaggaaggaacaaaggagacctctcgcagggaaggaggcagtaacctggcgggggacgaaccgggcgagcagggcaggtctgggggcccaggccgcggagagggaaagaagctcgggatgagggccaagaggaaaaggcaagggagcgggaggcaaaaatggagctgagaaacatgaaggtggtgggcgtgggatgcgc

SEQ ID NO: 206346 - DNA, 392 bp, Homo sapiens
tggattgcctgaggtcaggatttcgagaccagcctgaccaacatggtgaaaccccgtctctaccaaaaatacaagaattagctgggtgtggtggcacgcgcctgtagtcccagctacttgggaagctgaggcaggagaatcacttgaacctcggagacagaggttacagtgagccgagatcatgccaaggcactccagcctgggagacagagtgagactctgtctcaattaaaaaaaaaaaagtgttaaagtaacacatgctcattgcttaaaaagaaagaaaagtgaaggctgaggcaggaggatcacttcagcctgggaagtcgaggctgcagtgagctgagattgcattactgcactccagcctgggcaacagcgagaccctgtctata

SEQ ID NO: 206347 - DNA, 308 bp, Homo sapiens
ggtcttgctctgtcactcaggttgtgctatcatagcttactgtaaccttgaactcctggccttaagcgatcctcctgcttcaacctcccaagtagctgggactacaggcctgtgacagtgcctggcccaggcactgactttcttatgtcatatagcaatgaccactaagggaaagtctatacaaactatagaatagttgtcattctttacccaacccgggacacaagttaaaaacctagtattcattttttttttcctgtaccaaaacaatcatcttcctttatttttcctggagcgggaagaggaga

SEQ ID NO: 206348 - DNA, 699 bp, Homo sapiens
cttgaacttctgacctcaagcgatctgctttgcttcccaaagtgttgggattacaggcatgaaccgctccacctggccactttccagtgtttttggcagtattttcttagtctattattgtcctctctacttaatagaaactaatatgcttactacactttaaccaatcagaggattgcatacattctattttcttacttttttttttgagacagaatttctcccttgttgcccaggctggagtgcagtggcacaatctcgactcactgcaaccttcacctcctgggttcaagcgattctcctgccttagcctcctgagtagctgggattgcaggcatgcgccaccacgcccagctaattttttgtatttttagtagagatggggtttcaccatgttgaccaagctggtcttgaactcctgacctaagttgattcacctgcctcggcctcccaaagtgctgggattacaggcatgagccaccatgcccgaccacgttctgttttctaattaaattgtttgtttttgagatggagtcttgctctattgccctggctggagtgcaatggcaccatcttggctgactgcaaactccacctcccaggttcaagcaattctcatgcctcaacctgccaagtagctgggattacaggtgtgcaccaccacgctcagctaatttttgtgtttttagtagagacagg

SEQ ID NO: 206349 - DNA, 274 bp, Homo sapiens
aagagtgaagactcaactaaaatcagtaatgaaagacagacaccttacagaccttatagaaatcaatggattggccagacgcggtggctcacgcctgtagtcccagcactttgggaggccgaggtgggtggatcacctgaggtcgggagttcgacaccagcctgaccaacatggaaaaaccccgtctctactaaaaatacaaaattagccaggcgtggaggtgcatgtctgtaaatcccagctactcgggaggctgaggcaggagaattgcttg

SEQ ID NO: 206350 - DNA, 344 bp, Homo sapiens
caaagtgctgagactacaggtgggagccactgggccttcccctgggtgtttcattatctgagtctttctaggctggtttcccttccaggcatccgttaacccaggttaccagtaattttttctcagaaagccatgaccttgcagaaataccaacatattttctctataataaaaaatccttggtgcagagtttctttcaccaatgtttggaaaatgttgctccactttgccctgctttgctattacttttgagaaatctgatgccaggcgggctcctttgctcttgtaagctatttttaatttgtttttgaaacataataatttcattagatattttctcagag

SEQ ID NO: 206351 - DNA, 1054 bp, Homo sapiens
ggcttttacccagggagtatctgtagttgagccactggctctataacattgttagttctttgtattttcccaatggaggttttacctcatggccataaaaataaaagagggttgaatgtgaaaataactgcattttgaacatctcagaccctccactcataaaaattacttaatgttcctcttccttgaattacatattttccattgtaataaattcctgttttgaaaaccaaggaaaggaacattttttgaagaaagcagttcagtggcctctttaacaggtttatcaagaggttgatatgtagggataggttgtgggggagaagagggtgctatgaaatgtaaaattaaggatgtaaaaataacattagggatgccacaaaaggtgaaatataaaccatgatcatttgagacaagggaaaaacagggctttgaaaatgcctgtcatgtgataggaggcatctgtaagggagagactgaaatggctcccaggggtagtatatccatcctcttcccgatatacctgtgccatacaaataatgaccctcaacacgttaaaatgtggtttacattaagggtcatcagagtttaggcctaatttctgcaattcaggtattcatcattaccttgcaaacttactgtaccaacataaaaagcattttgctggtgtggcggggagaatcaggttaaattaagtagaagcattttggaaactttgcctagtacttcatgacttttgaaaattataagtgaaaacagagataagtcctattcttcgctcacattatttcccacaggcctttccagatccttatagctaaaaatttcccttttgccattaactgtcattaaaaaaaaaaaaaaagattacagtctttatgtataaaaccgctgccctttataacattttatgtgacttgtttgcttcactagattgtaagcctttggaggtcagaaaaaaatgcatctaaatgtatctgccaccacatctagcacagtgccttacacttatttgctattcaataaatatattcattaaaataatggacatatt

SEQ ID NO: 206352 - DNA, 213 bp, Homo sapiens
ttcagcagccacgtgtgcactctgtgtgtttgtgtgtgtatgtgtgcgtgcacttcttgcagttttgtcacatgtacagccttgcatcactgtcactgcagtcagaatcctccgctgtgccatcaccaacgattcctgtgttcgcctttatagccacgtcgatccttttttcatccctagcgctggcaaccactcacatagttcagcgtctga

SEQ ID NO: 206353 - DNA, 172 bp, Homo sapiens
ctcctgacctcaagtgatctgccctcctcaccctcccaaagtgctgggattatgggtgtgagccaccgcacctgtccctcttttcttttcctttttttttaaatgaaggtactattgaattgccctctggaaaaattaccagtttgatctaccaacagcttatgaaaaggct

SEQ ID NO: 206354 - DNA, 275 bp, Homo sapiens
agggttgtgtatgggaagagaaaggagcaggattctgaaatggtgctgtacgagcagcatgctaatggagccagcgcttggttctgtttaattgtaagcatccttccattgttcctccctgcacattaagtggggaggggatgccagactgccacagcctcctcatatcccatccacactggctttcatcccacagactatttttgactatgaacacagagcatttgaatgcctttgaaatgaaatgaatgaataaataaacaaataatctctca

SEQ ID NO: 206355 - DNA, 287 bp, Homo sapiens
tagagcccatgcctctatcttaatgagcctttgttctagctactctgttctatataggctacacttgcaaatcaaattcctctgtcaatgaccttcaatgctatctctaagaaattcctccaggagtctgtctgtcccatgctagaagcctcagaactgtgcctctgtgtttttatcctggacacaatctgcctagaaggtcttccccaaactcgtgtcagctgaattcatacctggtatctctctcccccagcttagtgtaaacttagtgcagggactttatcttg

SEQ ID NO: 206356 - DNA, 273 bp, Homo sapiens
ggttgagtttgctgactaaagctaccgagtaagaaatagtgccttgtctttcagtggtcactgaggtaataatggtctgttaccttctgaaggattccaggcaaatctaggggctgaggagtaagacagcaagatcatgagctggaaaaggaaactgtaaacaatagacctaatttcacagagacctaggcccagagcaagttcctgaaaccagggtattcggatttagatttgccagccaaaatatgcccacaggggctgcacgagtctctc

SEQ ID NO: 206357 - DNA, 741 bp, Homo sapiens
cagatttcacacggagcaggcacctcacagatgccaacccggtgggtacggccctttgagtgtcacctaaagcctcataacatcatcaccaagcccatccccaaaagctgtagttagtaagccaccaggatttgatatttagaaacttttcccactaacaaaaaacaagcaagaataaattttaaacaaaggctgactgtaccaaggaaatggagataataaacagaaaaagactcatggacactggtgttgggagtgatggtcttagccctcagaccagactaagacaccctgcagagctgaggctgtcaggaaccacgcagagccacggaagggaaacacctgcccccgggctacaaaggccaccctctgccctctgcttactgctctggttctgccctccagacacaagcaggtccctaaagcagttgctatcctgctgacgtgctgacaccatcagatatgaacaagaatcccagttttatttttcctaataaataaatcatccatttagcaaaacgtcaacgataccaaaagctatgaaagcatccttggatttacaaagaaccctcgcttctcatttcccttattttcccatgcccaggcagagagccctctaagcccatgggaagcttaacagaagggggtggggagtggccaactgtggccagggcaagacagaaaccacatgtgcgtgaacacgtgttctacacagagccttatgtactgggccacagaata

SEQ ID NO: 206358 - DNA, 504 bp, Homo sapiens
catgtttccaaacagcctcatttataaattaaattcattaaccacttcaaaaagtgtttaaaactttaatatagctgattttctctgatacttcaaatgcctgacaaatctggcaagcaacaactttctgagcatttagtctgttcctgcaattttaataaatcttgtttatagtgatttggctactatgtacgttgtttttatatatgtatggtaacacattacattgctttgtgtgtgcttcaactattaggatgcataatatgcctagaaaaccacatttattactatccagtagttgaatgatgcaccaaatagggaatgtaatctgcataggaatctatttctaattgcaagtgttctacacaaagtaaggaatttcttagagttactcaagggcaaataatttgactacataattaggtaggtatattcaaatgatggcccactaaagtcaactgcaatattgtctgattgttaacctagaagttttattgttactgg

SEQ ID NO: 206359 - DNA, 647 bp, Homo sapiens
gagcagtttaacctctaggttccctcatccacccccatacagccagacaattatccctccacccttctgttctcctcccctcttcccttagaaaacttgaagtttattctctagagaagttccaggctcagtgacaccaggccaaggtgctggactgaaaacaattagattaagttaaaatctgcttgataagtgtacaagtaatctattttcaaaacctaagagatgttgtcagctatctctaactatatgccagcagtaggccttctaggaaactgtactatgattccaggaaactcgattgtgggctggggaaggacaataaagtggattgtatgatcatctgcttctgttactggaaagggatcctgatccagaccccaagagagggttcttggatcttgtgcaagaaagaattcaggagtccataaagtgaaagcaagtttatcagagaagtaaagaaacaaaaggatggctaccccatagacagagagccctgagggctgctggttggacatttttatggttatttcttgatcatatgctaaacaaggggtagattattcataagttttctgggaaaggggaggttcccaaaactgagggttcctcccctttttagaccatataaggtaacttgggtgttg

SEQ ID NO: 206360 - DNA, 396 bp, Homo sapiens
taatacatgtgtgctgagcgcttcctggggctcctagacactgccaaaggtagctcagtggggaaattcaaggcaattttccccttaacttttgctacttctgaccattttccacttatgttattatgcttctgtatccatctgtctgcctatgtctagctatccatcatctatcaatcaatcactgtatcttgcaatggaggaattaactgtgatgttttcaagcgtgtcgcttctctcatattcctattaacatattggaaacgctcagctaaatagaataaagtttttagcctaaacctacagtgaatgtctaatgctttgggcaagatattgaaggggtgggggagagataatatgaatgctttcatagacacagctggacttctttccccc

SEQ ID NO: 206361 - DNA, 462 bp, Homo sapiens
gtagaattatctttcttagtatctacttggattgggtccctatatccaggtagagacagtgagaaaagctagtgattactcttttcttagacatgaacacctggacattccccagttggtggtttaacttctccctctttgttcctccatttattttttaaaatatttaaggaagtcaatgacttacagaacctttcatgggcacttggattaaagagatacaagaggcatagtccttatactccaggaaagaagacctggaatgtcttacctgatggcctggcattaaacatgccaggacagagggatgtgcaggaggctgtgaaaatacacaaaagcattgtgagtttggaagagagggaatggagaggactctgattttacccctacctatccttccaggatgattcctggcacacagctctctgtctcagacccgttaaatacaattattagtgtggt

SEQ ID NO: 206362 - DNA, 197 bp, Homo sapiens
gtggcaggatatcagcacccagttgcctcttcagtcaaaggtccttgggcattgcacatcctacacaactgtgtatgactattctcgcctgaatcaacatcttacgtctctggggttgggggtttctgtaacagtccttggccccggtgggctttcttatcagtcgctatccacttggtccattcgtcatcatgttg

SEQ ID NO: 206363 - DNA, 722 bp, Homo sapiens
agattccctgacctggagagatcagaagaggaaaaaagggattttttccctagtgagtatatagcaggaaaaaaaaaaaagatgagttagctttttcagtaattctcctgttatacacataaagtgactagcactatgcattccatacacacacacacacacacacagatctcatggtagtgatattggtagtgaaggaggaaaaggaaaaggtgagcaatggatgtgatattatgagaacaacacatatgaatgacactttattagaacttatctggttttcctcttatctctctggctgttccttctcaattcccttcactggtaactcttcaactccccaaccactaaatgctaagtgcccttaggctcagtctttcgaccccatttctacactcacttgatttcctgcagtttcatagctttaaaatccaatcttcttaatgatcactcccagacctttctctcctctgcctgcgaacttctatattcaactgcctacataacatccccatttggatgtctataggcatctcaaaagtaacatataaaaaatgaatcctgatattgcccccaaatctgaaacttcccccacacccaagtttttccattcaaaaatggctgctccattcttccatttgctcaggccaaaaaccttggattcatctttaatgcgtcactttctttcacaccccatatacaatctatcagcaaaacctgtg

SEQ ID NO: 206364 - DNA, 232 bp, Homo sapiens
catcacgagaatataatatgattctgtgcatgagactattttacatgattgtttatcacgtggtatgtctcaacagagagtcatatatattaactctccactaaattaagaaatcatcgaaaacaacactagtgagtctcaatgggaggtgggtaatagagattctcacttcccaagaagaattatcgcagtttcttggtgtggaagtgagagtttaggtgctaattgttta

SEQ ID NO: 206365 - DNA, 436 bp, Homo sapiens
atatatacttatctgttataatttcaggttttacttcaaatgctcacttgtctacaaccttacttttttcatttgaatctgttgggagacatagctgttcatgggcttctcatactccttgctgagatttcaaggccctggttgctcctttacctgggccagttcccaaggctgtgttctcataagtttctttgagggatgaaataaaacttccatctgaggcagagattaggcttgcttactgcttactacagaagtgatggatttcctcaaactcagagttcttcagactgtgacataaaccctatgcatgcacagcatctatctggaccctctctgtcacccctgtgggacttaggtacaagagaaactaaatgcaactatattcatttgtgttgcttgctgtgatgtaagtaataaagtcctctgtctctga

SEQ ID NO: 206366 - DNA, 461 bp, Homo sapiens
atcttctcttgggttgacaactatgctccaaaaatagtcatggaaattgaaagttataaattagaatttggaagttataaactctgataaaaaatgaatcaagctatttaaattatatttaatgtattctacatgaagaaaaaacaactatgttagccttaatcataatgtaatatggtagatgcctaaaataatgctaggagaagcttccttccatacaagcagcataattttcacacataaattaataccaggctgtcatctagtcacttagcagattagaacactaggagttggaagataaaacattgattttatatcagagaatgagggaaagttcaagcagaaagtgatatcaaatggaatatatttaaataaaaaagaatgagtaaaaacacaaactaaaaagaaaatagaaatgttatcactttttttaagatttggtattcaacaacctcgac

SEQ ID NO: 206367 - DNA, 2377 bp, Homo sapiens
cggatgagggtcagggctgcgcggacccctatcccgcctgcgtcctcccggcaagcccagcgggagcgcccgctcggctgggtccccgcctccagcgcgccggggccgcccagaccctgggctcagcctcgcgccccggtgcccacctgaggaggcggcggtcccggcctcgcgtcccggatgggacggcgcgggagcaatgccagtggccccgagcgccccgggccacgcgcggggccggccagccgctctcgcgccctccccgccccctccgcgccttgcctcgccgcccgcgcgccccacccaccggccgctcctcccctctccccaccctcctcctccgccccctcccctcccccgccgcctcgcagatagctcggccgcgcgtctcagccgccggggccccgagcgcaggcggcgaggccaccacacctgcagagcgctcgggctgcctaggcggcacctcgcctcccgccgcgcaaaccccttctccccacgcgccgagtctcccatgacgcccgagccccccggccggcgacaatgaccacttccctgcaagatgggcagagcgccgcgagcagggcggctgcccgggattcgccgctggccgcccaggtgtgtggcgctgcccaggggaggggcgacgcccacgacctggcgccggccccctggctgcacgcgcgagcgctcctgccccttccggacgggacccgcggctgtgctgcagacaggagaaaaaagaaagatcttgatgttccggaaatgccatctattccaaacccttttcctgagctatgctgttctccaattacatctgtgttgtcagcagacctatttcccaaagcaaattcaaggaaaaaacaggtgattaaagtatacagtgaagatgaaaccagcagggctttagatgtacccagtgacataacggctcgagatgtttgtcagctgttgatcctgaagaatcattacattgatgaccacagctggaccctttttgagcacctgcctcacataggtgtagaaagaacaatagaagaccacgaactggtgattgaagtgctatccaactgggggatagaagaagaaaacaaactatactttagaaaaaattatgccaaatatgagttctttaaaaacccaatgtatttttttccagagcatatggtatcttttgcaactgaaaccaatggtgaaatatcccccacacagattttgcagatgtttctgagttcaagcacatatcctgaaattcatggtttcttacatgcgaaagaacagggaaagaagtcttggaaaaaaatttacttttttctaagaagatctggtttatatttttctactaaaggaacatcaaaggaaccgcggcatttgcagtttttcagcgaatttggcaatagtgatatttatgtgtcactggcaggcaaaaaaaaacatggagcaccgactaactatggattctgctttaagcctaacaaagcgggagggccccgagacctgaaaatgctctgtgcagaagaagagcagagtaggacgtgctgggtgaccgcgattagattgcttaagtatggcatgcagctgtaccagaattatatgcatccatatcaaggtagaagtggctgcagttcacagagcatatcacctatgagaagtatatcagagaattccctggtagcaatggacttctcaggccagaaaagcagagttatagaaaatcccactgaagccctttcagttgcggttgaagaaggactcgcttggaggaaaaaaggatgtttacgcctgggcactcacggtagccccactgcctcttcacagagctctgccacaaacatggctatccaccggtcccagccatggtttcaccacaaaatttctagagatgaggctcagcgattgattattcagcaaggacttgtggatggagttttcttggtacgggatagtcagagtaaccccaaaactttcgtactgtcaatgagtcatggacaaaaaataaagcactttcaaattataccagtagaagatgacggtgaaatgttccacacactggatgatggccacacaagatttacagatctaatacagctggtggagttctatcaactcaataagggcgttcttccttgcaagttgaaacattattgtgctaggattgctctctagacaagccagaagtgacttattaaactattgaaggaaaaggactcaagaaaaataataaaagaccataaataagggcgaaaacattatcatgtgaaaagaatgtatttcacctgcaagttacaaaaaaatagtttgtgcattgcaaataagcaaagacttggattgactttacattcatcatttaaaattcattagttaaaattaaaccttagga

SEQ ID NO: 206368 - DNA, 915 bp, Homo sapiens
ggctttgggtagattggaatcacataagcagggtgacatttattactttcctagttgtttcattgcactgagccctgagattcccaaggagtaaccataaaagatttcttttattttgtccatgacctacgagacaggatcattctaagaagagcaggcatgagtttgagtgcaagaagagtcactctgcctgcaataacgccaataattctacagaaaagggtgattaaagtatacagtgaagatgaaaccagcagggctttagatgtacccagtgacataacggctcgagatgtttgtcagctgttgatcctgaagaatcattacattgatgaccacagctggaccctttttgagcacctgcctcacataggtgtagaaagaacaatagaagaccacgaactggtgattgaagtgctatccaactgggggatagaagaagaaaacaaactatactttagaaaaaattatgccaaatatgagttctttaaaaacccaatgtatttttttccagagcatatggtatcttttgcaactgaaaccaatggtgaaatatcccccacacagattttgcagatgtttctgagttcaagcacatatcctgaaattcatggtttcttacatgcgaaagaacagggaaagaagtcttggaaaaaaatttacttttttctaagaagatctggtttatatttttctactaaaggaacatcaaaggaaccgcggcatttgcagtttttcagcgaatttggcaatagtgatatttatgtgtcactggcaggcaaaaaaaaacatggagcaccgactaactatggattctgctttaaggtacaggcttaatattttgatagatgaataaagcaagcctcagccttttaggtaagcttgagtttcctttaattgcttttgaaaagagac

SEQ ID NO: 206369 - DNA, 787 bp, Homo sapiens
gtaaatattcatttttgtggctaagtagacaacatttagaaaaggaaattaatttctcaagtgggagcattaaaatcttcatttacttttactctgaatattgtagatttctttcattgattcaaaatattcatactgtctttactaacagaatgctgggagaattagaactagatgaagtagagtagcagtgcttctcagggatcagctgatatttcttttaaatgcaagtgatgttaaaaaaaacaagtagatatgccgtaacattcttttcactgtcttttagttttataaacttggcagttttggcatgtggagatagtttgcaatcgaatatgattgtccttctgtgtaatttatcctctttacttatttgttgcttttctttttgcaggtgtagaagatgacggtgaaatgttccacacactggatgatggccacacaagatttacagatctaatacagctggtggagttctatcaactcaataagggcgttcttccttgcaagttgaaacattattgtgctaggattgctctctagacaagccagaagtgacttattaaactattgaaggaaaaggactcaagaaaaataataaaagaccataaataagggcgaaaacattatcatgtgaaaagaatgtatttcacctgcaagttacaaaaaaatagtttgtgcattgcaaataagcaaagacttggattgactttacattcatcatttaaaattcattagttaaaattaaaccttaggaaaaaaatgaacttggcctcgttggcctcag

SEQ ID NO: 206370 - DNA, 757 bp, Homo sapiens
gtaaatattcatttttgtggctaagtagacaacatttagaaaaggaaattaatttctcaagtgggagcattaaaatcttcatttacttttactctgaatattgtagatttctttcattgattcaaaatattcatactgtctttactaacagaatgctgggagaattagaactagatgaagtagagtagcagtgcttctcagggatcagctgatatttcttttaaatgcaagtgatgttaaaaaaaacaagtagatatgccgtaacattcttttcactgtcttttagttttataaacttggcagttttggcatgtggagatagtttgcaatcgaatatgattgtccttctgtgtaatttatcctctttacttatttgttgcttttctttttgcaggtgtagaagatgacggtgaaatgttccacacactggatgatggccacacaagatttacagatctaatacagctggtggagttctatcaactcaataagggcgttcttccttgcaagttgaaacattattgtgctaggattgctctctagacaagccagaagtgacttattaaactattgaaggaaaaggactcaagaaaaataataaaagaccataaataagggcgaaaacattatcatgtgaaaagaatgtatttcacctgcaagttacaaaaaaatagtttgtgcattgcaaataagcaaagacttggattgactttacattcatcatttaaaattcattagttaaaattaaaccttagga

SEQ ID NO: 206371 - DNA, 533 bp, Homo sapiens
aaggtagttggaaaatagttgaataatggacagagcaaaaaacccttgagagttactggcacgggcttttcagagtaaccccaaaactttcgtactgtcaatgagtcatggacaaaaaataaagcactttcaaattataccagtagaagatgacggtgaaatgttccacacactggatgatggccacacaagatttacagatctaatacagctggtggagttctatcaactcaataagggcgttcttccttgcaagttgaaacattattgtgctaggattgctctctagacaagccagaagtgacttattaaactattgaaggaaaaggactcaagaaaaataataaaagaccataaataagggcgaaaacattatcatgtgaaaagaatgtatttcacctgcaagttacaaaaaaatagtttgtgcattgcaaataagcaaagacttggattgactttacattcatcatttaaaattcattagttaaaattaaaccttaggaaaaaaatgaacttggcctcgttggcctcag

SEQ ID NO: 206372 - DNA, 448 bp, Homo sapiens
acgttacactatgcaggtctaatcatagtcgtaaagagaactcacttagaggataacgtagaagatgacggtgaaatgttccacacactggatgatggccacacaagatttacagatctaatacagctggtggagttctatcaactcaataagggcgttcttccttgcaagttgaaacattattgtgctaggattgctctctagacaagccagaagtgacttattaaactattgaaggaaaaggactcaagaaaaataataaaagaccataaataagggcgaaaacattatcatgtgaaaagaatgtatttcacctgcaagttacaaaaaaatagtttgtgcattgcaaataagcaaagacttggattgactttacattcatcatttaaaattcattagttaaaattaaaccttaggaaaaaaatgaacttggcctcgttggcctcag

SEQ ID NO: 206373 - DNA, 445 bp, Homo sapiens
  misc_feature (37)..(37): n is a, c, g, or t
cacatgtcaggacctaccggccaccaacagccccccnattacgtcagtcacactgtagaagatgacggtgaaatgttccacacactggatgatggccacacaagatttacagatctaatacagctggtggagttctatcaactcaataagggcgttcttccttgcaagttgaaacattattgtgctaggattgctctctagacaagccagaagtgacttattaaactattgaaggaaaaggactcaagaaaaataataaaagaccataaataagggcgaaaacattatcatgtgaaaagaatgtatttcacctgcaagttacaaaaaaatagtttgtgcattgcaaataagcaaagacttggattgactttacattcatcatttaaaattcattagttaaaattaaaccttaggaaaaaaatgaacttggcctcgttggcctcag

SEQ ID NO: 206374 - DNA, 349 bp, Homo sapiens
  misc_feature (1)..(1): n is a, c, g, or t
naaaacccccaaccgggaaatttttccttttaaaaaattaaaaccccaaaggggcgtgtgtgtgagttctatcaactcaataagggcgttcttccttgcaagttgaaacattattgtgctaggattgctctctagacaagccagaagtgacttattaaactattgaaggaaaaggactcaagaaaaataataaaagaccataaataagggcgaaaacattatcatgtgaaaagaatgtatttcacctgcaagttacaaaaaaatagtttgtgcattgcaaataagcaaagacttggattgactttacattcatcatttaaaattcattagttaaaattaaaccttagga

SEQ ID NO: 206375 - DNA, 1735 bp, Homo sapiens
ggctttgggtagattggaatcacataagcagggtgacatttattactttcctagttgtttcattgcactgagccctgagattcccaaggagtaaccataaaagatttcttttattttgtccatgacctacgagacaggatcattctaagaagagcaggcatgagtttgagtgcaagaagagtcactctgcctgcaataacgccaataattctacagaaaagggtgattaaagtatacagtgaagatgaaaccagcagggctttagatgtacccagtgacataacggctcgagatgtttgtcagctgttgatcctgaagaatcattacattgatgaccacagctggaccctttttgagcacctgcctcacataggtgtagaaagaacaatagaagaccacgaactggtgattgaagtgctatccaactgggggatagaagaagaaaacaaactatactttagaaaaaattatgccaaatatgagttctttaaaaacccaatgtatttttttccagagcatatggtatcttttgcaactgaaaccaatggtgaaatatcccccacacagattttgcagatgtttctgagttcaagcacatatcctgaaattcatggtttcttacatgcgaaagaacagggaaagaagtcttggaaaaaaatttacttttttctaagaagatctggtttatatttttctactaaaggaacatcaaaggaaccgcggcatttgcagtttttcagcgaatttggcaatagtgatatttatgtgtcactggcaggcaaaaaaaaacatggagcaccgactaactatggattctgctttaagcctaacaaagcgggagggccccgagacctgaaaatgctctgtgcagaagaagagcagagtaggacgtgctgggtgaccgcgattagattgcttaagtatggcatgcagctgtaccagaattatatgcatccatatcaaggtagaagtggctgcagttcacagagcatatcacctatgagaagtatatcagagaattccctggtagcaatggacttctcaggccagaaaagcagagttatagaaaatcccactgaagccctttcagttgcggttgaagaaggactcgcttggaggaaaaaaggatgtttacgcctgggcactcacggtagccccactgcctcttcacagagctctgccacaaacatggctatccaccggtcccagccatggtttcaccacaaaatttctagagatgaggctcagcgattgattattcagcaaggacttgtggatggagttttcttggtacgggatagtcagagtaaccccaaaactttcgtactgtcaatgagtcatggacaaaaaataaagcactttcaaattataccagtagaagatgacggtgaaatgttccacacactggatgatggccacacaagatttacagatctaatacagctggtggagttctatcaactcaataagggcgttcttccttgcaagttgaaacattattgtgctaggattgctctctagacaagccagaagtgacttattaaactattgaaggaaaaggactcaagaaaaataataaaagaccataaataagggcgaaaacattatcatgtgaaaagaatgtatttcacctgcaagttacaaaaaaatagtttgtgcattgcaaataagcaaagacttggattgactttacattcatcatttaaaattcattagttaaaattaaaccttagga

SEQ ID NO: 206376 - DNA, 1539 bp, Homo sapiens
  misc_feature (24)..(24): n is a, c, g, or t
tgatggagttaaggaaaggtttcnaggtgattaaagtatacagtgaagatgaaaccagcagggctttagatgtacccagtgacataacggctcgagatgtttgtcagctgttgatcctgaagaatcattacattgatgaccacagctggaccctttttgagcacctgcctcacataggtgtagaaagaacaatagaagaccacgaactggtgattgaagtgctatccaactgggggatagaagaagaaaacaaactatactttagaaaaaattatgccaaatatgagttctttaaaaacccaatgtatttttttccagagcatatggtatcttttgcaactgaaaccaatggtgaaatatcccccacacagattttgcagatgtttctgagttcaagcacatatcctgaaattcatggtttcttacatgcgaaagaacagggaaagaagtcttggaaaaaaatttacttttttctaagaagatctggtttatatttttctactaaaggaacatcaaaggaaccgcggcatttgcagtttttcagcgaatttggcaatagtgatatttatgtgtcactggcaggcaaaaaaaaacatggagcaccgactaactatggattctgctttaagcctaacaaagcgggagggccccgagacctgaaaatgctctgtgcagaagaagagcagagtaggacgtgctgggtgaccgcgattagattgcttaagtatggcatgcagctgtaccagaattatatgcatccatatcaaggtagaagtggctgcagttcacagagcatatcacctatgagaagtatatcagagaattccctggtagcaatggacttctcaggccagaaaagcagagttatagaaaatcccactgaagccctttcagttgcggttgaagaaggactcgcttggaggaaaaaaggatgtttacgcctgggcactcacggtagccccactgcctcttcacagagctctgccacaaacatggctatccaccggtcccagccatggtttcaccacaaaatttctagagatgaggctcagcgattgattattcagcaaggacttgtggatggagttttcttggtacgggatagtcagagtaaccccaaaactttcgtactgtcaatgagtcatggacaaaaaataaagcactttcaaattataccagtagaagatgacggtgaaatgttccacacactggatgatggccacacaagatttacagatctaatacagctggtggagttctatcaactcaataagggcgttcttccttgcaagttgaaacattattgtgctaggattgctctctagacaagccagaagtgacttattaaactattgaaggaaaaggactcaagaaaaataataaaagaccataaataagggcgaaaacattatcatgtgaaaagaatgtatttcacctgcaagttacaaaaaaatagtttgtgcattgcaaataagcaaagacttggattgactttacattcatcatttaaaattcattagttaaaattaaaccttagga

SEQ ID NO: 206377 - DNA, 1765 bp, Homo sapiens
ggctttgggtagattggaatcacataagcagggtgacatttattactttcctagttgtttcattgcactgagccctgagattcccaaggagtaaccataaaagatttcttttattttgtccatgacctacgagacaggatcattctaagaagagcaggcatgagtttgagtgcaagaagagtcactctgcctgcaataacgccaataattctacagaaaagggtgattaaagtatacagtgaagatgaaaccagcagggctttagatgtacccagtgacataacggctcgagatgtttgtcagctgttgatcctgaagaatcattacattgatgaccacagctggaccctttttgagcacctgcctcacataggtgtagaaagaacaatagaagaccacgaactggtgattgaagtgctatccaactgggggatagaagaagaaaacaaactatactttagaaaaaattatgccaaatatgagttctttaaaaacccaatgtatttttttccagagcatatggtatcttttgcaactgaaaccaatggtgaaatatcccccacacagattttgcagatgtttctgagttcaagcacatatcctgaaattcatggtttcttacatgcgaaagaacagggaaagaagtcttggaaaaaaatttacttttttctaagaagatctggtttatatttttctactaaaggaacatcaaaggaaccgcggcatttgcagtttttcagcgaatttggcaatagtgatatttatgtgtcactggcaggcaaaaaaaaacatggagcaccgactaactatggattctgctttaagcctaacaaagcgggagggccccgagacctgaaaatgctctgtgcagaagaagagcagagtaggacgtgctgggtgaccgcgattagattgcttaagtatggcatgcagctgtaccagaattatatgcatccatatcaaggtagaagtggctgcagttcacagagcatatcacctatgagaagtatatcagagaattccctggtagcaatggacttctcaggccagaaaagcagagttatagaaaatcccactgaagccctttcagttgcggttgaagaaggactcgcttggaggaaaaaaggatgtttacgcctgggcactcacggtagccccactgcctcttcacagagctctgccacaaacatggctatccaccggtcccagccatggtttcaccacaaaatttctagagatgaggctcagcgattgattattcagcaaggacttgtggatggagttttcttggtacgggatagtcagagtaaccccaaaactttcgtactgtcaatgagtcatggacaaaaaataaagcactttcaaattataccagtagaagatgacggtgaaatgttccacacactggatgatggccacacaagatttacagatctaatacagctggtggagttctatcaactcaataagggcgttcttccttgcaagttgaaacattattgtgctaggattgctctctagacaagccagaagtgacttattaaactattgaaggaaaaggactcaagaaaaataataaaagaccataaataagggcgaaaacattatcatgtgaaaagaatgtatttcacctgcaagttacaaaaaaatagtttgtgcattgcaaataagcaaagacttggattgactttacattcatcatttaaaattcattagttaaaattaaaccttaggaaaaaaatgaacttggcctcgttggcctcag

SEQ ID NO: 206378 - DNA, 343 bp, Homo sapiens
tatgcatacacttcttggatttattaatgctatagttctatgaaatccatgagtaaatatagaaacattgaaattccttctctctctttagagttttcttggtacgggatagtcagagtaaccccaaaactttcgtactgtcaatgagtcatggacaaaaaataaagcactttcaaattataccagtaagtaattcgtgatttcacatttgtgtattagaaatgaccttaatgcataagcttttgatcttaatgcataagcttttggaaactttggttttcttttggtctttttattaaatataatttggcagcttgtgctttgactagagttaactttggca

SEQ ID NO: 206379 - DNA, 2220 bp, Homo sapiens
cggatgagggtcagggctgcgcggacccctatcccgcctgcgtcctcccggcaagcccagcgggagcgcccgctcggctgggtccccgcctccagcgcgccggggccgcccagaccctgggctcagcctcgcgccccggtgcccacctgaggaggcggcggtcccggcctcgcgtcccggatgggacggcgcgggagcaatgccagtggccccgagcgccccgggccacgcgcggggccggccagccgctctcgcgccctccccgccccctccgcgccttgcctcgccgcccgcgcgccccacccaccggccgctcctcccctctccccaccctcctcctccgccccctcccctcccccgccgcctcgcagatagctcggccgcgcgtctcagccgccggggccccgagcgcaggcggcgaggccaccacacctgcagagcgctcgggctgcctaggcggcacctcgcctcccgccgcgcaaaccccttctccccacgcgccgagtctcccatgacgcccgagccccccggccggcgacaatgaccacttccctgcaagatgggcagagcgccgcgagcagggcggctgcccgggattcgccgctggccgcccaggtgtgtggcgctgcccaggggaggggcgacgcccacgacctggcgccggccccctggctgcacgcgcgagcgctcctgccccttccggacgggacccgcggctgtgctgcagacaggagaaaaaagaaagatcttgatgttccggaaatgccatctattccaaacccttttcctgagctatgctgttctccaattacatctgtgttgtcagcagacctatttcccaaagcaaattcaaggaaaaaacagaaagaacaatagaagaccacgaactggtgattgaagtgctatccaactgggggatagaagaagaaaacaaactatactttagaaaaaattatgccaaatatgagttctttaaaaacccaatgtatttttttccagagcatatggtatcttttgcaactgaaaccaatggtgaaatatcccccacacagattttgcagatgtttctgagttcaagcacatatcctgaaattcatggtttcttacatgcgaaagaacagggaaagaagtcttggaaaaaaatttacttttttctaagaagatctggtttatatttttctactaaaggaacatcaaaggaaccgcggcatttgcagtttttcagcgaatttggcaatagtgatatttatgtgtcactggcaggcaaaaaaaaacatggagcaccgactaactatggattctgctttaagcctaacaaagcgggagggccccgagacctgaaaatgctctgtgcagaagaagagcagagtaggacgtgctgggtgaccgcgattagattgcttaagtatggcatgcagctgtaccagaattatatgcatccatatcaaggtagaagtggctgcagttcacagagcatatcacctatgagaagtatatcagagaattccctggtagcaatggacttctcaggccagaaaagcagagttatagaaaatcccactgaagccctttcagttgcggttgaagaaggactcgcttggaggaaaaaaggatgtttacgcctgggcactcacggtagccccactgcctcttcacagagctctgccacaaacatggctatccaccggtcccagccatggtttcaccacaaaatttctagagatgaggctcagcgattgattattcagcaaggacttgtggatggagttttcttggtacgggatagtcagagtaaccccaaaactttcgtactgtcaatgagtcatggacaaaaaataaagcactttcaaattataccagtagaagatgacggtgaaatgttccacacactggatgatggccacacaagatttacagatctaatacagctggtggagttctatcaactcaataagggcgttcttccttgcaagttgaaacattattgtgctaggattgctctctagacaagccagaagtgacttattaaactattgaaggaaaaggactcaagaaaaataataaaagaccataaataagggcgaaaacattatcatgtgaaaagaatgtatttcacctgcaagttacaaaaaaatagtttgtgcattgcaaataagcaaagacttggattgactttacattcatcatttaaaattcattagttaaaattaaaccttagga

SEQ ID NO: 206380 - DNA, 1641 bp, Homo sapiens
ggctttgggtagattggaatcacataagcagggtgacatttattactttcctagttgtttcattgcactgagccctgagattcccaaggagtaaccataaaagatttcttttattttgtccatgacctacgagacaggatcattctaagaagagcaggcatgagtttgagtgcaagaagagtcactctgcctgcaataacgccaataattctacagaaaagggtgattaaagtatacagtgaagatgaaaccagcagggctttagatgtacccagtgacataacggctcgagatgtttgtcagctgttgatcctgaagaatcattacattgatgaccacagctggaccctttttgagcacctgcctcacataggtgtagaaagaacaatagaagaccacgaactggtgattgaagtgctatccaactgggggatagaagaagaaaacaaactatactttagaaaaaattatgccaaatatgagttctttaaaaacccaatgtatttttttccagagcatatggtatcttttgcaactgaaaccaatggtgaaatatcccccacacagattttgcagatgtttctgagttcaagcacatatcctgaaattcatggtttcttacatgcgaaagaacagggaaagaagtcttggaaaaaaatttacttttttctaagaagatctggtttatatttttctactaaaggaacatcaaaggaaccgcggcatttgcagtttttcagcgaatttggcaatagtgatatttatgtgtcactggcaggcaaaaaaaaacatggagcaccgactaactatggattctgctttaagcctaacaaagcgggagggccccgagacctgaaaatgctctgtgcagaagaagagcagagtaggacgtgctgggtgaccgcgattagattgcttaagtatggcatgcagctgtaccagaattatatgcatccatatcaaggtagaagtggctgcagttcacagagcatatcacctatgagaagtatatcagagaattccctggtagcaatggacttctcaggccagaaaagcagagttatagaaaatcccactgaagccctttcagttgcggttgaagaaggactcgcttggaggaaaaaaggatgtttacgcctgggcactcacggtagccccactgcctcttcacagagctctgccacaaacatggctatccaccggtcccagccatggtttcaccacaaaatttctagagatgaggctcagcgattgattattcagcaaggacttgtggatgggtagaagatgacggtgaaatgttccacacactggatgatggccacacaagatttacagatctaatacagctggtggagttctatcaactcaataagggcgttcttccttgcaagttgaaacattattgtgctaggattgctctctagacaagccagaagtgacttattaaactattgaaggaaaaggactcaagaaaaataataaaagaccataaataagggcgaaaacattatcatgtgaaaagaatgtatttcacctgcaagttacaaaaaaatagtttgtgcattgcaaataagcaaagacttggattgactttacattcatcatttaaaattcattagttaaaattaaaccttagga

SEQ ID NO: 206381 - DNA, 348 bp, Homo sapiens
aatgactagaaaataatttttcaaaatgcataaacatggcttagaatatattgatatgatttttggttttagaaatgatggggctattttatttccgatttccaaatttatataagcaattgtgatttgatgaaaagtcagaaaagttggcaagtatttttttcttagtttaacaaagcatgtattgtttgaatatgtttgttttctctacaaacctgtgtgcattattattgaatatcctcagtacttgtgatagtattttgtgctcatgtttggctaatttgactcaacagcgcatcatggaatggcctctcttactcattttttccgttgtcttatgtgtctaat

SEQ ID NO: 206382 - DNA, 642 bp, Homo sapiens
ggcctaactataaccgggcaagccacttttctgagactgtttcgtcttcttaaagggtgaagatgaagccctatgccttttagggtagttgagaggatagaatgagttaatgtgtgtaattatgttgtatacgtatattaaggttcaattagaggagacatgtacagggatcttaataacccattccagagttttagcacgaatacatggcagcatattttttatttgtaattgtctttgttacttgatagtgaacctctctaacttctccattgcttatggtacccaaaataggagatgatcttcacaaaagagaatctcagactgaaattctggggaaagggccaggcgcagtggctcactcctgtaatcccagcattttgggagggtgaggtgggtagatcacctgaggtcaggaattcgagaccagcctggccaacatggtgaaacccccatctctactaaaaatacaaaaattagctggacgtggtggcaggggcttgtaatcccagctacttgggaggctgaggcaggagaatcacttgaatccaggaggcggaggttgcagtgaccccaggtcgtgtcattgcactccatccagcctgggcaacagagtgagactctgtctccaaaaaaaaaaaa

SEQ ID NO: 206383 - DNA, 268 bp, Homo sapiens
ggctaagagtttatgcataaccttgaaaacaacgtggagccacttacagttttgaggaagagaatgtcactggggctatattttaagaagattaatatgacaactggttgtaggatggattggaaggagaaggatctagtgataaggatggatgccagttcttttggttgtcagcaaggaaggcatccctggttatcttaggcaaaaaggaaatttattgctggggcaatggagagggaagagttaaaaactgcttgggttcaaagag

SEQ ID NO: 206384 - DNA, 380 bp, Homo sapiens
gctccaaagtaggcaaaaataaaaaaattaaaaagcaaagaaaaactaacaaggcaccatttgcacttacaaaacacagattaattgcaaccatcacattctagtgaacttgaggagaaactgatatattcaaactaactggtggtaccagtatcaactattcacaaccttaggaaagaaaagtaaataaagtggtctcattcatcaatgtagcaaccccactcctagaaatctgaggccaggaaataaccccaaagaaaatatacacaaatatgtcccctgtagcattatttaaaaccatgacaaaaataatgaaaatcaccttaatatccaacaaaactaatttccttgcaaaagacacagcccttcaccttaacctt

SEQ ID NO: 206385 - DNA, 3388 bp, Homo sapiens
  misc_feature (1079)..(1079): n is a, c, g, or t
  misc_feature (2422)..(2422): n is a, c, g, or t
  misc_feature (3134)..(3134): n is a, c, g, or t
  misc_feature (3306)..(3306): n is a, c, g, or t
  misc_feature (3368)..(3368): n is a, c, g, or t
  misc_feature (3377)..(3377): n is a, c, g, or t
  misc_feature (3384)..(3384): n is a, c, g, or t
tctatgctacattttaaattacattcttcaagtcatattttgggtgtcggttccacttgctctgatacacgctatttcacttcaatgaagtaaatgatgccaaccctgagggaagacctcttcttattctgcccagcatctgggactttgaaaccagcccagaactccaacaggaaaccccagtccagaaaacaaataataaagagaatccaagctcccattttactcctaacaaggcattttgttaattttaactattctagtccataagagaagtagattagaataatggaaacgctagttggtttttcccccaaagtgagaacagagaaaactagtctacatattaaccccacttattcaaactccccaagatatgtctagctctgcagctgccatttatggtgtgctccaaccacatgcaggcattgcactccagggcaccttcaattagttagtccttatgatgacacagtaagagggatttttttaaatttcaacttctcagatggggaaccaaggctcagtatggcaaaataacttatgaaagggccagacagctaaaaaataactgaactaagatttgaacacatagcctagcactagagcctgtgtctgtaaccactacactccattagacaaacactggtctccattttaggtaacagaataacatcacgtgcatagctcatttaatctcacaggagctctctgtggagtatactattatttaacagaggaagataaaaagagatgcaactggatggaataatttacctaggtacatacagctaggaaatggcagaactaggattttaagtgagaccctaaattgtgggtcagcaaacattctccagtactatggcccaatatgctcccctgaaatacactccacctttgggctggtagataggatcgatgtgaaaaaaaatgaaggaactgagaggaagaaacaaaaatttccaacattagatcttattcagaagtggctcccctcatgtcatatgtccttcctctaagcattgtcaaaatattgtcccaaaattttgtgtatagccttctcacaagtaacaaagtgncaggaaaaaccacctataacccaaggacctgttctacaatgaaatggcagagtcatagatacaactgatgtataactgcccgccacctccccgccaccacccgcaaatgaaagaaagagaacaaaaggaaaccaaatcaaatgtccaacagaaggaacatagttaaccaaattatggtttaaactggtgatcctcaattgggagttagaagggggttgatattaggagctgtgtgggagcatttttggttgtcacaacgacctgggaggcatcctgcaaaataaataccctgcagctatgacacacacaaaaagaactgttacatctctaatagtgatgacgtcctcatggagaaagacagtaattaattatgaagccctacatgggtgggacatgtcacctgaaagatactgaacatgccctggcacagagtaggcacctaataatatctgtgtaatgactggatgatctattacaccgttcataaaagataatatggcaatatgaaaatagttacgttaggaaaagaaagtaggataaaaagttataagcacaagataattgcaactatatatttatttaaattccaaaaaagactagaaggaaatacacttagatgttttattgtttcacaatagcacgagaattagtggcttttctctctgtggcttaagcatagtataattgatcatgaaacagtaaaaaacctaaaccacatttaactggccaaaagaggactagaaaagaagagtagagtgcaaccactcctgaataaatgtgatcaagagaaaagaacaagaaggtttttgaagaaagataaattatgactgtcacctgggtatttctagacagatttctgaccctcatctccaaattctgagtaccctagttcaggggtccccagtccccgggccacagactggtttccgtggcctgttagaagccaggctgcacagcaggaggtcagcgtcaggcaagcaagtgaagcttcatctgtgtttacagccgctgcccacagctcacatcaccacctgagctctgcctcctgtcacataagcagtggcattagcttctcatagaagcgtaaaccctattgtgaactgcacatgtgagggatcaaagttgtgcactccttatgagaatctaatgcctgatgatctgtcactgtctcccatcaaccccagatgggaccatctagttgcaggaaaacaagctcagggctcccactgattctatattatggtgagttgtataattacttcattatataatacaaggtaataataatgaaaataaagtgcagaataaatgttatgtgcttgaatcatcctgaaaccatcccntcctctggtccatggaaaaaccgtctcccatgattctggtccctggtgccaacaaggctggagaactgctgtagtttacaggccctgcccactgaagccttcctcatggagtttcccatctctgttatgcacactgccatccgctgtgtcaggcaagctcaagtctgaagtcatgattttctcttctccatcctatggctcccacctgcaggcagccctcacatcctctcagccctcactacaattcctattccatctcaccttcccccctgcttctatttccaatgccatcccccaacccaagaccctccctctctcctggatgctaaccccatgccgtcctataatttcctatcatgtgcaaggaacacccaagcatttttattaagcaggctaagatgctcaaactccacgattaaaatgctcagtggaagaaggagcaactataattttttaagaagtaatgattagcacagaaaatacgtttggtctcaaatattcccaccaaaatatacctccatggcaatcggggaaagggagagggtggtaaatgtcaacccatgagaaaggaagggtctggaggcacaaatcaaaggggacctaagtaggcaggaagtatcactgaaaaccttcaaaatcttgcattatacaacagcattaatttggccatttaaaatgtaaaaatgggccaggcgcagtgactcacgcctgnaatcccagcactttgggagggtgaggtgggcagatcacttgaggtcaggagttcgagaccagcctggccaacatggtgaaactccatctctactaataatacaaaaattagctggtgtggtgctgtgcacctgtaatcccagctactcaggaggctgaagtaggagaatcgnttgaacccgggaggtggaggttgcagtgagctgagatcgtgccactgcactctagcctgggngacagaacnagacttngtct

SEQ ID NO: 206386 - DNA, 3254 bp, Homo sapiens
  misc_feature (1079)..(1079): n is a, c, g, or t
  misc_feature (2422)..(2422): n is a, c, g, or t
  misc_feature (3172)..(3172): n is a, c, g, or t
  misc_feature (3234)..(3234): n is a, c, g, or t
  misc_feature (3243)..(3243): n is a, c, g, or t
  misc_feature (3250)..(3250): n is a, c, g, or t
tctatgctacattttaaattacattcttcaagtcatattttgggtgtcggttccacttgctctgatacacgctatttcacttcaatgaagtaaatgatgccaaccctgagggaagacctcttcttattctgcccagcatctgggactttgaaaccagcccagaactccaacaggaaaccccagtccagaaaacaaataataaagagaatccaagctcccattttactcctaacaaggcattttgttaattttaactattctagtccataagagaagtagattagaataatggaaacgctagttggtttttcccccaaagtgagaacagagaaaactagtctacatattaaccccacttattcaaactccccaagatatgtctagctctgcagctgccatttatggtgtgctccaaccacatgcaggcattgcactccagggcaccttcaattagttagtccttatgatgacacagtaagagggatttttttaaatttcaacttctcagatggggaaccaaggctcagtatggcaaaataacttatgaaagggccagacagctaaaaaataactgaactaagatttgaacacatagcctagcactagagcctgtgtctgtaaccactacactccattagacaaacactggtctccattttaggtaacagaataacatcacgtgcatagctcatttaatctcacaggagctctctgtggagtatactattatttaacagaggaagataaaaagagatgcaactggatggaataatttacctaggtacatacagctaggaaatggcagaactaggattttaagtgagaccctaaattgtgggtcagcaaacattctccagtactatggcccaatatgctcccctgaaatacactccacctttgggctggtagataggatcgatgtgaaaaaaaatgaaggaactgagaggaagaaacaaaaatttccaacattagatcttattcagaagtggctcccctcatgtcatatgtccttcctctaagcattgtcaaaatattgtcccaaaattttgtgtatagccttctcacaagtaacaaagtgncaggaaaaaccacctataacccaaggacctgttctacaatgaaatggcagagtcatagatacaactgatgtataactgcccgccacctccccgccaccacccgcaaatgaaagaaagagaacaaaaggaaaccaaatcaaatgtccaacagaaggaacatagttaaccaaattatggtttaaactggtgatcctcaattgggagttagaagggggttgatattaggagctgtgtgggagcatttttggttgtcacaacgacctgggaggcatcctgcaaaataaataccctgcagctatgacacacacaaaaagaactgttacatctctaatagtgatgacgtcctcatggagaaagacagtaattaattatgaagccctacatgggtgggacatgtcacctgaaagatactgaacatgccctggcacagagtaggcacctaataatatctgtgtaatgactggatgatctattacaccgttcataaaagataatatggcaatatgaaaatagttacgttaggaaaagaaagtaggataaaaagttataagcacaagataattgcaactatatatttatttaaattccaaaaaagactagaaggaaatacacttagatgttttattgtttcacaatagcacgagaattagtggcttttctctctgtggcttaagcatagtataattgatcatgaaacagtaaaaaacctaaaccacatttaactggccaaaagaggactagaaaagaagagtagagtgcaaccactcctgaataaatgtgatcaagagaaaagaacaagaaggtttttgaagaaagataaattatgactgtcacctgggtatttctagacagatttctgaccctcatctccaaattctgagtaccctagttcaggggtccccagtccccgggccacagactggtttccgtggcctgttagaagccaggctgcacagcaggaggtcagcgtcaggcaagcaagtgaagcttcatctgtgtttacagccgctgcccacagctcacatcaccacctgagctctgcctcctgtcacataagcagtggcattagcttctcatagaagcgtaaaccctattgtgaactgcacatgtgagggatcaaagttgtgcactccttatgagaatctaatgcctgatgatctgtcactgtctcccatcaaccccagatgggaccatctagttgcaggaaaacaagctcagggctcccactgattctatattatggtgagttgtataattacttcattatataatacaaggtaataataatgaaaataaagtgcagaataaatgttatgtgcttgaatcatcctgaaaccatcccntcctctggtccatggaaaaaccgtctcccatgattctggtccctggtgccaacaaggctggagaactgctgtagtttacaggccctgcccactgaagccttcctcatggagtttcccatctctgttatgcacactgccatccgctgtgtcaggcaagctcaagtctgaagtcatgattttctcttctccatcctatggctcccacctgcaggcagccctcacatcctctcagccctcactacaattcctattccatctcaccttcccccctgcttctatttccaatgccatcccccaacccaagaccctccctctctcctggatgctaaccccatgccgtcctataatttcctatcatgtgcaaggaacacccaagcatttttattaagcaggctaagatgctcaaactccacgattaaaatgctcagtggaagaaggagcaactataattttttaagaagtaatgattagcacagaaaatacgtttggtctcaaatattcccaccaaaatatacctccatggcaatcggggaaagggagagggtggtaaatgtcaacccatgagaaaggaagggtctggaggcacaaatcaaaggggacctaagtaggcaggaagtatcactgaaaaccttcaaaatcttgcattatacaacagcattaatttggccatttaaaatgtaaaaatgggccaggcgcagtgactcacgcctgtaatcccagctactcaggaggctgaagtaggagaatcgnttgaacccgggaggtggaggttgcagtgagctgagatcgtgccactgcactctagcctgggngacagaacnagacttngtct

SEQ ID NO: 206387 - DNA, 433 bp, Homo sapiens
ccgcccatcttgcttagcatccccaggaagatccctgtgtggccctttcacacctatgtctctaacgccatcttatccctaatccctggcaaccatagcccatcttccgtttctagaattttgtcatctcagaaatatcatatccagctgggcatggtggctcacacttgtaatcccagcactttgggagactgaggtgggcagatcacttgaggtcaggagttcgagaccagcctggccaacatggtgaaattccgtctgtactaaatatacaaaaattagtcgggcgtggtggcgcacgcctgtaatccagctactcaggaggctgaggcaggagaattgcttgaacccgggagacagaggttgcagtgagccaagatcgtgccactgtactccagcctgggtgacagagtgagtgagactctgtctccaa

SEQ ID NO: 206388 - DNA, 156 bp, Homo sapiens
acagtgaatttaattacctggtgaaaatacctgaagtgattaaaatcagagtatgctctccatatacctgggctctcctgaatgtctttacggtattactgttttgtaggatacttccctcagaagagtgaacagtacaagagcctttttcttggg

SEQ ID NO: 206389 - DNA, 494 bp, Homo sapiens
tcagttccttgtagattctgggtatcggccctttgtcaggtggatagattgcaataaaatacctagggattgctagaacaacattcttgctgttcctcttgtcaatggactgaaggcagatctggctgttcacacactatggctatagcacatgcttttttggagcgctggtcctctgttctttgagtggattcagattgcacattgaaaagcaattggattttcctgattcttcctcttagtttccatcctattcctttctttttcagcatttctataaatttgtgatttcatttttgtccattaacccacttattgtctgtattctgtcaggataccgtaagctccataaagacagagatcaccgagtatctatagcatggtatagtccacggcatattgtcaaaagtcaatacatttttgatgatgaaacatgtaaatcatttatttcatcaaaaatagctagggagtcattattctaatctaacaggccc

SEQ ID NO: 206390 - DNA, 736 bp, Homo sapiens
caggttccatccactttctgtcacccagcccctctcatctgggaaaatcccattcaatagatgggcctctcctcctcactcgactttccaatagtggacggtccttttaggagagatatcctagattcagcctctaagtccaagtgcaagcctataggaaagtggggcaaagacataaggtggaaaggaggacaggtggaaaaactgcttaatacctgccctctgccacgtcacacgcccaccccaccagcaattcatgttctgagtacacagaacatcccactgcttttgctgggaccgtccccagagcaaccctctcctgaccctgctttagaaataccaaacccccagcactaagcttcagagaagcagagggggaggagctcaactctgtagaaagcccctggcttccatccctccagggcctgcatcccacatcaaaaaccctgcctgaccctgaccccagtgctgaccttgccttagcaagaaatgagaagataacacgtttccttccagtcactgaagccacaaccattgcctctcctacacgtctgcctgtcagcccacaccacaggcggccccatcttgcggcagcttctgttaaatgggcatccccggggccatctcgcctacggcagtcttgcagggtggcaattgccaggtgtcctgggcagagccctgggaggacaaaaatcaaagtccctcatggctcagtttaactccacattgactggac

SEQ ID NO: 206391 - DNA, 498 bp, Homo sapiens
gagctattcgcaagattcccttaaagagtgtgctgtgttctgagacttccccagaccacatcaatgtggtttatccacccactaaagatttgttgtagttattgaactgctttttatttgcttcagttatcttaatgaatcattgtgtcttctctacataaccagttttccctaggagagttataattcctacggggatgctgctttgctagccaggcatggtttttgagaactgggagttgccagaatctgctgtcctaatccatgaggctgaaattggatttttcatctccctgggagaaagattacattttaaaatcaactataggtgtgtctccccaacattagaagtagactattttccaccctggaaacgctggggattcttatccaaaggctaaaagatcattaatagtacggcatttgattccatttgaagtcagagcaacatcctctttagcactgtggttaaatttcagactcacctttatcttggtg

SEQ ID NO: 206392 - DNA, 781 bp, Homo sapiens
attttaaagggacaaatacttcattttaacaaggtatatgtaaggcctctcctaattctcattctaaccaatagggatagaaattttagcccctgcagcaggtaagtttcctgtatatggcagttactgaaagtaattcatttcatcagagggtattaaaaacccaaaactaattttgtgtttgttttttatttggcaaagaaatgcaataaaaccatgaagtaggaagttattactggtatctcttaaatgacataattttgagcccagactttaaatgatatctaacctttgtgttttacagtgttatgggttgaactgtgttcccctaagataggttggagtcctaacccccagtacctcagaatgtgacctcatttggagataagatctttacagaggtaatccaattaaaatgaggtcattagggtgggccctaattcagtatggctagtgtccatattttttgaaaagttgggagagatttgaacacagacgcacacccagggagaacaccatgggtagatgaaggcaaagattggggtgatgcttctacaaatcaagaaatattgaagattaccaacaaactaccagaagcaagaagaaaggcatagaccaaattctccctcacacttagaaggaaccaagtctcctgacactttgatcttggacttaacagcctccagaactgtgaaacaattaactttcacttaagccacccagtttgtggtactttgttatgccagcctagaaaattaatatgtgagagaatccacctttc

SEQ ID NO: 206393 - DNA, 587 bp, Homo sapiens
acattcctgagccaaaatgcacacataagctgctttccctggtagcaaagctcttcactcctgagtgactcttatcaggggcagttgggcattctcaattggattacgctgacaaggaaaaaggcctgcggtatgttatttcaacaccatttggcttcagaaatgcctgtctcgacctttttgccctcagagtctacttctctcttcttgctttctagagggtcaccagcctgctcccatgcatgttctttaccctgcaaatattggcccatgttcctggagacagaatgccatcattcacaagatggatcatgtataacagactaataaatcatagcatgataaaaaaagaaattagttcatttacccctctaacatttctgtatccagagacagacgacaaaagctttttggttttaggcttttctgtctgtatctgtacattccattttaggagaaagtgttaggtctcatatgctacttttctgactatgctgtacaccccaggaatatatttcttgcaaaagtcaagattgatagtgatctacaaaaatgtctgatgtatggtaagctccgtaggaagaagc

SEQ ID NO: 206394 - DNA, 289 bp, Homo sapiens
ccccacggctcctcattcacaaacctcaccttgtcgctcctgcctcaagccctccagggattcctcgtcctacagagtcaagtccccgttcccatggctgacctttacgttctcatccctggcctttctctgccaagcaatctcacagttacggttgcagcacgttcacacctctgagctttagctattcccactgcctggaattttgtggtttttttgtttttgtttttgtttttgagacagagttttgttctgtcacccaggctggagtgcagtggagcaatctcag

SEQ ID NO: 206395 - DNA, 1114 bp, Homo sapiens
gaaatgagttggaatgtctcagaatctatttagacttcccactcatatttgaggtgaatagaaaataatcgatggcaagtactgagagagatgcactctcacactgagtgcattttatactcaaaatgtatcagatttatggatctgagaattcacagccttagtcatgactgacaaatacaaagaaataaagtgatgtatgaagtggtttagactttcttctaagtatttgtagataatttgttttacacattaaaattttctgaatcagttagcatactattacacaactgtcccctaaaaatcaataaaaatactattgcataaaagctatcagattaagattggatataaatgtaataaaattgtgctattataagtaaaatttagaagttagataaaggaatgaaaacatataattagtaaagcttactttacaaatgaggactacgaggtaagagacagttaaaggactaccccaggtcacacagatagtggtggggttagaggttgaactcaaggcttctaatgtcacagcttatttttatctataaatcataaacaaaaaatagaaaattttcattctaataaagcaaaaaaaggattttggcttatattcttactttctaaaactgtgtctggaagaatcactttaaaggccatgtaaggaatattcaactctttgcagtgtttagtccaacaagagtcttccacataattgtattccaccacaaatgagaaattactccaggggaaatctgctccaatatattgattatgtacaactacacaggaacttgtactaaagacaaaagagagccaagaaaatggcattatacttgtgttattattttgttgaactattaaaagatgactgttttctggctgttccatccttctctaatctatgcctcatcttagaaaggcactggtgcgttttctgttgatttgctcttcaatagtgttaatttctttatatttttcttcttaatgatcatacatttttataccaggatataaaaacctgtaacctatttcatatcctcaaatgggagacagcctgattttattacctgagtactatcaataagaggaatcagcatgaaaaatcagt

SEQ ID NO: 206396 - DNA, 1169 bp, Homo sapiens
cctgttccaagctatagacagacaggacaacaatttgatttcctgtactcttggtctggaacccatggggttctgagataaaagctgaggtcttagagcactggcaaatcaaattgttgtcctgctctgtctatagcttgcgaacagggacgctttgattactgactccggattccaacacactgcctaagcactcaaaacaaccatcctccaccatcttgcaaacgacgactgtacagcgtgctacttcatagcggcatgcgctggcctcaaccacaatcacagcccaacactgcgacactcaacggtgcgcagcgcgcgcgcacgggacatgacaactgcgcaacacgcggccgctgcattcccctctcccctagacttaccgactaattctactacggctaccttactcttcatgaagtaaccctctacacacgcctagcccacgcaacactgacccacacatcccgtactgcctcctatgccccatacctctctatactcctagcccacctggcagttgcacacgcggcaactacatctcctacacaaactcaacacttgcagccacacgcttgctacctaaacggcctacctgcctcaactcccacaaagcactctggcacccatcttcccgacatcatcatccaaaaaatcacattgcatagcaacatgggcgcactccacgtcgaagcagacaaccttgctgcattgataatttaatagctctcaaaagaatgaagcgattgcccgtgtgccctcataccccgtgaccccaacaactgccattgccccattcgtgcatcacggcagcgccccccttaaaacattccaatctacccacactaatgcgttccacaacaactactggcgtaatccccccccctgaatctggtgtgcgaccaacctcctacacccagcaacatgcaacttcacacttccttaaacgcgccctaagcatacctgatatctctcgaccccctctcgtccacacttctcccttggcgaccacctcgagtgaccctcggcaatacgcgttaagacaaccaatactacccaccattgattcccagtgtgcactcgacatgttagcataacaccctatgattgatgtagactcaccgagcacaagagtgtcactacacaacgttaatattgagttcgcccgc

SEQ ID NO: 206397 - DNA, 312 bp, Homo sapiens
tgccggtacccgggggacgaaaggctaacatgaaactagtctttgatatgctttactacctaatacactgccttcacagtagtgagtaaatatttactgatttgattaggtaccttttcaacaataaaacttacatataagcttgttttaagtaatttcctaaacaatctattcctggtttatatggatagtctatgacccacaggacttcaaaatattatatgggtgccagtttttaataatgagactgtcaatgaggacactgtcagataaaatgcctggagaggaaattttagaactctaaattgagag

SEQ ID NO: 206398 - DNA, 170 bp, Homo sapiens
caggttttcaaataagtaggtttaaaaaggcattttattaatcactggtctaatcattataataacctaaacagctagcatgtattcctatgctctttgtatatttattcttgaaattcacagtgcttacagcccggtagattatactctttacttggcttctggttttt

SEQ ID NO: 206399 - DNA, 508 bp, Homo sapiens
attccctaagatggggtgggctaccagctttccctttccagcgtctgtcccatctccctccccggagtttgcactgctggtggcttcagccaccgccccaggcagatgtttgcccagtctgcgtcctggacaataactctggccctgcttcaggcatatgcgtgcctggcaagcctgctgctgccacactgtggcctcacactcaaaataggccgcaaacagagcatgtcacaggcagccccaggccagtgccctttcagacatctctgttaatgctacttagccctagacattaaaatcatttttggatctagtggacaaggaggagaggagtgaatcagtcaccaagctacattcgttctcctttcagaatctctcccattcatccgtcttccttttcccctcccacttgagacagagtggattgaagctttcagggctgaggaaacacagtggttttctcattgctccctttacagttaggctcctctgccctccagtattgtgc

SEQ ID NO: 206400 - DNA, 332 bp, Homo sapiens
agatgctcggaaggacatggatagttcggggcatgaccacaccaccccttccaatccctggggcaccaaggctttgttaccaggccacagctgaaaaaaaatcagaagacctggtaatgatgggccagcattcctgcatgaccacaatcagctggagctggggaagaggatgctgttgccagtttaccaccgaataacacgtatgcttcttatatgacctgcctggccagtgttggcatctgaattttcaaccccagatgaggaatttctctttggaagcttttacaataaagatttaattcatctgatgaaatgagtttaagatgaaaaca

SEQ ID NO: 206401 - DNA, 740 bp, Homo sapiens
ggcattagggaaggggtatgtaatttcccctttctacaccctaggcctttcctctatatttaaatatattggctttctctcttatgaattcagtctgaaattatttttcactgcctttattacatccctgcttttgatggcaaaatagcttcctgtgttttgaaaacatctgctttccaggtttcacacgagaaaattgattttacttttctcttaagtccagaaaggtagaaagttggacttgtttccaagtgcaacttttccttttcttgtctttcctgaagttatcccctttcagttctgattcactttctcccttttatttcttctaatcacccctcctctcttcctctctccttctaaagaaccagagaagaccgattgcgtcttatttcagaacacaaaattaacatatattttttgtctagtctatggtatgtgttaaagttttctccatattttcttcattcgtcctctgatttggggggaggtaattttccttcagttaaaaaatctcagatttgcaatttaaagtggtctctattcgaagtctctgctctttcacttaaacctttactctaagctgtccccctccactaatgcccccattctttggagatgctcttttcctagttaatttaaacattgctgcgtttgcttagagagagagagagagagagagagagagagagagagaaaggggaaaataataagaaagaaaagagaagggggggaagaag

SEQ ID NO: 206402 - DNA, 681 bp, Homo sapiens
tcttggggctgagctaaaccatccaactttctttcccactcttctctggcccttgtgagcttcagggcttggggtaggcatgggactggcctaggcacacggatcccagggcatcaggagaaaggctggggcttggggtcttgtcttccccagttggcctactgttaggcattaaagcaatttgcccagcaaaaacagaaataagtactgatttatttcctcatttgtgatgccaaattgtaaagattaaggtaattgttctgttaaggtatgaaaataaatgacttataagagacagaggcagataggatattggcaaccttcacaccctagtttgaaaggtactggcctttcttggctgtgctgaggcatgaataaatactatagcaatagtaaccacacctttgttgtattttatttcttcaattaccatctgttgttgcagcttttagctaaagcagagcttcccgaacttccaacttgaatcatagcactgcgtcttggtgaattgattctagaggtggaagttagtgccttaaatttgatgcagtcacatatgccttttgggtgacttcactttgaatcctcaaaggatgacttagagaatgccaaataaacaccctggcaactggtaatgaccttctgggagattctgacagattaaggtttcacaacaaacac

SEQ ID NO: 206403 - DNA, 545 bp, Homo sapiens
caatcttaataaataaaacatttaaaataaaatatatttcacatttataataagagcatttagaaaagagaagatattgagggaaaaaaagaagtgaaaagatggcccagagtggccaagaaggaaagaaaatggtgcccaacgttcacctgaactgcctgtgaatttaggttgtagaactgagttgtttaggctacccaggatccaggttattatggccattgaagtgctatttgcttcctaactgttgttcaagctcacaaactattttattttaaatttgtaaatacttagggcctttcctagtgacaaggagaagtgcccttgacttagtggtggtgaccagaaaaatcttttgagcctttgatcatcttataacaggatcaaagctgccttcaaaccaagcggtctgctttgtattgcaccatcaaaattcaggaactgagacatttgacccttaacatgttatcgcctgcttgatttcacaaccttcactttatcttcacccttcctaaaatgtaccgtggccaaggggaaaaaaaaaa

SEQ ID NO: 206404 - DNA, 388 bp, Homo sapiens
atacagtaactcaggtctctgagtgtctaggacagaatcctacccctgctccatattagctgcttttccttaggtgatttatgtcactaccagaagcgttggttcccttgcttataaatgaggatacaggtccacaatcccttatctagaacagaggtcagacatgttttgaaattcaaagttttttgataatttagagaatggtgttaagttgtatataccatatatatcctaataagcaagatctgaaaccatatcccataataagcagtaatagttaaatgaattgtcaaagtgagaataagataataaataacttcatgttagctcaggtctggttttgccaccaaatgaagtatgaaaatgattctaattttctgagctctct

SEQ ID NO: 206405 - DNA, 421 bp, Homo sapiens
tatgctgcctttgagggacagtgtcccagaggagatacctgtgctcaggaacaggattgtacaaggagtggagaggaggtggatccaggcaggagtggagggaacaaggttaccaccttgttgtgaaagttcatggaataggctgggtgcagtgtctcatgcctgtaatcccagcattttgggaggccacggcagatggaacacctgaggtcaggagttcgagaccagcctggccaactggtgaaacctcatctctactaaaaatacaaaaattagctgggtgtggtggcgtgtgcctgtagtcccagctactccagaggctgaagcaggagaatcgcttgaacccgggaggaggaggttgcagtgagccaagatcgcgccactgcactccagcctgggtgacagagccagactcattgaa

SEQ ID NO: 206406 - DNA, 367 bp, Homo sapiens
caccaggagacttgaccatgaagtccctcctgcctcagctgagctaatttaacagggatacaaagagccgcagaacgattggtttgctgttggtttttttctttttctctccctccctgaaatggaatgcctttcagaatgttttggagtggggtgcattttagatatctctagtccttggcctagccctgacagtgaggtcttggctaagatacttaatgagttctgaatgcccctgtcctcacccttaagcagctgatttttcaaagttttgtttcgcttcatggtataaaaagcctagtcatgtgatctttgtaatgtttcttggttattttaatttttaatggtaaaaaatgcctgacagaaa

SEQ ID NO: 206407 - DNA, 423 bp, Homo sapiens
ttctaattatataatataaaactacttataattctgatgccatgaatttggaattcatgattaagatgggttaggcttttgctaagcaagtgttttcttcatagatactgcaaaccatattttaaaaataagatggcaagaataatgctgaaaatatgtgaaaaacaaactatttccaaatccctgaaagaatctagaagccacaattagcatgaaaatatttgtggtgcttttaatggttattttatatctctgtctctggcttctctggagagtggtgctctcagctgccaggagaacaactaagaccacctggatattccagaccccataaatgcatatgctccagactggatttgatttttgtactcctgctaattgttcctgctgttttcccattttcccatcttcactgccatctac

SEQ ID NO: 206408 - DNA, 508 bp, Homo sapiens
tagctaattatctggtttcttcattttctaactaggaaattgaatttcagaggagtggagggccttgcccaaggtttcatattcagtcagtgctttttccataaaggaccagagtgcctcagttaacatatcccagaagaacttgaaactgaactaaactaaaagattacatgacacagtcactcttaaaaatgtggatgagggaaagagtggtctgatgaactattctgccaagctagtataaagctaaagtgtgcctgtggctcaactttctgactttgcagatgtcaagatgccctgctagattggtgcattagggttacccagagcctcagagtaggctgcggcagggactgctcgggggtgcaagatgggcgacaggtgtgcctccagaggtgttgaatcccggcccacaggtggcagcagccttctattgtgtctgccctcacaggcagtagattctagaaacaagtgttctgtttgttctggagtgcttttatatttggtg

SEQ ID NO: 206409 - DNA, 182 bp, Homo sapiens
ggattcaccctattggccaggctgggtctcggactcctggcctcaagtgatctgctcaccttggcctcccagcatgctgggattacaggcgtgagccaccacgcccagcccagaatgatcttttgaaagcacgtttgattttgttgactcctcgcttctagaagcacatcttcagaataaag

SEQ ID NO: 206410 - DNA, 302 bp, Homo sapiens
aaaaaaaaaaaaaaagggtactacaaagaggatgaaaaggaagacaaattggaggagatgtttgcaatatatatatatattcaactcatatctagaatgtataaagagctctataaatcaatgtgagaaagacagacaacttaattgaaaaagggggaaaacttgagtaggcacttctcaaaagatggtgttcaaatacccaatgaacatacaaaatatcgaacttcattagtcaccaagtaacttaaaataaatcaacaatgagataaaaggatacatccatcaagaatggctaaaataaa

SEQ ID NO: 206411 - DNA, 672 bp, Homo sapiens
gttaaagatgtaccatatgccatgatctaggtacctacagccatttctctgttctttctccatatccttgtctctcattcttccacaatccttccctgcctataagcaattacagtgaaaaatgctggagtagaatgacataagatcttttaaggtcaagggccaggtgatttcagatactatgacttttcagaaagcccaaataagttatttccttacttacatcgctgttgatatatgcaaattatgatgcatgcaggaagaaaaaaaaattttcttaatttccacactctagcaagctaaatggtttgaaatatacttgacaatgttctgcaatattgaaagtagtatctatttctgatgtttcaattcctgtatgtcaaacattatcaaagagggcaatatcgcccccaaggggataaaacttcattattggaaggtggaaagttcttatctttttaatgtacaatattaagcacagacatacatacagtaattacagatacagcatatctgcggtattataatttcatagtgggggattagggaaaaaatatctaaaaaggctccttggaagcagggtggaggggataaccaaaaaagcttaagaaacactattgtacattgtgctttccatttattaaaaatcttattctccccaggttcaggcta

SEQ ID NO: 206412 - DNA, 243 bp, Homo sapiens
ctgttaagacaggatagtgaaagtaaagaaggaaggaaaagggagaaattaaggatcctgtggaaatgaaaaagaaacaagacaacccaaacccttcttctttcgtctcccagtgccagctgtaaaaagtacatagaagagggcaaaggtgacagaaaaaaagactctcagattaggaaccagttcgttcattaaataaataggaatagaataaagtagcccacatctacccaaaacgactct

SEQ ID NO: 206413 - DNA, 814 bp, Homo sapiens
agcgtggaacatgtcttatctaaactcttaaaacgtgtttgttgctgtcaaatatgacttgagttcctgatcgggttatcattgcctaaagacacaggactattttttttattaagataactttgtttttatcttaataaaagagatgatagtcatttcctgacagttttgtctgacggaatgccttctgtataatagtttaaaataattatttttagtgtttggaaaacagcatttaaaagtttgaacagcagaagtctgttttaagaagcttctgttaacccttgaaaagaatcttcctgtgggatattaaaattttggattgaacttgtgcaaacagtactggatttggaaggtctggattctcatcctggctgttccactaagcagctgtctgtccttggacatatcacctaccctctctgaatctgttcagttgtgtgtaaggtggaatacctacccgaaggtttttctgtaaggtacattaaataatacatgtacaattctttttgaattgtaaagggctttatgaacatcaattataatcatttcgcttattaggttctgcagaaagtattctctcaaaagttatactttcatcaagaatgaaaaagactttgtaatggaactctaaaaaactgaaacacgtatcatatgacattattcctttcctatatgtatttcatgcatggaattaaaacagaatgtagccttttcagccatgaaggatgctgagtgtttagatttgcaaaccatttttgttcatatatttatatgaatctctacatatttttaagatttttttttcatatct

SEQ ID NO: 206414 - DNA, 501 bp, Homo sapiens
aacatctatccccctcctctcctcacctcacttctgctttccctggctcgtgtgaggccatatgttggctgtttcagtgctaagcacagggcatggagttcttccataatgttcctgactggctagccaggctgcggggcagggtcttcatagcgctgtcccagcaggcatggagtcactctgaggccaacagctggggcagtaactccctgattcctggattgcagctaaggtgacaccttcctgatgctgataccccaccttcccaatggtgtcctaggcagccgctctcctggcaggcccaggctaagtggccatgcttttgaggcaccattcctagaggcccagcccagagtcccctcctcatgctagcccaaggacttcgtaagcacccgactccctgcactgcatttgtttctgcttaaaatagcctgagtggtctctgctgttaggcactgactgacccctgactgatacagtgtagaaggacaattacagccc

SEQ ID NO: 206415 - DNA, 285 bp, Homo sapiens
aagtctaatctataggatcccctgatcttccgtcccaacatcacatttaggtttttgggtttttactttgcgtattttttagacggagtgtcgctctgtcacccatgctgggattacaggtgtgagccaccgcacctggccagacctgctaaatgtttaacctctcctctgcctcctcctgacatcttcaaaaaatgttgctgcatgctgtcttatgtacatggtaggtgtgttggagggagttggtgaagaattcaggaagcatcaaggaagggctgaatttca

SEQ ID NO: 206416 - DNA, 594 bp, Homo sapiens
ttgtgggtcacatatggttggcagtctgctgacttatgacctcttccatagcgtctctgtcacagaatctttcagattacatgttattacatgttattgtttctgtgtattcttcccactgggctaagagctcctaagggctaggttatgtcttatttttcaaaaatcagagacacagtagatgctcaaaagaaaaaaaataacaaaaacctatccttttgcacattttctttttcttaaagtatgaccctctatttaccctccagaacaatcttttcgtatcttagtcttctcagctatacaacgtttatttgtaaagttctagtcgtcagaagtcacagtgcttaagcagatattccagtctgggacagaacctccaatttaggattcagcaaataatagcattgagataggcactctgagggccacaaaatgaaaagaatgacatgaccccttaaacacttgataatcaaatgggctgtattttagaaacaattacataacaatacaatttagtacaagatcaatacaatataatacaatacagtttagtatgcaaatgggaattcaggaagggcgtgttcttatagtgtg

SEQ ID NO: 206417 - DNA, 529 bp, Homo sapiens
aaatgatgccacagagatctcttaaacagatttttactactttagaaggtggtaactgatttctggagttgtattaagtacaaaagagtaacttattgtcatttttttccctattgatgcgtatatttgagttagagggaagcagtcgtctttgtgttatatgcttatcatgtatatttcatcttagcaaatttattaattttagtgacagttttattgagatgaaatttatataccaggagatttcatctctaagtgtacaattcagtgatattttaatatattcaccaagttatgcaactaccagtactttgtaatcttaggttactttcatcatccttcttctggacgccctctatcacccagccctaggcaaccactaatacactttctgtttgtataggtttgcctattctgggcattttataaaaacagaatcataaaatatttgtccttttgtgtctggcttctttaatttagcatgatatttaaagcttcactcatgttgtagcatgtatcagtggccatt

SEQ ID NO: 206418 - DNA, 602 bp, Homo sapiens
cacaccccccttcacctcccagcaagcctgccagccggctacctcaattttcagtctgaatgattgattgcttcaacgggctacaacacaacagaattaagataacacacgctgtaactttaaggactgcaacatgaccctcgccccattccagcagaaggccactgccaggacgtggtctttattttgtgagtcgagcccagactgaaagctctgagcttcaactgccctgtgttacatgccccctccaactggcatcacagcaggcctgagaatctggaaggcagaagggagagtgcggcagagaagggagagggtatctcacagaaatgcacttttacgcagtgggcctcccagaagctccccccagcaccatccttcctgctgccagtcagtgaatcccagcttcatgctctgtgctagttccacggaatgaccacggctattatttagttaatattttcctttaaactgacccatttagaaaacaaacccagttcttcataaagaaaccttatgtctctaccatacatggaaaactagtatcatttgtcattttcaatcaaaataaataaattgaatctctgtaaagacaaaaggtg

SEQ ID NO: 206419 - DNA, 334 bp, Homo sapiens
cacaccccccttcacctcccagcaagcctgccagccggctacctcaattttcagtctgaatgattgattgcttcaacgggctacaacacaacagaattaagataacacacgctgtaactttaaggactgcaacatgaccctcgccccattccagcagaaggccactgccaggacgtggtctttattttgtgagtcgagcccagactgaaagctctgagcttcaactgccctgtgttacatgccccctccaactggcatcacagcaggtgaaatgggaactacaggtgaaatgggaactgcaggtgaaatgggaactgcaggtgaaatgggaact

SEQ ID NO: 206420 - DNA, 407 bp, Homo sapiens
caattttattatgatactgctggttgtagagtggaaacaaaggtcaaccaaagagaccaatggaggtttttttatgaccttgctactcaaagtgtgatccctgaaccatgggcagcacctggagcttgttagaaatgcagggtctcaggctcctctccagatccacttaatcaaaatctgcattttgaaaagatccccaggtgattcaaatgcacattagttttttggaagaattgttccaatatttttgtgcttatttcctaggagaatcaaacttggcaacctgatcaaatggcaaaatgaagttgctctatctttattaatttcagtggagtaattttaaccttttattagtaaactaaacctaggtccatggtataaatcataaactctaacatatgccttca

SEQ ID NO: 206421 - DNA, 100 bp, Homo sapiens
tataaaataaatattccacgaaatgttggtaaaaagagaaagatgaaatattactgtattttagtagatattttagaactgctgcaagattttgttaggg

SEQ ID NO: 206422 - DNA, 141 bp, Homo sapiens
tcacaggcctggaggcctaggaagaaaagatggttttgtgggccgggcctagggcctgcctactctgtgcagcctaggaacttagtactctgccttccagccactccagctatggtgagcaggggccaaggtacagctcag

SEQ ID NO: 206423 - DNA, 602 bp, Homo sapiens
cttattttagaagtcttccctcgctgtggtatatgttctaggttgttttaagaactctgtaatttgaattttgtccagaagctttaaagagctttgatttcctcctggttatatacttttccagtcattggatgatgtgacaatgaagggacagtggatacaaattacagagttggatgtaatttttcagatgcactcaaggcatactaatttttttctacttcaaagtcatattggtcatcaggttcttctaatacaattttcccactatctttagtctactctcctgggccatatcttttgtttcttccagagacacttgcttcttctggctcatattccttagcatgcttgtggaaccaatagaaagtattcttgatgccagacatcacctttgcccctccatgctgtggttcacacacccatctctgcttggccttctgggtgctcagagatgtgtaggcatttctctttttacccttgaagatcctctggaggtgccctttgttagtgtcagctgaagaatcatgaagtacataaatttggaaagaagagctttatttctcacaaagggttgcagcttgcagggtggccattctgac

SEQ ID NO: 206424 - DNA, 348 bp, Homo sapiens
tgtagaaatctatcctcaaggaaataacttctcagtgttccatctgctattctactactcctcaatgattattcaggcccactaccttctctacacatcaatctggaggatttgcccccacccaggactggcaaattagctttactcaacatgccccgagtcacaaaaactaaaatacctcttattctaagtagacactttcactagttaggtagaggcctttcctacagggtctgagaaggccaccgcaatcctttcttcccttctgtcagtataccaatgatggcgcgatgtaacacgagaaagcacataccaaggccaccacacaccacctgtccaaaaaggcct

SEQ ID NO: 206425 - DNA, 1041 bp, Homo sapiens
tgtagaaatctatcctcaaggaaataacttctcagtgttccatctgctattctactactcctcaatgattattcaggcccactaccttctctacacatcaatctggaggatttgcccccacccaggactggcaaattagctttactcaacatgccccgagtcacaaaaactaaaatacctcttattctaagtagacactttcactagttaggtagaggcctttcctacagggtctgagaaggccaccgcaatcctttcttcccttctgtcagacataattcctcagtttagccttcccacctctacacagtctgataacagaccagtctttattaatcaaatcagccaagcattttctcaggctcttagtattcagtgacagactaatggtctattaaaaacacacctcaccaagctcagccaccaacttaaaaaggactggacaatacttttaccactttcccttctcagaattcagcctgtccttggaatgctgcaggctacagcccatttaagctcctgtatagatgctcctttttattaggccccagtctcattccagacaccagaccaacttagactgtgcccccaaataacttgtcatccgtactatcttctatctagtcatactcctattcactgttctcaactactcatacatgccctgctcttgtttacactgccggtttacactgtttctccaagccatcacagctgatatctcctcctgctatccccaaactgccactcttaactcttgaagtaaataaataatctttgctggcaggactatgctgaacctccttaggcactctctaattagatgtcctaggtcctcccaattcttagtctttttatacctgtttttctccttctcttattccatttagtttttcaattcatacaaaaccgtatccaggccatcacccatcactctatatgacaaatgtttcttctaacaacccacaatatcaacccttaccacaagacctcccttcagcttaatctctcccactctaggttcccacgctgcccctaatc

SEQ ID NO: 206426 - DNA, 435 bp, Homo sapiens
ttgtatataatttttgattctcccaaaatttaactgctaatagccttatggcttactgttgatcagaagccttatcaacaacatagcttcctaacacatattttatatgtttatatgtcttatatattgtgttcttaaaataaactaggaaaaagtgttactaagaaaatcataagagaaaatatatttactgtttattaaatggaagtggattatcatagaggtccttattctcatggtctttttgttaagtggagggggaagtgttattgtctgtgggatgacagaggcagaagaaaatgcacgtgtaagtagacccgtgcagttcaagcttgtgttgttaaaggtcaactgtaaataggaaataaggaaaattaaaaatctataaaattgatatttgtacatatatttgttttaaaataaaatttaaaatat

SEQ ID NO: 206427 - DNA, 372 bp, Homo sapiens
aatataaaaaggatcatactgagaggtcttatattcattccagctccatccctcctgactgtgggatcagctgtgctgcctgtttctccatctttaaaatgaggatattcatgcttgttttatctgatcttacagcagtcttatgaaattcaggttaggtatcaaatatgacataagtttgaaatctatggcatgttccagatagcacttggcggcagctacctagaaaggtatgtatggaaggatgatgaggtctcaatatctgtgtcagtatgttgtgatagattagtcatgtctgccttgggctcagaagaggcaaatgggagtatgtatgttgtgcattttctaaacatagtgctatgaaaatgtaag

SEQ ID NO: 206428 - DNA, 453 bp, Homo sapiens
taaactttgtttttcactccggctaaaaacaagatcataagtgatactagatgcaatccctgtccctgtactttgtctgaacaattccctgggaaggaactagagccgcggtatagcctgtggtgccaatattcaccactagatgatgctcctgccttggtaagtcatctgctgactaccttagagcagaataggcagaaacagcaaactgggccgatcctgtgccacagagtgaaatactgtcagccctctgtctccatgggttctgcattcgtggattcaaccaaatgggaatggaaaatgtttggaaaaaacaggatggttttgtctgtgttgaacatgtaccgaccttttttttcttgtcattattccctaaacaatacagtaccacaaatatttacatagtatttacatcatgttagggattataagcaatctagagataatttaaag

SEQ ID NO: 206429 - DNA, 408 bp, Homo sapiens
ggttggaattctctagataatgtctggccactcccaagaatgactgtttgtcttatatacaggttcgagcacaacagcagggatcctacaatagcagagagctgccattccgttctggccatggacccctccccaacatgcagggcagaaggtggggatctgaaaacaggaaatgacaggggctgggtgtgggagtgggggcttcaatgctgcaggaacacaagcaacaaacatctcaagctgtgcaatgctagaaggcagctggaaccaaaacgttgactggaggatgatgcagctttgttgtattttaaaatgttcatccttccattttttttcctttagttcttctgagcacgctggatgcaaaataaaaataaaaataaacatgtagccagaacgacccaccga

SEQ ID NO: 206430 - DNA, 343 bp, Homo sapiens
ttaataaattacatgagctattcaacactttattataaaacacgctttatattgggtgatttttgcctaactataggctaatataggtgttctgagcacatttaaggtaggctaggctaagtaatgatgtaaattatagtgaatcaacgtgaatgtacttaacactactgaactatacactcagtggttaagatagtaaattttggccaggctcagtggctcatttccataatcccaacactttggaaggccaaggccagaggattgcttgagcccagcaatgctaaatgaaatgttgaatacatttcaacttacggtattttcaacttaggatgagtttgtg

SEQ ID NO: 206431 - DNA, 185 bp, Homo sapiens
ttagcaacccagggttgccatcatttctcttaaattatcaacacaaccagtagctggcatgctgctatgatagtcaacccctccaagaaagctgtgattcaaaaatcagttgatgagattactgcttaacagaaatatttgaggcaagcggttaggatggttagtaaggttttaataagcggaaa

SEQ ID NO: 206432 - DNA, 357 bp, Homo sapiens
ccaaaatgctaggattacaggcatgagccaccatgcctatgctaggattacaggcatgagccaccatgcctatgctaggattacaggcgtgagccaccatgcctagccccatctcatggctttaagactaaagtgttgaagcagaaaaggagcgagggtagaccaaagaaggaattatttagatataaatattttattagcctagaattaattttagaatatggtaagatacgtgcccaactttcccctcccacctggttagtcaactttttcaacactattgctgaataatctatgttttccattgtgatttgaaatcttgtttgaatcattactaaattcttgaatacttgagta

SEQ ID NO: 206433 - DNA, 231 bp, Homo sapiens
tggcaaaagctgcgtttgttcagcgatcagcctcccgggaaaagctcgtgttttgtgactagccgggtgtcttcgggctccgtgaggggttgacagataaccatgctgccttctggaggtcggcgcttccccagccttgaggcgtatgttccaagggaagtaagcctgcaaatgagccttctaccatgtgatacctatttttctttttaaaaaatcgtttcatgaaaatcc

SEQ ID NO: 206434 - DNA, 656 bp, Homo sapiens
ttttatcataacaatatgaggagtaattcatcatataatgtcttccaatccatgaagacaggatatctttccatttatttatgtcttctttaatttcactcagcaatgttttgtagttttcattgctagcgtatggaaattcaattaatttttgtgtgctgattttgtatactacagctttgctcaattcacttattagctataatcattttttttgtgtaacctttagggttttgtacatatataccatcatgtcatctgtaaaaagagacaatcttacttctccctttccaatctaagttaacttttatttctttttcttgcttaattactggctaaaacttctgctactatatttaataggagtggtgaaggtagccggacacggtggttcacgtctgtaatcccagcactttgggaggctgaggcgggcagatcacctgaggtcaggagttcaagaccagcctgaccaacatggagaaaccccgtctctattaaaaatacgaaattagctggacatggtggtgcatgcctgtaatcccagctactcaggaggctgaggcaggagaattgcttgaacctgggaggcggaggttgcagtgagccgagattgcaacatggcactccagcctggcaacaagagcgaaactccatcg

SEQ ID NO: 206435 - DNA, 218 bp, Homo sapiens
agtttgtagagatggtaagcaaacttaccaaggtcagcaaacttcttctgtaaaggactaactagtaacatttcaggctttgcaggccacatatggcccctattaaatattcttcttcttctttgtttttctttataatcttttaaaaatttaaaagccattattggccgagcacagtggctcatgcctgtaatcccagcactttgggaggccaagga

SEQ ID NO: 206436 - DNA, 674 bp, Homo sapiens
tctacctgcactgtatggaatttgttatagcctatgttgtagggtagctgaaatcacctcaccatcctctgggtttccagagcacctccattcttatagcccatgtgagtcgtatggtggggtgtggttctatgtcctttctcgccctctgtctgggactgccgagagagcaggtctcatgtcatttatttgtagagtctcagggcctattgcaggatctgacagagtcaatgactgctacctttgcggaatgaatgaataaaatcattaatggctgaatgtggctggcttttccacgtcttcccacagctggggtacttaatattggctgaggccatcctagaccagccagcctccagttgttctgccgatagatacaaaacagagttgagattagccaagcctgtccggatcagcagaaccagctggttgacccacaggacaataatacacagttgtttcaagccactgccttgggggtggtttattacacagcaatagcttactgatacattggagaaggagagagggaactcttcacagagaaggggatgcctcagcagggtcaggaagaatgaatggtagtttgctagatgattgagcagagaaagcagcatttacagcagcaagatggcaagaagcagcattgcatcaacaggaccataacaatccta

SEQ ID NO: 206437 - DNA, 390 bp, Homo sapiens
ccctcatccactgaattgagagctagccaatgccaaacacataaatgaggccatcctagaccagccagcctccagttgttctgccgatagatacaaaacagagttgagattagccaagcctgtccggatcagcagaaccagctggttgacccacaggacaataatacacagttgtttcaagccactgccttgggggtggtttattacacagcaatagcttactgatacattggagaaggagagagggaactcttcacagagaaggggatgcctcagcagggtcaggaagaatgaatggtagtttgctagatgattgagcagagaaagcagcatttacagcagcaagatggcaagaagcagcattgcatcaacaggaccataacaatccta

SEQ ID NO: 206438 - DNA, 380 bp, Homo sapiens
agtttttcatttgtctttctttaatggtgacaaataagtgaagctgcctgggaatagtgcctagtggtgtggttgagaagagatggtgaggggccaggtgcggtggctcaggcctgtaatctcagcactttgagaggccagagccagtggatcacttgaggtctggagttcaagaccagcctgggcaacatagtgagaccccatctctacaaaaaaattaaaaaataaaattagccaggcatcatagcaagcctctgtagtaccagctacacaggtggctgaggcaggaggattgcgtgagccagggagttcaaggctgcagtaagctatgatcataccactgtactccagcctgagtgacagagtgagacattgtctct

SEQ ID NO: 206439 - DNA, 350 bp, Homo sapiens
ctgtgagccattcatacttcagactgttcctctttgtgttttacgctgtctgtctctgtagtaacactgtagacatgttcacagatattgcagctgggcccctcacagcatggggcaggaggtgggccccctggtgggtggggctagaaggtggccttggagtgtccgaagatgcagatggggaagatgcttcagtgagagagagtccacagggtagagatcagcacctaggacagagcctcgagaacttcctctaggatagggaagggctggagaacaggaggaggagccaaggagaggaggaaggggccaagagggcaggatcaggactgaggcaggccgacttctgc

SEQ ID NO: 206440 - DNA, 385 bp, Homo sapiens
aatttcaagaagtgagtagttaacatcaaatgcttcggagaggtccaaaaagattttgaaaatcatagttggatttgatcataggggcatgtttggtaatcttgcagaaccatgtgctgcacaacacgttgcacagtggaacaacagatgactgacagtgactcccaatccagagctctttccagtataccacattgtcaaaactttgtcttaaactcttccctctctactctctcccaactacctgaagtccattggcagattattatatctttttgtttaaatacaatagagaattattgaatgtaacttcagagctttatgttcagtacttttttggatctaaatttgtaggttctacagtatccattacctgaaaaaaaaa

SEQ ID NO: 206441 - DNA, 345 bp, Homo sapiens
tgggatgtcagagtctccttggaagagtcctaattaaggactcagaatgattgacaggtggtggaagctcaagaaagcacacttgatatgcagcagaagacagtctgtgagttgcaaaaaacctggcaattggagaccttgaaaaacttttgtgtaattggtattgatgttatccatatggtggacaaatgtgatgtctgcagaatgtcaagacaatcaaagtctctgcagactctactgtgagagagaaccctcagataagacataatgaatgcatactgctttcctttccatgaaaaatgtgaacctcttttgatcttccttactgataaaggttgagaagta

SEQ ID NO: 206442 - DNA, 1621 bp, Homo sapiens
ctcccccagcacccagagaatctctctgcaccacgtattccagctggaggtggcgtcagcaattctggactgctttttctatcttttcagtgcctcattcagtgatgtcaagttaaaaccagaaacgatgggtgttcaccagatttttggttcttatgaagggacatggatggagctggaaacacttatgctcagcaaactaatgcaggaacagaaaaccaagaaccacatattctcacttataagtgggagctaaacaatgagaaaacatggacacatgtgggggaacaaaacataccggggcctgttgcagaagcaggcagggtgagggagagcatcgggaagaacagctaatggatgctgggcttaatacctaggtgatgggttgatctgtgcagcacatcaccgtggcacatgtttacctatgtcacaaacctgcacatcctgcacctgtacccctgaacttaaaagttgaagaagaaaaaataaatttgcatatagtaatttttaggatacactgttagggtcaatacatttcatacggttttaacgtatggctcatcttaccctacaaggaatattggaaaattgtctgggggcaaaagagcctgacctttgtgctgtcatgttgacaagtcttgtgaggaaagcggccctggaaaggcacgtgcctctgtgcaaattactttccagcagaggtaattcccatagaggctaatagttaaaggctttgtgccaagcctcactccacacagctagaggaaaaaagtgcctcattatttaggaaaatctgggtgaatcatcaaggcattcaccacagttttcacatttgcttatggttgttttgccctcagtgttttcatgttcatgtattggcctcaggattcctgcaccagatgaatgatataaaattgaatccatatgcccatttggtgcataccttgaacattgctttaacttttacacagaatatgtttttgtttgtttgcttgtttctagaagttccaggaaaagaaacaaatttcatgtagcttctttacaccaaggagaaaaatctttcccatttttttcaattgaagggtcagcttgttcagggtcccagatttgtgctatttcaaagataaatccctgatttaccttgatgaaagccagatatcttatctccacataggtattagcccctatcacctaagtctataccatattcagtagaatttcccttgatcgcttagagatttttttttctgtcatctgaggatttgcctttctttccagcagatatatttttaagcattttgatcacatagaagaaacatttgtaaatattttagcatgcagtgttgtccacattgactctgtccacagttttttgaaacaaaattctccaaaatgtttccaattctctatagcatggtaaaatgttacattaacttttcttccttctttttgtcaataaagccatgctgacaatttaactatgtgcctggagctagaatataaaatttataacatcaggtctttatcttaggtttttaatcaattttggatccttttgtagagaagctcgatattctcaactaaatatcgtaatagtatatttgaatctaatcgtgtaaactat

SEQ ID NO: 206443 - DNA, 748 bp, Homo sapiens
tagcctattatacacatagactcaatgatacagcttatcgctcttaggctacaaacctggacagcatgttaccgtactgaagactgtaggcagttgtaacacaatggtaagtatatgtgtatctaaatatatctaaacatagaagaggtaatgcattgcactataacattaccttatgacagccacgacatctctaggtgacaggaattttttagctctattataagtttctgggatcaccattctatatgtgatccatcattgactgaaatgtcattatgcagcaaatttgtatataactatttccattgcgtctgcctaaaaatcttagtagtgtgggcagaacttgattagggattgtttaaggcatatatggtcaagcatatgaatttcagatatttatgtttatggaagactcctttgtaaaaaaaaactgaagaagaatcagaggtgatacattttagttcctgtttattttgaaagccaaaagtctgcacaaattgcagaccaaagtatcacaaactactaacaaggcagtggtttctaataaatgttgctatctttgtcctgagcaaccttgcaaaactgtacattcccactcataaaaaatggagaactttttccctatagtctagggcagagtgataagtttttctcataattccacatagcttatagttaaactcagtgtagaagagtgatgaacacaaaacaatacatactgtattcaagaaatcagaacaggtgc

SEQ ID NO: 206444 - DNA, 231 bp, Homo sapiens
tagtgcgatgagcttttttctttttgtttcactcttatagtgccaagaaagattttctgaagtggcaacaattagcgtgagccctgactctaggatcctcgtttactgtccatggtgcaatgtactgatacccaaatcttgtatgcaatcaaacacaaggcagacagatgccagcgaggtgccaggggatggggagccagcctgctctgcaaccctcccacaccctcatct

SEQ ID NO: 206445 - DNA, 197 bp, Homo sapiens
gactaagacaggcattatgtaattaattctgtttctctcagaagactaataaatgctactgactgttgagtcaagacttggaaattcttgtctccaaaattttatcataatttcagattggacttcaaatggttttatcctatgaataatgggcacatactatgtccctaaatacatgagcctgactttattgctta

SEQ ID NO: 206446 - DNA, 845 bp, Homo sapiens
ggccttgacatcactggctcccaagtcccatcctgttttttcattgacctgcttgtgccaggtactgcgttaggaagtggagctaccagatgaataaggcgtggtcccgccctccatgtgggagacggcacgtcagtgtacttaggatgctgcatgtggtgacagatgagggccctgcaagggagcacaccacagggccgggagggtgggatgggcgggaggagtagccaactttgcccgaaagcatcaggacaagcttccaggaaatggcacatccaagctgagtcttggacagcgggttaaagaggcagagaggggagagaggaatgttccacatgggaaaagaggtctggaggtgacaacaagtaacatagagtatgtgggctgtgccggaagcttgatattacagaggcacgaagtctgaggcagggagtgtgaaggaagatgaaggtaggggaaggaagtttacacaagggtggccttgacttttatattaaggcactttagggaagcaggaaccactgaagacaggagaacatggtgactacacgggcgcattgaaggggggaggagctaggtttttgaagggaatttgagcttgcaatttttcaagggcattcaatggttataaatgaaacttttcattaatatatttgtgtccaagtgtttttagatgtgcttttctgctactctctttttatttggtttggagatagatggtgactttccttcagtgccttctatgtgtcttgacatgttaatgtctcaaacacatggtccgtatcatcatggagcttgcaatctaacagggtagtttaacacataaatatgcatccagttggaaa

SEQ ID NO: 206447 - DNA, 294 bp, Homo sapiens
gagttctggggcctcaggctgaggtctctgaagcttggtttgcatttcaacagcgattcctcctgctccaaactgtctcccttagggatcgttaccagcttggtcgctgctgtgttgccagtgtcacctttctggagccaggtggctctcttaagggcagcgtttggtcagctgggaaaaggaaactcggaagcaggctttgccctggtttcttcatgtctcttcctcctcctgacttgggacccgaggggaagagctgcagagctcatgtgttgctttgcattgacgccaggc

SEQ ID NO: 206448 - DNA, 329 bp, Homo sapiens
cagggttaactccaaatattttcactaaggtattgtttttttgggcaaaaatgcatagtgaacattgtggagctgaagtgagggaacttcgatttctgagaaaccactagttttaagggttttgaaggaagagttggaggaggagaggaagagaataaattcacagttaatgagtttccagtattttctgtcgcattttacgttgtaatggaaaagactgggaactgaactcacatgcagtttgtcaaatcactttttccctagcattcaggattgatgagattaacggggtgttaaaggtaaactgaggcacataattaacatggaca

SEQ ID NO: 206449 - DNA, 437 bp, Homo sapiens
ttcactctagaggaccccaaccagtaataagactcattgagttgaaaatcaaaaactactgggctttggattgttctggtttgatctgtaaagaatcccgatgcaatgattcaagagtcacctcatatcatgatttgtttcacctgtctcctatgactgcacactcaggccatctgcaatttttccaaagcaaataattagagtgtaattttaatcagtttaatatttatagtaatctttatacttttgcacaatttgggccaggtatctattaaggagatctttggtcctctgattgagattagtgaagatacacaaatacgtgactctcacatctggctctccataactaagtacaacacgattatagttttgaatcactggagaactgccatgagatgacactagaccaccttgaggctgtttgtgactgtata

SEQ ID NO: 206450 - DNA, 403 bp, Homo sapiens
ggcatggtggtgcatgcctgtaatcccagctactcgggaggctaaggcaggagaattgcttgagcccaggaggcagaggttgcagtgagccgagatcgtgccattgcactccaacctgggcgacagagcgagaagactctgtccccccacaaaaaaaagaatgctagctgtcctgggcctggcactacagactagcactttgctccttgctgttttcatctagaataggggccagtaaactacagttcctgggctactcacttggcctaccgccttgttttgtaaataaacttttattggagcagtgccaccaagctcatttatgtgctatctatggctgccttcataccataacagcgaagctgagtaattgcaacaaccaccctatggtccacaaagccta

SEQ ID NO: 206451 - DNA, 352 bp, Homo sapiens
gacagggcaggagtcaggcaaaggtcagcttgcccagattgttctggtccaaggatctggaccgcaagctttgagatgacaatgtagcaacatgcttctgtgtggggaggggtgggagagaagcctggtcttgagccctttttgcctgaggtgttctcagcagatggaggctgcctgctcacccctgctgcttctgcctctttctggtgacaggcgggatgaatgggtggcagagcacgcagatgtgggcagatgtgctcaggccctacattctgtgcaaataaagttctcagcaaagggtttagtgttgcctcttgccacccttctcctatgggcatcagggcacgtatgg

SEQ ID NO: 206452 - DNA, 612 bp, Homo sapiens
atcatcgaaaccgcaaacatatcatacacaaacgcctgagccctatctattactctcatcgctacctccctgacaagcgcctatagcactcgaataattcttctcaccctaacagggatctctctgtggggatgatgtggcagacaggcttggagaccttggggaagtgggcgaggctcagatacagccacagagacagacactgaggatgagagtggggaaagaggcctgggagcccacatggagatgcagaaggagaagaaagtgacgcagtcacacacacagaagagggccggtggtcagccccatgggacgtgcagctcatgagccaatggtacccaaatgtcctgcccagccaatgaaggagacaacgctgacctgcatgaaccctggctctccctggcttccagaggttgagagatcccttccccaacatgcactcaaactagcatccacctttaacgagaaatcaaaagaacaagaaacgtcatgccaatctcctgtggggtgaccatctgatgagttttgtccgctcaggctgcccagtgcagggcaccgtcgaagatggggtggactcagggtgggaagcaccccgcaccttcctgctccact

SEQ ID NO: 206453 - DNA, 598 bp, Homo sapiens
atcatcgaaaccgcaaacatatcatacacaaacgcctgagccctatctattactctcatcgctacctccctgacaagcgcctatagcactcgaataattcttctcaccctaacagggatctctctgtggggatgatgtggcagacaggcttggagaccttggggaagtgggcgaggctcagatacagccacagagacagacactgaggatgagagtggggaaagaggcctgggagcccacatggagatgcagaaggagaagaaagtgacgcagtcacacacacagaagagggccggtggtcagccccatgggacgtgcagctcatgagccaatggtacccaaatgtcctgcccagccaatgaaggagacaacgctgacctgcatgaaccctggctctccctggcttccagaggttgagagatcccttccccaacatgcactcaaactagcatccacctttaacgagaaatcaaaagaacaagaaacgtcatgccaatctcctgtggggtgtcttttaggatggcaagggacttcctgtaacaatgcatctcatatttggaatgactattaaaaaaacaacaatccagtgtggagagag

SEQ ID NO: 206454 - DNA, 1340 bp, Homo sapiens
  misc_feature (22)..(22): n is a, c, g, or t
  misc_feature (36)..(36): n is a, c, g, or t
  misc_feature (49)..(49): n is a, c, g, or t
  misc_feature (68)..(68): n is a, c, g, or t
  misc_feature (73)..(73): n is a, c, g, or t
  misc_feature (77)..(77): n is a, c, g, or t
  misc_feature (108)..(108): n is a, c, g, or t
  misc_feature (123)..(123): n is a, c, g, or t
  misc_feature (133)..(133): n is a, c, g, or t
  misc_feature (143)..(143): n is a, c, g, or t
  misc_feature (148)..(148): n is a, c, g, or t
  misc_feature (164)..(164): n is a, c, g, or t
  misc_feature (169)..(169): n is a, c, g, or t
  misc_feature (179)..(179): n is a, c, g, or t
  misc_feature (188)..(188): n is a, c, g, or t
  misc_feature (265)..(266): n is a, c, g, or t
  misc_feature (281)..(282): n is a, c, g, or t
  misc_feature (293)..(293): n is a, c, g, or t
  misc_feature (296)..(296): n is a, c, g, or t
  misc_feature (299)..(299): n is a, c, g, or t
  misc_feature (310)..(310): n is a, c, g, or t
  misc_feature (312)..(312): n is a, c, g, or t
  misc_feature (317)..(317): n is a, c, g, or t
  misc_feature (333)..(334): n is a, c, g, or t
  misc_feature (338)..(338): n is a, c, g, or t
  misc_feature (347)..(347): n is a, c, g, or t
  misc_feature (354)..(354): n is a, c, g, or t
  misc_feature (359)..(359): n is a, c, g, or t
  misc_feature (363)..(363): n is a, c, g, or t
  misc_feature (372)..(372): n is a, c, g, or t
  misc_feature (378)..(380): n is a, c, g, or t
  misc_feature (1082)..(1083): n is a, c, g, or t
cgccggctggtccggtccggtnttcccgggatgtgnctcagcctgccgngccgcagtttccgtggtgngagtnagtncgggcccgtgtcccctctcccgccgccgccntgggctgcacgttgngcgccgaagncaaggcggcngtggngcgaagagatgatcgnccgcnacttacgggnggacggggnaaaagcggccaaagaagtgaagctgctgctactcggtgctggagaatctggtaaaagcaccattgtgaaacagatgnnaatcattcatgaggnnggctattcagnggntgnatgtaaacaananaaagnagttgtctacagcaannctanacagtccancattgcnatcanaagngccatgggncggctnnngattgactttggggaagctgccagggcagatgatgcccggcaattatttgttttagctggcagtgctgaagaaggagtcatgactccagaactagcaggagtgattaaacggttatggcgagatggtggggtacaagcttgcttcagcagatccagggaatatcagctcaatgattctgcttcatattatctaaatgatctggatagaatatcccagtctaactacattccaactcagcaagatgttcttcggacgagagtgaagaccacaggcattgtagaaacacatttcaccttcaaagacctatacttcaagatgtttgatgtaggtggccaaagatcagaacgaaaaaagtggattcactgttttgagggagtgacagcaattatcttctgtgtggccctcagtgattatgaccttgttctggctgaggacgaggagatgaaccgaatgcatgaaagcatgaaactgtttgacagcatttgtaataacaaatggtttacagaaacttcaatcattctcttccttaacaagaaagacctttttgaggaaaaaataaagaggagtccgttaactatctgttatccagaatacacaggtaccaatacatatgaagaggcagctgcctatattcaatgccagtttgaagatctgaacagaagaaaagataccaaggagatctatactcacttcacctgtgnnacagacacgaagcatgcggccagaatgcgaaaaagactgcctggtacaagaacgaacagtccacttaacaaaacgaacgttacaaaagggaaccggtggcgactccacacttgcagcagcacgggacggctagggaagagcgaccacaagaagagcacagagacgaagacccaaacgcacgaccgcgtgggccgcaggagggcacaaacaagaccgaacgcaggaccaggaaacgcggaagcaggccgcaacaacgc

SEQ ID NO: 206455 - DNA, 357 bp, Homo sapiens
tggccagtatttgtcacgttacttatgactctctcagtagctgtgatgggatgctgttctgtacgagtaagtctctttttcaggcattgataccagagggccatgtggcttcctatagcactaggaataaaactcaagtgtgtccgcaaggtcgcctgtcacctggtgattggccacctctcagctcctccccctctcttctgtctggcctgctgtccagccttctggccccttccttcttggtgctcagagattttccattttgaattccacctctctggaacatcttcctccctgggtaacccatggggcttcctctctgtgcattcgggtccctgcttgatgttgccttatcag

SEQ ID NO: 206456 - DNA, 201 bp, Homo sapiens
taaatttttatcatcacaacatcccccggttctagctcatggcctaacaaagcagatacttaataactttccacttaatgactaaacacaaaatgtccagagactttaaattaacgacatcttacacacacacgttttaaatatataatgaagaaaaattataagcaggaaaccaagagaccacattatgtaaaaaaatag

SEQ ID NO: 206457 - DNA, 167 bp, Homo sapiens
cagcccgcctgcacccaggtgaaataaacagccatgttgctcacacaaagcctgtttggtggtctcttcccacggacgcgcatgaaaaattcctttctattttgcattataattatttatacacaaattttatttgccttaccagtgtataagctacttcaaggcag

SEQ ID NO: 206458 - DNA, 476 bp, Homo sapiens
ctagctcctaggggtggcgggtagctgcacgcagtaagtaaaccttgggaagagagactactctggatgcattgacttgcatatttcagttacatgtgttattggacattactcaattgtagtcaacgaccactgtattcttaggaaaatcccatggaacagtgctatatacgccagtctcgtatgtccagtctcagcagagcctcagtatctggtatattccaccgttgtggggcaacctgcagaccctgaagacttctagttcaattttgttaactgagttttggttggtattccatactagagttgccatggagaaagaggctaaagtgatgtccaatgaagagaaaaaatttcagcaacatattcaggcccaacagaagaaagaactgaatagttttctcgagtcccagaaaagagagtataaacttcgaaaagagcagcttaaagaggtacttatgtcataaaactttcca

SEQ ID NO: 206459 - DNA, 777 bp, Homo sapiens
caggaggcacataatggaccagcagtagaagcacaggaagaagaagaggaacaagatcatggtgttggccggacaggaacagttaatagtgttggaagtaatcaatccattcccagcatgtccatcagtgccagcagccaaagcagtagtgttaacagtcttccagatgtctcagatgacaagagtgagctagacatgatggagggagaccacacagtgatgtctaacagttctgttatccatttaaaaccagaggaagaaaattacagagaagagggagatcctagaacaagagcatcagatccacaatctccaccccaagtatctcgtcacaaatcacactatcgtaatcgagaacactttgctactatacggacagcatcactggttacgaggcaaatgcaagaacatgagcaggactctgagcttagagaacaaatgtctggctataagcgaatgaggcgacaacatcaaaagcaactgatgactctggaaaacaagctaaaggctgagatggatgaacatcgcctcagattagacaaagatcttgaaactcagcgtaacaattttgctgcagaaatggagaaacttatcaagaaacaccaggctgctatggagaaagaggctaaagtgatgtccaatgaagagaaaaaatttcagcaacatattcaggcccaacagaagaaagaactgaatagttttctcgagtcccagaaaagagagtataaacttcgaaaagagcagcttaaagaggtacttatgtcataaaactttcca

SEQ ID NO: 206460 - DNA, 265 bp, Homo sapiens
tttttgaaatgtgaaaaattggtgaggttagattaagttcatttggtagaatctgaaggcacagactacaaggacagtattttccattggtttccattgtaaaattagaggcatcaggaaaaatagactctttaggcattttgaactttctgataaaagtggaaagaaaagagcataattttctggccaggaaccataagcaccacaatttcttctcaaaatctctgctacttgataacaattaaaaggattgttaaagttcctt

SEQ ID NO: 206461 - DNA, 329 bp, Homo sapiens
agacatgttaataacccctctgaaacccaacctgccatgtgttcagacctctgagcttagtcagaaacctcttcctcttgggacccaagagagggctgcggggagccgataatgcagtgtcagctttctgtggagccgccactccggagcccaccctggcaggtgtctgctgagcttgtgctttcttttgggtctctggggttctccagtgtgattttttccccctgaagatgggctgagccacaggtgggtgccttaaacagcctcagaaatggatcccacctgagctaggacctgggctgcaccctcagtgccgaggataccccaag

SEQ ID NO: 206462 - DNA, 361 bp, Homo sapiens
ggtttctggcattggttctctcatctgattaggtttaacgatgctaataactctgtttccattaataaagagggcactgatagatagtccgtggtgtactctgtcaatagagatatataaatattaccattggatactcctaatcaaccacttataagaagcaaagattttggtgactgtgtatatgatgcttttgaacatgattggcaaagtaacaaatgtaaagagattggcttctattgtcatcgaacaaagaatgagctcagggtttgaattcccaggtcaaatgctgcatacatgatctcaaagctgctatgtctgccctcgaggagacctttatctcctatagccttaggactaa

SEQ ID NO: 206463 - DNA, 1922 bp, Homo sapiens
  misc_feature (672)..(672): n is a, c, g, or t
  misc_feature (1417)..(1417): n is a, c, g, or t
  misc_feature (1535)..(1535): n is a, c, g, or t
ttatagcctgaagagggtaagttattggtcctcgcccccatgccccacagtgaggatgctcagctccccccagccccacccaccccttcctgtccagtttgctcaggaccggacaactatatgtagatgacagaagagatacttatttggagcttgggtgagataagcatgcaggtgcctcaaagaagcaacctctacacacccagtactgggttttggtttccatttggtgtggaatgagtgtttctgaactgtgggtgagaggcagaaaggggagtggtttctatactgctgtccaagcaggctcactctgtttccagggtagaggaatgtgcctccaataatacgatttttctagggccatggggtttgaggttggtggaaatgtttgcctgtcccggcaaccatcattcccaatttggaggcatgaatctcagtctctctggggctcctctctcctttttgaaattttcccccatggtctctgtctctatatcctcccttgcccccacaaccactggatcttgcttgttccacctgaaacttggtgattgtcagctgtgcccctgaccacactgccactaagtccttctcaatctatatcctgagctctgattcctcttctgtctggctgattttcatgccgccttgcctacttgatatgtgctctgnccctgtttgaagacagggaaaattttacatgaaccttgatctatgttctgttttttttttttttttttttgactgagtctcgccctgccgcccaggctagagtgcagtggcacgacctctgctcgctgcaaggtctgcctactgggttgacgccattctcctgcctcggcctctggagtagctgggactacaggtgcccaccaccatgcccagctaattttttctattttttaggagagacggggtttcaccgtgttagtcaggatggtctcgatctcctgaccttgtgatcctcccgcctcagcctctcaaagtgctgggattacaggtgtgagccaccgcacccagcctatgttctgaaatagttgtatatgggctgggtcacagggaaagtgaaactcagagctaatttaaggctggacacagagtcagcaacacacaagacatcatcttgaaggaaggatggctttggtaagtccccagaaacggttttaaagctttgatttgaggaacaaccaccctattagtgatgattatgtgtattcttgttggtctacagctctggcatggagggcacatgggcacatgctgagttctgggggtctggctctctcagacactgtgggaaggaaccacggtgctgggttatgaccctggaggctccccagcctcagctgccgcatggggtctggttctactgtggccaaagtttgcgtttatgcttttccaagccctcctctggccnaactaccagtggctctgctaagcctcctgaaggcaggaatggtgggctcagggagagcagcccttggtttaccccacaggccgcctcctctgtcacatcatcctcagtgggagggatnagctggggagggagggtccagggaaagggctccagctgtgtgggtggcaatgggggctgtcagaaagggctctgtctccctcgcctccaggcagggccagtccctctactttccctccttccctccaattccttcttagtttccttcttcctttagacccaatagcagccacatttcccaagtgctcaggggtccagacaccatgctaaacacttcttttatttaatccacaccaggtagttaataagcaatcctatgaagtaggcataattactgccaacttcatggataggaggaatgatatactggtaagtatagagagggggctgcccaaaagtcagagagggaattcgaacttaggaggctctgactctaaagcttcgactt

SEQ ID NO: 206464 - DNA, 1818 bp, Homo sapiens
  misc_feature (672)..(672): n is a, c, g, or t
ttatagcctgaagagggtaagttattggtcctcgcccccatgccccacagtgaggatgctcagctccccccagccccacccaccccttcctgtccagtttgctcaggaccggacaactatatgtagatgacagaagagatacttatttggagcttgggtgagataagcatgcaggtgcctcaaagaagcaacctctacacacccagtactgggttttggtttccatttggtgtggaatgagtgtttctgaactgtgggtgagaggcagaaaggggagtggtttctatactgctgtccaagcaggctcactctgtttccagggtagaggaatgtgcctccaataatacgatttttctagggccatggggtttgaggttggtggaaatgtttgcctgtcccggcaaccatcattcccaatttggaggcatgaatctcagtctctctggggctcctctctcctttttgaaattttcccccatggtctctgtctctatatcctcccttgcccccacaaccactggatcttgcttgttccacctgaaacttggtgattgtcagctgtgcccctgaccacactgccactaagtccttctcaatctatatcctgagctctgattcctcttctgtctggctgattttcatgccgccttgcctacttgatatgtgctctgnccctgtttgaagacagggaaaattttacatgaaccttgatctatgttctgttttttttttttttttttttgactgagtctcgccctgccgcccaggctagagtgcagtggcacgacctctgctcgctgcaaggtctgcctactgggttgacgccattctcctgcctcggcctctggagtagctgggactacaggtgcccaccaccatgcccagctaattttttctattttttaggagagacggggtttcaccgtgttagtcaggatggtctcgatctcctgaccttgtgatcctcccgcctcagcctctcaaagtgctgggattacaggtgtgagccaccgcacccagcctatgttctgaaatagttgtatatgggctgggtcacagggaaagtgaaactcagagctaatttaaggctggacacagagtcagcaacacacaagacatcatcttgaaggaaggatggctttggccagaccaagaccgagacttggagacctgattgagatttctcgctttggctatgcacactgggccatctacgtgggagatggctatgtggtccatctggctccggcaagtgaaattgctggagctggtgcggccagtgtcctgtctgccctgaccaacaaagccatagtgaagaaggaactgctgtctgtggtggctgggggagacaactacagggtcaataacaagcacgatgacagatacacaccactgccttccaacaaaatcgtcaagcgggcagaggagttggtggggcaggagttgccttattcgctgaccagtgacaactgcgagcacttcgtgaaccatctgcgctatggcgtctcccgcagtgaccaggtcactggtgcagtcacgacagtaggtgtggcagcaggcctgctggctgccgcaagccttgtggggatcctgctggccagaagcaagcgggaaaggcaataaatccaagaaattgtcccaacaaccaccaattcttacggaggaatattatttagccagcaggagtggagtttggtttactgattttactgttttgtgttcatgaatctttattttaatggagttaaaagcacaggaaaatgtatttggaaatgcagcttagtatgaattctattaaagacacaattgggctctgct

SEQ ID NO: 206465 - DNA, 350 bp, Homo sapiens
gggagctgcgttcgccccctctcgatcatacaccgaccacaactaataatctggtcactggtgcagtcacgacagtaggtgtggcagcaggcctgctggctgccgcaagccttgtggggatcctgctggccagaagcaagcgggaaaggcaataaatccaagaaattgtcccaacaaccaccaattcttacggaggaatattatttagccagcaggagtggagtttggtttactgattttactgttttgtgttcatgaatctttattttaatggagttaaaagcacaggaaaatgtatttggaaatgcagcttagtatgaattctattaaagacacaattgggctctgct

SEQ ID NO: 206466 - DNA, 346 bp, Homo sapiens
ccatcaacacttcttcgtgatagtgtgtatttgaataaaatatttcggccatagcgtgtagtcacgtattgtaggtgtggcagcaggcctgctggctgccgcaagccttgtggggatcctgctggccagaagcaagcgggaaaggcaataaatccaagaaattgtcccaacaaccaccaattcttacggaggaatattatttagccagcaggagtggagtttggtttactgattttactgttttgtgttcatgaatctttattttaatggagttaaaagcacaggaaaatgtatttggaaatgcagcttagtatgaattctattaaagacacaattgggctctgct

SEQ ID NO: 206467 - DNA, 472 bp, Homo sapiens
tgaaccactgagcccgacctattatgcttttaatacccacaggtgcatctggttttcctcctttgactctgtgtatatcacgcctatggcttcattcttccattcattctgtgcccaccagacatctccactcctctttcctgggtggcctgacctcttggcatcccctctcccagccaatatttgttccctctgtgattcaaatgaagaggactgggccagatgagtctttcctgagctgtagtttcctggtgtatgtatcgtggtcccgccctgatgctgagtgtgctctcccttctcttctgctgcaggtcactggtgcagtcacgacagtaggtgtggcagcaggcctgctggctgccgcaagccttgtggggatcctgctggccagaagcaagcgggaaaggcaataaatccaagaaattgtcccaacaaccaccaattcttacggaggaatattatttagccagca

SEQ ID NO: 206468 - DNA, 580 bp, Homo sapiens
  misc_feature (16)..(16): n is a, c, g, or t
tagaggatcccgacgngctcacggaacttcaaatcagaggagtttagggttagtaattatagcaacctgtttcttcttttaatccatgtaaatgtcaggtagggtccctagtttgaaaacaatttctacatcaaaatagtgtgatctttgtccaaagaaggcttcatgagagaagttaatctgttaaattgaccacagggatggtgtggagaatcattagaatcatttgggaattccttttgcagttttagatgtacctttttcatcacacattttcatggggaagttgtattttagaaatggcccaaagtcattgtcaagtaataacactgtttagtcaaagaaacagggtggaactagatagtacatgattgttgatcttaagtgccttttaaactagttttacagacagttccaagagaggtgttccaggtactccttaaacaaaggtggcattgttgaactttgtgtggcaacattcatgcctatgtcctgatgtttctgtttacgtttttgaatgttccatgactttttaatcatgtgtcacgaaaagttccgttgaagccgtccataccttctg

SEQ ID NO: 206469 - DNA, 302 bp, Homo sapiens
gttaacgactttgaatactgtgctgggcactgaagatagaggtgaatataaagaaaaggcagatggatttaatgtctaaagtagaagattaggaggaaagcaattaagcagttacctgatttaaaatgttaccctacagtgttcatggaattgtttaaaagctatatcttagatacaaacatgtttgtctcttaatgtgtgggttaagtatttgattagatgagtatgtcctaattgagtaatccaggaggaaaggtcctaaatccctgaaagtaatagcatgtactattttgttaaaatgt

SEQ ID NO: 206470 - DNA, 550 bp, Homo sapiens
atttagaccactttctatgctatactctgtagcaaatcactgtacaattccttgttttgtctatttcacatgtctcaaaatagtaaatacaaatcaatatttcttgagttcaaaaaaaattagtgaattctattgagccagttcaccagttaaggtatgtagcagacatctttccaaataataaatacagcctatctgaagtcatgctatagtatgccaattcaaatttcatggaatatgaaatttccagcataaatctcatctgatccagccccataagtggttccttaatcctttgccacaacctcaacatgtaattgtgaagcctatcattgaacactgccatgggtctgaattctaaaacagctggctgcattttggactatttgggatgtcttctttatattgatttcttgctctttttttttctttttatagccacaccgtcttcatcgcctgaattgatctcaaatatttaaagatggctttcatatcttccatgagttattttctcctgaaagcaaaaaatcccacttgaaatacaaaatag

SEQ ID NO: 206471 - DNA, 695 bp, Homo sapiens
tctctttaatctgtgctatgacttttctttgagtctaatgaatcttgtaattcttaatttgaggtaatgtttcccagtataattctagtaaacacatcttggcagtagtaagctttattttttgaaattattgaaagcacatatatgagatgtaattcactttacagtttcagcatgctactaagaattgataatgaatacagcaaatcagagttttcccaagtgtgttctgtggaacattaattctgtgagatgtttctagaaaagagatctgtgttaaaaaaaagtgcagtatacatcttttttatttttggtggttaggttctaaaataattgtggaaggtaaaaattatgtatatacaaaatagcccttgaaaattcctttgctgcccataaaatagcataaacatagtctgctacaatcatatttttctgcagcattgtttaagattgctttttctttagtgtgttaggtgacacaattcattagcatttaggggctgtatacaataagaaacctatttttacatatttttaaacaccagaatcacactctttgagtttactgcagcaacttttccaagtcaatcttgtttttctccaagtcagtcttgtttacttttaatttgcaaaagtttaaatgcatataattctcctcattgtctacctccccttgtataaccatgattaacata

SEQ ID NO: 206472 - DNA, 300 bp, Homo sapiens
cttctgcctgcttgagtggcagcgttttttccctgtgcaggcccccaggtgtgtgtgattggctgccccggggccccgtgacaggggatgctttttgagctctcaccggcatcttcctccttaaatccagattgggcggagacatgaattcagcattacctctcccatgtccacacgtgaagaagcactttccaggcgcacacacctaagtcgttggccgcgggttcttggagggcgtggcctgagctcccagacgcctcctctctcacctagcactgcacagtgccttccacacacagg

SEQ ID NO: 206473 - DNA, 387 bp, Homo sapiens
gtgacatcaaggagaagctatactatgtcaccctggactttgagcaggagatggccacagcggcctccagctcctccctggagaagagctatgagctgtccgatggccaggtcatcaccattggcaatgagctatcctgctgccctgaggcgctcttccagccttccttcctgagcatggaatcctgtgacatccacaaaactaccttcaactccatcatgaaatgtgacatggacatccgcaaagacctgtacaccaacacagtgttgtttggcggcaacaacatgtaccctggcattgcgaacagggtgcagaagatcgtcactctggtgtggatgggcagctccatcctggccttgctgtccaccttccagcagatgtgggtca

SEQ ID NO: 206474 - DNA, 505 bp, Homo sapiens
tgacagaaaaccaagggagagagcctagcactaagtgtccactgagtgacacaggatacacttatattgacagagtaccgtgggcagtggcagcaggaacacatgtagaaaatctcttgtttttctggccctgggaacaacaaaagtgaagctggtaatccatgaatgccgaagagtgtggagaactccagaaggacaggctgtgcttagtgactttgttctgaagaatatagcatgggaaggtgaaaaagtaactttattgtggaggcgtctacaaacactacctcagccagcatttgcaaagatggctgctccagctacagacattaggtctgcattccagccaacgagaaagaagatttgaagaaggcaatatgccatctctttaagaactgatcgagggagcaagatggccaaatataagcctccactgatcatccttcccacaggaatactaaatggaacaaatatccacattaaaaaaacacctttgatctgggcgtgg

SEQ ID NO: 206475 - DNA, 143 bp, Homo sapiens
cactgagaggactctagagcagttgaaccccgcttcccacctagggttggaatcatggcccaggcagatgctgtgggtcccaagctctgcaggaatgactgggggctgccattcataaagcagctgtcccattattggatgtt

SEQ ID NO: 206476 - DNA, 533 bp, Homo sapiens
tgatctgcagaagacattcctgtgtataacagagtcatcatattcttgggtttgatttgttcttttttaaaatatggaatttttgtttaattccaaatggttttctttattctttttgttgttgtacaatttaccctcaaccaaagaaagaataacgataatttggagagttaaacttatttcatagctttaaataggtgtgtgatttccacagtgactgacgtcttacctgtattttgagatatttggaaatctttacctgtttccccagtggtcatggacagccttgggcttgacttggtttagattctcagacactgtggtttggactgggctggggctgggcccagcctctcaaggctttgattaatccactgcacctctcattttcctgactataaaagagaagctacagttctgaataagcatcttgcagaagaaagaagccaaagcagaaagtattaaactttcatccagcaccataggagagatgtagttattaaatttcagctgcttatcaaactgatatgaaa

SEQ ID NO: 206477 - DNA, 451 bp, Homo sapiens
gatgacagaggcagagattgcagtgatgtaactgcaagatcaagaacaccaatgattgacagcagtcaccagaaattagcaagagtcaaggagtgattcttctctacaggtttcaaaggaaatgtggccctacagccaccttgattctggatctcacagcttctagaactattaagaatacatttctgttgttataagaaacacctagtttgtgtcactttgttacagcagccctagaaaactaacacagttattcttggcaaatgtcaagggatttgctcctggatatatcagctcagattcagtcttgagttcatttaaaatttatatatcttttctttattaagatgaaagtaatataccctcactaagaaaattatacagtaaagtataatgataaaaataaaaaatccataaattatataacccagaactaattgctcttctatca

SEQ ID NO: 206478 - DNA, 291 bp, Homo sapiens
ctccttctgtgttgcccaggctggtcacgaactttgggtgtcaagtgatcctcccaaagtcttgggattacagttacgagccactgtgcctggccagtagtgttttttgagacactaattataactagataatgtttttattttcaagatgcttatattatttagatctagaatctcactatattgttaaactttatctttaaattatttaccaaatcaaggtgattgggctagatttgaggaactctacaactgccttccaattatttttcgctggcagtatgatgctaa

SEQ ID NO: 206479 - DNA, 414 bp, Homo sapiens
tactacgtcagttagagccactaattggaccgttcatgccgtattcctattaaaccattccagcagggttggcatattttgttttaatggaagcactttaatgcttacaagcaagttgtggtcatttctgatcattttcttgtgcctaaacagaatttctacacctaaatatatggaattattgtacaaacccctcttgaatttcatcttagttgcaataaaacatttctgtaatttgccactctctatttttgttttgcaagtattttctaagttagaaactccatctgtcttgttatcatgccgtgtaatatattctagatattgcattgccctatatattagccactagccttgtgtggctatttaaatttaaattaattaaagttaaaaatgtagttcctctgtcatact

SEQ ID NO: 206480 - DNA, 662 bp, Homo sapiens
  misc_feature (661)..(661): n is a, c, g, or t
gaaatagaaatggttagaatttggcagtggagtttgcataatcccttgaattcaggaagggtagatcttaatgcacgtttgccttcttgtagacaaatctgaaaatccagatttttacaaaaccaaagtagtaattgttggctttaaaggtctgcttcctataagatggttttaccacccccccaaaaaaaaaaaaaaaaaaaaaaaaaaaaaaaaaaaaaaaaaaaaaaaaaaaaaaaaaaagaaaaaaaaaaaaaaaaaaaaaaaaaaaaagggggggggggccggaaaaaattgttcgcccgggggggagcagaagggccaaccggtttgtgttgagaaggggggccgcccaaggggggggtagattaaaggggagaggggggcggggggttaaaaaaaaacgggagtgaggagggggaaaaaaaggtgctatggacgaggatcacctactggaaaacaccccccactgctgcggggggggggaccagcagtgggcggaaaccaccccacccaagcaagatataatagcgccgccggaggaaaactaaaacagaagaggcgttgagggcgagggacaaccccacacactaatagcgtcacgtggcacatagaaaatctcgcgtagagagacattgatgaaaacataatacacacgggng

SEQ ID NO: 206481 - DNA, 349 bp, Homo sapiens
ccttcccactgaggcaggcagcaataattgatcacagacttctctagtcacactgcaaaaagtcagagctggccaagaaatgaaccattccagacataaccttgaatactcagacatctcctttcccttcttacctctccttcgttaatagactgcagtcccaagagccaaaccttcagcatctggatttgcctttgcttctgcccacttgtctgagacccaggaactaaaacttcctgtgatcctctctgctccccacgaaaccctctcctgctcctgtgcacattcagtccccctgagcccccttgataacccttccctgctcaccactgtgcagttgaagggacgt

SEQ ID NO: 206482 - DNA, 153 bp, Homo sapiens
ccagggctagtcacagatgagcatcctcaccaataaaactgggtttgttgttctgatgacgctagtatttaccagaacgctctgacacatccccaccgaacttgcgaatcgccgcgtttaacagcctgaaaatctggcctgctttttcccggg

SEQ ID NO: 206483 - DNA, 386 bp, Homo sapiens
agtgtctgaactttgcttggcctctgcactagtccttctgtgaggatgactctctctcactccctgggtgtccttcatttgtctaggtgtaccctactccagactagtcctaccagtcagaaagtagagatcagtcagcaccataagaagacagggcaaggcaaaaaaaggagattaaaaaatgcatccagggccgggcacggtagctcacacctataatcccagcactttgggattacaggcgtgagcccccgcgtccggccaatttttgtatttttagtagagacggggtttcaccatattggtcaggctggtctcgaactcctgacctcaagtgatccgctcacctcgcctcccaaagcgctgggattacaggcgtgagccac

SEQ ID NO: 206484 - DNA, 535 bp, Homo sapiens
agagggttagcaatggagagagctcatggaagaagataatggcaataactaactgaagtctgttaacagcctggagaaatgtgagattttttttgttaaggaggaagcagtgatgtgaaagccaaatattttagtattatattgggaagggatcttagaaatcacttatgaggtaggaaaactaagaagagggaaggaacaaaacacttctcatggtgatttgcccattaatttaatttcacaatgggagttcaattcaagtccattaacttctgaaccagttggctttctggcataccctgttatctcccacctccatttttttcttcccctttattgcatattgatattctttgtgtggatcaagtatacactgaatgggagaatagttctgatttttcttgtgagagatttttttcctatttagaatacaaaatgctttgttcatgtcatgcaaaatgaacaaaatcctttgttcatgtaatgcaagatgtccaaccttttataaagtaattctcaatgatcaaaattttga

SEQ ID NO: 206485 - DNA, 351 bp, Homo sapiens
tattttcaggtaggaaaggaaaatctaaagatttagttttcttaggacaaactgtgaactaccatcatagtccattgcttctttacacgtggaaaaccctgccagtgctcattgtgatatgcagtcatccccaggctgttttggaagctccagttcatggcccaacagtgatgggaggggctctgtggaaccattcagggattcctcagtgaaggtatccatgatatagctgggaagaggaccaaatggtgaggtggaagagtggctctttaccatctatctcacattccttgtcaaggtcaatgtattattttctagatgacatgtttggtatattattccctgagtaaa

SEQ ID NO: 206486 - DNA, 774 bp, Homo sapiens
aagacttgtttttctgattttacatagtaaatggctgctaagtattgagtaattcttaactaattctaaaaactaaaatgtgcatttcgacttgataaggtaaaactcttatctagaggctaaacccatgtattttcagaattgaatttttctccttgtagctttcagggaacaatttcattgacattgcttgcttcctgccttttaccttttaataaaaattgtgatgctactttattctaaagatttatattttataaccagatgaatttcctcaaaggtttccaaacctatatcatatagggtgaaaagcaggaaagtagacatttttcttggcgtgggaattctctacatagggcagtagatttcttaagccaatgaatttctgcttttcagcagtagtcatataatcagtatcataaagaataatgtgtaaataacagaaggcatatgagagtgtggtgttcctagatgagctgttacagattatagtaaaataaggaaatctaagtgctttaagtttatacagttaactcttaggataagagggatgtatgctgagatgtttgtgcatcccagatagcactgtacgataacctgtaaagtattactgaatactgaatagctgaaactgcaattggaaaatctgataatgacgaggaaatttttacgtttccagtttttaagtctaatttggtaattttggctggtttattttggcaggtacaaaagtcagtggattttttcaaaataatttaaggtaaaccattgggt

SEQ ID NO: 206487 - DNA, 264 bp, Homo sapiens
ttcttgactgctacttttggtccttattaattgactattccatgtggacccactccttaaatactgaagtctctcaattccagatgctaagcccccttatccttctttgttttcataggtacttccatgaacattcatgacttcatttaccagtttctttaattttatctacgtactcaacatctgcacttggatcttcgcatatcttgcaaacttagcatgcccataactaaactaaaaatttccctccaaaactgctctttc

SEQ ID NO: 206488 - DNA, 221 bp, Homo sapiens
  misc_feature (10)..(10): n is a, c, g, or t
  misc_feature (29)..(29): n is a, c, g, or t
  misc_feature (32)..(32): n is a, c, g, or t
  misc_feature (62)..(63): n is a, c, g, or t
  misc_feature (69)..(70): n is a, c, g, or t
ggatcccctncagccacgacctcaagttnttngcccgcctcaacctcccaaaatgttgggannacaggnntgagccaccatgccctgcccttccagccctaccggtgtcgacagtttctcacccttccaagtcaggctgtctcaacagcccttactacttaccttaacattttcgacaactctctatataactccctcattaaagttcttttatttgaaac

SEQ ID NO: 206489 - DNA, 284 bp, Homo sapiens
tcagtaagcttatagtgtgggaagaagctgcaaacagacatccaaagcaaaaatatttgtgttggtttatatactattttaattttttgaacagccattttcttaaaacaaaaagacttgtaaataaccatttctgaatagcagtcgtaaatgtttagcactgaaaaatctttgcttatataagaaacaatccttagaaagatacaatataattcaaaattaaatattaaatggaagaattggcaagaacatttggtttttttgttgttgttgtttttgagatg

SEQ ID NO: 206490 - DNA, 549 bp, Homo sapiens
cataagcaatgacctgtgttttcagctaagtagtttcttcagccagcttcctccctgtagaacctcttaggtcctaaggcctctcttcatttttactgtcttgttgtcttttaagccaagctagcaagcagtgctattgttactataattctcttagagtctcttgtgaattttacttgagttcttgtcattggaaaaaccacttgtcccaatctctttgagataagcacttcaccttgtgcttcctgtgaaggaagcacactgttctgtgtagtaggacagtgccttaagatgcttatacccttaagatctttaagggaatttgaggcaccaccttaaatctttctaaggtcttaaaatagggccttacactgacagtcttggcttcaccttcagactttctcctggcggcaccctggatttgatcttatctcagaggccatttatttcagcaatacagatgctcctcagattaggatgggtttatgtctggatggcatttgcatttgttatgtctgatatttgcaatttataggccatcataaattg

SEQ ID NO: 206491 - DNA, 165 bp, Homo sapiens
cttgatacagaggagtccaaagtaaagacagcaaagctaatccatatcccaaataatcatatctgagtattagacacagaaattctgctcttatcagataaagaaagtagcttcacacaccttctcaaaatcataatatgcttctgtaattttttttttttgaga

SEQ ID NO: 206492 - DNA, 143 bp, Homo sapiens
ccacaaattcatcactactttccctcaaacattttcctcctactgtatcagtggacagtaccatccaaggttatggcttgagcaacacttgagagattacttctctcccttcctcccactgaatatccaatctactcccaggt

SEQ ID NO: 206493 - DNA, 502 bp, Homo sapiens
acccaattcggcctatagagcggggcatgacgcacgcttactgggcgctgagtgacaacgaagggacttgccaaacccaggatgtgcaggggaataaaaaaaggtaatcagatataacacccatcacaataaaagactttccagagggttctgatattgataaattagggggaaaactaagtttggaaatgaagggcacagtccataaaagttgagttgtatgtgtgtatccactctgccaaacactttgcttttaaagttgttggtgcttgagcatgactgaggctctgaccttttctgatatgatttccagttcattccctttggaatgaactgcctgacgctgaagcagacgtgttaatgtaaaaaaggtgcctggattgaagtggtacctctccaactaacaggaaatcataacagaaaaggtcagagcctcagtcatgcccaagcaccagcaactttaaaaggattctacaatgccatggcaccttcttttcaacca

SEQ ID NO: 206494 - DNA, 348 bp, Homo sapiens
aaaaataagacaaaaatctctgcataaagggccatgggattgaactggacagtggctgattatctctaggaagaggctgaattctgaaaacatttgtatatgcaatgcccggattggttaaaggagagataatttatttcgttttatttttgtgtctctttgatatagaagaaaagaaatgtgaacagaacttgtacaatatatggtaaattctctctaccagaatattgttgatgttcaggctccaagaattaatgtggttttatcttggaatttaacctgttatttattgtgatatgcttatgtaaggacatgtgttagataatgtgatagccgataatgtgatag

SEQ ID NO: 206495 - DNA, 187 bp, Homo sapiens
gtttgtacataaacagggtcaggatgacttaacaacatatcaaaaaatctggtctaataagtgtcatggcagggactttcaaggtatataactttgggaacacctaaaaatctcaagagcataataggcagtcaacaggtgtttacttatgaaatgaaaataatgatttacaaattttattcaatct

SEQ ID NO: 206496 - DNA, 780 bp, Homo sapiens
ccagcctgggcgacagagtgagactctatttcaaaaaaaaaagtttctcaaaatgttaaacatagaattgccatatcaactaccaattccacacctaggcatctatccataagaaatgaaaccatatgtccacacaaattgacacacaaatgttcataacagcattattcataatagccaaaaactagaaatagcccacatagccatcgactggtgaatggatatacagcatgtggtatgtttatacagtggaatattaccaggcaataaagagaaatgaagtactgatacatgctacaacagggtgagccttgaaaacactgtaccaactcaaagaagccatctgcaaaaggcctcagattgtatgactttgttcatgtaaaatgctacaaaaggaaaatctacagagacggaaagcagattagtcttttcctgtgcctgggagtggagtagggtgaagactgactgataatgggccatttccttgtggagtgacagaaatgttctaaaattagatagtgatgatggctgcagacctggcaataaatggaaatgcaccgagctggacatttaaaacaagtgaatttcatggcacataaattgtctcaataaagccattttttatagaagaatgatctcagattcctaattggccaagagttaggcccgcacacgtttaaaacaggtgaattttatggcacataaattgtatctcaataaagccactttttggaagggaatgatctcagattcctaactgaacaacagttaggcctgcac

SEQ ID NO: 206497 - DNA, 439 bp, Homo sapiens
tcgagctgttactggctatttagaaaagtctgttctggaaggtgcgtctaaagcctgggtgttgcctttctagcgttgcagtattctatttttgaagtgatagagaggtgcagggctcttgtttatattgaaagctgcttaccaggaagtacttaggtctcttctgacaaaaatcaacataagcgcaattaacattgtcttgcttttaacttaatttgctttctaattcatttagcaatggatgtattactaaatgaccttgtaatatatcttacacctgtcaaaagacaaaattacaacaaatttagttatagatctaattggcatttattcattatttggtaagtgggcagcctccattctataaaagagactgagcttccactgggcaatgtcagaacagtgccttttataagggaacaaagaaacagaacaatag

SEQ ID NO: 206498 - DNA, 524 bp, Homo sapiens
tgctctatagtacacattttttgctgaccacttgggaataagctacagataccatgaccatttttgcaccctgaatacttcgcaccctgatacaggagtgtgtatgtcttaagaacaagaatgttttcttggaaaattatatttttgtgtgtataattaatcatattcaagaaatttaacattgattcaatctaatgtctaatgtgaaattcatgttttaattttaacaattgtaatgtctttcatagcaatttccccctccccccaaggcagaggcagggatggtacacgagttctctgtcctctgggtgctacattaagtcatgtgatgtctgttgttggtaacattaacttggttcccttggtgtccaccaaatttctccatgaagctgccattttatttttggaagtagcttcttcatagttgtggggaaagaggatttaggtgaaattattaggaaaaggcttatcaatccttggacattttactcagatattacctactggcatgtgtagtctccttt

SEQ ID NO: 206499 - DNA, 457 bp, Homo sapiens
  misc_feature (209)..(209): n is a, c, g, or t
  misc_feature (249)..(249): n is a, c, g, or t
  misc_feature (442)..(442): n is a, c, g, or t
  misc_feature (452)..(452): n is a, c, g, or t
cagaactgaatatgaatagcaagaccaaatccttttttggctattttctatagcttatttatttgcaacatgtcttcatgagggaacctgtttgatgtcgtgtttgtttgtttattttatttcatttgtttattttttgagatggagtctgggcaacaagagcgagactctgtctccaaaaaaaaatccataaagcagctgggcgcggntggctcacgtctgtaatcccagcactttgggaggccgagncggtagaatcgcttgagcccaggagttcgagaccaggctgggcaacaaagcaagacactatctctacaaaaaataaaatagccgaatatcgtggtgtgctcctgtagttccggctactcaggagcctgaagcagaaggattgccttgagtccaggagttggaggctgaggtatgggcaccactacactggaancctggggtgncagaa

SEQ ID NO: 206500 - DNA, 501 bp, Homo sapiens
tcagaagatggttagtgggcacctaccctgcgacaggggcttttatgtgcttggcagataatagtaaacaaaactgaactccctgcccttgtggaatttacattctaatgggagagacagataatgaacaataaacataataaataaattatatcgtatgttagaagatgttgaaccctaacccctcctgtcacattggaaactcttccacacctttgccctccctggtgaggggaagtagatgagtagattgatcccctctgtccgattcctgtccaccccttggcttctgcccacctctggctttctctccttactgtttgaaaatttctccacagtttgtttctctgtagggtgtggggcatgcagttcaggtagccaggcccctggacgtggctgaatgggactgtttagtgttctggggccttgggggaggagcggcctttcccgctccatcgatgtgactgcttttcctcccttatcctcccacctctggcagaa

SEQ ID NO: 206501 - DNA, 593 bp, Homo sapiens
aaaggtactgtgcccggatgtgcacgtaggctaaatttatgtttctctttacccaaacatgtcattgtagcaaagagtaacagagcagcagcgctagatttatgtttctctttacccaaacatctcagtgtaggaaagagtaacagagcagtattgctgccagcattcttgcttccaggcagttttctcctatctcagaatagaacaaaagggaatggttggctttacaatgagacattccattcccaaagacgagcaggagacagaaggcttcctcttatctcaactgcaaagaggcctccctctttacgactcctcagcacagaccctttataggtgttgggctgggggacggtaaggtctttcctttcccatgaggccatatctcaggctgtctcagtggggggaaaccttggacaattcccaggctttcttgggcagaggtccctgcggcttcccgcagtgcattgtgtccctggttaatcgagaatgaagaatggcgataacttttaccaagcatactgcctacaaacatattaacaaggcacatcctgcatagccctaaatccattaaactttgattcattacagca

SEQ ID NO: 206502 - DNA, 594 bp, Homo sapiens
aggaaagccctcaattgtaccctactgaggaatatgtgggcttgggctttcaataaataatcatgaaagggtgttggattttgtcaaatgtttttctgtgtcaacttagatgactgtgtttttttctctctttctaataatgtagtgtattacaatgaccagttttcttgtattgaatcactcttgcattcctgagataaatctcatcagccctggtgtataattcttttattgtgctgtcggatttggtttgctagcattttgttcgggacttttgcctctataattaagggatattggtttcttctcctatggtgtcatctgaaatgtgttatctgacctcaagaaaatgtttccttctcttcaatttttttggaagagcgtgagtagactgagttacttctttaaatatgtggtagagttcaccagtgaagccatctggttttagactttttgttttttggaggtttttgttactaatcttttttggctggacgcagtggcttacaccagtaatcccagcactttgggagaccgaagccagcagatctcttgagctcagcctgggcaacatggtgaaactctgtctctata

SEQ ID NO: 206503 - DNA, 585 bp, Homo sapiens
cttcagtgttacactactgagtatgatgtgtgctttggctttcataaatgccctttatcatgttcattaatttgtcaaatgtttttctgtgtcaacttagatgactgtgtttttttctctctttctaataatgtagtgtattacaatgaccagttttcttgtattgaatcactcttgcattcctgagataaatctcatcagccctggtgtataattcttttattgtgctgtcggatttggtttgctagcattttgttcgggacttttgcctctataattaagggatattggtttcttctcctatggtgtcatctgaaatgtgttatctgacctcaagaaaatgtttccttctcttcaatttttttggaagagcgtgagtagactgagttacttctttaaatatgtggtagagttcaccagtgaagccatctggttttagactttttgttttttggaggtttttgttactaatcttttttggctggacgcagtggcttacaccagtaatcccagcactttgggagaccgaagccagcagatctcttgagctcagcctgggcaacatggtgaaactctgtctctata

SEQ ID NO: 206504 - DNA, 550 bp, Homo sapiens
aggaaagccctcaattgtaccctactgaggaatatgtgggcttgggctttcaataaataatcatgaaagggtgttggattttgtcaaatgtttttctgtgtcaacttagatgactgtgtttttttctctctttctaataatgtagtgtattacaatgaccagttttcttgtattgaatcactcttgcattcctgagataaatctcatcagccctggtgtataattcttttattgtgctgtcggatttggtttgctagcattttgttcgggacttttgcctctataattaagggatattggtttcttctcctatggtgtcatctgaaatgtgttatctgacctcaagaaaatgtttccttctcttcaatttttttggaagagcgtgagtagactgagttacttctttaaatatgtggtagagttcaccagtgaagccatctggttttagactttttgttttttggaggtttttgttactaatcttttttggctggacgcagtggcttacaccagtaatcccagcactttgggaggccaaggcgggtgaatc

SEQ ID NO: 206505 - DNA, 192 bp, Homo sapiens
caccatgcccagctctttgtcaattttttaaatggatcctgcctttactgttgtatttaaaaagtcatcaccaatccaatatcatctagattttctcctatgttatctactagaagttttacagttttgcattttacatttaggtctatgatccattttgagttcatttttgtgaagggtgtaaggtctatg

SEQ ID NO: 206506 - DNA, 390 bp, Homo sapiens
tgctggcattagaggcgtgaaccaccttgcctggcccatattcaatttttataatggaaagaccatttcttagtgttcccttagaccctttttatagtattatagttttgtgtacattttctctacatgtgacataatcctgatactgtacatctccaaagcacccttactttgtggtttatcacattgttcccactaatggcttccaaaactgggctaactgaagctgagtatatctgtagaattcctttttcattccctttcttctacaaatggacctctttcaagcttaagccatgctgaaatttctcttccattggtgataggtgggactgcttaacctgcggcttaagttattttccaaagattaccataagactaggttgcctt

SEQ ID NO: 206507 - DNA, 721 bp, Homo sapiens
gggatcctcctgccttggcctcccaaagtactgggattataggcatgaaccaccatgcccagaggatggcctttaaattttttttttttctatgtggacataggcatctgtgatcctgattttctatgttacatatactatagaggcatttttatacttttggcctacttaataagatgaagtaaaagtgttgtttctcagtgatattctgccatgggaacataggaccatgtgccagcccaccctgggcatgtgccatttctgcctgcggggcacatgcatcttcccacatgtctcaccagcagtgacagagcagaggcctggcgttacccagcagtgatcacaaatgcgtggtgctgggtgctgaccaggatagtgtcttagcctgccttccatgggccccagtaagtagcagtaggatagaacacatagccagtacccgcaagaccaagatttgaacatttactccacctcccatgagagcttaggcaagctggttaatcttctagagctatggcaaggatgaagaatgatggtgaaaatggcttttttttttcttgagacagtgtttagctcctgttgcctaggctggagtgcaatggtgtgatctcagctcactgcaacctccacctcctgcgttcaagtggttctcctgcctcagcctcctgagtagctgggattacaggcacctgccaccatgcccagctaatttttttttttt

SEQ ID NO: 206508 - DNA, 1067 bp, Homo sapiens
cttgttttttctccaacactccctgacaagctcttgccgcagggcctttgcactagctgtttgttccttctgctgggagagctttttccccagatatctgctttgactcactcactcacctcctttaagttcccactcaaatctcaccatctcaatgaagccaactctgacaactctaggaatctagcaagccctccctcccctctttctccgtctttctctgctttattttttcctttttccacagcacctatcatctccagaaatacatatatttgcttgcttattgcattcactgtttgtctccccctgcgagaggtcaagatctttgttttgttctctgatgtctaccaaatgcctagaataatgcttgcatttggtaggcactcaataaacactttcttatatgtgtaatccacgagataaatataatttttatcacttttacagcatctgaaggacgtagtctggggcctggccccagaagctgaggtacaaagaaggtaacaaacttaatcagatcacccagccaataagtagtggagctgagagttgaactaagaatccttgcacttagccgctacttcaaattgctttcttgaaacttacaaaatgggagcctcatgtaggctgcttcctggattccagtgactcacatgatctaattattctctttgctctgagaaggctgcactcctactcagactggggctaggtttcacatttctttgtctcctaagatatgtaaacatggtatttcattttacaacaaagacctttgaactggattggatctttcattctgtcacgttcttggggccccacaactccatggacagaaagtgagcaccacgaagacaggtcttgttggatattctctttgtccctttctgattccccagtgcccagagcaaggtgggtgctccacaagtatgtgttaaatgtcgtatgaatgacattggagatggtatccagttaaattttagccttgtggccttgtttgacttgaggtcatggttcatcatgcctcaagtcaggcaatgaaaatgagaaggaaccagtagagt

SEQ ID NO: 206509 - DNA, 916 bp, Homo sapiens
cttgttttttctccaacactccctgacaagctcttgccgcagggcctttgcactagctgtttgttccttctgctgggagagctttttccccagatatctgctttgactcactcactcacctcctttaagttcccactcaaatctcaccatctcaatgaagccaactctgacaactctaggaatctagcaagccctccctcccctctttctccgtctttctctgctttattttttcctttttccacagcacctatcatctccagaaatacatatatttgcttgcttattgcattcactgtttgtctccccctgcgagaggtcaagatctttgttttgttctctgatgtctaccaaatgcctagaataatgcttgcatttggtaggcactcaataaacactttcttatatgtgtaaaacaaaaaaaacaaaagaaaaaaaaaaaaaaaaaaaaaaaaaaaaaacaaaaaaaaaaaagaaaaaaacaaaacgaaaaagaaaaaaagaaaaaaaaaaaaaaaaaaaaaaaaaaaaaaaaggggaggggggcgagaaccaacaaagaacaacactcagggggagcacaaaaccacaagtcaccacggccgccgctgttcgagcgacgacgccacccccacgcccacagcacacaatcaacaacgaagacgcagcagcggagcagcaaaaccaccgaacagcgtcgggcagaaaaaaaggcactcgacaggcgatctcgagtcgagaagaacaacaccacctcaggtggcgacggatgatcacagcaccacgacaaccaaagaagaaaactaacgacagcgagcggaacacaacaacagagcgaatcgattaagccacacccccatgcactcgggaccagaatgaccgcgcggatcataagaaacaacacaccgcggggaca

SEQ ID NO: 206510 - DNA, 378 bp, Homo sapiens
caaagcacacacaagcctaccctgtgagaacggagctgccccagttccctgagtgcccccttcagagctctgggtggcctctaacatcctggctgcttgtccatccccctgagcacaggaagcgggcaaggcacaaaactcactcggcgaggaggggagcagctcgctccctccacatgtgcatgcatgtgaacaaaatcacatgcatgtacacgcgtgcacacacgtgacacattcatgcacacacacgtgcacatgtacacacacacacagacttcacctcacgatgctgtcacctttttgtgtgtctctttaaaggtctttttgttttgattccttttgcgggtttgaaatagagatatatgcattaatcatttc

SEQ ID NO: 206511 - DNA, 356 bp, Homo sapiens
agaagcagtgtcttgctgaggatttggctttggatggaaattatctgtgttcactaccatgtgaatcctgacctgagtcccctctctgaggctgggactgctggactttcagaacaagcagtgtgcaggaacaggcaatgagcctgcagccacatggtctgggccctggccctgcgtcctgttagacactgaatctgtgtgtgttgtttaagctttctgagccatggtctcttcatttgtaaattgggacagtgctaatgattatgaacaaaataaataatcaacctgtgtctgcataccttataggatggtgcagaaattcaaatacatgcagaagtgtttttgaaaactaccaa

SEQ ID NO: 206512 - DNA, 414 bp, Homo sapiens
tgttgtccaggctggtctcaaactcctgggctcaggcaatcctcccgtcttggcctcccaaagtgctgggattacaggcatgaaccactgtgcctggcccaatagtagcgatttctgtaaggctttatgattgtccccactcaagggtccacctcatgtccctccacttgcaacacactggcactccaaccatctggcttgccttgctctctccatccctcgatcttccctcccatccccctaccctgttaaattaatccctcctccccacctttcattccctggctgtgagctgggcttctctgagtcccattgtcctcgggcttccccttccccagccagatcccactattctggtcgtgggtctctcccactcatatccctaattccaggccccttgcagggtggcaggta

SEQ ID NO: 206513 - DNA, 467 bp, Homo sapiens
tagagcatttactttagaaattttgcaattatcaattttttctccctatttttgagatgtaaattttctacaactcaggaatgtctttctcaaggacatgagagatatccctttgaaatgtaattgtgaaaaatgatagcacctctatttcaatctgtgtaggagagtaggagcctaactcaggtaagtgacatttagcaaactcagatggcctaaacacattcaccaacttccccactaatgtactccctactggttcatgtcagcatttaataatccttctgctttcttttcagtggagctgagttcagtctgtctctcttctgcagtggtcttctctcccattgcaatggtcttgagtaaagtgttctttgtttgttttacttggagatgatgtcagttcaatattgaagtctctcttccctactacagtagttcaaataaaatccatcttgccattcttaaca

SEQ ID NO: 206514 - DNA, 600 bp, Homo sapiens
gagaaaaaaaatcctgagttaaagaaagagttaagttcttgacttagaaggaactacctagggctcatcagaaatattagaaagaagatacgtactatatactagttattctttaaatgttcatagaaatacaagttcaaaaatgttggtttaaaatatatcaagttaacatacctctgggaagaatgggatttaagggaggcaaaggtaacttcactattttatatacttcactcttgtttgtttaaatcgatgatgtttttaattaaaacatttaaaagttaatacaactagaatagaaactagggtttttacaaagttaatataacattaataaagtaaaagtcagggaagagaaaaagaaacaagaacaaagaatgagattcagaaatatatcaggaaaaagataaaatatatgattcaagtaaatgtgactgttttatatccaaatatccaaagcaaaacatattgctagaatctgtctaataaacatgtgaaaagattctcaagtatattaacaaggaaacaaaacagtaaaatgagaattattttaaccttttggatttgcaaagacaaaatgattgatgatgcttgggatgg

SEQ ID NO: 206515 - DNA, 356 bp, Homo sapiens
taattctaattttaccattgtaacttaattaacatgaaatctataacaaggttacacatactttcccgttctaataccatgttcgtgacagaaacaaagcaggtgtcttctctgcaatgtggtcatctgaggtctgagatgaggggtcacacaggtattttataatatttaagggtttggacaacagtagtgataacaattctgaacagcactggctcctaattgaaaggttataggtaaatttaatgctgcaattttatattaacaccttgtccgaatgaagctcagaggaagatgccacatcccaggtcacacagagaggaggaatggagctgtgctctgctctccacaccacc

SEQ ID NO: 206516 - DNA, 141 bp, Homo sapiens
actgtggctgctttctacccaggaggtgtctcctccaaatgctgtcggcagagatcaaatcccatccctgatgttccaaggcttccaggtgtaactcacaggcccagttcttggtaggcaggtgatttagccttctgtgtc

SEQ ID NO: 206517 - DNA, 589 bp, Homo sapiens
ggttgttctagaattttataatatatataaactctagtgtagtgactggcatgataatttttacttaaacttcatttttgtccaatagatctttctgtgattaaactgttttatatctgtactatataatatggcagcagctaacaatatgtgggtattaaacaattaaaatgtaactacattgcaagactttaaatacatgtagaattttatatatgcaatgatagcacaaaaaggcagttttaaaatttaagtgttctaaagtcattaaatttttcagtatgtggtaaaagtactaatatatattgagctttgataaatcaaaatgcattttgatttttaggtaataactaccaagggataagtaaaaggaggtttgacttacaaattaatggaggcaatgaaacttaaaagtcactattatggaagggtgaggccagaggatcacttgagcccaagagtttggggttactttgagccatgattgcaccgttttactccagcctagatgacagagtgagaccctgcctcaaaaaataataaataaacagtaacattttaaaaaattcattaatgaactaaagataag

SEQ ID NO: 206518 - DNA, 499 bp, Homo sapiens
ggaggactgcctcttgtgactgtggaaggacttctaccaggctaacacccctggcctctcaccctcccatttctcaccctgcaaagcagagtgctatttgattcatgttcttagtctgtggatctcagttgaggagaactcgttagagatttgccctctttctgtctttttgagaccttactggtgcaagacagcaaatcctagctggtgtctacaggacacatgcactcttaggttacataactgcagggaccactgtcattgtatcctggagctggttctatataagacacagcctgagcagtatataggcttcctagtctgctcctggccaaatgtcccagttggaagcccagaggttgtctggctatgccagtggcaggatgggcaagtctaactcaagggtgacatattagcaagacctttatggccatgcatctaagatgctctgtccaagcctgaacttagcaacaataaacctgacattttgaaatccatc

SEQ ID NO: 206519 - DNA, 271 bp, Homo sapiens
agctgggactacaggcgtgtgccagcatgccctataatttttgtatttttagtagagatgaggtttctccacgctggccaggctggtcttgaactcctgacctcaggtgatctggctacctaggcctcccaaactgctgggataacaagcatgaaccaccatgccaggcctatagctttgtaatatagtttgaaatcaggaagtatgatacctccaactttgttcttattcaaaactgctttggctattcaaagtattttgtggtttccta

SEQ ID NO: 206520 - DNA, 807 bp, Homo sapiens
tgtttattgcagcattattcaacttaaatgtccatcaacagataaatggttaaagaaaatgtggtatagacatacaacggactattattcagccttaaaaaaaggaaaccatgccatatgtaacaacagatgaaccttgaaggcattatgttaagtgaagtaagccagtcacatgaaggacaactactacattccacttatgtgaggtatctaaaatagactaactctaaatcagtgagtagaatggtgattgccagagaatggggggagggaaaatagggagttgctattcaacaggtatgaagttttaattatgcaggatgaacaagttctagagatctgttctacaacattgtgcctgcagctgacaatactgtattgtacacttaaatgtttaacagtagatctcatgttagtgttcctaccacaatgaaaaatcaaaatcctaacaatacaggaaaaaagagggattcaataaatgaaatcaaccaatcaataaaaataatatgatagatttaaaaaaacttcaatcactacaacatctcaaaatttttttgttgaacttagagaaatatatatttaatccaaaaatgtggccactttttgttgtttttttgtttaacagatttttagtatggtgttatatatgtctgagttacatacagttttggtaactaagaattcctctcagtacgttgccagattgatctctgtttcttactcttgtgagtaatgtgtaacaaatatgactcccaaataaagcagcatttctgtggctattttgttggcccactttcagagtagtat

SEQ ID NO: 206521 - DNA, 615 bp, Homo sapiens
ccccaaattgaaaaccagagtagcctatgatcattccctgtgggattctttaactgttaaggcaaaagaaaatgcagttgcacttaagagtatatggataaaataaagaactgtgaagtgaaaaggggagagatttttttaaagatgactatattttaactcctcctgactagtaaattcaaggataccaggaaagatgaggtgtagactttaaaccttccaacattccattgtgttaatcattcttcctcatcaaagaggcagtaagggataatttagagtgactacagttacaaataatgtgctgtataagcacccaagagcagagataaggatggaattaagggtgttaaagaaaatatggcctctcttctttaccatttgattgtttttgctgtccctggagactcatatctctctctattcctaggaccaaagtttacacaactgccaaatatataaacaagaacaccccttaaaattcctgtgaaacattgtacatcttaagagagcagatgtgtctatgggctgtcacaaatatcagtcttgctatgttaagcataaacttaacaaatattagtggagacacactatttaggattcgcctaaaaccct

SEQ ID NO: 206522 - DNA, 407 bp, Homo sapiens
caggggcatcctatgggagccaggctggcttctaggacctcttatggatggaagttatttagtggatcttcctggatttgattttatttctttgatctcttaagtacatcaatctttgggtttgctacctgtaatttttgtcttaggaaggcagcatctctattctctccaggaagaaatcttgatgcaggaagaagaaaaagcctggtatcctgccctgtttttgttctcatggagattcaacagatttttacgtaatctctttttactataattcaccctgcgtttcttgaattctttgtgaacatccctttctcctgtagctgacagcttctgttctttctcttggggcttatgagctttctgagtcagatcttttagcaaagccttagttttctgctcatgga

SEQ ID NO: 206523 - DNA, 382 bp, Homo sapiens
tgtgtcccaatgtgctcaatactacaggccagatatcaatcaagacgcaaactatgttctggagaacctcaccatctcattcagcaagctagggaaagaaggaatgcaaaaggatgtgtatatctctcaacatcattcaatttttagataaatattaatatactaaactcaggagttctaatagtttttcaaagtattttcttgggttccccaggtagactaatactttctgcaaataatcgtgtttcatctcttcttcaacagttgtgtaactcctattttcttatttttcctggccagtttactggttagaactgagaaattaccattggttggtgaagtagtaagaaagtacagaaagcacctacaacactatgtggga

SEQ ID NO: 206524 - DNA, 443 bp, Homo sapiens
ttaagtgtcagcctccaggcatttaacaagtgagttgttccaaaccttcaaaggacagtttattgccacactataaaaactgttacagagaaggtaaaaaggaaaagtcattaattcattttacaaaactagtctaggcctgacagcaaaatctggaaaagaactcatctaaagagaactgtaaagctatctcatttaaaataagagattaaaaaatctgaatatgttagcaaaccaaatttaattaggaatttaaacagccacccaccgcaaccaaaaatagtttaacacgggaatttgaggagggattactactaggtaatctattcctacctcaattaataggtgtaacaaccacttctgaatccaaatgaatgccaaaatgacatctgatgacattcaacacccatccttaataaatcacccaagaaaacaagacaggc

SEQ ID NO: 206525 - DNA, 467 bp, Homo sapiens
gcccaggcaaaatctgaaaaatgttagtctaatttagttaagtttttcttgcagaccagaacttctaggaaactaatatacaggttttctccaaaatatattttcaaggaaaatcagagaataaaagtttccaatgcatttagactagaaaattaaatattcaacaaacaatttcggagggccaactatttgccaggatccttgctggaatagtctctaacctcaaggcaattgctgtctagctttaagatcaagagtaattgtgacttgatgtaaggtatctgtgttgctttgtattacattcttcttagctccattgtgttaaatacagatagacaatatttgtacatgataggttggctcaccattaatcacttaagaagtaatagaatgatcaatgattttctttctggcttgtctacgccaaaatggttcttctgctcagttggtttctatagtgattttat

SEQ ID NO: 206526 - DNA, 711 bp, Homo sapiens
ttcagggatttagaaaaagaccatgtactaccaaaataatttcatctgtttgaaattgcatttttcatatcaaaatggcacaagttccttttatattaaatgcattgaaaaccctcagcttcacacatttgaatatttctattttactgacaatttatttactattgggaactactcatattgatttaaacatacacataagtttatatttatatttttttctccttttcatcaccagaaagaatgttttagttcctatttaatggaaccatccatttttatgtctttaagtcatatataattttttctttgctattcctccattgtttctgttttatataattattaaataaatgtcaattgttttgctatctgaagaatgcaaaccacaactgcttctgaagaccctatcatatctagcttttaacctaccagttatgcacctagcgtcaaaaacaccatttcctccgagattcacaagcctactgaaatcaccatagttctttagtaagcatcagaagcctggagtatggatgtatatttttctcctgtctttattataaaaccccttagaaagcagtgacatttactagatcagggattaaacactataatctacttgcagtgggagtcattaaaatgttgacccaactcttcacagagttgcaacaagaactgtgaagtgtgtctttgctatttaaagtgggaatg

SEQ ID NO: 206527 - DNA, 483 bp, Homo sapiens
cctagcatgctaaaggctctgagaagttctgcagcaaatattccattctaactttgctccccccagatgtcagaagatctgcctgccctctttgccttttaagtcacacacactaaccttctgcaaaactgcagtggcatgggacacacttgggaacctcaaagaggttccttggtatcctccacagattggacctgacctggtgcaggggccaggtgcagccacccaggagcatgcacgggacttggccagcaggaccagcccccacaggagaaagtatgtgtgtttgctgtgccaacgttggcgagacgagcccctcagcggagcagcaggcttcgggcagtgaagaggaggctggcacttgggccttctcctggtgcagcagtggtttctgcacaaggcagtgatgtggttgccaacaccctagaccagcaccatccaatccagtggctgccagccacaggtggctacttacgagtgatt

SEQ ID NO: 206528 - DNA, 211 bp, Homo sapiens
ccttaggacttacctcttagcttgtgttgagcctaaagatcgggcagaggtgaaagtttagactcttcctaggccgcttcttagcatgtctcctgtccagtgtgcctttctaaatcccaggcgcatgcaggtgcttttcagtgctccagttcaccacattagccttggtgcctagctcttcttcccaggcattcagctgtgtattgtttac

SEQ ID NO: 206529 - DNA, 792 bp, Homo sapiens
ctaataatgaagaaaataagaatatacaaatgtatgaatatgaaatatatatgagatattcatatctatatggaagaagaccaaaagtgtattaataatgaagcaaataaggatgtacatacctatatatatggaaacaaaaagtagattaattttgcagagtataattttacccttacatactccagtgtgtattatgcaacaataggaaaatctttttccataaccacagtggagttctccacttgagtcactttcacgttgatacagcacagtatctgatccacatctgtattccattttgcagttgcccgataacgtcctttataacttctgttccctccaggacaggatccagcctagagtcagatactgcatttagttgtcacgcatcttcagtctccttttatctagaacatttcctcagcctttttcttttacaacgttgaaactgttgaagaatatcgtgcccctccccttttgttagtaggcaggtcctcactttgggtttgtctgttgcttcatcgtgattggattcaggaagtgcattcttagctgaaacactgcagaggtgacggtgcgtccggggagttacacctggaagcacgcagtgctcctctcttcctcatctatggtgttaattgatcgctcaaccaaggtgttgtccaatttctccacctcattattttttgaactgaacaagcagattgtgaggagatattttgagctcctcgtcaaaatttcctcttaaatttgccatccactgatgattcttgtctgatccaattttta

SEQ ID NO: 206530 - DNA, 799 bp, Homo sapiens
gctgctggcgggccccaagaattgaaactctaggtggacatgctgaccaatctactgagcatatgcactattgactatagaaacaccagcccactgtattaataatgaagcaaataaggatgtacatacctatatatatggaaacaaaaagtagattaattttgcagagtataattttacccttacatactccagtgtgtattatgcaacaataggaaaatctttttccataaccacagtggagttctccacttgagtcactttcacgttgatacagcacagtatctgatccacatctgtattccattttgcagttgcccgataacgtcctttataacttctgttccctccaggacaggatccagcctagagtcagatactgcatttagttgtcacgcatcttcagtctccttttatctagaacatttcctcagcctttttcttttacaacgttgaaactgttgaagaatatcgtgcccctccccttttgttagtaggcaggtcctcactttgggtttgtctgttgcttcatcgtgattggattcaggaagtgcattcttagctgaaacactgcagaggtgacggtgcgtccggggagttacacctggaagcacgcagtgctcctctcttcctcatctatggtgttaattgatcgctcaaccaaggtgttgtccaatttctccacctcattattttttgaactgaacaagcagattgtgaggagatattttgagctcctcgtcaaaatttcctcttaaatttgccatccactgatgattcttgtctgatccaattttta

SEQ ID NO: 206531 - DNA, 408 bp, Homo sapiens
cagtatgttatagtggttaagaatacaaactctagcatcacatatgggttcaaatcttcccttcagctcttacaatctatgtgggttggacaggttaactaattttcctccgcgtcagtttccttagtttaaaataagcattttaatggtctctaatgtagaggcaataatgctgatagaagcctcttatagtaagcacatgatagtaatttatattccctttcaagtgttggataccggaatgcagttattcagaaatgatcatcattgagttgattcattattgtaaatgagttcagcttctctctgaccacctgattttgttaccagtccaaattgattataatcacctttgcaattgtggcttactcattatctctgaaaataaaatttgagtctgtgcattta

SEQ ID NO: 206532 - DNA, 523 bp, Homo sapiens
gagaaaaagctcacaggagtgggtagagagagccctttggagagtttccatggcagagccagcaatgggacacctggtggggacatggagtcaaggaaagccccaagcttggccacagtacagctgcgatgccggcggaaccatgtgaaggccaggggcagctgcaggcacaaagtctgagggacaccaagcactcattgcagagggatggccgcggcagcatgaggcagtatgccttcctaacgaatgcaggaaagccagagaaggctttaaaatgggggtgtgtcatggggttctcactggcagagaagttctggaaacgagaccgcaaaagcaaaggtgcacagtggggacagccacagccaacagcctgacatgtgacacagcctgacacatgcagccagacccacattgtccatacggtggccacagctatgtgtgacaacttaaatttaaaatttaaattagctaggagaggccggcacagtggctcatgcctgtaatcccatgagcctgtaatccc

SEQ ID NO: 206533 - DNA, 280 bp, Homo sapiens
agcagatgacatgggtttggacctgactctgctgcttctagctgtgtaaccttgagtagattacctaggccccctgggcctcagttttctttttggtaaaatggggataatattagtgtctacctcacagggtgttttgtggattaaatgatccaatgtacataaagtgcttaaactgcctgagacataggcagcacaatctaactatctgctgctgacattactatttttattactcctccaagtattgattaaaggcattttgctattgctctgagac

SEQ ID NO: 206534 - DNA, 275 bp, Homo sapiens
gctttcctccccattttacagatgaggaaaccagggaaatcaagggtgtttgagtgactgaccgaaagtcacacagctaggaagtaaaggagccaggatacaggcccagagctctggttttatctgaaaccaaaaccagaagttcctcttccagctgccaccacctctctgagtatcagccctgctaatgacaatgataacatcagctccgcagcatcgttctaagcactgtacgttaatgcgatcagttaataaaagcatcttgccttaattaa

SEQ ID NO: 206535 - DNA, 426 bp, Homo sapiens
tagtgggaaaagagaaaagttggtccatcgaggagagtgttctgcataaggggagagatgagaaggtagccttggccagaggaagaaacttcattacaaccagctctccttctgcaagggaagagggtgaagtttgagtttgtcttgcaggaagacaatcaaactaaagaggccaacaccagcttagagccgagcggccccctgctcagagcttccctgtggctctcctccatgtgatccagaaggagggactccagtgtgaactgcctgttccagaaaccccatcatctcagcccataagctgataagcaatgtcagcaaagtctcaggatacaaaatcaatgtgcaaaaatcacaagaattcctatacaacaacaatagacaagcagagagccaaatcatcaatgaactcccattcacaattgc

SEQ ID NO: 206536 - DNA, 749 bp, Homo sapiens
cccttcccactgtagcattctgcctcctgtatatctgactgaaggtgaactccctgccattggcgttcatttggcattcagatgtttcagtgcatcatcccttttatgttcgtatttccaagttaacactggaatgtactgacaacacatttgtcaggcactacccttcctatatatattaccacatcgaatccttataacaattctctgggggcaggtatcctaatacaaattttccatataaggaaactcagacctagagtggctaagtcactcacctgagagcacacagtaagtggtagaatgggagcttagcccctagactgactctcctgatagtttattatactagttagaactgtatctaatattaaaagattcgtattagcagtttcttttatattatcaaaattttagagtcttgaatagaaataataatgtgattttaaaagtccttatttgaaaccccaacatgcttttgagctgtagaggtggtatcccagtagctgggggtagccgccaaaacacttcagtgtgatagggcctggtcttgctctcaggaggtttcaatgggagcccagttgaaagcactggattagtgattaggaatatcattactgaatgagattgcatgcatgctaccttacaatttaggtagcctcatctcatgtcttcttcttggaccagtggttctcaaggggtttccaggcccccaggagtccggagacccttttagagggtctgcaagg

SEQ ID NO: 206537 - DNA, 136 bp, Homo sapiens
tgaaatgttggatcacctgtgggtgtccatcacctcagcttcatctctctttattaactaagctccacttatttctgaggatgacgcatcaccgagaaaactctaaattagatgagaacttgggaggatacagatc

SEQ ID NO: 206538 - DNA, 583 bp, Homo sapiens
taaagttaccaagtgaactggaattggaacatcaccctccccagcctgctaggtgatttacttaacacatagagtaataaaatcatcgctgttgctttagatcacggattattttgctaataatgctaaggatgaagctgtgatcttattatcacctgaatcgggaggtgtggacactttaagcagttccactttccttctaattccccatccccatgcctttgctaaagctgtcccttttgctctaacacccttcctggaccttcctaccctagctgggctaagtgtttctcctcagcgttcccacttgtttcaaacatagcacttaccacttgtactaaaattacttgccttcttaattagatatgaacaaccctccccaactccagtatgggccttctgtcaataataatacgatatgacagctaccatttattaagggcctcctgtatgaaagaccttaggctaagcatgttttaaatgttatttaatcttcacaatctctgaaaaaaatgaagaaatcaacgtgcttttcttactacctctacccctaagccattattacttttttttttttttgaga

SEQ ID NO: 206539 - DNA, 271 bp, Homo sapiens
ccatattcttgtcttggaggaaggacaatcgtttattttttattactgcagtcctcattattgctcacacaaaagctttatgtgtggtctctccagtgagccaaattatcttaaaattatggaaagtgccatgaaaatagaaagtaaaaatgatgattgaagaagcagattactgaagaaatctgttaaaaaaaaaatagcgacaggaatgtatgctggggaagaaatttatggaaggagtaattttcagcagtgcctctctcgactcttc

SEQ ID NO: 206540 - DNA, 475 bp, Homo sapiens
ccaatattgatttcttgtagtctacagattcattcaaaggaaaatgaaatcaattaaacttttctttaaatcttgtcttccttatctttgcaagtctagtccagatggattggtctagcgcagatgcacctgccccatgaagccttttctatgctcctaattgggcatcatggtacatgatctagaatgatggaaaattagaactgagaagatacattagaagtcatttagagatattctgatccctgaaccttaacattaaccataactctgacatttaagggaccttaaatgtcacttaacattttgtgtctttagggtttgtttgttttataaaatgtcttttactttaaaatgaagcttccctgggcctgtcaacatagacgtgtgttccacacacatgaaacatgatcagtataaaatccgtgctaaaaatattttacaataaataaatattacgatttcaaaccacagt

SEQ ID NO: 206541 - DNA, 426 bp, Homo sapiens
tgaaaaaccactgaatcccaactgaaatgggtgaattccacagtatgtgaattatatcacagtaaaacttctgttaaaaaaaaaagcagctgtagaaccatgtgtatgagatgctatcacttatagatttgctcacatctccataaaatatctctggaaccatacacaggatactaacactgagttcctcagcaaagggacaggggactaggaggaagactttttatcatgtattcttttttaacttttgaactatgtcaacatactactatctaacatttttatttaaacgtgaaataaaagacctggtgtggtggttcattcagcacttcgggaggctgaggcaggaggatcacttgagcctaggagttctagaccagcctgggcaacatagtgagacccctgtttctacaaaacattttttaa

SEQ ID NO: 206542 - DNA, 328 bp, Homo sapiens
aatgggcttggtgttctgagtaaaaaagaaacaaaaacaaattttttttcccatttagagaaatggagaaattaaatggtttatatacagacccgatccctttcataaagttcgcttggaggtaataccacaatttcaggccctctttgaagaaataccatctcgtgttgggttctaattaaagatatgctgttttgccgggcgtggtggctcacacctgtaatcccagctactcgggaggctgaggcaggagaatcacttgaacctgggaggcagaggttgcagtgagctgagatcacactccagcctgggtgacggagcatgactc

SEQ ID NO: 206543 - DNA, 476 bp, Homo sapiens
  misc_feature (25)..(25): n is a, c, g, or t
tcgagctcggtaccgtagctcgatnaacctgttctccagcagaaccaaatgtcagtcacatataccacatttaaaattgcttagaatagataggctgggcatgtggtttatgcctataattccagtgctttgagaagccgacgtggaggatcgcttgaggcaaggagttcgagaccagcctgggcaacatagcgaaactctgtctgtccaaaaaattttaaaattagctgggtatagtgctgcatgcctatagccccagctacttgaaagtctgcagaggaaggatctcttgagcccaggagtttgaggctgcagtctcccaagtagctgggcattgttgtgtgtacctgcagtcccagctacttgggaggctgaagtgtgagaattgcctgagcccaggagttcgaggctgcagtgagctatgattttgccactacattccggcctgggaaacagagtaagaacctgtctctgac

SEQ ID NO: 206544 - DNA, 622 bp, Homo sapiens
ggcatatttggaaagatgagaacaccatatttatcaacaagtttttgcatctgcccagtgatataaagtaactcaggatcacaaagcaacaatatacataaattacagtaatcaaaatttatgttaagcacaggcagtgaattgtgtaagaataaagtatttttcatcagctgaacagttaccaagaatttagattcacagccttggctaaatgacccttccccacaggaagggttctgtggggttcctttattgccattcagtggtgcttgcttgagtagtttgaatctgcccatatgataggcaccttttttattgtataatgatcctggccaagtcatgcgattgggttgccaccttatgtctctagtaaagcaagacactaggatttgtgctgaaaggaaaagagatgcagaaagggcacactggaacttaaagattgctctgtgtgtgccagacacagacattgtaagggctgtggctttcccatcactcactatacttttccaatcaatatcgtcgtgaggtgactgcagtgatattatttcactgtgtcaaaaaatgaagtgacacctaataaaaatgcaaaggaaaaagctggaaaccaaaagaaaatggtttc

SEQ ID NO: 206545 - DNA, 490 bp, Homo sapiens
gataggtaaaattataccgtgacacactgagtgacaaaaaacagcccctttacctaatttcctggtgtgatattggactacaaggcattgtttttaaaaaatgaaataaatatctaatagaatctggtagaatcagatctatttcactgtatgtatatgtatgtgttgtatgtatatgttcttcacctagttttgacagttgtctataatctgtcaggccactaacactaacctccacctgtttacctgtcagatctcaatgacgagggccctgttttctgtaattaagataaccctactcattctggaactatgtaattttacacagataagttaagcaaaaatagtaattcaaactctggaaagtgttaatattttcagagacctacaagtattctcttaattgctctatatagctttcaggaattggacgaagtgagaaaggatccaacttcccaatagtacttttggaacataaaataaagggtgg

SEQ ID NO: 206546 - DNA, 597 bp, Homo sapiens
aggaaacacaatattgtttatagaagccctctaattttcataagttgctaccttcatttggtacctactgattatcatgtgctaactaggagaaaacacctacaagcaaacaatattatagtgctgcgattgattctgctttaatgttgcttgttcaggtagcaaagccattagctacttcttgatagtttttatgaatagacttagcacctagtattgagcaaccactgaagaatgcatcttccgttaaaaggttgatttattagtttatatgtaaaagaacactggaggttataaaggtaacaaagaccttaaacattacattgatttttttttctcagagctttttttcttcttgttgtattgcagggtaataaaatttcactaggcccattggatctataaaatctgaagtacaaccaccaactgatacaaatgaaattgtttgactggagcgataagcaaggacttggctttgaactctgagcagtataagtcgtttctctggcccgtgagggtgaattacagcctgctgtgcattaaaggacaggcatgtatttgtaggagctcccagttcagtaatcactgggtgataca

SEQ ID NO: 206547 - DNA, 428 bp, Homo sapiens
tagaaaatgctcaagtaaaagaaagtgatttacacattttaacccagtcattccattgcatataaagatggcatacaaacttttttgttcctagaaatatgtacttttaagaatacctgaagaaattggaagaggaaaaacttcatccatccatgagatacatggaaaaacaatgacagaaagatgctcagtggggctcaaatttatttaactataggactaaaactaaaaattagtgatagaacaaaatgtgtatgatataaataatgttatattaggtacaaaagtaatgtaggtcttgtcattaattttatttatttatttatgaaacagagctcgctctgtcgcctaggctggaatgaagtggcgtgagtcgagattgcaccactgcactccagcctgggtgacaaagcgagacttcatctcaa

SEQ ID NO: 206548 - DNA, 661 bp, Homo sapiens
agctgcatgtctcagaaacagcttctttctcaagagagaacaagagggataatgctggatctaaaggcatcatctgaagaagacaaagatatcaacaatcgcaactatttggctttctgtccatcactgagacttttcataatcttcccttcataaataggatctcttgatcagaacagaaaagttgagtcttaaatttcctgtatttatttctgactgatactgagggaagtgcaaatttggttgctatgattaaactccttgattgttcttaatgggactcttttaataagtcaaacatttttgccatctaagtatattgatgagcgccactttatctcaaatgtttacacatactagggaaaagcatctgcagtttctgaactctttgtgaatcagtatcactttttcatgttacttcagagatcaatattcagtgcattggttttatttaccatcttttctcccagttgatcttgtaatcatcagaaagggaaaaaaaatctccttcacaaagccctttgcgacaaacttatgtaaataataatctaaggacagctagaaaaaaaatacaccatacaggggaatagatccaaaattgatatctgcctcacctgtatcacctattgtattagtaactggaaaggtaaataaataacag

SEQ ID NO: 206549 - DNA, 160 bp, Homo sapiens
ctctctccacactggaaatgtatgtgcctaattaaaataagatgtactctttaaatgatgaaaataaaaagtgatcaaaatagatttttgttatccttggggcattgggagtttaaacgcaaactgcatggcttgctgtgtggagaattaattattggta

SEQ ID NO: 206550 - DNA, 354 bp, Homo sapiens
ggtttgctggggaccagcagccttgcctgaaacattgactgttaactagcatagtctcccaagaatttttttaggattttgtttaagaaaatacaaattctcggctgggtctcatggctcatgcttgtaatcccagaactttgggaggacgaggcagctggatcacttgaggtcaggaatttgagaccagcctgaccaacatggggaaaccgtgactctactaaaattacaaaaattagccgggtgtggtgtcgggtgcctgtaatcccacctactccggaggctgaggcaggagaatcgtttgcacctgggaggcggaggttgcagtgagcagagatcgcggcactgcactcc

SEQ ID NO: 206551 - DNA, 522 bp, Homo sapiens
tgcagggtctttctattctattacacgtcaagaataaaaaatggctgggagtcacaaaaggtagataagatgaattactgttaaacagataggattccctcgacctcagaagtcctcaaataattccacaatgcttccccaaataatctatgacaacagaaacatcctcccaggaccatcacaactgccatccccctgtcaaaagcagttactccatccaggcttctcaaaggtcaaacagctctaagggtttcctgacttaccaggaaaatgttctagtatcacacaagcaagaaagaaaacatgctgcagattaacatggagtttaatttaatctacagttagactggaataaaattgtcaccatgtccaaggcctgcagagactgtaatgtactccccacaaagtcttctgttgaagctctaacccctaaggtccatgagaaggtgatcgagggtaaataaggtcataggggcacagggctctgacctgagagggctggagtcctcgcatgaggaggaa

SEQ ID NO: 206552 - DNA, 529 bp, Homo sapiens
ccaatacccactaacttaattagtagagattataataattttgttttttttttgagacggagtctcgctctgttgcccaggctggagtgcagtggcgtaatctcagctcactgcaagctccgcctcctgggctcacgacattctcctgcctcagcctcccaggtagctggaactgcaggcgcccaccaccacgcctggccaatttttttgtatatttagtagagatggggttttgccatgttagcaggatggtcttgatctcctgaccttgtgatctgcctgcctcaacctcccaaactgctgggattacaggtgtgagccaccgcacctggccagattataataattttataatcaacttgttaagtaccaaaaaagctctgccagaattttgatcataactccattgaaaccgtgtatcaagtggggggaattctcatctttgtaatattgaatcttctgatccatgaacattgtatgtctcttaagtccttgatttctttaagtaaagtttttataattttctcta

SEQ ID NO: 206553 - DNA, 104 bp, Homo sapiens
agcagacccatttcacacaataaaaacggcaggttgattttgtggatttttgctacaccggctacaatcattgatcctaggtattcgggactcctatgaaatcc

SEQ ID NO: 206554 - DNA, 485 bp, Homo sapiens
agctgttgaaacaagagaatggaaccagcgtttgtgtagcataaaataagtaccaggtattttacatatgcagttacatattcttttaaaaaaaatggtgctttaggatacacttttttttttttttttctgagacagagtcttgctgtattacccaggctggagtgtgtgtagtggcgcagttggctcaccgcaacctctacctcccaggttcgggcaattctcgtgcctcagcctcccaagtagctgggattacaggcgcatgccaccatgcttggctaatttttgtatttaagagacagggtttcgccatattgaccaggctggtctcgaactcccgacttcaggtgatctgcccgcctcagccttccaaagtgctgggattacaggcctgagccaccatgcccagcctaggatagttatcaaggaaatgtattccaaggagatgaaataacttctctgagtaatatacctcatacttggca

SEQ ID NO: 206555 - DNA, 169 bp, Homo sapiens
agtaattactgcagaaaagccaattgagcataaaatgactcgagaaaagggctcagcttcaactaagtagcatgggaaggtggctggtacacccactcaaagtttggctgcttaattatatcatgcctatttacatattgggtacagtgatatcagtgaactataaatt

SEQ ID NO: 206556 - DNA, 673 bp, Homo sapiens
tggaaagagaaaacttaaagggggacgaggattagtctttgtcttgagactttccaacaagagaaatttacatttagacactccatgtatccatgtattttcctaccagaaggtagtgtttaggagttaaatgtcacatcaaagacaaatgttagagccaggagatttttctttctaggaagaaggatatgttagttagtgactttctccatctgattcggattttatctctactgttgtcactaaattcttttcctttctctctccatggagctggtagtttaaaaaaagaaatctgcagggatgggtacggtggctctctggttatggtggtaatagccatgttcctaaatctgaactcctttcttcaggtcaaattgcataagctttccatggtactgcaggctttttctttctgctccccttcactctgcgatgcctcaaacctctcatttccgtccacgctctctgcagacacagagtactgaggctggaaggagaaggaggggaacaggcaggccccactctctgctctgagtagtgtgtgggaggaggctggagaacggagcacttctctctgatcctgcctgactcttttggagccagtgaggtgggggtgtctctgagtgaagcagagggaggcctggaggggctcaggagctggactatttct

SEQ ID NO: 206557 - DNA, 379 bp, Homo sapiens
cttctctcccttctctctctctggaggtgctggcacctagagtacaggctcctgtctgaggtcctgcagttccccgttcctgtgacagtgcagtgcctgtcccgctttagagcccaggactctgatcctgtgcgtaagataggggaagcctaggaaccatatggagagcgtgggtcttccgtgcttctgctgagtgaagcttgtgaccaggtgcatgtagagaccaagaagcactgtgccctgagccattagcgtgtctgttaatgagaagaagactccaagtcgtccatgctgagtgagaggcacggctttgccgtctacaggagttgtaagataaatgtgaaactgggacttgactctgagtgaccgtttctgggtt

SEQ ID NO: 206558 - DNA, 343 bp, Homo sapiens
acaatgatcagttatgctatgtagttatgttttacaaatatgctatatggaacttggtttggggccccttgtatcttacttggacttggaaattctctcataattggtatccatacctctatatttcttttccctagtacactgtataccgggctagcaccaaaatgatcgttccatagtaaaaatctgctccgatggcctctagaatgaaatctttccagccgaccaataattgtgttcagcttttcaatattgtattttagcatggactagtaagcactaaatgatggaatcttgtcttcctccactgcttattgcttcatttaccatcttttcccttctc

SEQ ID NO: 206559 - DNA, 554 bp, Homo sapiens
agatgagacccaaccatctgctctcttcaaaagacacgtatctcatttagcaacacccacaggctcaaagtaaacggttggagaaagatctaccatgcaaattaaaaagagcaggtgttgctatttttatatcagataaacagattttaaaccaataaaaattaaggagattgtataatgataaagcatacaatacaagaagaagacataactatactaaatgtatattcagccgacattggagcactgagagtcataaaacagttctttttgacctacgaagacttcaacaaccacagaataacagtgagagacttcaacaccacactgacagcattagacaggacatcaagggagaaaactaacaaattctggccttaaacttgaaacttgaccaattggattaaaaagacatctacacaacactccacccaacagccatagaatatataatcttctcatctgcatatggaacatattctaagattgaccacatgcccagtcataagggaagtctcaaaacattaaaaaattgaaatcataacaagcacaca

SEQ ID NO: 206560 - DNA, 261 bp, Homo sapiens
gtgaggcccctgcacacctatcaccaccactgatgctccaggacccaagcaggtggtcgcccacaggcataggacaagcacaacctttagagcagaaaggccaagacttggatcctggagccaccaaatgctttactaggtaggtaaccttaggtgagatcatgagagtcttagctttcccagctgtaaaatgcagataatagctacttggcagttcattattgagacgacagcagtagcaacaagcagggccacccactg

SEQ ID NO: 206561 - DNA, 455 bp, Homo sapiens
gagctaaatctgcagatgttagtgagatagtagatgtgacgcttttatttttgttctcgtaattgctaaagaaacgaaaaagtcagatgaaaacagcgcgattctccattagtgcaactgtaaatagatacagtcttttggaaaacaaaagttctttaaaaattcagtctctttgaccatttctgtgaatcaccctaagcaaattggcctaaatgtagaaaatctttagttacaaaatattcatttgattcctgtttataatggaaaatattttaacataaaactcagtaatagtctctgtaatgtgtggtacaccacttgacacccataaatgatatgtttcaaaagaatgtaataatatggagaaatgttaatgatgtaaacctaaatgatgaagtgcagaatgcagttatataattacaactattttaaagtctattcattaaaaatgattg

SEQ ID NO: 206562 - DNA, 272 bp, Homo sapiens
ctagggaatttagaaagccacgtgcaagcctacaacagaacacatgctcataaaagccctatactttaacattgggtcttctcactaaggccctaaacttcaacctagggctgagctctgagctcagtgcaagcttagctaaatgttgaaggagggcactggcacagatccaatctgcgaagactataagaggtattgttctctctcttgctttttgaatgtttgttttattcgttgtttttgtgtttagctgtcaaaaatttttttttaat

SEQ ID NO: 206563 - DNA, 869 bp, Homo sapiens
cctcgatccaggaagccctccaaggcaggaacggcacccagcccaagggttgatgcaggtttgtcactaaaacttgcagaggttaaggctgttgtggccgagcggggttggcgacacagcctgtgggtccccagtggggaggggtctgcagccttggccccccacagaacttctgagcacaaatcatccctggttccactagatgccagggagcatgagtggattgtgaagcttgccagtggctcctggattcaggtgtggactttgttctgggaggaccctcaactggccttgcacaaagactttttgactgggtacactgcgttgcactggatagccaaacatggtgacctcagggcccttcaggacttggtgtctggagcaaagaaggcagggattgtccttgatgtaaacgtgaggtccagttgtggatataccccgctgcaccttgcagccattcacggccaccagggggtcatcaaattgctagtgcaaaggttggcttctcgggtaaatgtcagggacagcagtgggaagaagccatggcagtatctaaccagtaatacctctggggaaatatggcagctgttgggagctcctcggggcaagcccattttccctgtctatcccttagttggaagttcttcccctaccagaaaggccaagagcaaggaaatatctagaagtgtcacccgaaaaacttccttcgctgcactactcaaaagtcagcacaacaagtggaaactggccaaccagtatgagaaattccacagtccaagggaaagagaagagtatagtgactgaggtgggtctctctgtccaacatgcaggcagcactccctcatcctgctcagtgagagaattcaggg

SEQ ID NO: 206564 - DNA, 370 bp, Homo sapiens
ttaagaagtatagctgaccaaagatgtgctggatgactttgacaattgtgttttcttccttgaaggtgttaacaaggatttgagacgctattaatgagattgaaatatgggtgggtgcttggattagtaacatttcagattaattcatttccttgtatgaatagatactatatttcctaggtattgtgctaagtttttgtagtggacaaaacctaccctcagaaagctcaaaataaagacctttttttgatactttatgattttgagagtctatgataaaaggaaagagaatgtgaagaagtaaaacaacatgctttttaacgtttgctggatttttcctttttgaggtagaataaaatttattacaatt

SEQ ID NO: 206565 - DNA, 566 bp, Homo sapiens
gtattttattagttgattagtgggtataaatgtacagttagataaaagaaataaggcctagtgtctgacagatcagtagggtgactatagtttactaaatgctattgtacatttcatttcaaatcgctagaagaaaataatttgaatgtttctagcatacagaaaagacaaatatttaaggtgatagatacccaaagtacacttatttaatctgtacaggaagactccagagtaaagggagggtctcccggcctgactacctcccttctcccaccctatatgtcttctctgaacctgtcacttcccacccctctaaaaaagactgtttaaattctcttaggcctgaccactcacaaccttggggaatcacctaacatctaaccagttccatcttttgaatgggctcaggtgggaaaacaaaggtacccaaatcctgagctttgaccttactctgaggcacagcaccaaggaactgaggggtggaagaggacgttgaccccatctcactttttcagaaaacacaaatactgcaaataaataccacatggaaatcattactaaatacc

SEQ ID NO: 206566 - DNA, 188 bp, Homo sapiens
agaagtgccatttacttttttgacacccagagggataacattgctttggccttggaggctacttactgagaatagctgcataaagtatagaaggctataaagaattgcctggactatcatatctctgtgcagactattatgggagaagcacaaggtgcagagaatctctgcacagcaagaaaaggaga

SEQ ID NO: 206567 - DNA, 370 bp, Homo sapiens
agcacagcggaacccagtaggggaaacagatagcgcagtagggttactcatattttctaatgtggtatttggagatgttatgttagacttaacattaaaactttcccctctcttcaagtgctcaaatgaaagcattttattttaaataaatgtctggggagtgattttgatcatttggcttttctttccacaggctgatattaaatagaagagtatttggcttttattacacagctcgcagttttggtgatctattctaaagtggtagtcaaacctctagctaattaaacagatcagcctagtaattagcctgggctttcttctatcgtcatattgccattattccacaaagatgctgaggcacaaccat

SEQ ID NO: 206568 - DNA, 197 bp, Homo sapiens
tgctcaggaagcaaagcctaagtttcctcttttcctagaaatacagacctatttgtagacctcctgttcttcatcttcagcctgcagatattttgtttttatcttggggaaattctcctcatttttggccatgatactttgtacttgaatcttctcaacctctccaggactttcggaaataaaaggcagaaaactta

SEQ ID NO: 206569 - DNA, 433 bp, Homo sapiens
atcccatgtggacatgtgaactcagtgagaggaggtgctgcggtgagggccacttcttggagatttgggaaaaggagcaggatgtttctggcagtgaggctgggaagggcatccttcatagcagagggaagctgtgagcagagcagaggctgaggacgactccacccaaggggaccggtggggcaggggctgtgccagggcttgacccggagctctgggctgtgtccagttcccttcaaatgagaaagaaggcgccagaggtgcaggggacaggggatgcctgccagccaggccccatctcctctgctgtttagggactcgggttggaatttccacgacactatttgggggaggatgagggagctggtgggaaatgggtttgggggcgcgaggcttgatatcatttcttccgataaagaggcattggctcagc

SEQ ID NO: 206570 - DNA, 281 bp, Homo sapiens
tattcttcttttcctcttaagaataaataatttactgttagaagttcaattaaagaacatgctgagaaagagtaggaccttagaaaaaaataagatggccattcactgaggcccacatttatacgtacctcagaaaattgctcactatctggggtcgctggcacacataccatgtaggaccagaaactggatctcaccaatgtctcagagtgataaaactcaggaatgctaagttatgcaaaacaaacccatatgaaacgaatgctaatggattacttcac

SEQ ID NO: 206571 - DNA, 377 bp, Homo sapiens
tgaatagacattcttcaaagaagtatatgaatgaccaataagcacatgaaaagatgctggacatcattagatactgggaaaatgcgattcaagactgcaatgtgatattgcctaatacctaccagaataggtaaaatagaaaagacaaacattagcaagtattgataaggatgtgtagaagttggaactctcatacattgctggtgggaatgaaaatgttgcatttactttggagaacagtttggtagttcctcaaaaacttaaacacagagttgctatacaactcaacaattccacttctacatatatacccaagagaactgaaaatatatgtccacacaaaagcttgtacaccaatgtcgatagcagcactattt

SEQ ID NO: 206572 - DNA, 247 bp, Homo sapiens
aaaaaaaaaaagagagagatatttatttaggatgtcacaggaagttgttggcagagctcagaagtacacggtgctagacttttaggtccagaagagcagtgactatctggccatctcaaagttgaatctcaagaacctaccatacagctgagcacaaaatagaccatcagtacatactggtttgaggaagaaatattcaaatgaaagactagcaccagaatcaggatgtagctgaactacttaaatc

SEQ ID NO: 206573 - DNA, 937 bp, Homo sapiens
cagggcggccaagcaataaataaaattaatagtatggtcttttccaggtttatatgagggcattaactattcctattgcaatgagatatagatttaattaatccggcaactttacaattccatttattaggagcactatgcggccaaaatttagtggcgagaagaaagaaagggaaccatagtcctcttcctcaagaagaccagccgaagttgtaggcccctaaagcgacttggaggagtgggaaggctggaggggaaagtttgggctaagggcgctaaaggcggctggggaagtccgcttgctctgaacaattccctcttcttttgcttggttccccaagacctttcgcgcctgcaaacgcagtctccaagtctggggcgagccgggatcgggaagggaggcgccgaggcaagagcctgcaggagggcggtggaaagtaaagccttgctggttaattaactttaagcctggggtggtttcttccccctcccccgaaaaaaaaatgtggatctcgctgagacacaagtaaaatcaaattaaacactccaggagaatatgcaccactagaaacgtagtaattacatctccaaggcgatctcgccctagaaagcctttccagggcctggcgctgaaaccctcggctgcggtgctcacccgggcgcgccccgccggccttcggggatgaggcagtgaggtttgactgtggatgaagtttagagaaaatccagctgctggtatgcggagaaagacggagcatttaattatacgaaaggaaaatggaaaacggctcctcagcctcgtcgggaagccccggctctgctctcggctgctttttcaaagggacttctacaaccgcggagcggcagaagccactctgccctcagctacagctcatgaaccaagctctcggctaagttcaactctgaaatgttttct

SEQ ID NO: 206574 - DNA, 456 bp, Homo sapiens
gacatgtgagatgtaggatagtgtccagtaaagtcactaatacttagacctgaagtgaaagggagacaagagtgagcaggggagggctggaaggaaaagtaagggtcatcagtatcataataaaacacaaacaaacaaaaaccaagaaagaaaaaaaagcacaagtgctggtggggatgtggagaaattggaatctcatacattgctggtatgaatgcagaatattcagctgctatggaacacagtttgacagctcctcaaagagttcaacagaattaccatacaacccagcaattccaccccaggtatacacccaagtaattacaagcaaggactcaaaaagatacagcagtatttttgacaatagccaaaaggtggagatgactcaagtaaggattgatagatgcatgggtaaacaaattgtggtatatccatacaatggactagtattcagtc

SEQ ID NO: 206575 - DNA, 498 bp, Homo sapiens
tggggaaatgtcaagttctgatcatctatagatgagataatgctgcaagaattctgcggttactaggctttgcataggcttaaagcagtgattctcaagggtgtgaaagggtaaatattagcatcacttaagggtggttttttggtgttttttttttttttttggtctgttttaaatacacataccctgttgccgcttgtaggagatataagactctcctgaggaaaagcttggtcaggtgtacctggagaaagctcccaggaggttctaataccttcccactgccacttttacctctttaagaatacaaagtacttcccagccgcttccatgtccccattcctttgacttcggctgaaaacagctactctttccttcaatcagctaatttgacgttttacttcccgaggaatcatttgtgtcctgtcagcctatggcatgagaactactcctgcacttttcttaacccctgcattcagaactaaaatcatacatttg

SEQ ID NO: 206576 - DNA, 416 bp, Homo sapiens
cttatttaaatgcattttttttttccagtttagactagataagaacaagctcactctctaacgccagattaattccaccctgtgagtatgccctttacccaagacactttgaggagagagacagggtgttgagcgggaaggcccactgacctcgctggcttgctagctcactcacaggccacacaagaaattctggctgagcctctcagacacactcaaggtcaccatgggaagtcacccaacagttttccctatacacattctggatcagaatcccaagaaatccaggacaagttcccagttaggaaagttccatcaggacggcaaatcctttctttggccttgacgtaggaaggagtggaacctcttgcggaaaacacacaaaaaacacaccttcagaaaggggcaatttccta

SEQ ID NO: 206577 - DNA, 611 bp, Homo sapiens
cagcactcaaaggcatagtgtgaatgaccttgagaatcacctgaagcctgtgctgctaacccaaggtttcaagaaggatgtgacaaacatactgtcctagttagtgctgtcctcgatttccagcgttgagaaggttggttgtcatttgaaagaatctcttctctctgcctgatttatggcttcttgtgctagagctggctgtgctgaggtggataccctgaggagggagatttattggtaggcattgcactgtctttaggtgctgacatgttttcccagccttgcccaaggcagacaagaattgtgagtgcaataataaacctcttgagttccatcaacagctcataggcagaagtgcccttagttggtccctgcccttgcatgaacctgagagggttttttggtgatcgacctctacacctcacttgtctaccccagttccgccgtggtcatgacggcgcagttgtgaatcttgccagctcctcagccccatgcctgcctgaacagcaactcagggcagtagacagtggagaaagcggaagttggctcacccagcctgaagatctttgagcaccagagaacccacgcatcctgcccagacttccccattt

SEQ ID NO: 206578 - DNA, 160 bp, Homo sapiens
tgtactgccttttgtctatgtctggaaatagctgttttgtgtgtttgatccagcttctcagttgtttagcaggagaaagtaactcctgtttcagttatttctccataagtggaagcagagtctgaatatattgtgaaaataaagccagtagggctgggcg

SEQ ID NO: 206579 - DNA, 789 bp, Homo sapiens
ataaaaaataaaaaatcccagaatagtgctttggccaggactttgggccacatgtgagatatttacatttccccagctcatatcaggtactcaccctgagctaatcagttaggcccttggaaagtagggtcaaaattgtgaaatgaacctttatgtaaagtccacatcaccccacctccacttatctttttggacacaaaccattgcacacaaaaaattgtgcccattaattagaatgattagatgactgcttcaaaatagagagactcctggctctttattgtactcttgtgacaaaagtgacgtgcaatattgagatccagtcattacttcatccttcatctatgtttggatcggtggacaagtgcctgcctgttttttagtggcaatattaaatagtaagtaaaagttctgggaagagattttttttacaagaagcttgcaagaggatacattgagtttattgcaatatatgaaatttaccttttggggaaaggtaaattcaaatgaaaagtgtgacttattttaaaagaacagtcataaaaaacttgccagtcccgtttgtttcccactatcagggaaaatagttaattgttaattgttatcctatgataagttttgaggggtttcaggcctacaaaggggaatttgaccatgggtcacacagagcacctcacctttgtattcttggtacatgacacagaatgagttcagcaagcagttagtgtgttaaatgaagcttaatgaaggatattctgatcttctcttgtttgtgcctgacctctccaa

SEQ ID NO: 206580 - DNA, 411 bp, Homo sapiens
aatgccagcttaaggtagaatttcaccacgtaaaactatatttgaaatatatgacttttgaacaaagatctaaagtaatttccttcgccagaacttaacaaaggtggatgtgtggaaatggaagtggcaccagatttagggacttggacacctaatttttctcaggaatgggggtggacagtggtgagtgaagaggcaaaagacagactcaaggaaagtgtgggcggggagacaacagaacccacatgggaattatggaattgaataattccctagccacacctggcccaggaaattttgaagttcttacaggtacagggttgggaaattcatcatttgcacataattcctggagacttgcttcatatcaccagcttctactttgtccccagagacatttctacttctact

SEQ ID NO: 206581 - DNA, 366 bp, Homo sapiens
ggtactttaggttaaggaagggttactgaagaggtggtggcctgagctatttgagaagcccaataaaatttaggcagataaatgaaggaggaggaggagtcaactcaaagcaagcagtgtatattacatgattttacagtgtaaggccagtaatgattgtggttattgcaaattaagaaacactcaataatgtagaaaacagccataatatgcagtgagttaactattgtactcacttaaccactcatttttacttgatcctatggaatgactgggcccagtatactcatcagcaagacttttggcatatatttttatataattggttgaatttttaagaaaagtatgaagggaacaagtaaatgt

SEQ ID NO: 206582 - DNA, 788 bp, Homo sapiens
agagtttaaattaatcttacaccttcttttgagggagtatgttcaagaagagtttaggagtttccctgtagctttattacttgttatttcctaattgtcccagtttcccaattcatgtaagaataataaataaaaatacaaatataaataaatgtgcagagtatctgcataagaaagaaataatataacttattttcttttgtccttagcactgactctgatgattactggaatcactggaaatgtgaccagtatgttagttcttttcatgcctggaacaaggctttgtactgttggaagaatacaggtttcagataaggaaagatctacacaagcacttagttttgaaacttttctgctcccatgtgtcttgaccccttactcataaccaagagaaagggagtttatatctcctctgatgcatttgtaaatgagaaagaatatatttccaggtttcaaagtttatattgctgtagttaggaagagaatagaatgagttgcaagagtggtggcaaatatcctcaaggatgctttggaggtaacaggtacaaccacattgaaggaaatttcatggtttggtgaggatttcaaattagaattagcaattttgcaaaatgtcatagtacttagagtaaaataggacacctttctttaagaatgttgaatattggcccccactctcttctggcttgtagggtttctgccgagagatctgctgttagtctgatgggcttccctttgagggtaacccaacctttctttctggctgcccttaacatttttttcct

SEQ ID NO: 206583 - DNA, 471 bp, Homo sapiens
tgtgactttgggaaagaagtatattgcatgtaatgtttccaagaattagttactgtgtgccagaggagtgggcacataagctggatcagtggctttaatgggcagcagttggctgcaagagaaatttgcagtttcaccagtcttaatgctgggcaacccatatattaaataatgtttggtacacttggatatcttttattgggaattaagcccccaaagcagctttctgtaactattaaagtctgataatgctaagctcttcttcaggcactggagaagtttggcagtctctggaataaggaatttgtttggctttggcactgatagccaaaatgccacttctagtcactttaaatgttaccaagatttcagtctcattgccgattattgaaaggtctgtggcaaataagatttcagtgctgtggtgaagcaatctgtgtgtgctttaaaggtaaataaaaatacagcaca

SEQ ID NO: 206584 - DNA, 414 bp, Homo sapiens
cctgctcagcttcccaggtagctgggattacaggcatgccccaccacaccctattagtttttgtatttttagtagagatagggtttcaccatgttggccaggctggtccagaacccctgacctcaggtgatccatccgcctcggcctcccaaagtgctgggattacagatgtgagccactgtgcccggctgtttttttgtttttaaatagagatggggtcccactgtgtggctcaggctggtctcgtaactcctgggctcaagtgatcctcctgcctcgacctcccaatgtgctgggattataggcatgagccactgcacccagctactttatgggttttattgtaaaactttctcatgaaagcactaagctgtttatgtttggatctgtaacaaggtcccccccacccccccc

SEQ ID NO: 206585 - DNA, 293 bp, Homo sapiens
aggccattgtaaaagcttattttgagtgatttgggagcttacatggtcagggtttaagcaattaaattactaaccaaaatcccatttactaacatattgcatgagggacttgatgaataatctcgtctttagcatataactcaaacattaataacagaaggaaatatgcctcagttcaagccatgggctttgatttttaattctaaacccattttatttttttcagactcaaatatctattaaaagtgactattttccatatgtttttccttttgtattgcataaaacttaat

SEQ ID NO: 206586 - DNA, 903 bp, Homo sapiens
caaaatgctaccaccttagggaataaatcattaagtgatctgtattttattccccatatttctttttttttgagatggagtctcactctgtcaccaggctggctggagtacagtggcacgacctcggctaacttcaacctctgcctcctgggttcaagcgattctcttgcctcagccttctgagtagctggggttacaggcacgtgccattacgcccggctaattttgtatttttcatagagatggggtttcaccatgttggtcaagctggtctcgatctcctgacctcagatgatccacctgtcttgggctcccaaagtgctgggattataggcgtgagtcaccacgcctgtcgggcttcttgtaaagggtcgtttaattatttttttgagctagggtcttgctctgttgcccaggctggagtgcagttgcgcaatcatggctcactacaacctcaacctcctaggctcaattgatccacctgcctcagcctctcaagtattttagttttctatttaaggaaggaaatcttgctattacttttctttgtacctgtgtttatataacttaattcataaaacacgggcttagcaacaaatagagattagatctgtgtcataggaaaatgacaaattattgcctatcttggacctgcgtggtgacttgcattcacaagaaaccatagatgctaaatccacaaatacctttatcttatggcatggcactaaagacttaaaggaaagcacttgatgaaagataatagaaaatgttcatggttgcaaaatcagatattttatagtcgttccgtttgagtacttcatgtgtaacaaaaacttacctgcaaaaatagtttataaaaggatgaaaactgcagagaaagcctttttatgacacagaagggag

SEQ ID NO: 206587 - DNA, 507 bp, Homo sapiens
catctagattatgcaatttgttggcatacaaatgttcataatactatcttaaaattctttttatttccgtagaatcagcaataatgtccccattttcacttctgattttagtaatttgactcttctctctctgtttcttcttacatgtaactaaagttttatcaattttgttgattttctgaagacccaacttttgatttcattgattttctctgtggtttttctattctctaatttttaatctctgctctaatgtttatgttttctgttacttgctttgggttctttttttctttttctgctttcttgagttgtaaagttaggttgttgccttgagatttttcttattttttattataagtatttatagctacaaatttccctctttgcactgctttcactgtatcttatatgtttttggtatgttgtatttttgttttcatttatctctaattattttctaattttcatcctgatttctgccttgatccattggttaagagagtg

SEQ ID NO: 206588 - DNA, 1285 bp, Homo sapiens
gagaaaaaaactgaagaaagagaaatcataagatacaacatataattagaacattaatagattttattgcagtttttaaaaaggtgggggtttttgtttgtttttgtttttgtttttgagacagagtttcgcccttattgcccagactggagtgcaatggcgcgatcttggctcactgcaacctccacctcctgggttcaagcaattctcctgcctcagcctccagagtagctgggattacaggcatgcgccaccatgccctgctaatttcgtacttttagtagagatggggtttctccatgttggttaggtggctggtcttgaactcctaacatcaggtgatctgtccacttcagcctcccaaagtcctgggattacaggcatcagccaccactccgggcacaataactcatctttaaagagctctgagagcaatatgggtggccaaagcactcaggtggaaccagaagtcatcactaagcaaccgtggctgctttgtttgtccctaacaatagccaagcagatgttgtagctcctctgtctcccaccctggccccatgacattgaggtggggtcgttccagctcagatgtaaaaaggcaagtgtataagtatttgggggtgtggcaggaggcagccgtgtcttgtgtatgaagggagtccctgcccacttctccccatttctggaggtaaagattcccatgaaaggtactaggagcattgggcccctaaaccccagaacccatgagtatgttattttagatggtgaaagggattttgcagatatgactaaggattttgaagtggggaagtcatgcaggattatcgacatggaccccatgtaatcacaagatccttctgagagggatacaggagagtcagggtcagtggcaggggatgtgctggcagaggcaagagactggggagatccgaagaaggggtctcgagccaagaaatgcaggcagtctcaaggagctggtaatggctgggcaatggattttcccctgggacagggatggagagacagcagtgatttcagttctcactcttgaaccttctctcttcttcgttcccaaacatgagtccaccagccccattaccactcaactgactgggagccacatcaaccataactcttatgatttaccagttgtaatacttaagcattttctgtggcctggcaatttatttatttattcatttatttttgagacggtctcaccctgtcactcaggctggagtgcagtggtgcagtcgtggcccaacgcagcctcgaactcctgggc

SEQ ID NO: 206589 - DNA, 551 bp, Homo sapiens
cctacttggcattgtgcctctttcttggttgtaggaggggccaaatgtagcaacttatccttcaccttagaaggaagatcttgactggcaccatgccactggacccctagaaattttactgaggtagaagttccctgaattttagttaaacttatttcccatcctctggcatgcaaatgtctcaccaataagtccagtgtgtttgaaagccaccattataggtataaagcagcttgtataatcagtgatgatcattgatgaattgtccatgtattcttttgaatttggaaagatagaatgatgttggctcacaatgtaaaatgtagcttgatcattttatttcctagaaatgataaaaagctgtgccatttctggaaattagaaaaataaaagattaatcataaaagttcaggatttttgtatttcagcctgttctcataagcacagaatgatgtgtgccctttcctattagattttccaagggtgtttctgatttgcaaagtaagaagaattgccttgtatctagctaattaacttggagtactaatgcc

SEQ ID NO: 206590 - DNA, 278 bp, Homo sapiens
aaacccagcttctcgcctccttatccccagaaaaaccttgaatcagtgggatcatgtactacaaatggtcacagaaaaaatcactctgaggagcggggctgttcacaggctttatactttagaaggaaaacttgttgagagtggagcagagttggagaatgggcagttttatgtggctgttggcagagataagtttaagaaactgccttacagtgagttactttttgacaagtcaacgatgagaaggccttttgggtaagtcttactccttaccactc

SEQ ID NO: 206591 - DNA, 410 bp, Homo sapiens
tcgagtccgtaccgtaatcgatcaactgacacacacccacacacacacacacacacacacacacacacatatatggtatcttcatcatgggatgttgcaaagatgcaatgagctaacatatttaaaatgcttatggccgggcctgggggctcatgcctgtagtctcagcactttggaaggcaggtggatcgcttgagcacaggagtttgagaccaagctgggcaacatggctatatttgtgtctcttgtgtagagacaacatttcgccgtgtcgcccaggagttgtctccaacttctgagctcaagcaaggtgcctgcctcagcctctcaaagtcgtggtaatacgggcgtgatcccaagtgcaagtgtccagcagatgcattcttatcacttaagttgcgtgacctaga

SEQ ID NO: 206592 - DNA, 317 bp, Homo sapiens
ggaagtataaatgataaagatttttagatctcagtactcagaattttatttaacactttcataaatcaactgaagggataatcctaaattcttggaaacattgaaatgccaaatcaagagaccacaggacaacttagggttaaacaaaatagttgaaaaaagtagctagttggtttggaacatggcctaaggaaaagtaatatttagataaacacattttttcttttttctctcctagctttaaagtataattaaagaactgtatgtatttacagtgtacaatgtgatgttttgatgtatgtatacatcatgaaatg

SEQ ID NO: 206593 - DNA, 481 bp, Homo sapiens
agattattaaggaaatctaagtgaaaggtgtatagtaacaaactttgtgtagggtcttattgttctaatcagtttcaacacttgctgagaccattttggaaatcgtgtagaaagtaaattatgctgttttagcaggggggaaagcctcactcttcactctaagtagcctagcattcaaaagaattcctttttcagggtgggcgctgtggctcacgcctgtaatcccgacactttgggaggccaaggcgggtgcatcacttgaggccaggagttctagaacagcctggccaatatggtgaaaccccgtctctactaaaaatacaaaaattagccgggggtggtggtgtgctcctgtaatcccagctacttgggagactgaggcacgagaatcacttaaacctgggaggcaaaggctgcagtgagccaagatcatgccactgcactccagcctgggcaatagagcaagattcagtctcaaaaa

SEQ ID NO: 206594 - DNA, 432 bp, Homo sapiens
gccagaaccttttagtcaaaggagcggcatacaactccatgttgtggctgattagggaaatctcacctaattagaagatatgtcctacttagaaataaaagtatgccaagagaaacttactctaagaatatgaggctgggtgcagtggctcacgtctgtaatctcaacattttgagaggtggaggcaggcagattgcttgagctcaggagttcgagaccagcctgggcaacataaggagacccccatctctacgaaaaatacaaaaaattatctgggtgtggtggtgtgtgcctgtggtcccaacaaccgtgctcccaacaggaggatcacctgtgtccaggaagttgaggctgcagtgagccgtgatcatgccactgaactctagtctgggtgacagcgtgaggccctgtctcaaaagtaaaaattcaaaa

SEQ ID NO: 206595 - DNA, 548 bp, Homo sapiens
atgggagacagatttcacattcacaatttagttcaggaaaatcactaaataagcaaaacaacaataacaacaaatcttgtggggaaagtcagatttcagagttgctaccgtatgttatgtaaaaggttcagtattcaacaaaaacatgagagacattcagagaagcaaaatgtgatctgtgtgtagtaaaaaagtggtcagtaggaactatctctgggtgtctgtcctcagaagtaggatttagcctaaagagtctacagagcagctatttaaatttattcagaaatcaaaaggaaaccatgtttaaagaattgaagcaaagactcggtgaatacagaatctcagtaaagagatataaattatttacagaaaggaaaagaaagaaccaaatggaaattctagaggtaaaaagtacaataactgaactgaaagtgctctagagggactcaacagatttgacgtggcagaagaaagaataagtgaacttataagttcttttataagtaccacttataagaaggtaaagcaaatgaaataattcaatctaa

SEQ ID NO: 206596 - DNA, 666 bp, Homo sapiens
taggaaggcctttgaaatgggaagaaggattaccactgagacaaattaaagggaaagagggatatgataaaggcaagcctttcagacttcacaattatatataggattggctccatttcgcttcagtttccatggccatgtaggccataagagggatatttatatccctgcacatactatctcagaagcatgaccattaagccatttggttactaatatgtctaacctcattttaaggcgtatctttcttagaaatgtcattgagatatcactgaacagaaaaatttcaaaagcataatatgtggtccatctcaaaatggccaaattaatctcttttattaagaagccagtgtttatgaaaaaaaatcctgccttaggaaccaggtgagctagttttcagacctaactctatttctaaacatggaatcttgagcagtttcttcaggccagagttttctcatccctccaaataaatgagggctctggctatggtgagtttctgctttaaaaattctgtgattctattcagtgttcaaatcagtttgtaaagtggataaataattaagtgttgattgtacgaataatctattagaatctgaaatacatgactacaaaaacaaatcatgtaaatagaatgtttaaaaataaaaatctcactgaaaacct

SEQ ID NO: 206597 - DNA, 124 bp, Homo sapiens
tgggcaaatccaccctggaggccccaattccagcttctcgtgtgacttttccacaattctctagctccacactgaggccccaaggcttatccccaccctccctgccctcccaggaatgaccaag

SEQ ID NO: 206598 - DNA, 348 bp, Homo sapiens
gtattttattgtgcattaattatacttcaattaaaaacaaccaggaatgtggacattcctcctcctgtctcacctttaacaacatgatcaacagctaacccatacagagcactaaccatgtgctaggcactattcgaagcactgatgtggattacacgcagttactccttacaacagcccttggtggagacagtatgattatctccactgcacagaggaggaaatcaaggcacagagaggtgaagccatctgcccacaggcacacagctagtatgtgggaaggtagagatttgaacccaggccacttggctctctaggacctatcaaatggcggcttcccatattgcc

SEQ ID NO: 206599 - DNA, 335 bp, Homo sapiens
tctctccctgggattgtggccaccgaggtactaccagaactatcgtttgaggtactaccagaactgtctgagacctgttctttttgctcctagaatgcattgtccatctttcctggtgtcacagatagcctgaagtctggcttggccccctgagcctggtattctctcttccaggcctcttgctatggaattactttatccctctggcaaagtcgtcaatctgtatcttaagttacctttcccgtactactttagagcacacagaagtttcctaaggtacatttcctaaatgtaccttcttccatggcacatgagaaataagggagatgccagag

SEQ ID NO: 206600 - DNA, 254 bp, Homo sapiens
tcatccccaataaaagccagtatccaatactaatgttgccagtggtgcaaactgatgctcgatgatggtagaagtgatgacctcaccagacccgttcaggagaagaggtcttgagcactgtttctgacttacgcttgattctttagccacctcaagtattttattagccaacgcattatctttttaatacattactttctctttaaagcagacagagttaatttcgaatgtttgaaagactcctggtattttca

SEQ ID NO: 206601 - DNA, 403 bp, Homo sapiens
tgcactcattcaagaagatagaattacaagagtagagagagcatgaatttgtggaggtgtctttggtgaaagtggtgcttgtatctcaagtcctccagagaaggaagagtgggaggggccaaacctcctttacctcaagcaaatgggttcagctctagccctggaagagcctgatataacctgtaatcccagcactttggcctaaaaaaatttccttattgggggaaaaaaaaaccagatcatcaaggacctgaggaacaataccaaaatgtctaatattcaggacattagagtcccagaaggtgaggagaaagagtgtactgaaatactgaaagaaatcatcgaagcaaaccctcacaagtttgacaaaagacataaaccaacagattcaagaagctcaagg

SEQ ID NO: 206602 - DNA, 400 bp, Homo sapiens
cagtgtaagttgaagaaggtaaaatctggatgtagtttctaaactctgcttggcagttttcatatttaagccactagaagaaaaaaattgggagggaagctgagaagaatttactgaaagaaaaaaatacttgggagggaaattggcaagaagtatgaaaaagcttgggagggaagtaagcaaataaatgagttaatgactgttctggaaaataaactctatcatgcagatatcacatgactgattaaatttgaatttgacctcctgctttccaggtctggtaaaaactaacctgtaagaacttgaaacttagcctttgaatggtcaatccaccactgtaggagaatttatgaatgttcagttgagagaactgaaaataaagaagtaccataggaattaa

SEQ ID NO: 206603 - DNA, 359 bp, Homo sapiens
ctaagagcttgatggagatgctcaaggagattaaagttgaaccactgtaggtgccatgaaggacattcacagtttttgggaggaggtaaaatatcaacattaacagaagtttggaagaagttgattcaaacacaattaagtatttttaatgaaattatgcacattattttcttagacaaaatgctactgcacacttactagactatagtatagtataaacataacttttatatgcactagaaaatttaaaaatttgtgtgactgtctttgtggtggtctggaactgaacccacagtatctccgaggtatgcctgtattcttgttcttgtctaacttctatacaatatcctcagagatct

SEQ ID NO: 206604 - DNA, 236 bp, Homo sapiens
tatattaagtgatgagtttttattccattaagtagctttttattgtcttgtatttctgataaatttaaaattgacatagaagtaataaatctttgagatggtgcttaccaaaatatgattttcctcatcccttacagtaatccttatttggaatctaggatgggcctaaggtatctaggtttgaaaatcaccactttagagtactagaatggaatcctaaacaatctcagatttaa

SEQ ID NO: 206605 - DNA, 221 bp, Homo sapiens
aagcatagagctaggcagtaacatatttgaagagaaaaacaagaacactgaagtttacagagtgctgataagtgatctccagattatatggtcttagactcgatttttcttaatttaaaattgaatttacacctcactttatttgaaaagttatgtgtcatgcacgaatgaaataatgtgcagacagagttcactttatatcattagtggtgtcttggaaa

SEQ ID NO: 206606 - DNA, 591 bp, Homo sapiens
ccccatttttcttgtcctaaaacgagacaagccttacaagttagttcaggatctgcgccttatcaaccaaattgttttgcctatccaccccgtggtgccaaacccatatactctcctatcctcaatacctccctctactacccattattctgttctggatctcagacatgctttctttactattgctttgcacccttcatcccagcctctctttgccttcacttagactgaccctgacacccattaggctcaacaaattacctgggctgcactgccacaaggcttcacagacagcccccattacttcagtgaagcccaaatttcatcctcatctgttagtcatactcccgttcaccgttctcaactactcatacatgccctgctcttctttacactgccggtttacactgtttctccaagacatcacagctgatatctcctggtgctatccccaaactggccactctaaactcttgaagtaaataaataatctttgctggcaggactctgctgaatctccttaggcactctctaatcagatatcctgagtcgtcccaattcttagaccttttatacctgtttttctccttc

SEQ ID NO: 206607 - DNA, 217 bp, Homo sapiens
gagatgtggatgagcaccattgacttagcaatggatatgcggggtgattaatgtagctggtatttgtgttaacccggaactggagcagaaattttcaatgcagtttaatagaattgcttatgaattgaagaaattatgaatcattagttattcagcattctcttatgcagggggcagggatgtggtttctctgaaggcgttcagctttaagttggag

SEQ ID NO: 206608 - DNA, 389 bp, Homo sapiens
caaatattgatggagcacctcctcggtgccaggcgctgctgcagcctctaggaaatcaaccgtggaaacacacggaccctgccctcccggcgccagtgttctggtggtcaggaggtgaagaaaaccagcaagaaccagcacaggaatccgacggtggcagcgccgagagaaacaagcttggaggggaaggagagctacagaggctgcatggatgtgatggttggagtggaagctgacattgtgggccaggagaccctgggagtataggccaagatgaaaagagcctcaatccagagcgttctgtgaagcagtcaccacggccaccctgggccatcagcttctggacttttacaacatagaaattaaatttccattgaatttgttggagt

SEQ ID NO: 206609 - DNA, 239 bp, Homo sapiens
gaagttcaaagaaggagataagtctaatagtctgtattaaactgacacaataaaaacaaagggaaacttgtattgattgattgagtgattatcaacaggcccattaggctagtgtcttcccaagaacctgacatttaaaatcaaaaacaggacaggcctaattttaaattctgcaatgagggaatttaatttaaatgtgagtgagaacagaggtgcatatatcaacccaatttagtaca

SEQ ID NO: 206610 - DNA, 290 bp, Homo sapiens
tcaaggagaggcagctgtcagttcttcctgaggttagatgtccaaattaagcagactctttgtgcttcagtgatactaccttctactctagaattttgtaaaaatacgtatgcgaacctttttggggctccaggcagtgcttggtgtccaggcgaaaatgtgtgaataagcaagcactcgtgtgtgttgggaaaacaaattatccctaaatgctgtcattttctcttaacaccagctgcgatgatgtggaattgaggtacaattaaaacccatgaaatgttctgcaagtt

SEQ ID NO: 206611 - DNA, 133 bp, Homo sapiens
aatcttctcactatctctcaataaagttgttggcattgggccaaagggattcataaaagcaactcacagagggccaaggaacaccagtatggtttcaggcatgtggttctttgaggatctggctgagtatagg

SEQ ID NO: 206612 - DNA, 181 bp, Homo sapiens
gtttctgtgacaacccataccatttcccccaacagaatacatctcacctttattaaaataactgctttgtcttccccactaaagagtatgttctatggagctaggaagcacgtgctcctgtaagtccagggcttggtatgatgcctggcacatcacaggtctcaataaatactgatcaaat

SEQ ID NO: 206613 - DNA, 481 bp, Homo sapiens
cacaccacctgagtctggagtttgagagcagcatgaccaacatggagaaaccccgtctctactaaaaatacaaaattagccaggtgtggtggcgcatgcctgtaatcccagctactcgggaggctgaggcaggatctggtgaaagtttggaggtggatggaggtgagggtaccttctagggctctgacttggtggaatggatggggctctttatggagttcaggatcttaggaggggagagaggagaaggcagggaattcttttctgcttgtttagttgcaagtgttttgttgacagtacggtacaccaaacataaggtcgggggtgagaatagagggagagagacttgagaggcttcagaaatgcacggtgcttctaatcatgaggtcacccaacgagaggctggggagagaggcgcagtaagccagggtggagcgctggagaagccgatgtttaggaggcaggtgggcaggaagaagct

SEQ ID NO: 206614 - DNA, 465 bp, Homo sapiens
tgaaccaaaggcaaccagttaattttgaggtgatcattgagcacatacttgccctcaggtctgtcccaggctgggaattatgggaaatacagagtatctgtaataccaaaatgtaagttctgtgagagcaggggtagtgttggttttacttactgtgaatctgtattaaccaaaacagtgcctggcatataccaggtactcaataggtagttgaatcaataagtaaaacatgccgtcagatattatacagtctttttgtggatcaagtctaacagctatttaaaaatgagcaaccactataaagtaatattaattcacatgtgttttcttattgtaactgacactgcaatagaagtttactgcaggagatagtgagggcagcttcaatcaaagaaagttatataggggtgttgggcatggtggctcacacctgtaatcccagcactttgggaggctgagatgggc

SEQ ID NO: 206615 - DNA, 559 bp, Homo sapiens
aaagagctgtcagccagttactacagacactcaatgcagacaccttcagagtattgggaaaagacttgccttctgccagaacttaacccaaatacacacagagagcaccatgaagccctggattcttctactcgtcatgttcatctctggagttgtgatgcttctgcctgtgctgggaagcttctggaacaaagatccctttctagatatgataagagaaactgagcagtgctgggtacagcctccatataagtactgtgagaaaaggtgtactaaaataatgacttgtgtacgtccaaatcatacatgctgctggacctactgtggaaacatctgcttagacaacgaagagccccttaaatcaatgctaaacccctagattctattggccgatcactactgtgggctgaaggatgaccatctggtctaagaagagtgctgcctacttccttcttgggacacccactggctctagctggtaacctttctgctatttccttgacctctttaccctgaagcttttgtcaaataaactgctacatcaacctgaaaaaatgca

SEQ ID NO: 206616 - DNA, 573 bp, Homo sapiens
ggctcaaacctatcacagaatgtgcagggacccatcaaaaaccatactggaaacactgccctttgagaagttgttggaagaataggatcataatatttccaaatttcaaggcagaaaatgaagacaagagagatgacttctttctcccaaggccacatattaatctccaaggccacataataatctatgggctatacttttgctccctgcatctctttcctgtgttccaggcatcttgaggctcccagaggtcatgacacttacttagagccagataggactgtgccctccagatgacactggaccatcttgctccttttgagtgagctggtctcaggagagagtttactaaattgagccccattttagttctcaagtgaggctttttgcagttgaatcaagggtgaagggttttcagccacaagtaggtatgtttgctcctctgttgtaaaagcccatgattgttttttacaatgtagagtttgttacccaacaagtacagtagcccagccctgcaatctgaatcctcacatcctgcgtgttgtaaaataggaaaccaaatacaggggaact

SEQ ID NO: 206617 - DNA, 473 bp, Homo sapiens
ggctggggggagagggaattagtgtttagtagatatagtttcagtttgggaaaatgaaatacttctagagatctgttgcttaacaatgtaaatatatttaacactaccgaactctacacttaatggctaagacagtaaatttaatgttgtatttttttacaacaaaaaaaattgaacatgtgaaatgtagatgactttgtctaatattatttgtaattttctctaggaagaacatagaaatactgtaaaataagtgtgatgaatgtgtgacaatactcttttttctaaatatcatatgacaactattgaggaaagaaaaagatataccattctatttaaagtcaggaaaagccttaagggatacacattatttatagaatacaatggaagtcatttgcagatatttcaaatcaactgccaattataatatcaaacaacttataaaacctagggcatggtgccataggcctgtc

SEQ ID NO: 206618 - DNA, 470 bp, Homo sapiens
tcactagtgtcccggcagtagcatttcttgagcgctcgctctgtgccaggtgctggcccaagcccttcgtgtgcatccttttgacaaagcagtgctgtgagcacagggctcttaaccccattttacagatgaggagactgagagaggcaggcatccagacaagattgcatgcttgacgcctcctccaggcagatgcaggctccaggagcttgagcatagccatggtatgtggctggtatgtcaggtggagctggagtcttttgtggggactgttgctggaggtgggaggggcagggactgggattggagaatgcagaaagcagaaagggaccagatgaggtggctcaatgcctgtcatcccagtactttgggaggtcgaggccagaggatcagttgagcccaggagtttgagaccaacctgggcaacagggtgaaaccccatctctacaaataataaaaaattattcaga

SEQ ID NO: 206619 - DNA, 497 bp, Homo sapiens
agcagttaccatatggcccagcagtttcattcctagagagattatacacacacgagagaacagaaaacatatggccacacaaacatttatacacaaatgttcgtatcagtgttacagtagctaagcagtgaaaacaagtgtccatccactgatgaatggataggcaaaatgtgatatgtccatatgagggaacatcattcagcaataaaaagtaatgaacaggctgggcctacgtggtggctcacgcctgtaatcccagcactttgggaggccaaggcaggtagatgacttgagttccagaccagcagcctgcccaacatggtgaaacccccaactctaccaaaaatagaaaaatgaagtgtggtgctacatgcttgctatcccagctacttcggagggtaaggcaggaggatcacttgaacccaggcagcagaggttgcagtgagctgagactgcaccaccgcgctccagcctgggcgacagagggagaccatctc

SEQ ID NO: 206620 - DNA, 1393 bp, Homo sapiens
cgtggtggtgggtgcctgtaatcccagctgctcaggaggctgaggcaggagaattgcttgaacccggcaggcggaggttgcagtgagccgagattgcgcactgcactccagcctgggcaacaagagcaaaactccatctcaaaaaaagtgtgaatgtcatgatttagtaagaactgtttaatgtattaatatttatatttcataatctgtaatcatggagtaaaagccaagcaggctgcatcacttgccctgcagtctcctagcacatgaactaatgggcaggcaggagggtgtgcatcatccaccttgcttaccgctgacctccagcacccagacaatccctggcactcagcacaagtaactgctcaataaccagaaacatcaagtgcttgccggaaaaactccatgatgagggagagggaagattacacagaccaaatttaagaatctctgccttaggaactcaggggctatcctgcctgaaccatcgataggggatattttcaagtcacctcaaccactgttgactcactccaggtggacccaccactggcaccttctagtaccacagctcagccttgagtatgtgcttgaactttcgttcgcacttcacattttccacacacaaatataatgtgccaaaatgagccagtcctgctcccaaaaccctgctcacaaaatggaggacgtgagggtgtggacgcatagaatgaatgaaatgaaagatgtcagacaaagcaaattccaaagagaagtgggaaattttctagcctccaagaacagaggacaaaactattaaacatgatacttatctaggtcactagagttcactctaggacacattgttttggaaagaaaagcccttcaccattccccagattaaagcaaattcactaatctgtgttcttactacacaggggcctggctttctcaagtctgggaccctgctgggactcttatttccgacgtcctattgggaggagccctcacatccatcctcctggagatgcccaatgcccccaagtctggtctagatccacccttgcattccaggcttgcacatccaaccgcttcaatgacagcatccatgaggatgtcgacaagctccacatggtcaaggaactaaagtgaccccattttctctaaaacctgtcaaaacagggtgacaacagccctactgagtgttccaagcccccttcaaaggcccacttaccacaggggacagtggctaccaggctggataacccagctgcagaacagtcccaacactgcagaaagtccccctggacagcactgctttggaaattgggtaatacactgtaaaataagtaaggtctagaccagaccttggaagatggaggaaatggagtttggggggatgtctggaagaaga

SEQ ID NO: 206621 - DNA, 384 bp, Homo sapiens
ctcccccacccccacaaaaaaagagttagtataaatacatgtactttgggccaggcatggtggctcatgcttgtaatcccagtgccctgggaggctaaggcaggaggattgcttgaacccaggagtttgggaccagcctgggcaacacggtaagacctcgcctctttaaaaaaaaaaaaaaaaagctttgaggcaggaaaggaaagtgttggggaattggagtggagtaagcaaagagagagtagtagatctcatgagagaagtaggggagtgtaggtcttgtaggaccttgtaagccatggtttgggccttgggttttactgaaaaggagctatgaagccacgagtgggttttgaacaaaggactcatatgacctgagtttgg

SEQ ID NO: 206622 - DNA, 574 bp, Homo sapiens
actaaagaagagatgattcaaagaattaatagtaagtagctttgcatgatcaagatattttagtcttttaattccttatggcatataacatacaattgctctgtttagggcaacttattgttggcgttataacttttgtgtcagttctctctagcgacaaataaactatttaccctagacgaaatagatgtgacttaactatagttgtttgataataaacttctatattcagcatttaattattttatgaagaattttgtcttaagtagaaatgaccccttaggtgcagtggaaaagatgttatttttctctaataacaagttatttcaaatagttgagtgaaattttttttatctttatagaaaccaccagaaatcagggatcaaaatcgatagatgccacattttcaggaataataattctgaaaaataatgttatcagagaaatagcaaggcaaatcacacaaatactgtatagtattttaagatccaacaaaacaactataaaaaatagagttctaaatttcttcatcgttctgaaaaggtagagtttggttatattttctgcaatcaaa

SEQ ID NO: 206623 - DNA, 235 bp, Homo sapiens
aaaagttggtttaatgtggatctcaaagagtttaaagttttccatttaaagatcaaattccttccaatttctgccactttttatttttctccaatgatttcagtgttgttttctttttcatcttaactaaaatttttgtggaaagtttagtctcatacaagctagtccattgttactgaaagtggtacttcttaattatctactttagtctttcaccagaaccatggtaatgtcc

SEQ ID NO: 206624 - DNA, 207 bp, Homo sapiens
ggcggccggcttgaactccgtgcacgcgggcctggagctgcgcccctgcgtcttttcccgacttctgatccgcagaggggcactcggagccccagcctgggtcgcagtgccttcggtctgcgggcctcagtttctcggtccgcgccgggggtttgtgggggcacctggagacatttgggccgttctcgcagtctcgggaagccgcgc

SEQ ID NO: 206625 - DNA, 626 bp, Homo sapiens
atgttttctccagaaacagaggaccccagctcatcagggcattcttgggatgccaagactcaagaccccatgtggtcgcctatctccttcctctgctccctggtttcacctgcgtctcacacaaaaccagaaacgcctcaagcagaaacagagtctgtgaccgaatcatcaattctggtttttttttgttggttttttttttttcctcttggaacagattcgggaggaatctaagtatcattgtaaaattcacaaaatgccaaatccactgagtgagcaacagatgagggaaattgctccacatcccgtggagaggaaatgaacgggactggggaggaagaatgtgctgcgtggtgggaacactgttttgattcctgatgctgcacatctgccacgtttctgcacagagctaccagcccgggcagacactgaggaccctcctcgcgcactggagctgtggcctcggcagctgtgggaatgcggacaggaagcaggggaccctggaggcgagaggaggaggacatcctgcggggatagataaaaaataacggccgggctgtgggaacctcttccgagcaaacatgtgagcccaggaatttcctgagccagagatctgactccggtta

SEQ ID NO: 206626 - DNA, 553 bp, Homo sapiens
ctgtggccttcgcagtgtcctgaagacactagccaagactgtaggaatcaatcacacctcagctctccagcaatagtgttgattcttcatgctgctaaatgaaattaagcattttgtttttggatgttttttctgtccggggcagcatgagaatgaaggcttgaattaaagatttgatgttgcattgttaagtttatgcagaggaaaatacttattaaaatattagattttgcctcatctcagaataaaattccactagaaaaatgaggtgtagttcagctttttaaaataaagttcttgaatgattggttgagccagaaggggagcagcattatgatttaaagttagtaagtatggaatggagaagtaatttagcagtcatgtggcaaatgtcaggagattggatcaaaataaatgtagataaatgtcttatttattctagctacaaattggccagaagcgttttctgtctgactccaaggacacagaagggctatcttttctagtgaccatagttgtacatttttagtcttttgttttcaaattgtcatag

SEQ ID NO: 206627 - DNA, 515 bp, Homo sapiens
gaaaccccatctttacgaaaaatacaaaacttagcctggcgtgatggcgcatgcctgcagtcctagctacctgggaagctgaggcacaagaatcgcttcaacctggggggtggaaattgtaataagccgggattgcatcactgcactccagcctgggcgacagagcaagactctgtcgatagatagatagatagatagatagatggatggatggatggatggatggatggatggatggatggatagatagataaagatatagagagatagatagcaaagagtttacttagataaaattgggtgttgataactaagtccctgcacagttacagcccatctgtatggcttgggtgagagtcatttcgtagacccctcacgtactctgtatcctcacctcattccatctgatcagcaagtgtcctctttattgatatggggagagaataagaaaagaacacctttcctaggtacatttctcctttcaaatatttgtgttgatcctctcatcacaaaca

SEQ ID NO: 206628 - DNA, 513 bp, Homo sapiens
ttatcaaataagtttcaatactgaaattagcaagtatatagttaagatatgggaagaaaaaaatgtcagtcaggaatttcctgtaaacagttcccagaacaaagacaaactcttcaagtgtcacaattaaatgggtgcaaaaatcagtacaacatagtaaagttttatatgttaaatatgcccatttattttactttgcaagcatagcagttttattattttggtcttataatgtttcgtctatgaaacgatatagtcagcagactataggaggtttatttaaatgtttttatttaaataagtcaatattcataccttttaaacataaaattttattggtaaataaatttcataaatctgtataaccctgaacattcacctgaaattaattttcaaggatattaaaagttagaaactgttgaaacataccggacaaagctatctttaagagtaaatttttaaaaattctattactttttcaaatggattggttaaataaaagcaatttttaag

SEQ ID NO: 206629 - DNA, 335 bp, Homo sapiens
agaggcatgtacttgtgttctcagctactgggaaagctgaggtgggaggatctcttccacccagaagtttgaaaccagcctgggcaacgtagtgagacctccatcttaaaaaataattaaaaatacaatgaagagaatacctccatgttcaactttatgttcttctggatgtatgataatgcgggaattttaaggggtagtagttactcattgaagctttgttgccatttaagtttttacctttgctgtgggaatggtactcttagaacatgcacattattttgaaaaggaagtataaactagtgaatatcaaaggggaaaaattttgttaacca

SEQ ID NO: 206630 - DNA, 284 bp, Homo sapiens
tgacccagaggatccggctatacattacctgggcaacgtagtgagacctccatcttaaaaaataattaaaaatacaatgaagagaatacctccatgttcaactttatgttcttctggatgtatgataatgcgggaattttaaggggtagtagttactcattgaagctttgttgccatttaagtttttacctttgctgtgggaatggtactcttagaacatgcacattattttgaaaaggaagtataaactagtgaatatcaaaggggaaaaattttgttaacca

SEQ ID NO: 206631 - DNA, 504 bp, Homo sapiens
ctgcttgtgcttttggtgtcatagctaagaaaccatgacctaattcacagtcacagagatttacatttatgtttaattctaagagttttacagttttagctcttaaagttaggtctttgatccattttgagttaatttttatatatggtgtgaggtaggggtccagctccattcttttgtctgtgaatatccagttgtctgagaaccaattgttgaaaagactcctgctttccccattcaatcatcttggtttcatttgtattttagtaacattttctgttttgaaagatactctggtttatagagagataacatctgtgaggtcacaccgtggcataagatgctggcaaaatttaccctagactcctcagtaactggcactgggccaattggatatccacatgtaaaaaaaaaaaaatgaatttcaatgcttactgtacaccatatacgaaaatttactctaatgaatcatacatagaaatgtaaggggctgggcgcagtggt

SEQ ID NO: 206632 - DNA, 221 bp, Homo sapiens
caaagaggtgtaccatattattttaatcaattttcccagcttgtctccctaccaggaatagaaatacccatgtttctcaacaattttgctaggtgacctgatgcactgaatgcaacactaagaaaatctttcttatgtgtgggatatcttcttccaccgtttttggcacaccccaggttgtcgcagcgttctgatttttaacatgcatcactcacatgtaa

SEQ ID NO: 206633 - DNA, 138 bp, Homo sapiens
aggataaggggggctggccggggagctgccggtgttgccatcctgtaagggatgctaaagtatcaatgagcacttaggcatctctgaaaccatagtgatatggagaaagttgtgtttgccggaactcctgcagagcac

SEQ ID NO: 206634 - DNA, 747 bp, Homo sapiens
tttctcttggctcataaaatatgggggtagcaggaggaaagggaagagtatattaagagcctatatctgagaggtacgttcagtttttcctcaaaagtatctggtggttggactagtaatttattcatttattgagaacctattaaattacagaaaatacttagtaaagagcggtgagaaagatagaaactatccctgtcctttacctggattgaaatctaaagtggatatttgtacaataaactcacaaactaaagaaagaaacgtaagtctgaaggtcacgtttttcttttaaccggcttttgatgggactgaatttaaattgccaaaaggtgaattaacataatcttgaaaacttgcaagttcctggaggcagttctggagggagggtggagcaaaagagatggcagaagaagaggagccagcagcactggaattcaaaagtagacattcttgcctcctccctagtggacagggaggaggggtggggagagcacaagagagccgtgacagaggaagggagagagcacagagtttaagtctatattgatggaactatggttacaaataggggctacccatttatattctcatctggccatgtctcatcagtgatttacaaggatttcatagaagtgctttaataaaatgtacaacctcactgaaatatagaaagtaatactataagacagcaaatattgtatatttatgcaaataattttttaataaaaggtttttttaatgtcc

SEQ ID NO: 206635 - DNA, 486 bp, Homo sapiens
ggatgattcttagtaattgactaaaaactgttttgtctctcatttgtttgtggtttttgcactttattatggacctgtaaaggaataggttaattcttacattgtgtacttggctaatgtcctaaatgcaggcatcttttgtgggtactgttgcccatgaataaacatatgttccctaatcaggtccttatatttttccattaactatacatgaagaaaatatattatgttacaaatgatgcatcatatatatatatatatatatatatatatcttatagattacatattatatactgcacattattcatttaagaagtcattcttgaggccctacctcaaattttctatttatgtataaaaatgcaatttattgtattatatatttgcctattatgtactgatataaattagaatttaccctaataatgtatgagttcacaaaaccctaaataaatgtcagtgtttaaaacatgattatagtatt

SEQ ID NO: 206636 - DNA, 555 bp, Homo sapiens
atgtttttatttgtacatcttcccactagactgtaagctccctgagggcatgtgaatcttactatatttatctttggctgcttcaaggttcagactatgatgcaatctagcctcacctttcaccattttcccataaatatgatctatgtaccaaatacttcaatactgcattccctgaatatactatgctattccatacttctctcccttttatatatgataatcctgctgctttacttcctcatgtatctggtgacctctcacctaaatttcaagattcagcttcatttctaaacacatgccaaaattcacttctatttttaggtaactactggttatttttaatcctgaaataaaatgaaagctgatgcccttaaaataaatatacatttagttgaaaagcacagagttaagtcttcttttaaaaatgcaacatataaaatctttgttttagcaaacattgaaattgatgttcagctatgaaaatggtaattctctctagccaaaacttatacctgaaactcttaccaactgcttcaggagattcactatcac

SEQ ID NO: 206637 - DNA, 362 bp, Homo sapiens
tcggaaatgaggcaggtttttttgtaaaatggtggcagaataaaaatgtgtttatttcaatccctttcttgaaacctacttcacaaatacatgtaaattaatgaaaaaaaaatggacacaaattataacagccccactaggaaatgcagttcgaaaatgtagtgactgacatagctatcaagttcagtggaatttagtccatattgagggaggacattgggagctgaaacagttttccagatctctacctgtttgtatatatctctgaaaatgcatatattctccactcaaacattcaattcaattggtagtttttggtaaatattgaagaagtttacattatttttgggaacttagaatct

SEQ ID NO: 206638 - DNA, 452 bp, Homo sapiens
cctcttccttctcatgattggaagtctgaaggcatgatggatctcagacatcaataatgtcatcaggaccctgtttcctttcatgtttccgttctggtatcctcaacattgactttatcttaaagttggtttctcttaagatcacaagatgcctgctatagttccatgcatcaattccaggcatgataatattcaaaagaagaactctgggaggccgaggcgggtggatcacgaggtcaggagatggagaccagactggctaacacagtgaaaccccgtctctactaaaaatacaaaaaaaattagctgggcgtggtggcgggcacctgtagtcccagctactcgggaggctgaggcaggagagtggcatgaacctgggaggcagagcttgcagtgagctgagattgcaccactgcactccagcctgggtgacagagcgagactccgtctta

SEQ ID NO: 206639 - DNA, 300 bp, Homo sapiens
agcctcccacctcagcatctccagtagttggaactagagacagacaacaccatgaccaattttgaaaatgttttgtagaaatgaggtctcactgtatttcccaggctggtctggaactcctaggctcatccagttctcctgcttctgtctcccaaagtgctgggattacagatgtgagccacgacatccagcccaaggttcattttaaagctatgagttgatttttgataattgaattatttgctcatagttcttttaaaatctgaatgataatgcaattgtttgctttattatcttgtg

SEQ ID NO: 206640 - DNA, 582 bp, Homo sapiens
taggggttgttcaaggaccaaagggtagaagttacagagaagcacagttcatgatgaggaagaatgttctatcttttggaaaagtaaagccacagaacagcctgttttgcaaagctgtgcattttctattggaagcaaggtcagggacatcatagcaggggctccctcaaggaaggcacatttgattaagtaattgccgtaaggcccttcacttctgagagtttgccaagtgcagtaagaatttaaacagccacattgtttgcacatcactgcttgagggggaaagaatagcaaccataagtattaaagtcaaggacagaacagtatcagacagcagtgaggatgaaatacctctgaaaaatgagatttaatttacaaaaatatgatttatgctcttttctaaaaatatgtctacttcgttaaaaaaagaaaaagaaaatagaacaggagaaaaataaaggacacaacctagactcctagaagactcttctaagaggagctgagtgttgtcgcagcatcggacatttccagagtgcctgccactcaccagggacgtgagccatgcttgctaccctcatttcc

SEQ ID NO: 206641 - DNA, 396 bp, Homo sapiens
tcatactgaagctcctcattcaaagcaaaagattgttaaggtcctcatcaagccatttcaatcaatgtataaattgtattttatgttataatgaacagtctgttcaattgaagtttttagctttttaaaagtgcttagaagaatagtaacagaagtgctcttaatggtgaaattattgaactgaagtgcttggataagctgttttatttcttaaatgaaaggagatattttagatggagaaatgagataaatattcctcaaaggagactggtggtaaagagtgactgctctccatggattactgattataacacaagtgtccatcaagagcagcttttattgaagacagtttaattggaccactgccctttagctttaaattacccacggcaaact

SEQ ID NO: 206642 - DNA, 221 bp, Homo sapiens
acccaaagtcactgttttagtacattcaccactttacacattgagttaccagctaagattttagaattacatcactaggtagaatatattaaagatgatccctcagaaaaagaataaaattcctgcagcaactttaaaccaggtgtaggaaggggaatactttcatcaatacagagccactatgtgaaagccctgccttgggagaatcgtaccaaattcaa

SEQ ID NO: 206643 - DNA, 439 bp, Homo sapiens
taggaagtgcctaacccatactatgtgctcagtaaatataattatttcattaggaaagttaatcctgaactatgtgaaatttaaattggaatgtattctttaaacattaaatgtgaccatcctgaaagaaattctcctttcttgatagtttcaaggaatagtcagaatgctgccaagctccttgaaaccatgtagtgagaaatgtagagagaattaagggtgaggggagattttttttgctttgaaaatgtagtcatgcttattaaagaaaatttgagaagtttagaaaagtataaagatgacaaaaattgctcatattcctgctacctcagtgctaaccatgtaagcattttagttaatttcttctagtcattttccccttggacattaattttttcaatgtacagacatacgtgattataacacatatacagaacta

SEQ ID NO: 206644 - DNA, 394 bp, Homo sapiens
gtgggtgaaaaactgattagttaaggtgaataatttactaccattaaatgtattattaaatatttgtaaaattttaatatcatacacattttctagcagaatttttaaaatttgtaagtagcatgctttaataactgcaattattatttgtttatcttaccttgaaattatatatgtgaaaaacaaagcaatagaaaatgccattttacaatgtagctttgactttacataattatctaggcttcatatacttagattaaaaaaataagatacttttatatattcaccaattgaagttactaagaagcattttatatgtttatatgcatgtttagatagttttcatgggtgtgtgctgtatttcatggcaagcaactcctccttgggtgcttac

SEQ ID NO: 206645 - DNA, 403 bp, Homo sapiens
tgtgagttgaatctacatatcacaaaaaagtttctgagaatgcctctatctactttttatgtgaagatattccggtttccaacgaaggcctcaaagcgctccaaatatctacttgcagattctagaaaaagagtgtttcaaaactgctctattaaaggaagcttcaactctgtgagttgaattcacacatcacaacgaactttctgacaatgcttctatctaggttttatgtgaagatattactgtttcctatgaaggcttcaaagtggtccgaatatccactttcaggttctacaaaaaaggttttaaaaactgctctatgaagaggtatgttcaactctgtgagtcgaatgaaaacatcacaatttagtttctgagaatgcttctgtctagtttttagggg

SEQ ID NO: 206646 - DNA, 784 bp, Homo sapiens
caaattgagatcacaatgtgatatcactatacatctatcagaatggccaaaataaaaaccaacaccagatgccagcaagaatgctgagaaaccagatgactcaaacattgctggagggaaagtaaaatggtaccaccagtctggaaaacagtttggcaatttcttataaagctaaacatgctactaccatacctcccagcaattattctgttgagcatttgtcccagaaaaatgaaaactatgttcacacaaaaacctgtatgtgaatgttcatagtggcttgattctatagccaaaaactggaaatgactcaggtgtccttcagcagataagtagttaaacagattgtgctacatccatactgtggagtactactcagcaaaaagaagcaacaaacttgatacacaccacaacttggatggatcttaagagcagtatgctgagtgaaaaaagcctatctatctcaaaagtttatatactgtatggttccatttctataacattctcaaaatgaccaaattttagagaaggataacagatgaatggttgttgggacttagggatggtgaaggaggagggatgggaatgactgtaaaggaggtagaggagggaaatctttgtggtgataaaatagtttcgcatcttgattgtggttgaggttacatgaatctacacttgcgattaaatggcctagaattatacacttatacacacacaaatgagtgcttgtaaaactagtgacatattaataagatctgtgaattgtaccaatgtcaatttcctg

SEQ ID NO: 206647 - DNA, 290 bp, Homo sapiens
tccaataatgctccgtgagcatcctcacgcctgcctccttagccaggttcttggggatgtggaagggaagcccacttcacactgtggccccccctcatccctccctgctccatctccctcccttcatacactcagcactgaagacaaaccatgcacccactgctcctccagcagggtccctgctcgcaatctctgccttttctttttaaaaattatacatttttttttttgagatggagtctcgctctgtcacccaggctgcagtgcaatggcacaatctcggctcactg

SEQ ID NO: 206648 - DNA, 464 bp, Homo sapiens
tctagaagtcagaagtttgacatgggctaaagtcaagatgtcaatagaattgtgtttcttctagaggctcaaggggaaaatatgtttgcttgcctgttccagcttctagatgctgcctgcatttcttggctcctggccccccctcctctgttttcaaagctaagagagaggagtcaagtccttctcaaatctaatcattctgacactttgccattctgcatccctcttccaattttaaggaccttgtgattacatcaggcccacctgaagaatcatgcaataatctcccaattttaatatcaatgttaattctatctgcaactttaattccccttttctttgtaatgtaacatattcacaggttccaggggttaggatgtgtacatctatgagggactattattctgccttccacaattggcccttctattactggcatacaactattaaagattttacttcat

SEQ ID NO: 206649 - DNA, 118 bp, Homo sapiens
gtaacattaatacaagtgctaatttttctcctaactagttatattcttcaatctgtccttaaaaaataattcaaacaattggtcattattttagcttaactagcttttaaatcagtta

SEQ ID NO: 206650 - DNA, 578 bp, Homo sapiens
aacttctgagtcttgggcaaggaggggccttctcaccaaccagtgtctgatattctaggtagcaaatattccttacctactagggaggacactcctatactaatgtcttactaattaaatgttactgcagctggtgggggacagggtattctaaaatgttgggttaaaaccttgaagttgtagttatacaccactgatgcggtatgcttcttgtcccacactgcaaatgacagtgtctctaagcagagaaacctaaaataagggcaactgctgtattctatgagtctcgaaagccacattttatcctgagaaggaagaaaatagtttgaaacatcaaccaccacagtgcttgaagtctgtttcttatcatgtcatcttattttgtctgtagaaaacagagacattctatttctcttaaaactgcttttaaagggaagggataatctgcggtttttgttttggtttttaatggctggctccttgctttaaatcgttgaatgaggaaacatatttgaactcgtaagttttgcaatgtgaaatgaacatgggttcattattccatctggaggttatttctt

SEQ ID NO: 206651 - DNA, 266 bp, Homo sapiens
aagaaaagtgtttccagatggaaggtctgaaattcaagaaaataggaaaatcaaagatattggtaaataagtacagaaatcttgtttagaaagagtacaataataataaaataatacttgtggggttaaaaaagagaattaaaatatattattacaaaccagcctgggcaacatagtgagaccccacctttaccaaaaaaatatttttttaattagttgaggcctaggcatggtggttcatgcctgtaatcacaacactttgggag

SEQ ID NO: 206652 - DNA, 144 bp, Homo sapiens
aagccttcatacgactgcaatttggctaacagcctgagagcaacttcatacaagaccctaagccagaaccacacagctaagcagctcccaaatccctgatcaacagaaactatcagtaattaaatgtttattgtttaaaaccag

SEQ ID NO: 206653 - DNA, 328 bp, Homo sapiens
atgtaattgttcaattgtgtgagtgttttaatccttctgcaattatcatctcgaaggagactttgaaagcatcttaatctctctttaaccattttttttttctttttcctaccacattcaggtttcccaactacatgctctggccaactgggccaccatgatctcttccacttaaatcctcagccttcaataactgctgtttacaaaaagatcttatggaatatggatcactttacagtaaagccaaaagtacttgtgaaatttcacattttaatggagctgtttcattgatatttttttccaccaaacaaatctatttatgtaagca

SEQ ID NO: 206654 - DNA, 200 bp, Homo sapiens
aatatgtcactttttagtcgctagactatgtttgaaagctgtaaaatactggcgagccacaatttaggaccacgtaaaatgtgaaaatcgggtttatggaaacagattagaatttattttcattatggaatgttttgtttcaaagtttgttgaaaaaatatattttgatgtataataaaggtatatagtatgatgtttgt

SEQ ID NO: 206655 - DNA, 777 bp, Homo sapiens
  misc_feature (16)..(16): n is a, c, g, or t
  misc_feature (32)..(32): n is a, c, g, or t
  misc_feature (47)..(47): n is a, c, g, or t
  misc_feature (51)..(53): n is a, c, g, or t
  misc_feature (58)..(58): n is a, c, g, or t
  misc_feature (62)..(62): n is a, c, g, or t
  misc_feature (95)..(95): n is a, c, g, or t
  misc_feature (115)..(115): n is a, c, g, or t
  misc_feature (137)..(137): n is a, c, g, or t
  misc_feature (161)..(161): n is a, c, g, or t
  misc_feature (180)..(181): n is a, c, g, or t
  misc_feature (192)..(192): n is a, c, g, or t
  misc_feature (202)..(202): n is a, c, g, or t
ccgccgagtagatacncaatggatattcacancctcgatattgtagnagcnnngtccnctcnataaccaaaaggtggaagccatctaagcatccnctgatggatgaatggatacngaaaatgtgatacatatgtacnatggaatactattcagccgtaaanaggaaggaaattctgacanntgctactactnggatgagttntgaaaagaaactatgctggccgggcgcagtggctcatggcctgtaatcctagcactttgggagaccgaggtgggtggatcacttgaggtcaggagttcgagaccagcctggccaacatgagtgaaactccatctcaataaataaatagataagtaaaaataaaaataacttctccctttcggattcccgatgcggtggttgctgtaaggggtcctccctgtgccacacggccatcgccatggtgaagctgagcaaagaggccaagcagagactgcagcagctcttcaacgggggccagtttgccatccacttgggctttatccctcttgtgatttacctgggatttaagaggggtgcagatcctggaatgtctgaaccaactgttctgagcctactttggggataaaggattatttggtcttctggatttggaggcaatcagtggacagcatgaaagatgtgtgctctggctcggataagagatgggacatcattcagtcactagttggatggcacaaggctcttcacagatgaacctgtagcagagtggaacttgtactaacttatgatagaat

SEQ ID NO: 206656 - DNA, 490 bp, Homo sapiens
gcaatccacccaccttgacctcgcaaagtgctggcattatagcccctgagccaccacgcccagctcttcactagcccttcaaaaatgcgcttgcaggattcccgatgcggtggttgctgtaaggggtcctccctgtgccacacggccatcgccatggtgaagctgagcaaagaggccaagcagagactgcagcagctcttcaacgggggccagtttgccatccacttgggctttatccctcttgtgatttacctgggatttaagaggggtgcagatcctggaatgtctgaaccaactgttctgagcctactttggggataaaggattatttggtcttctggatttggaggcaatcagtggacagcatgaaagatgtgtgctctggctcggataagagatgggacatcattcagtcactagttggatggcacaaggctcttcacagatgaacctgtagcagagtggaacttgtactaacttatgatagaat

SEQ ID NO: 206657 - DNA, 267 bp, Homo sapiens
gataacagtgggaggcagcagtgttcatactcctgggacctccagagtgacttgagccaaggacatgctggcggttccccacacgtagaagagggtcccactatttgaaaggtgaggcagcctgcccagctgccccagtttcagcccctcctcgtgttcaaaccacacaggcatggacacatgagaaacagcaattagcagggagcctcaggggcctcgttggctccactcaggcataagatggacgggggtgctctgaaaggggct

SEQ ID NO: 206658 - DNA, 554 bp, Homo sapiens
taaatagagcttaaattacccaaacaaggcagttagattagttatgagaggacctcacagctgtgaagattcaccgtcattagcagagaccttgcaatcccctttaactggaggaacggccactagattctacctggaaatggacttgtgctttgaattgaaaagcttcctgtctgtgtttagctaaaaattgctcaggtctattagcatgggacagtagcccagtgacacttgttttattgagttctggactgttcatgttttaaacaaggataattctagatgggcaaagtagctttataatgtataccctgtttcttcttaaggcaaattttaaatttgttatgaaaggaacttgatccattactgtgtccaagaaaagacaaacacagaagaagggaaaccccacggaggcattgatatttgttgtagttaaccgggtcttcttggccttggtggcatgttaacagcttataacaactcacttggcagctggtgctacccccatccccagagactattgagctaagaacgttatctcaattgtcttccca

SEQ ID NO: 206659 - DNA, 119 bp, Homo sapiens
ccattctacacaaaatatcaatgaccgaaaacaccgtttgacatgggcaagattgtatgaaaagactaattatacaaagcaagtcgattcaactatttactttcccaatgtttctcttc

SEQ ID NO: 206660 - DNA, 977 bp, Homo sapiens
tccagctggcccagcagctgctccactaccatgcaatccaggcatccacccaggaggaggcactggcaggctgggagcccatgggagtaattggcctcatcctgccacccacattctccttccttgagatgatgtggaggatttgccctgccctggctgtgggctgcaccgtggtggccctcgtgcccccggcctccccggcgcccctcctcctggcccagctggcgggggagctgggccccttcccgggaatcctgaatgtcgtcagtggccctgcgtccctggtgcccatcctggcctcccagcctggaatccggaaggtggccttctgcggagccccggaggaagggcgtgcccttcgacggagcctggcgggagagtgtgcggagctgggcctggcgctggggacggagtcgctgctgctgctgacggacacggcggacgtagactcggccgtggagggtgtcgtggacgccgcctggtccgaccgcggcccgggtggcctcaggctcctcatccaggagtctgtgtgggatgaagccatgagacggctgcaggagcggatggggcggcttcggagtggccgagggctggatggggccgtggacatgggggcccggggggctgccgcatgtgacctggtccagcgctttgtgcgtgaggcccagagccagggtgcacaggtgttccaggctggtgatgtgccttcggaacgcccattctatcccccaaccttggtctccaacctgccccagcctccccatgtgcccaggtggaggtgccgtggcctgtggtcgtggcctcccccttccgcacagccaaggaggcactgttggtggccaacgggacgccccgcgggggcagcgccagtgtgtggagcgagaggctggggcaggcgctggagctgggctatgggctccaggtgggcactgtctggatcaacgcccacggcctcagagacccttcggtgcccacag

SEQ ID NO: 206661 - DNA, 1267 bp, Homo sapiens
aacaggagggaggctggacactgaggtgggtgaatgctgcagatcttcctgcttgatctctgaacacccatgaccagtcctgcccacaagctttggtccatgctggatgcctacccagaaagttccttcctctcctccccaccacatccccgaatcctgccattcttcagggcacctcacctgccccatctcctccagaacatctttgtcctcactgaggcccagactgactcccttcccgactcctgactgatctgttggtctctgtcactttggcatttccccacacattgccttctgctgttaccagataggctgcatgtttgagtgacgcttcaccaactgtcatggctatgattttccaccatctgtgctgtaagacagtaaaaactcaaccaccaccaccgagatgccatccaggcaggcaaccctgagcgtgcccccacccgctacacactcttctccccagagcacatcagggttctgagatcaacaagttggaaggagacttccaggtgggcaggaacgctctctccttcccaggacccccacgaacctagcccagagctgcagagaaaggggtgcatgagtcgttgaggaaggatttttccttgctcctgggacagcaagtcaaaactgtttgttttaggttttaagttaatttcagaatatcctgccctaaacaatttctttccttacatagcaccaactctctgctggggccctttggctgtttcctttctccattctttccttctcctttcccagatcccagctgggaacctggggggagagcctggctggcaccacctgccctttcttgggccatttcccttcttgtttgtgatgaggaggagcctaggaagtctccatgcttcttggctttctggccctcatcactttcacagccttctgctaactaagctagtgagcccccctgccctttcccattccctctctgaggccaaactctctcatcccagcttctttcttttcatcttccttcctctaaagactgctcagcctcatcggaggctgccttctgaatcctgaccctgctttccacattttgtaagacatctcggccccagagtaagagtgcatgatttacctaccacttccttggatcccaacccctactcactgctagctcctggcagtggcgttcttcctccttccttggtgtgcagatgtgcccctgtgtggcctccttctctaaaagcattctagattgttcttggttccagcacttctgaaacccatcctt

SEQ ID NO: 206662 - DNA, 975 bp, Homo sapiens
ctcccaaatccggtcatccacctttcagagcagcaccgtaaagtgaagacagacatttattagatgaaattctggtttcacttttacacttgtgcaagcatttttaacagtaaaggagaggaaagggaggaatttatatttctagataatatatgaaaattaccttgatattgtatttttaagatctttcaccaatactgcagtgctgcactagaaataattagtttaagaaaatacattcaacattgtccaggtgatcctgtcaccttttagatgacgaaaaacatcttgaggatgttttgtacagttattttcccattgttactcttagagacttttgtttcaaaaaggcaggctcattttattttgttttatcttagaacattttagcagctctttgtcatgggttaaaaaaatctagaattaaaaaaatgtttaatatatgatttatataattttgacaagaatacaaattcttagtcgttcaaaattggaagcgctcttagaagtgtcaagctcagctttccattccacaaatgaagtaactggtaactgtgacttattatgttatacagtgacagttattatgttatacagtgtcagttatacagtgacaaccaggacaaaatcctagggttctagattccccttctggtgctctttttaccagatgatggcattactaattgcctaccttgaggcctttgaaatcaccatgtctgataaaaacatgcaattgctttggtgaatttgtttgttttattgttgttgctttgagtgaatgcttcagtttgctctagattttactttgtttgttaaaaattaccatgttttaacccccgaaaacatttaatgtttttgaaatgattttttcataacaatcttatgagtctattatataataggaagtattttggaaatttaatggtgatatttctttggaaaagaaaaataaaaactctggaatgcaaaaat

SEQ ID NO: 206663 - DNA, 300 bp, Homo sapiens
caggcaggtgccaccacgcccagctaatttttgtatttttagtagagacagggtttcaccatgttggggagggtggtcgcgatctcctgaccttgtgatccgcccacctcagcctcccaaagtgctgggattacaggcatgagccaccgcgcccggcctggcccttggcattttaatttacaactgttcccattcaccaccccatcccccaacactcagtatcacagcatggtaaactggcagttttgctgtccccagagtcacctgacttaatttggatcgctacaaaaatgcttctca

SEQ ID NO: 206664 - DNA, 394 bp, Homo sapiens
gtcccagaaagatacttggggtactattcacagaaaaaagggaagtggccacagggctgataaaacgacgatgcccactacacctgggtattttctttctttttgttttttgtttcttttgagacggagtctcactctgtcacccaggctggagtgcagtggagcgatctcagctcactgcaagctctgcctcccaggttccagctattctcttgcctcagcctcccaggtagctgggactacaggcgtgcaccaccacgcccggctaatttttttgtatttttagtagagacggggtttcaccatgctggccagtctggtctcgaactcctgacctcatgatccacccacctcagcctcccaaagtgctaggattacaggcgtgagccactgt

SEQ ID NO: 206665 - DNA, 564 bp, Homo sapiens
ggaagatcagagtattaaataactctccccagccaagtaagctcttaataaatgtcaggtaaggctaaacctgaacgtcgagcctagagagggcaaagagcatgccggttcagagcagacacccctgccaggcactagctgggtgactttgggcaagttacttaacctcactgtgcctcagtttcctcatctcccaatgtaaggataatgtacctacctcacaggtttgttgtgaagactaaatgaagataatgcaataaacggctgagacccatgccaagcacatggtaaaagtgtgtaattgcgtattagcagcagcagccagagcaatagccaagggtcaattaactcccagtccagtgttcagttcatgattgtccatgcattaagagccaaagcacccccaaagccatctcaccctgctgaagcagtctaaagtgctcaactaagttggtgcattaatctctagaccagaggtcagcagacgttttctgtaaagggccagacagcaaacattttaggtctctgttgcaactactcagctttgcccttgtgaatgaaagc

SEQ ID NO: 206666 - DNA, 510 bp, Homo sapiens
actgaaacctagcccagatcaactacacaaaggaattaagatattatggaaggaggtgacaggtaatttttatggtttttgtttttgtcctattctttattttaaactaattcacttgtatttgaaaaaataatgcacatacatgatagttctaatagctcagcaaggtaaatttgcctgcagaactaagacctgtagtctctgacctcagtcataaactgttaggttcttgtgtgtctttacagaattagctatgcatgtacatgaagctaattctccctctgtccatttattccttccatccccttctctccctcccttcctttctcaaaaaggaatatactgtgtgtagtgttctttgtctgctttttacacccactccacttaatagggcggtctccctatcaacataagtagatgtcctttttttttttttttcgcagacggagactcgctctgtcgcccaggctggagtgcagtggcgtgatttcggctcattgcaggctccgc

SEQ ID NO: 206667 - DNA, 561 bp, Homo sapiens
agttagatctttattaacatgctatgccactgcagggagggagcaggaaaagcatgatacacaatttaagacaagtgccaccataggctactgttggcaaacaagagctccaccaaactttttaaagtgaagaagcaacagtctgagccatttttctcaccagtggcaggagggggagacttccaccagcaacatggaatcttcagtggatgcagctgaccaaccctcctgacttctcagtcttttcccaccactgctcaccctttatgttcagatgtattcagcactagataaccatacttattaactataagtgatgtgtgtgtgtgtgtatgtgtatatatatataaaactgtactttaagaataaatatatataaactatatgtgtaacaaatttataatatataaactataaatctgtgaaagtattcagcattatataacggcaggctgtggtgatttagattggtggagctcctgaccatgcctgaaaatccctgtaccccactttgaccgtgattttttaagggaatattgtttttttacatctgtatttaaa

SEQ ID NO: 206668 - DNA, 643 bp, Homo sapiens
aaataccacactctttttttgtggggggcgggggggcagcgggtagagacagggtttagccatgttggccaggctggtcccgaactcctggcctcaagtgatctgtctgcctgcctcggcctcccaaagtgctgggattacaagcatgagccaccatgcccagcactaaatactgtactcttctagttttccttctttctcctgtgctctttctcacactaaaatattacagtgccaggctttgttcagtctccctgggtaatacccattcccagggctttagatgccatctgtgtgcttataacaccctaatttatatatctagcctagcacttttctccctgaaattaagattgctctttgacctctccattaaatttatttccaataaatatctcaggctttcctgttgcatgtagtggtacaaccatttattcacttgttcaagtcaaaaatcaagaattattcttaattcctcttttttctttatttcttatgtccaattagaagccagactcattgacttttaacttcaaaatacatttcaaatcaagtcactgggaaaataaagtcaaataacaagtgatctctgcttccaaagattgttcatagtagactggcaaactaattagcaattatgtga

SEQ ID NO: 206669 - DNA, 399 bp, Homo sapiens
tcagacgaagatttcaatcagtacacttgctaatcttgttcagacatggagtaaacctggactactaagatttagtgactttataatcacatcttccaaggcaaagcaactacccaaattaaaataattggtttgctattacctcctggacacataatgtaattcctttctatcagtatctcatggaagatagaatgccaaccccccaaatttggggttgccagataagctaatacattaattatcatgatgataaccaataatatcttaaatgtttttgtcagtgagtagaaaaagcgaattccaagtaagaataagaactttatatccactttatttcgcatcaaacttaaatcaaaataaaatgccttccatctctacctagattttcttattggg

SEQ ID NO: 206670 - DNA, 749 bp, Homo sapiens
aaactcaatcagcaaaataaattcaataaggaagatttgaagatcaaagaccttcctctctctggcttcacatttctcatcactagttgaaagcctgaaagaacaaaaaagctgacccttccctgagtaagagagaattcttcctgcgtgatgatcttcaatctgggacattgactttttttctgcctttggcctgaaacattggctctccctgggtctcgagcctgcgggcctttggactggaactaaattatcagctctcctgggcctccaggttgtctattcaccctgcagatctttcaacttgccagaccccataattatgtgaaccaattcattataaaaataaatctcgattgctggcaagatggccgaacaggaacagctccggcctgtagctcccagcgagatcgacatagaaggcctaggtcatcaagatgcacagcacaggacagaagcccctctagtcctgcacctggtgacatggaactgctgtgctggtccacacagacacagcctccaaccaagcctggctcctacccatcacagttctgtaggctgcccatttgcagaaggccttccatctgacactcctcctcgcctgcttgttctccagccatgttgtggccaatttgccatgaggaggttgcagtggccaagactgttggaaactgtgcggtgtagctgggagagaaaggacacactctaaatgttcttactgcctgtgacgatgcagctacagcgatgta

SEQ ID NO: 206671 - DNA, 571 bp, Homo sapiens
actagaggacccccaagcagcttactacagactcacatttcagttctgaatgtacttcatgttgatatttgaatatagtgtgaggtaagggtctaatttcatttttctgtatgtggatatccaattttcccaatgccttttattgaagggactttcctttcttcattgtgtgttttggcaccttgtccaaaaatcagttaattgtaaatgcatgaatttgtttctgggctttttatctgttcctttggcctatgtgtctgtttttatgccagtatcatgctgttttgattaatatagcttggtagtacattctgaagtctgatagtataatgcctccagtttagtccttttggtccgtgattgctttgactacttgggttaatttatagttccatacaaactttaagattattttttccattttggttaaaaatgtcattggaattttgatggggattgtattgaatctgtgggtcactttgggtagtatggactttttaacagtattaattctcctgtttcttgaagagatttccaaaggtgtctcttatttaagcataattgtcttgga

SEQ ID NO: 206672 - DNA, 863 bp, Homo sapiens
tgtttattgagatcctttgtccatttttactcaggttatttgtttcttacgattgagtagtttaacttcctcatacactttggatattaatcctttatcagatgtatgctttgcaaatatttcttcccactttataggttatctcttcactctgttgattgtttccttggttgtgcgggagctttttggtttgacgcaatcctatttgtctatttttgcctttagtgcctatgctttgggggaatattcaataaatctttgcccagaccaatgtcatggaacatttcctctatgttttcttctagtggttttgcagcttcacactcacatttcagttctgaatgtacttcatgttgatatttgaatatagtgtgaggtaagggtctaatttcatttttctgtatgtggatatccaattttcccaatgccttttattgaagggactttcctttcttcattgtgtgttttggcaccttgtccaaaaatcagttaattgtaaatgcatgaatttgtttctgggctttttatctgttcctttggcctatgtgtctgtttttatgccagtatcatgctgttttgattaatatagcttggtagtacattctgaagtctgatagtataatgcctccagtttagtccttttggtccgtgattgctttgactacttgggttaatttatagttccatacaaactttaagattattttttccattttggttaaaaatgtcattggaattttgatggggattgtattgaatctgtgggtcactttgggtagtatggactttttaacagtattaattctcctgtttcttgaagagatttccaaaggtgtctcttatttaagcataattgtcttgga

SEQ ID NO: 206673 - DNA, 275 bp, Homo sapiens
tcggagcctctcaattacttgcagttacatattgagtcccaaaaagcttggggattttaaaaggtaagaaacggggaacaggtcaggcaagagtaatcccagcactttaggaggcaaaggctggcagatggcgtgaactcaggagtttgagaccagcctgggcaacacagtgagaccctgtctcaaaagaaaaaaaaaattagaaaaagctaagtgtgatggcatgcttccggtaatcccagctactcaggaagctgaggcatgagatttgcttg

SEQ ID NO: 206674 - DNA, 414 bp, Homo sapiens
ttcaaagaaaaagtaagatgtttaagacagtaaaaggctactagagtcaatgatttttccatctaaaataccttcaatcatataaaagatggacattttaaaataacaaagtcctagaaagaatctatgtataaagagtcgtaagaaaggagtgagataatatgtttgttaagttacaatttgaaatccaagtatccagtacataggtatatagccacaaatgctgggaaagtacttctcaggtctcacagctatgaaatgtagaactaaagatcctacagtctccttcaactttatcattttataagcctccaacagtactaataaaatcataacgtattaacatataattcaacactttttttttttttttttttgagacggagtcttgctctgtcaccaggcaggagtgca

SEQ ID NO: 206675 - DNA, 218 bp, Homo sapiens
tcgatctcctgaacttgtgatctacacgccttggcctcccaagggaagtttttaaaggcattagcaaatataaatatctactaggagagacagacagaaaattagcaaaagaaggagaggatgtccttataggaagcttttctactctgaactgattctctatgcatccacaactgccttcacctaggccaacacctgctatcatctgcctatacaca

SEQ ID NO: 206676 - DNA, 287 bp, Homo sapiens
tgggggaatatttcagggaaaaacaagcaataatagtgatagcagtaatagcaactagctgtacttttataagattatcttactgaaatcctcacaagtgttagatactgttaccgactattatagcttctacataataagaatgccttatgtccataagaagacatgtctgtagtgtcttctaatgtagaataggaatggtaaaattatttcactgagccagacctggtgacttatccctgtaatctcagcactttgagaggccaaggcaggaggattgcttgagc

SEQ ID NO: 206677 - DNA, 742 bp, Homo sapiens
cagacctaaggcccagggcgcctgggggctggagcaagagaagcaaaaggagccaagggtgggggtttggggttcttgtgagggcccagccccaggaccccaggaccaggacacccaggagccccagggcccagccccagttcagaaggcaggggccttctgagggagcttaagggtcccacagcccaggacccccaccagggccagtggccagcgttgggggactcagcctcctcgtcgctcgtcctctctgtttctcccaccttttgccccctttctccttgcctgttcccacccgaggccccctcttggcctgcgtgagccggggcggcactgaactgggggccgatccgcctgggcggcggtgagaggcagggccgggagccgggccgctgggtttgggcctggcccgctcgccgcaatattgatggcccgtcagtgcagccctgattcctgtgctttcagttaaaaggtttctgttgttgtagcttatgcagttgctctgttgctatggaaacgtgacatcaaaatgacgtttcccgtttaaaagcttttaactaaattcctgcctgtcagatgtaggccccattttgagcgtggagctgccttcgagcgagcgtgagcggcgcctcccgcccatggtgcgtggggccgggccggggccctcgctgagcgcgctctctcaccccacaggcgcctccggcatggcggcggccgaggggcccggctacctcgtgtctcc

SEQ ID NO: 206678 - DNA, 414 bp, Homo sapiens
cagatttgcgtgaggacaaaggacacagtactgcttgtatagagtttgaatgccatgtgactgtttccttattgagcagaaaaacactcctctgggaagtagtttaaaaattattttatttttggtctacttcaaggactaaaaccttggaataaaatttttacagaattctgtatatgtgataaaggcaaccactgcttaatggtggtaatttaagtggggagaactgttcttccggtttcatgagaaccaatcacagcaaaaggaacatttcttgctctactttttttttttttttttttttaaataaagactaagccaaatacataaacctattatggataatggccttctccctcctcagcccttaatacaacccacctcctgactacatacaacttgtttcagtagaac

SEQ ID NO: 206679 - DNA, 156 bp, Homo sapiens
ttatgctgagtcctctgggaacccctccctctggaatcacagaaagtaaacaccaaactggaaacacgtctgcttctctctcccactgcatatctcttcatgaaaatgtctcatgaatttgaagctatatttcaagcttttcctcaccttttccac

SEQ ID NO: 206680 - DNA, 551 bp, Homo sapiens
attggagtctgcccctccagtgagatttctacaatactatgatattggaaagtaatcagaagctcttgttttaatagaaacagtgataactgggaggtataatttctgatgaggttggtgatcatccttactctttacccttgatagccaaaaagagaaataattgtattttctatttcatgtagttttggatatttgaggtaatatgtgaaagctgaaaaatacattatatgtacctgtattttaatccataaaacataagaaaaaaaactttatatgccaaggaagacagctttaaaaacacaatatactcaagaggatttttaaatattccccaaacaaataaattataaatgtttgaagtaatgcatatcctagttacaccttgtatatgtcttgaaatgtcactctagacctggtaaatatgtacaattattgtttcaaataaaagcggtttttataaaaacaaaaatcttcaatgataaatgaagtttatctaaaaataaaatgaactacaattgatgatttatatggagtatttaccattataa

SEQ ID NO: 206681 - DNA, 492 bp, Homo sapiens
tcagaagtaaactgggagtggtacaaaggtattgaaaagataaagcctgcatcgataaaatcagctgctatctgatgactcatggcgtaagagatatcatcttttaagcattcagttttctagtttcagggggatttccccttgtcatttgaacccctcaaacgttacgtttaaatggtaagagattatctcattttgataataaacaatggaaacagtctccaatactgaaaaaatgtccccaaattgccattctgcacatgctatttttctcttagggaagtaaaaataacaacaatgaaattgagcacatgttatttaccatgcacagtgctagggtctttacttatgttgtctcatgcaatgcctactataaaactgttagacagcaattttttagataaggaaactcaagctcaatcagggtaaataacatatacaaagcaatgtgaaattaaataggaatctctctaataccaacacctgtgtccc

SEQ ID NO: 206682 - DNA, 127 bp, Homo sapiens
gacaaacggttttgtctgcagacctcacttctatcctcctgtattactgagccatgccaagaacaagcctctcacagaagctgcttgttcttggattacactttcttgacatcaaaatgtttgctga

SEQ ID NO: 206683 - DNA, 427 bp, Homo sapiens
gcagggaggataaattcaaaccatcctccatttctgcattagcgagccattattactaaaaggactgacttacaatacttcttaaatctggagattgtaaagttcaaactttatcatgctgggtaaaagtattacaattctgaggtagttgtgtaacaacagagggaaataacaggcattctggctacagtttcaaatctctgccccatcaattaccagataacctctctgggtctcattttctgaaatcagtcaactgaaattgactacccattttgtaccagcatcctacaaaatagcttttttaaatatggtggtaaaggctgggtgtggtggcgcatgcctgtaatcccagcattttgggaggcctgggcaggtggatcacctgagactggaagttccagaccagcctggccaacacggcgaa

SEQ ID NO: 206684 - DNA, 1054 bp, Homo sapiens
agatggccaatattttgatttataaattatgggtcacaggccagccaaacttgaatgtgatttattctgtgaaatcattctccaacccaaccatccctcctgtgtgtttccagacactctgaatgtatttggggttagttatgtacacatctgtcttccctgctaggctgtgagatccagaagggcagggagcacctatcacacaagctggtacccccacctctaagcactgtgcctggcttacaccacctgctcaatcagtattttctcagtgttgacaaaaatgactacatgaaggatggctttctttaatctcatgttcattccacgttgctacagtggcgatacaaaaacgaataaaacacatttcttgctttgagaaggatacagtctaagaatattagaaaacatgaatacagcttttaagacagaacatcatgttgtgtctgcaatctctagcccctaatatgtactaaactttaaatattttgtgatataaagacaaaacaaaagtaatattttactaggacattatcctaatacataatttctcttgctctatgagtattttttttaagccacccagtaaatgtgtagcaacaaagaaccatttggaagttattccctgtcttgcagactgagtcagatcatggctaactgatggtcggtcctctctcatgtttcttgttttgttttgtgtttagggttatttctttttctttgcttttcaccattactatgaattttgaaattccttccattttgcaaaaaaaaaaaaaaaaaaaaagctttcctaattattgttcattataactgtaatcttttaaaaatgaaagagtccaaaattcatctaaatgtctgttaaaatgaacagaagttgacttaagatacagtgtagtttttagtctacatatttaattttcagtgtattcccagagaaatagcagtgttgattatctctctttcatgtcctaaaattaatagcagctcatactgaacccgtctaatggaaggataaagacttaccctccaggccagtaactacaaaatgact

SEQ ID NO: 206685 - DNA, 379 bp, Homo sapiens
aactcgggtagtctgaagacgatggggcagggcagccacagcacctactgccatggcgacttggccaccgttataagtagatgcaactgtacaaccaaggatagccaagggtggacctgagccccctctccagaaattctgccttactttagaatggggtgaacagcagggaaaatgaacatttttctttgctttttctcctccctcctttcttttttctagataagccagccagccaactgcttatgaggataaggagaaactggggcaaagtttaaggatgtcgcaaagtctgggtggccttcagtccatgaaagagaacacatctgttctatctcaggctgaggtcatctgcatcctcatcaataagctgactgag

SEQ ID NO: 206686 - DNA, 279 bp, Homo sapiens
aaaataaaaatacaacaataaaagtaatacaaataaaaaatataacaactatttagatggagtttatgttgtattaggtattgtaagtaatctagagatgatttaaagtatatgagaaggtgtacataggttatatgcaaatacttcaccatttcatataagggactttagcatcccctggagccctggaaccagttgcctaggaataccaagggacaactgtacacacatatatatagcaactttttcattttaaaaattgacctaatgttagagata

SEQ ID NO: 206687 - DNA, 456 bp, Homo sapiens
atggtcagatttggatgttagcagtatattattggctgcataggaaatcatgcccacaggcagggagatgacctaaaaggttgctacagtcctccatgtgatgcaagatgatggtctgaaggagacatatgggctgagtgaagggatgtttttgaagttacgtatcaagaagagtgggacaggttgtagagaggagggagagagaaaataactgctggagtgaggtcccaaagagtcagaagtgaagtaaagggtcttctttctcatggagttctgagacaaatttgtcagctgtctgtgaatactgataatgaaatgaaaagctcattttcgtacagtttttcctgcaaataaattttacgctatctctcccactgccattctgacacaattatagtattcctgtgggatctatgttttattcttttttatatactcatacctggtatagtaaat

SEQ ID NO: 206688 - DNA, 468 bp, Homo sapiens
ttgactgcctctttcctgggatccaactcccaggaagttctgacacttgatggtaggtgataggccaacacatttgtaagaaacaaatatttactgaattcagctatgcacaaagcactgttctagatgcttttatgaaaattattttatttagtttacttaactactctgaaattggcttttattattaccattttagaaatgtaaaaactgagacttagaaattaggttacatagccaagataacacagtgggaaggtggcagaacgttcatttaggacttggtccttggtaactccatatctaaactgtttggattcagtaagtctgaggcccaagaaatgtaaatacttctggcgaggaggtcacattttaagtaacaagacttgactacttttgcatatacgtccttattggaacctgagaatcagactctgagttaagtagtttaagtgttatcttaattat

SEQ ID NO: 206689 - DNA, 679 bp, Homo sapiens
cacgcgtcgcccacgcgtcgcccacgcgtcgggacaaacccacccgagtcactctactgctgtttcctgtgtccacatggtaaactctcagcttctggccaaagaccttggtggaccctgctgacttgctcactactggcaagcaaagtgttcactgatgaatgaacaattacatttacccacagactgaaatatgatgttattttgttttgactgaaattccaactcactgtgagaatactgtgaaaaaaatcatgagaagtatcctcataggtgagtcttttcacacatctgcactagtgaatatctgaattttaaaagccactccagacctacataggtgatgaatgaagaagagtgcccttccatgaacacatgtgctggagacgtgttgaatttcttccccctcagcataatcagaggaggtgaccccaagcaccttagagaccatgggaagttcctaatgccggcctgatgcagattctcttctccacggagcaccatggccgctgggctctgccttccacacagaacgatgtgtacttgaaaacagtacactcttgcacagctgtccctggagcttccccgtggagctgttaaacttgccctccgctggctgttttccacaaagtaatatggttacatagattcacggctcatggcaatgtttcattaagac

SEQ ID NO: 206690 - DNA, 418 bp, Homo sapiens
agaggttggtgtatgtaggcattatagaaggtgaagtatggcttataaatatcagcatatttttaatgctccagcctgaaaagtccattgctgctgctgctattattattgttaatagttattggctgggcacggctgggtgcagtggctcacgcctgtaatcccagcactttgggaggccgaggcgggtggatcacgaggtcaggagatcgagaccatcctggctaacgtggtgaaaccctgtctctactaaaaatacaaaaaaattagctgggcatggtggcgtgcacctgtagtgccagctactctggaggctgaggcaggagaatggcgtgaacctgggaggtggagcttgcagtgagcagagattgcgccacggcactccagcctgggcgacagagcgagactccgtctccta

SEQ ID NO: 206691 - DNA, 754 bp, Homo sapiens
gctgaagcgtgaattggccttatgttccctgcctccagaccctattttcctgcatcaacgggaaagggtcagattcactggctcagctgtttaacctgtcctggtgccagcagctggagctgggtgtcaggaccagcccgcaagctcttccctgccggaaggaccaggccagtcgctgtccttttcatgctagagagtggttgtggttgctgacttagcagagaaggtgcttggctttccccttaactggagaaaaaactttctaagaaccaggcctggttggcagcagacctagctttcttggggtggcagggaggctaaagcatacctcaggacagtcagtggtgggtccagcttcggctggaggttctttctactgaataacttctacgggctctgtcattagcaggatttgtataatttgaagcagagctgggcaactgcagagcaatggggaagccagcccagtgtggtggcaagacctgggcaacttgggaccagcctgggctgtctcttgccagctgttgttatcagaaccaggctcttcacactcagatccttgggccccccatctcagaatgcccagtggttgaaaggatgaaacctggaatttaagtgacttctcagtgatgtgtgcccttctctgacggttccttgttcatcccatgtatttactgactgcctgctatatatgcagagccaaagagtggggcctggtcttgaactatctcctcatctgccccttctggcacct

SEQ ID NO: 206692 - DNA, 700 bp, Homo sapiens
gctgaagcgtgaattggccttatgttccctgcctccagaccctattttcctgcatcaacgggaaagggtcagattcactggctcagctgtttaacctgtcctggtgccagcagctggagctgggtgtcaggaccagcccgcaagctcttccctgccggaaggaccaggccagtcgctgtccttttcatgctagagagtggttgtggttgctgacttagcagagaaggtgcttggctttccccttaactggagaaaaaaggaggctaaagcatacctcaggacagtcagtggtgggtccagcttcggctggaggttctttctactgaataacttctacgggctctgtcattagcaggatttgtataatttgaagcagagctgggcaactgcagagcaatggggaagccagcccagtgtggtggcaagacctgggcaacttgggaccagcctgggctgtctcttgccagctgttgttatcagaaccaggctcttcacactcagatccttgggccccccatctcagaatgcccagtggttgaaaggatgaaacctggaatttaagtgacttctcagtgatgtgtgcccttctctgacggttccttgttcatcccatgtatttactgactgcctgctatatatgcagagccaaagagtggggcctggtcttgaactatctcctcatctgccccttctggcacct

SEQ ID NO: 206693 - DNA, 382 bp, Homo sapiens
ttcttaacttttatttttaaatagtagattaagctggcaatactttagagctggcaagctattgcccatgggccaaaaccagactgctgcctgttcgtatctaataagttttactacaagcatggtcacaaccattaattgatgtattgtctatggctgtttctcaagctacaactgcagagctgagtggctgtgacagagaccagctttcaactcctaaaaagcaattactatctgaccccttatagaaagaggtgtctgacccatgatctagagtgtctcaaactcctaactatgattatcacaaagacagaaaaccctgaagtctcacttgagaaggcagttctaaagcagtcatcattctgacctgagaaccttgggg

SEQ ID NO: 206694 - DNA, 278 bp, Homo sapiens
cactgtacattcttgagcaggcaatgacttcacaaaaggatttctcaaaggttagtcctgcaacagaagacagcgtggattggactggaagagtgggagggcaggtggagaaggcattggtctgcaagtggggagcagccctgggggcccagccagtcccctgtgccctgacaagtggtatggcatggatggatggctctacttctgggccgccaggatggacaggtactggttgctcttcaccatggcgataatgaggaggccaccggtcagcagga

SEQ ID NO: 206695 - DNA, 595 bp, Homo sapiens
gcaaaccacactacttcgccgacactcgccagagaacggcagcaccagaggcagttcctgaaggtttgccatggtagcagcctctggaagaggaacagggaatttgtcttcaagctgtattgtatacttacaaatatattgtgtatgtgtttagggtaatttggggaaaactaataaaattcatgaggaggccaaagtccctgcacatttgcaagttataccttggtgcttttccagaaggactatatgggagtgattgtggtagaaatgaaataagcagctgataaatgggtcatttttaattttcattttttatttaaactatcgatctttttattgcaataaaatgtcacaagtaaaaataaagaatttatgacagttttaacgtggtggaaggtagagcaaacaaatggagaaaaaatccaggtgaaggattaataattaaataatgaaactcttaaacttgaaaatatctgtgaactttaacaaaaatatgtataatagatatggatgcaaattccctttgatgcttacatctgagaacccagggaagtgaaaggaacatattaagaaggagacttcatagcaacactgg

SEQ ID NO: 206696 - DNA, 402 bp, Homo sapiens
taaagaactcctataaagcaataagaagaaaagataaacaacccagaaagggaaaaaatgggcaaaggtatgaacaggcaatatccagaagaaatgcaaaatttttgtctgtacaaaaattatgttgtagactcatgtaacacccagtaaactacatgctaggagatttaagaagtcatgtttttcagaactaacaaattacatatatttacacaatatcagaatgggaaatgcctgtctgaacttgaatctacagacaaaaattaccaagaaaaatcattaaaattatcatagacttgaaaaaacctttgtactagcattcgtctaaatcaatgtgaaaaattctaaaatttatccaggcaggagaagaaacacagttaataaaaacatgaaaacctcatt

SEQ ID NO: 206697 - DNA, 563 bp, Homo sapiens
ctctgtgagccccctccctgagctccactttcccttatgtttttatctgaaatgtcatggtatacaccaccaatttcagggtgtagtgttccctagttccattttctggtactcagtaaattttaggaatgagaggctttagctcattaataactcacacaggtaaatgtgtgtgagtatgtcatgtgggcttttaagaatgtggagagggtgggataatgtcctatagtcatggaacttgccaactagctcccaaggaagaacacacacacttaagacactgaggagaaggacagtgctaactgtgcatccctggctgtgagcccttttgttgcccagagataatggagggtcagagtagtcagaaaatccttggaggtggcatctcagagaaaaaataatataaaataaataaacactgggacttagggagtattaagctgagggcccttcacagtaactacaaaagaatgacttggggatttacttgtccaaaagtatacacaagactggagacgtaatttgtgggatatagtactaaatgaaaatatagagtcacttgt

SEQ ID NO: 206698 - DNA, 457 bp, Homo sapiens
aattaaaaagaacgaggtagacacccatctattaacatggaaaggaaggcattattctgttaagttaaaaaagcaggttagagaacagttcatatagatgatattatttatgcaaaacatatgcatacatacatatacatgggtacctgaacacacacccatattctctctttctcaaagaatacactccaaacttttaggaatgattactcttagacagtaaaagggaagaaaggagattttttattatttctcctctcttaaccaggaagaaaagcaggggaaaaaaaaaaatctttaaagccccagatgtcatgtaatggaaattacagaaattccttgggttctttctctgcctccaccaagttcagaggcagaggcttgggtgcgctgaagattccctatcaccagtaaaccaccggcatggccgaagaaggcactgctgctgctggtgtca

SEQ ID NO: 206699 - DNA, 416 bp, Homo sapiens
ggctagccagttttcccagcaccatttattaaatagagaatcctttcttcattggttactagtacaaaaacagacacatagaccaatagaatagaatggagaactcagaaataagaccacacatctacaaccatctgatcttcttaaataagttttttaagagttttgatcattttctgtggcacacttttacataatttttctttagatatcttcctaggtatttgatctttatgtgtatattattgtaaataacgttcttaaaattttgttttctaattttttgttggtagtgtatgacaatgcaatattggcctcctgttcaacaaacttgccacattcacttattaatcataattgtttgtggaatcttttggattttctgcatctaccatcctgtaatcacaaatgcagat

SEQ ID NO: 206700 - DNA, 366 bp, Homo sapiens
gtgtattactgcatgcatcaagtgatggcacaactgtccatatgtcagtccatactctattgtaatgtaaacaattcaagcacaaagtctaaattttcctgttgccaatgccaaacatgaggcttggcatgtggtggttacttaacaaatttcactcttatgtttatttctgtactaattaagactgtaaaattatctaggatgaagcctaagtcttataattcctccacagcacacagcatagcaagagcacactgcaggcatacaacagtgatggtttagctagcagtggaatgtttaccgaaacacagttccatggacaaaatgcacttttcaaaccatatgcttacctataagataagatac

SEQ ID NO: 206701 - DNA, 182 bp, Homo sapiens
atcactttactattggagaaatttagggcagtgtgtgtgagtgtgtgtgtgtgtgtgtgtgtgtgtgtgtgtgttgggagtaccgagttaaggggcctccaagaccatgttgaagggatgacacaaatggtctggttttcttttgctgtggactgcttgtctggctttgtctagctgaatgc

SEQ ID NO: 206702 - DNA, 388 bp, Homo sapiens
  misc_feature (181)..(181): n is a, c, g, or t
  misc_feature (183)..(183): n is a, c, g, or t
ccatgttggccaggacggtctcgatctcctgaccttgtgatgcgcctgcctcggcctcccaaagtgctgggattacaggcgtgagccacagcacctggccagtacatgttttttatgagtgccggttcttacggtatgttcacgtagagactgaaggctataaaaactttccttaccactngnacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactacctta

SEQ ID NO: 206703 - DNA, 436 bp, Homo sapiens
caatcattagcaatatatgagagtgcctgttttcctacatccttttattaacttcacatatgaacttttttcctttttaagtgcagtatgtaccatcaaagttaccttttacttcaggaatggtggttcaggtcgggctcagtggctcgcgcctgtagtctcagcgctttgggaggccaaggcgggtggatcacgaggtgaggagttcgggaccggcctggccaagatggcaaaaccccgtctctgctgggaatacaaaaattagctgggtgcggtggtaggctcctgtaatcccagttactcgggaggctgaggcaggagtatcgcttgagcccgggggacaggttgcagtgagccaagattgcaacactgcactccagcctgggccacagagagacgccatctcaaaaaaaagaatagtggttcagatacatag

SEQ ID NO: 206704 - DNA, 152 bp, Homo sapiens
  misc_feature (146)..(147): n is a, c, g, or t
atacacttaatggcataacaatcaaaattccaagaggatttttttttcaagtcacttaatgtcttgatttgaaaaaggcaagaatagctaatatttttaaagaataatgaagggggacaaggtgtagacaattgaatcgggtaccnngagct

SEQ ID NO: 206705 - DNA, 336 bp, Homo sapiens
cccctcccttctcctcagaagcaagagttttcctagacctggctcgatgggcccccgagtatgtagcacatgatctagctaaaagttttacattaaaatagaactccttgttaaaataccatacatcattgactcaccaacttaagccctattgcataatacatttgagtcaggatataacatagagtaagattttaaaagaaatctaaccacctaggggaaagcaagaagattctctcagcaggccaacctgtcttaattactgctgaactctacctaagcctttaagtgggagcattttgagggctccttacagggttgctttccaggaccacc

SEQ ID NO: 206706 - DNA, 401 bp, Homo sapiens
ccatttcaggccaagcaaaggcgtggatgagtaaaagatggggcctgtttggggactgtgactgggctgagtttaggggataagaaactggcaactgcagcatagtggcaagaacaggggattaggaatcgagaggcctgagaggagtattcttctggatatgttgtttagcttttctgaactttagtgtccttagcttataatgagattattatcttgtccaagggattattgtgaggataaaatcatagaaatacccaagagctcctactacagggtccagcacatactgagcgcgtaataaatttttcttgaattgcatttttattgagagatgtggtcgcaggtgaggctggaaaggatacacttgttcacgcgaggcctgtagtggtgccaaggag

SEQ ID NO: 206707 - DNA, 664 bp, Homo sapiens
ctagtcagtgaaagctggggtggctgtaataacatcaaagtacatttgaatgctaagaatattatcaaggttaaacaaggaattttaaatgaagaagggatctatatttcaagaggatgtagcaactctgaacatttatgcacttagataagagagcttcaaaaatatgaaacacaactgatagaactttaggaaaaaatagacaaatctacagtatagttagaaattttaatagccatgtctaaataatttgtagaacaaataaaaagaaatttggcaagaatgtggaagacttgaatgacgccatcaaccaatatgacctaattgacatttatagtacacaccaccctagaacagcaaaatagacattcaagcacacgcagactatttatcaaaaaagaccattttctaggccacaaagcaagtattgacacatttaaaatactttagatcatgtaaagtacaatctctgactacaatgaaattaaattagaaatcagtaacagaattctatatggaaattccctcaaatgtttagaaactaagtaatacactcagataatacatggtcaagaagaaacaaaaggagggttagtttcaacgtatgttgacctaagggaaaatgagaacaccatcccgctatttgtgggatgcagatacagca

SEQ ID NO: 206708 - DNA, 320 bp, Homo sapiens
tcagcagggtgcaggccaaggcaggaggcgtgtggtattgattgattggttaatagaacgggggacctattttaaacatttgtttttctgctttttcttttactttcacactttgacaagggtgtgtcctttaaaagctggttgggaattgttaatgggtgactctgatatttccatataagtagtttttaaaaatgtatcaggcatggaagccacacattcatggaccgatacaccccataagtagatctttgttaagtgttatagaatgatacagggtgttggccgggcgtggtggctcacgcctgtaatcccagcta

SEQ ID NO: 206709 - DNA, 404 bp, Homo sapiens
aacgttacagaataccatgtattgtgtcaaaaatgcatttgcaaattttcaggaagggctcgttgggtgccaagggctatgtgaggtgccagaaacagacaagtagctggaaacagatcaaatcagacaaggctactttcttcgtacagcatataatatagctgaaaagagcacacacacacacacatccttttgcttacctgaatttcatatttaatgttcttggactttttttgttgacctcaatccataagaactgtagttctccccagtacagtttcagcaccaatgaccaagtctcatcagaggaggccacatgatgatctagcagatagactctttattcagtatgtgagagtcatttacagactggggacataaattagaaatgatgagctggatgt

SEQ ID NO: 206710 - DNA, 570 bp, Homo sapiens
attattataagtaatattattagccgtcttctaaatgaggtagtacagtatagtgcaaaaaccatagaatggtcagaaaagctgttttctaatcctggcgctaccacttactggctttgaaagacagcaaattctgtgattcctctgagcctgtttcccagtctataaatttgggatagtactccttaatccttaatcttattgtgaggccttgctgaaattatgctcattgaaaacaaacacttaagcttggcatttagtagacactcctcaaaagttgtagtagttatcactgctagaatctgctaccatagattaatttgtaagtttttaaaaactctttattcccttgataaggaaaagtgtatgcttaaatatgttttggcagtttataatggatcactgtctagatttcttttggattctccattaatctgaactaaaaatcagataaatttctgtaaaatttgttttgccacacctgatggaatcatggtcaagtcactttacctctctgggcctgtttcctgctggcaaggggagttgtgacgtgtgaatgttaaagcccct

SEQ ID NO: 206711 - DNA, 174 bp, Homo sapiens
tgtctttagttatgtaatttttatacatgttaactttttctgtagtctcatggcaattacaattattattattattttttgagatgctgtctcactctgttgcccaggctggaatgcagtgatgcaatcttggctcactgaagcttctgcctcctggtagaaataaagaaataa

SEQ ID NO: 206712 - DNA, 295 bp, Homo sapiens
ggagccagagagctgagcaacgcacctacactatgctaggcgccgtgggctgcggacagcccatatggagatataaaagccaaccgcagaggtttaacacagccttcctcaaagtgggtcaaagtggtccaggatccttttgtgcttggatcccctggggacttgttgaaaagcagattcctaggtgctgagccaaatctacgaacacatatacagatgatttaaatacaatgataatactgagaacctttgtcctaaaaagtagggctaaccttctgattaagaaatgatattg

SEQ ID NO: 206713 - DNA, 443 bp, Homo sapiens
aaaaaattactgagtccccctctaaaaaattctattaaaatgacaattattttttaagtttatagccctcaagtataaacaataggctcaaaaggttgaaaaacagtgtcttggtccactcctgtgaggtgctaaaatgtaacgaaaaggccaccggtgctagggcataggaaggctacttaccttcccagagcccaagtttcttcatctgtaaatagaaggtggtcgtaatacttacctcatggggttgttgtgagaattaactgggttaaagtatacaaggcacttagaatagtactggtacataagcattccacaaatgtggcccattattacattattgttgttcttactatactttttctggtcatgtttgttatcccaaatttgttactcataaataaaaaggaaaataagttgggtgtggtggctcatgcctgtaa

SEQ ID NO: 206714 - DNA, 244 bp, Homo sapiens
tgagccaccatgcccggccagggtctttcttatcctagaaagaggacaacacccttctccctgtcctttttctcattctgctaccattcaagcttctaagtcaaagatccagttcatcttttcatagaagtatgacttcatttattttagtatattactaatgaacaactttaatatagcgatcctattaatatttttaacataatttgtttacattataaattaagtgggaaggggaagatga

SEQ ID NO: 206715 - DNA, 341 bp, Homo sapiens
agaagcaatttcccaaacagataaaaacacttgacattggtaatcagcttccaataaaatctcaggaattggccaagtgagctcaggcatgcgcattaagagacaaaatagcagagtatggctttctgggggcattccaccagaaaagggaaaacccaggtgggcatgcatataacttcctaaacacactgtgcatgctcacctcccaagcataaggagggcactgcacatgtgggcagctcacccttcagaaagaatgtagggaaagggatgcaagaggtcagaagtgggccagcacataaaagtcttaggatcaagtttaaatggggaacttgccttca

SEQ ID NO: 206716 - DNA, 352 bp, Homo sapiens
aattctgcaatttcttaacaggtagttaagaaattgcagaattttagcaatactaggaatcacggagcccagaatacaggtgtaatattgcaatttcttaactacctgttaagttcctcaaggtcagagcttctgctttttttatctttctttgcccagcaccttgaatagtgtgggacacgtaattgacgctcagtagatatttgtgtattgaactccatcccttgtcctcctcccctcttgatgtttttctctactggccttatgctacacagtaaagcagggcatgattatgccacttgattacccccaagagattggaataaatgcttatgccaaattcctacagcta

SEQ ID NO: 206717 - DNA, 395 bp, Homo sapiens
aaactcctgggctcaggtgatccgcccaaagtgctgggattatatgcgtgagccaccacgcctggcctaaaaggaccttcttctcaaaactaagaaatatgtcttcttagtggttttagtttatctgcatttccattttcaaaaagagaatatacagataaaataatggactgaaatgtcaaatttagaaactcaaaatatattgctcaatgtaatgaaatctcacctctgaaaaacagtggaaggcatctctgctacattctcaaattttcaagttaaaatggaccaaagctgaagtcatttcagtgcttcaaagctgcatcctctggcccgtgaccacacacacaagtgatttaactgtgagtcatgatctcgacctagcccagcatttctat

SEQ ID NO: 206718 - DNA, 526 bp, Homo sapiens
gactgtggaatccagggtaataagagtagaaagaggtagttgttggtgagcacattccttctctgaatccctgtctactttgattcagtatgtaaagtaccttacacacagtggctacttgaaaagtgttttctttcccgtctttctactgtagcactgtatctttatgccttgtatagcatgcttcaaaagaggcacaaatcacttcccctccttggttgcctcttgaccagtattaagtctagagactgcatagcgagaaacatcaaattacaggtcataggtgatgggacttctacaggggcgatggcttataaattgcagagccaggacttaaacctgggtctcctgactttaattccagtaatcttttaaaatattgccctaccttttgaaacctcacagtgatcctgcatttattatagagtcattcagttgattcataattaatgcttcaatataattagttgctcataaattgttaggttccctgagcctctggggcattggtaaaatgtgatcgctc

SEQ ID NO: 206719 - DNA, 370 bp, Homo sapiens
ctcccatgaatcactcttttctgtcctatggcattttgcttatctctatttttgcatttctttcttctctgccattatataatagcgtgctttagctatatttttgaactcccctacagtctaacatattattggtccccaagtgaatgttcagtaatatctaacacacaaatgtatattcagtgctgcgtctttaaaatacctaaaacatgttatgtgtcattttttgttcaattacttcttgatgtagtttctggtgtgttagccctcttttactattttgctaatattgttctcactgacccctactatttattgctattatatatcctttttttttgtgaaaataaatgctccactctttaaggtt

SEQ ID NO: 206720 - DNA, 370 bp, Homo sapiens
ggtgggagatgtctggaaacatcatggacacatgccgggaaaacacggaagctgtgcaccaaggtgctgacaaaggaaaaaggagaatggaggtgtgaacatccagctagcaggtcccactcagaaactcctgcatttccagacatggccaccagctctgtggatgagacaggggaggacagggtacctcacaccaggaacccacacaggtccatgtcttgctctgtgatcacacaacagcctccaccaccctgacatgcaggagggaggtcaaagcctcgggtccaacaacaggctccacagcaagggaagaaaggcaggaaggaactcagggccaggtcctcccaggcagcagctgcctgcacgctgt

SEQ ID NO: 206721 - DNA, 806 bp, Homo sapiens
agattgtctgagcttcataaatatttaaggtttactctgtactttcatccctttctatggggaagtaactctcttatttcatcctttttatctttgttcagcacacacgtgctctttttattttctctatgtctcacagctctcagagattatcaatttgctccctacgctttaatccattctataagttccatccaactttttgttgcttgctatgacaaaatcgaataatcttaaataatgcagcaaacacacgttgcagcctgtttaagatattttaagagttctttttgatctaggagataaaacacaaagttttcagtacagcaggttcttgtaagcaggttcttaaaatctcctcctggctacatctttagactcatttcctacctctcataaaaatgccctccactaccctacgacacggaagtactcgacatttgctgaacttgcatgctctcttaatctctatacgtggcagtttttaaaatctcttgtctacctggagcactagttctgcacattcattaaaaagcataagctttgctttctctaacaagtattacttgaacaccactatcttcttaaccccaaactcagacccaaatgtgcatgtatatatgcacacacacactcccaatagcttctctctttccctgtgttccttaggtataatgcaaagaactcatagtagtattaaagcacttaaaacattgtattacatttttatatcactctctactccattagactgtaagtaactttgatccagggatcaaaatatatttctccttttatctccagcc

SEQ ID NO: 206722 - DNA, 472 bp, Homo sapiens
agtgctgggattacaggcgtgagccaccgcgcccggccagcccactgtctttcttatgattaaaaattaaatcatttgattaatacactgtagggctgtgaggaggaagcggctggaaatgctattgtattatcttttactcttttttgttcttcccctgtgggaggatggaacaaaatgacttgttatccatatattctggatggttgaaagaaatattctatatcaatcacgttcaatcgtgactgtttaccagggttttcagttattttgggacacctaatagtaatcattagtcctaaaacctaatgtgaaaattaactggaaagagggaatgcaccatctgtagatacagtctaaagtagggtttttgaacttaagcttacaggaaagtcaaaccagagtagtctaaaaaatgaagattggtagtctgcactctagcactccaggaatttatttttcattcacctta

SEQ ID NO: 206723 - DNA, 447 bp, Homo sapiens
ccaggaatcctaaaacatttcccatctggcacttcacaggaaaagtttgcaatttttggtgtaatggagtaaaataatgatactaaattggagtgcctactctgcatgagacatgtgcactgtccatgtattatttcatttatacttcccatctggggagaggtaggtatcagtttcttcaaattataggtgaagaaattggagctaaatgactaaactaatatgtctcagaatcagaagcataactgaaaactttcaggctccacagctcatccgtggttttctacaacaaactctttcactatatacttgagaacaaatgaatatattgacgagcatgaaaacacacagtacacattgaatacataagtgatgtggatgtcaaataatgaagtagccctagagaaatccagctaatacaggaagagttaattgcatcaatagaga

SEQ ID NO: 206724 - DNA, 163 bp, Homo sapiens
cattctacctctgcactgtccaatccatagacaccagccacttctgactactgagcacgtaaaatgaggctggtgcaactgaacaactgagttgtttatttcgttttaacgaattcgaatttaaatgaatcaggggcagtggctcacacctgtaatcccagca

SEQ ID NO: 206725 - DNA, 373 bp, Homo sapiens
tgctcacagccaagaaaagtctaaggagacgtgacaaccaaacacaatatgatatcctggatgggatccagaaacggaaaaaggacatccagtaaaaactaaggaatgtccatacagtgcgggcgtcacttaataataacatgtcaatattgttcattaattgtgatacacgtaccatagtcacgtaaaaggttaataacagaagaaatggttcagatgtgagtgaactctccaaactaacttctcaattttttctgtaaatcaaaactgttctaaaaaatagtctattttaaattttaaaaaatagaaactctaaaagtggcaacctcacagtatctttaccaagtttaagttgagcttggtaagtttcctg

SEQ ID NO: 206726 - DNA, 685 bp, Homo sapiens
aaactgtggatattgacagtttttttctgggctgagaaaactctggaaccatttgctaccctatcagagtggtttgtccactagatggtggccatctacaccatccctggccctctcctatccgtcaacgctttatacttcacccagtaacataggtggaagttgaagttttgtttttcaggttgacccagaaggtctcaactctgggattactcatgccagtacttgtttttggtagactggtgttttggtatacaaagctacttttaagtactgaaaatatcagtaattatatagtaccaatattttagtatatttggaaatctgaattattttgtgattgttatttagttaaggcaaaaagacaaaccctatagtctacaggtctagatatgaaagctgcaatcagccactccattgagtgacccagagttctgtattagttcggagactttctaaccaagtataatagaaacttgacagcattaatattgtctaggcaatagcatcagactcttcatttatatatgatgaagcttaaaaaaaaaagacaaatgctttcaaaaagctatagtccctcacctccaaattaaagaagatctgttttaagaagtataaagcgttgagttacatttgagagacaggaaagaaaggatttttgttcaaaattatactattttatttt

SEQ ID NO: 206727 - DNA, 405 bp, Homo sapiens
caagctgatttctcagatctgccacttactcttaaggcggatccatttgctctctgatatggtttggctgtgtctccacccaaatctcatcttgaattgtagcttccataattaccatgtgttgtgggagagacccggtgggagataattaaatcatgagggcagcttctcccatactgttctcgcggtagtaagtctcacgagatctgatggttgtatatggggaaacccctttcacttggttctcatttctctcatctgccaccatgtacgatgtgcctttcaccttcagccttccaccttctgccacgattgtgaggcctccccagccatgtggaactgtgagtccattaaacctctttttctttataaattaccgagtctcgggtatgtctttatcagcaa

SEQ ID NO: 206728 - DNA, 225 bp, Homo sapiens
ttgaattagtttatagcacaatgacaattatctgctgagaaatactgctatcggtggctgggcacggtggctcactcctgtaaacctagctctttgggaggccgaggtgggcagaacacctaaggtcaggagttagagacaagcctggataacatggtgaaacctcatttccactaaaaatacaaaaaattagccaggcatggtggcacatggctgtaatctcag

SEQ ID NO: 206729 - DNA, 375 bp, Homo sapiens
ctatatttttattagagtaacactagctgctgtaacagataaatccccaagtctcaatgccttaatacaacaacaatttctcatatagcaatattgtcttctaagtggtgatggaggaacccaggctccactgtgtgactctgctatcttctagagaccattctgtgcattcagccagatggagaaagcacataggactgggtgagggttttacaggccaagcctgggaacggcaaaagttgcttttcaccaagtgtacccagctgtgtgccctaggcaatggaatttggcaagcaagagtttttgccaagatataattgctcataattctggtttatttatgaatatctattctatacttccctttatactggt

SEQ ID NO: 206730 - DNA, 695 bp, Homo sapiens
cagcattgctgcaaacatgtctcgcctcccaccatagggcggtttttgtcctatctcagaattgaacaaatgtacaatcgggttttataccgagacattcagttcccaggggcaggcaggagacagtggccttcctctatctcaactgcaagaggctttcctcttttactaatccacctcagcacagaccttttatgggtgtcgggctgggggacggtcaggtctttctcatcccacaaggccatatttcagactatcacatggggagaaaccttggacaataccccgctttcaagggcagaggtccctgcggctttccgcaatgcattgtgcccctggtttattgagactagagaatggcgatgacttttactaagtatactgcttgtaaacattttgttaacaaggcacgtcctgcacagccctagatcccttaaaccttgatttcatacaacatatgtttctgtgagctccagattggatcaaagtggttgggtcaaagtggctggggcaaagctacaaattaacaacatctcagcaaagcaattatttaaagtacaagtctttttcaaaatggagtctcttatgtcttccctttctacatagacacagtaacagtctgatctctcttttccctacaataacatacattacaatgagttgggaaataaatgtctctccaagactgaagcccc

SEQ ID NO: 206731 - DNA, 204 bp, Homo sapiens
tttggaagccttttttttctgttaagaaggaatttccagaatccatgatattttggccaatgcagagggtcttctctgagtatagcccatgtttccctgttgtgccttaaatactcttttctcaacttctaaatcaagtcaaagaatcagctcaagatttcttatcaaattttatgtactccataaagtcttactaatgtcact

SEQ ID NO: 206732 - DNA, 503 bp, Homo sapiens
agggggttatagagttaaataagacagcacattgctttctgtttttaatggcggacattgctgatggtttcatagaaagatgcaggaggaaaaatggatacccaagggaatgaagtcttgagaaagcaagaagcaatgagacccaaagtcaaatgaagagactgtcctgctaggagcagggacacgtgtattgtaataggaagaaatatgtgtgtaagtgaaggcagagttgattttctcaagagtgaggctgagaacaaggagtgtagttatgtttgaggaaacaatgtttgagaagtcatattatttgtggagatacactattttgtttcatttcctctaacaagtgtcattggcatagtcatagcccctaaatatctaaaaattaattccactttaaccacctcccctagttcagtgatagataattttaagtgaaaataaccatgcaaatagccaccttatgtgacactttattaaaatgataaatgatgcaatcaaaa

SEQ ID NO: 206733 - DNA, 534 bp, Homo sapiens
ctaacgaggacttggtgcatttgagacactctcagctgtactttgaattttgattccagagaggtcacgactctggtcaagagggcagacagggaggtgggaggacgggttgtgtgcaccctggataggccggggtagggggaggagaaaggaacggcagatgaggggtccatcttgggtggagcagaagttaaaggtgagagccctccactgagaaagcgcagccctggatctaggcctgaggaatttggagcagaggggatggggtcacatccaggatctgctgaaaatttgggggtgtcgaggtcagtgagggaagcctgagtcccacgggagcaggtggcagtccagctgtttacatgctagaatgttctattgaacacccactgtgagccatgtgcagatgcccccccacactcagtgctgggagcacagaaatgactcatatctggcctcagtctgtttggatagacagacggtatggccagtgctatggagccatcagtgctgtgatggtgggaagaggagcagggc

SEQ ID NO: 206734 - DNA, 408 bp, Homo sapiens
acattccatacactatgcatactaatactccatactatcaattgccctcatcagaaggatcttctggctaaccagtgatcaacatttttaatagcaaaaaaggtctgatacttagagaacatgttaaccacgtgaactggggcaggttactcaacctctctgcatgtgcctcagttttatcgcttgtggaatggtgatggtaacagtaacaacctgacaggtttttgaggattaaaggaactaatacacatacattatttcaacagtgcctggcagattctaggcattaaataaatggtaactatcactattattatgtaaaaagtataaaaatctgctatatgaatacttatggaaaattacatatatacatatagacacacatataaactattaggtctctttttt

SEQ ID NO: 206735 - DNA, 374 bp, Homo sapiens
aatgtgcaatagtctaaaagatgcagctgacgatgaattagtaattggaagagcactttcagcaaacctccagaggcagtagaaaatgttttaaaaaacaagttagcttatttgtaaattttctagcttatatctagggtaaaactagaacagaaaggaagaaatataaaaacagagaaggggaaatatttgaagatataatggagataaatttcaaggtagaaaaaaaccttcagattgaaaaggtttatctcaagcaaaatgtttctatatgtaagtatttaaaagcataactttgaacttattttctattaagccatattgtcattagaatgtgagaatgtattaataataaaaatattcttatgaaagat

SEQ ID NO: 206736 - DNA, 505 bp, Homo sapiens
ctcgtccttatgtttgcgagattcatccatgttgttacatgtggctgtccctttgtttttgtgctgtatgacattctactttatgaatataccagtgtacttaccattgtgctattgaggatatttgggttgttcccagctggggactattatggatagtgctgctgtgtgtgcctttggggtacatgtgcatacattctgctgggtatgtacctaggagtgggattgctggatcatggggcgtatctgtcttgaactttagcagaatcaagccaaaccattctccaaagtagatgtaataatttgcattcacacaagtagtgtgtgaagatttctgttgttccatagcccgagcaacacttaatcatatcagactttgatgtttttagccattgtggtatataatggtgtatcattatgattttcttttgcatcaaccttacttactactgagactagatgccttttcctatgtttattggccatttggataattttggttttt

SEQ ID NO: 206737 - DNA, 510 bp, Homo sapiens
aacgccctgaggtgactggccctttcttcatggattccggtcacatctggtccatctttgtcagctggcctctgggaagaatgtgggctcggccacctggagcagttgcctggggagatcagaggagccctgaggggttggcagagcgccctcgtggtatccatacccccatccctgtagctgagctgattccaagaagtgccctctgcttccttgtgaatcagatgtttactgcgctcctgctgagcctgctccaggcagctgggtggggccgtagggtgcctgtctgctcaagcctgcagagggaggccagctccccaccccagggtcagccaggctggcaggcaacagcctcaagaaggcagtgtgcgtgccatggcacacggggctgaggccgcgaggcaggggccgagggaagcggcacagagcttctctcaggcaccagaggggagctgagttctgggctcagagcaggcttcgtctgagggcttcagcgtcctccttgtgaaa

SEQ ID NO: 206738 - DNA, 496 bp, Homo sapiens
caaagatcttaggtgctggtcctgtccctcacttatgggaggaactagtggacagctactgaatgtagttatgggaaagatgagtggttgtgtaccacggcattcattcattctctagattgggcacttgctatgcaccagcacacgctaggtaccagctgaacagcaagacatggtgtctcctccctggagcccacctcctgtgctctccagcaagtgccagggaggggagtcagaagtccaaatgtagagcagttctcagtaggaagccccacctgaggaggctgaactccgcatggagagggtgtggcactggttgacctcctggactgtcacacaggctgtggttaggttggtgccatggtgctggctagaatggagccagagggacttagacctcatattgcacctgtccaacatggaccgcagtggtatggcacgtggcaggcaggaaccatatcaagtgggtggtggctgcatctgggccatgtcccct

SEQ ID NO: 206739 - DNA, 239 bp, Homo sapiens
atagctttctaacatacaaggaagcaggaggaccttggcatttccgtcatagtccagacctgatgttgaaacctttacacagagcctgctttgctttgagaccatcaacactcagattcaatactaaaaatcagtgaattgtatagtctaaaatggtgacttacgtgaatttatggtctgtggaatatggcatctcaatttgttaaaatgacagacattaaaagactttgaatgttgta

SEQ ID NO: 206740 - DNA, 933 bp, Homo sapiens
ttgagagacatgatgttgctctgtcacctgggccagaatacagtggcacaatcttagctccgtgtagccttgaactcctgggctcaagtgatcctcccacctcagcccctcaaacagttgagattatagtatgaaccactgtgcctagccttaagtgatttttaaatttgtactgaacagtttgtcctttccttccattaaatcatattagaagtacagaacttgatatttcctgtagcaatacagtttttctttgatgaagtttgatttcaagtacttatttttcataatttaaagctattttttatagagagaattttaatcaaatatttggatgtcactattgctatatatggtattaagtatggtgaccatagtttgtaaactccaaactgacagcaagacaggaaatttgtgttagcaaaggcttttttcttactgtttgaattttttaaaaattagatacaatacagagaggagcacacaaatcattaagagtacagctcagcgaattttcacacagtgaacatgtgtaaacagcaagtaacaaaagatttacctgcatcctataacctcccattattcccttttctaggtactgtctctccactgcattcccaccaaatataaccactatgctgaattctgacatcataaatgagttttgcctgattttgagcttttgtgactggaagtgtacagtgtatataccctttcgattctgtcctctttagtttaccattgtttgagaaatttatccatactgttccagaattaactactgttaattattgttaattaactactgttgtagttaattcatcctcattgttatctagtattcttttgtgagtaaacacaatttccattctactgtgatcccagctatccatttgggtcgtttccagtttggggtccattacaaatagtaat

SEQ ID NO: 206741 - DNA, 152 bp, Homo sapiens
gtagaaacaatgaaggcctgggggagcgatggtggtggggatagaaaggaagacctatgggagaactgagagttaagacacaggggcctccaagttcctggttagggataactgggtgcctattcaccagaaattagaaacagaggaacagg

SEQ ID NO: 206742 - DNA, 531 bp, Homo sapiens
gtggcagaggaacagtgtgagcaaagaccaatagtctgggaaaaggaggaggataggctgtgggcggagcaggaaatgtgggtggttctctttgccaaggattctgaatgccagatgagcaggatgaatgtatcttgtgggcaccagagaggcctgggcctcagcctgccccctgtaaaatgaggtgattagactggtctgcttcaagccttcctagggcaaggggctgtcacagaaagggtctactctaggttcttccaggttcaaccctggaaaggcagaatgggaagtggctggagcagctcagaggctaggggtaatattttgctccagagctcaagtctgagaatgactattttaccaagctgtctgtgttgcatccctaagtcaccctggctaaccctccacccagtcagggtccttcagagaaagcccaggccttgggtcaggaggcaagaagggtgatgggtgtcttacccctggctccaaccctaggtaagggttggccctcttggagcttcaacttgctca

SEQ ID NO: 206743 - DNA, 323 bp, Homo sapiens
tctctcttacaggtattatgtaaaaaatagatttggaggctcacaagaaataaatgacagaaccaagatgaaaaagtagatttctctctcatccataatattttattcctgaatgtaattgaaatttaaaatttttagatgcagcacgcacaaaaaccccattttcaagagtgtaaatccagctatggaatatcttttcacggtatggtataaaatccagcaaaatctcgagagatcacttgagttagttttgccaaaacaacaacatccccataaatcagctgactttaaaaaatgactcaccgctccttcagtctttatca

SEQ ID NO: 206744 - DNA, 365 bp, Homo sapiens
accttcctatcccttgcaaagccctttgataaactggcaataaagacagtatcagtagcttgttatgacaatattagttacaatattgtttaatagctttttagagcctagcacagcccagaacataaaaggaactttaaagaaaaaaagaaatagtcattcaatggtttattcaagatgtaccgattgaaaagctggacgagtcaaaaatattatcagtatagttctcttgacagtaagtgggaccagcctagcacacactttctctgccaacatccccccactgtcctcgctaggaagtgtggtccattaagtccttgaatcctcataagagtgactttagagttgtaactatagagacaaac

SEQ ID NO: 206745 - DNA, 503 bp, Homo sapiens
gatgaggctttttgagagaactcttactaaggtgaaggaccagcgatttacgtagaatcctagaatctcaggagttcttagtggagaacctgaatggcatcactgtcgaatatttgaaatccttgttagcacttggtataaaaactggaggcagttttagagtgcagccagtgtagttaaagtaagaattgaaatgatactaaatggcacctctgtttcataagtgaaggtcaaattctgatgtaacccttgtactcttggaattatactttaataggtgcttatgtcattgatttaccattttgcttaatggctaaataagattgctaaagtgtgattttattcatcagtacttactttatatttagaggtatagaggaaaatgggccaaaaaccacatggctgccacggtgcacttcagcaaccctgtagctaacctgtttaagtagaatcaatctgaaggttgaaagtgacctcaaaggttataaagtctattcatccct

SEQ ID NO: 206746 - DNA, 284 bp, Homo sapiens
  misc_feature (45)..(45): n is a, c, g, or t
gtcgacctcggtccctgttatctccgcactttgagaggccaacgngtgggcattatccttcagcccagagttcaagaccagcctgggcaacaaagcaattctcccgtctcagcctccccagtagccgggcgtggtggcaggcgcctgtaatcccagctactggggaggctgagacaggagaattgcgtgaacccgggaggggaagcttgcggtgagctgagactgagccgctgcactccagcctggcctgcagagcgagactccataaaaaaaaaaagaaaaaa

SEQ ID NO: 206747 - DNA, 666 bp, Homo sapiens
aggagaccaagattagtgcctctaatttatatacatgaatctgctagcagcaggaataaggcttcattttaagggcatggcagtattacctcaaaacaggacaagtctgataatctacttggtttctatagttagatgttagctattcaacttttgttatatacatttcatcctatgatatgtaaagctgagaaactcgtgtctacatcaagtccaatattctgaaatccaggatctcaaaatataggggttagacgcactttctaatgagaagataaagctcaatggtggatgatgtgtgtgtgtctattaattacaaatggatcactctgcagaagtactgtgaagcaaacaaaggaattactacaaaaccaaaaattatacaaggaatatttttacaatttgttcttgaatattcaaatttttaagaatcagatatgcttaagtggcaactgatgaggcaccttcaagagtaagtatgcaaaaagaaatgtatagccaggttctgaaaaaagaacaaaaactcaagactgaaaagatgacaatttgaaaacaacttcaaagcttatagtcaaggcaaagtgtattaaaaaaaagaaagggaaaacatcagatcttattaatggtgggaaagacacataaccaacctaagaggtagtctacaga

SEQ ID NO: 206748 - DNA, 480 bp, Homo sapiens
ttcagtattctcagtcaaatcttgcttcatacttattataaataccctgaaggagtcataccaatgtgttctctgtaaatgccatgaacaacactttgtttttgtataacggttttcatgactattgtattaatagcacattcaataatatttcaataggtcaaaattatgtcatatgttttcttacaaatttttgtcattttttagaattaatgctacagcccagaaaataaatattattatgaaagcttgtttgtaaaaaatttcagtaattttatatctttttggtaagattagtggcttctattgtatatatttacaatggatatcaatgttgatattgagttatccaatctaatattcttaatagctccagcttgaactatgaatggtagatgactatgttctgtacgtataccaatatgagtatttttctatgttaaagattttactagaatccttaaataaaccataatcatc

SEQ ID NO: 206749 - DNA, 391 bp, Homo sapiens
tgatatgatgccctgcgaaggtgtattagtcaggattcttcagagaaaccgaaccattaggatttattatatggagttggctcacacaattatggaagctgacaagtcccaagatctgcaggatgagctggcaagctggagacctaggagggaccagtgtcccagtttgaaggcagttaggcagaaggaaatctgtcgtcgttactcaggtgaggggtcagcctttttgttctattcaggccttcaactgattggatgaggcccacccaccttagggaggacaatctgctttactcagtccactaattcacatgctaatctcatccagaaacacccacacagacacactgtgctatttttgcaacatttctgtaaatctaaaattatttta

SEQ ID NO: 206750 - DNA, 602 bp, Homo sapiens
agaaaaagcttgaagattcacagtggagcaaggctaattggagccttcctcagagcagctcaactatcccagttttacctatcccattccttgccattcccacttgtaattctgtcttggcaagaacaccatactgaaggttcttaaagcagtttgtagactttaattagttctgtggaaagtcagtcaaagctcagccttcattctgccaacagagacaacagtggtgggtgtggaaggaaggcaagaagaagatggacacccagagcagttgtgcaacttactgaaggccatgtggataggaggaactgggtttaaaacccctgagtcttgataaaagtgtcttagccttctagattcctaaacaggtagtgggctcatcctactaacctactttgctagggtgttgttgatgaatgcttataaaccctgtcctagatgataggtttggaagattgttaaagaaagcatgtcattaagtccctactcaccccctccttgacaaatagccctggagggaaatgaatattagccagaatcgtagggcctccacttcaatggaatgaactgagattcaacaacaagagaaatgttccaacagt

SEQ ID NO: 206751 - DNA, 617 bp, Homo sapiens
aagacgtctctgcgaagctgtaatatcctatcttgccgccatcagtgtctattgtcatcagtcacccagagtcaagaagatctgaagaggatcaaccagtccccacatcctgcaacctagtcttcaaagtcttacctacacaaccattagatccttcttccctatcacttatatatcaattagcacttaattccttctttacatgtctgtctcctcatcaaactgaaagctccatgagggcagaggccagccatctttgtattccagtgtatacacaggttagctggcaaagtatatgttgtactgagttaaagaataaaaatctagcctggtgcggtggctcacgcccgtaatcccagtactttgggaggagacaacttgtaaaaaaatgggagtaaaatttaagccctttttttcccctagtaaattgaccagaattttcatcataacttaaatataaatgaagattcccataaggcatttaaaaaaaattgacttaaagtctcattcattcattgtgagtcaacaaataatttactgagggcttgttatgggccagacacttggactacatcagtccggaaaacaggcaaaatgtctgccctgtggagtccatc

SEQ ID NO: 206752 - DNA, 383 bp, Homo sapiens
atccttttatataagaaatttcctgttatttaaaatttataacagctttggctgctaaattttatcaaaactttttgggacatatattgatacaaccatatggttttcctgcttacttaataatttacagaatatcaccaattcctgttaaactactcttatatttctgggctaaccactgcttgtcatagtgtgtttactcttttaattttcaacttgctttgacttgccgagattttgtttaggattattttaaatgtattcaaaagtatggttgccctttagatctttggggggtgctgtcttgaacagttttagtaatagagcaactttttattttttaatagaactgctatttaattttttatttcttaattggcagg

SEQ ID NO: 206753 - DNA, 262 bp, Homo sapiens
cttaaaaagtatccccccacagataagggagaagtattatatgcatacatctgtaaaaccatttccataattgaaataaatgtatcattttgactttttttggttttctaataccttaatttctgactttatatttagtagtatgtacttacatgtgtgtgatatgtatttcattctttgtctagttgcttatgtgaaaactattacatttatttttaatatttatttagtctttaaaaataaaatcaattctcatttatgt

SEQ ID NO: 206754 - DNA, 477 bp, Homo sapiens
ctttgcaggattcatttaaggacttactaaaattgcctttatgtttctagatgttttagttttttccttaatattttggattttgcaatgcttttactgtttttggatggcttttaattttttctcattatattttcttattgattacttttagtatccacacactctactgaattcttactaatgttaagtggttacagttaattttcttgagttttctagttgttatttcttatggaaattgtattcctacttgtgttcaatatcttgtagtaacagccacaagttctagaaccattgagtactaaagggcagaacatgtatgtgtgttttgtttctaaatataatggatatcatttaggttttcacaactaggcatagtgacggttgtcaggttagtaaagtattacttatcatgttttatgtgtattttatatttaagattttctcaataaaaataaaagttttattgtaaaa

SEQ ID NO: 206755 - DNA, 558 bp, Homo sapiens
ctgcattttaatttttgtacctcttctcagacgctgcattgtatgatagaatatttattttattattaaaaatggtgaattaactagcacattgctttttctatcttaataacgactatcttaattctgtaaaattataatgtaagtcttgagtaaagtagtcattgcagtattttataatcctagtcatataccagagctttctcaaggggaaaagtattatagttatctcttcaatatttgcttgtgtgaaacagttattaacaccgtttatagctaaccctgtctgtagtgactgttttgagaaccctaaatctctaatttaaaggcccaagattttatcagtttgtatggaacctgtgtttgctcctcagtcctggtttcctaataaacttatgaagatatttgtgatggatttctgaagatttcgagtacatgtgaggggattcagtacaaattacagggattcaacacattgacagcaggaaaaatgtaatgaattgttaggtggggaatgatgtaaagtgaagtaatctgaataaaagcctatattatatt

SEQ ID NO: 206756 - DNA, 180 bp, Homo sapiens
tctaggaaaaagagctatgtggaaagtcaacgtttgtcaaatgctctcagcaaacagtcagctttacaaatggagacagcaggaccagaagaggagccagccggagctacagaatccttgcagggccaagatctcttcaacagggcttcaccactggaacaagcacaaggtactgaacta

SEQ ID NO: 206757 - DNA, 557 bp, Homo sapiens
ggaagtaggccccaagttcccttggcaacaagtagagtagaagcgatacacagaaaactgagtcatcggtgaatcatctgaggatttctgtttccaatccttggaaataatttaccgattgttttttatttgtgcagtgtttgctgactctgagtggacacctcagaaactgtaacatctttggtcaatttggtcaatcgtttaagaaacattctggatgctccaagtagaccttaagattgatatccaaacaaaacaaacctctgcttgctttaagatgacactcactccccatctgaggaggaacagataagtgagtcaaggtattggcaatggggaagtcccctttctacaaagaaatctgatgtccccagaaaaatgtttcatgacattgtcacatttaaaatgttagtcacaacaaattttcagacacctaaaaagagaacaaatatggtctcatacattttctctctctcactctgtctgagacttatgttcatcagttactcaattcccccatttttttttttacaaatacatctcttatataatccctt

SEQ ID NO: 206758 - DNA, 543 bp, Homo sapiens
gggaaacaaactctacaggtcatatgccccaacttcttcaacagataacttgaaagaaaggggtggagggggaacccatagatttaaaaagatatcaaaacatttttaaataggcaaggctaacctcaaaaatacgatgctaggccaggcgcagtggctcacacctgtaatcccagcactttgggaggccgaggcaggcagatcacttgaggtcaggagttcgagaccagcgtggccaatgtggtgaaaccccatgtctactaaaaatacaaaaattagctgagtgtggtggcaggcacctttaatcccagctatcgggaggctgaggcaggaggatgacttgagcccaggagttcgaggctacagttagccatgatcacaccactgtactccagcctaggcaacagagagaaaccctatctcagaaaaaaagactcctgagctgttagaagagatcagatccccacacatttcattcatagtaatgagactatttctcatgagcaaagtcagagtagccaggaaaatgctgctttacctcac

SEQ ID NO: 206759 - DNA, 482 bp, Homo sapiens
aaatgcctccttgagatataagttatttttgagctaaaggcaataagaaactgcaaattgagaggaagctatctctaccctcttctctttctgcctaaagataggaaaataaattctttatagatgacaactctagactcatcagcccagagatgacaccagaggaatctgcaaacaaactttactccattagtttcatccccaatatttaccttcccacagttgcgtgcccttggaagtttaaaactgtttttctttgtctgtcattcctttacaagtgtattgttctttattgaagatgttctataagtggagctaagtcatctttttgaggtatttccattgagatttctccagtgtggtgtgtgtggcatgcattaatacacttgtttgtttgtttgtctgtcattaatctgtcttgtattaaaggagtctgtccaaacctaagaactatgatgaataaaggtaaagtttctactcct

SEQ ID NO: 206760 - DNA, 414 bp, Homo sapiens
ggtggcttcaggacctgttctgtttgggtttggtagggacagggcagtggcccatattttcatattttcattactgtagtagaaattgttggtgtctgtggcaggggagggcacctgtggacggtaaaagaggaacatatatttttatttccgtggagcaactcattgttcctgaatctcttctgttataaaggagaaagatgagtggactttttggtcttggtccttctgtctgtgagtgtgaggctagtaggtaagcaggtggtgctgatgcctttaagggacttgtctcaagatgcaggtgttacttgtccagagaattttatctgaaaaggatttctagaggaggagaaagaggaactaagaagaaggagaggaagaataagaaggaaagaagaaagaaaaaagtaaaag

SEQ ID NO: 206761 - DNA, 405 bp, Homo sapiens
ggtggcttcaggacctgttctgtttgggtttggtagggacagggcagtggcccatattttcatattttcattactgtagtagaaattgttggtgtctgtggcaggggagggcacctgtggacggtaaaagaggaacatatatttttatttccgtggagcaactcattgttcctgaatctcttctgttataaaggagaaagatgagtggactttttggtcttggtccttctgtctgtgagtgtgaggctagtaggtaagcaggtggtgctgatgcctttaagggacttgtctcaagatgcaggtgttacttgtccagagaattttatctgaaaaggatttctagaggaggagaaagaggaaaaatgcttcttttcagctaaacatatctcagatcaagagctgtgt

SEQ ID NO: 206762 - DNA, 301 bp, Homo sapiens
gaggattccgtccgaccggaagcatctttaaacttcagtaaatgcattgtgtgcttgggagtccactcattctcttctcctcaacttaaaaaattctatctgttcttcaagaactggctattccatgaagctgtccgtgtttgttttggttcttgctgatctatttcccagttgttcaaacttttccaacacttaaacagtctgctgtatatttagacactgattttgtgtcatttgtgtcttcattacttaatgggttcattatgtagattatgacagcagagatctctttcaaaccctg

SEQ ID NO: 206763 - DNA, 878 bp, Homo sapiens
ctgcaaagtccattttgtggtgtcaggtaaaagattcacaagttccagggattcagaccgggatatctttggaggccattattctgcctaccatagggtctcagagatcctcctcattgcttccctctcccacccaacctaggggagtgggggtgtgcaatggtatttctgacccagacgggccaagcaggggagtcagaaaggggcccttgcctggtgttgcacagaagagggagaggatgttctgtgcctgagggtagaccaggaaggctgcctggaggagggagctgtatcctaaaggatgctcaggagctggcattgaggccagtggcatagcctgcacaaatacaggaggacctggggaggccaggggtggggctgggggtattgggtggggctggccgcattctccgtcttaaccagctcgctcctaggtgcttttgtggcttctgcactctaccagcttggagccaggggcctcattctctcttgcagtaaaatgaggctgatgactgagcctaggagttgctgggcatctggtctgctgattaccaccttggtgcccaatgtctgcctgcctatccactgctttcaaacaaggaggctgcctgacaccacccagggggacgcctcccacccttgcccagcctcagccaatctcctctttctcttcttcagagctggagttgtgccctcctatcctctctctgcccaccccatcactgctgtacaccctgccccttggcacttcggccccggacttgctcctcctggcaggcctgggtgcttgtgaagccgggtgccagagggcccagcacggcacggcctttgattctgttttctgtaaatcgacgacaataaattctctttttccttca

SEQ ID NO: 206764 - DNA, 412 bp, Homo sapiens
gcctggaggacagagaaattaatattaaatatgaacaggctgataacgactttttattttgcaagtagtcttcttttcaaattttattagaaacaagatttcctcattgactccacgataatttccagagtcctcaaaagccgtgactgaagtatgagtatgttatacaagtgattgtttttagctttgaaaagtaaaacatgctcattgcagcaacagccataaagactagtacagtgttgtacaaacaagttaaaaggcccccaccccaaggcagccctgttactcctttagcccgtgcattttgttttttgtttcaggcttttgtatgcactcaaacatacacattaatttcgctagctctgcactggtcattttcaaaactgtaattgaaagtcactctgtaatactg

SEQ ID NO: 206765 - DNA, 803 bp, Homo sapiens
cattataccagggaatcatgagaacttttctaggaatcagcatttgtatactgctgtatgttgaggttgaagttaggggaatatcccagtacgttttatgatgataacataactttaatgctccaacctgagaaagataaaatagactaagatgaccattgaatgcaaacagaaagttctaaatgaacaattaagcagactgaattcagtcctgtgttgaaataataataaacaattctgtttcagaaatgtaaaatagtttaataccagaaattcaatcaatataattagctaataatatatttgcatcagccaactaatgctacaatgttgtataacaggcaattataaaatctcagcagcatgcaccagaaagcatttgttgagtgtcagtgtgttggctggagtttcattgacctaggctggcctcatctggagaggctctgctccacatggctctctcatcttctttggagcagaagaatgtcgagcccagatttggagctagcaaagccatattcttctcatgatgatggcagaggtgtgagagacaaaaaaaacattcaaaggctctgccggcacagtttcagaactggtacactgtcatttctgcctcactctattggccaaaaatagttataagactgaatccagtcaagggttggagaaataatactcttcccttttaaatgggaggaactgtaaagtcacatgagaggggtgaaaaattaggacctgatatggaaggatgtgtgtcccttccaactctcaagttgaaatgttacctccaatgttggtgatgg

SEQ ID NO: 206766 - DNA, 580 bp, Homo sapiens
ctgttgatagaacctaacagtgacccagctatgaaaggagaaattttgtttccagggcctaacctcagcatcagagaataaattatagaaagtatggaagtggagctaaaagacaacaggtaaatgacatctctggtttaatcctacctttaatcgtataaagattaatcagtgattttaggtgactttagcctaatccgtccattattaaattctcagtgtttaatctaatggttttaacatccattggttactgttacctagataatttattattttattagtggccacaacacagaaatttcctgattttaatatcctttatgcatttattagctggaattctataaagaagaacattccctcatcaactatttggttattttgaaatacagtttgtacaggaaaggcaggaaagatcttgattatttctctttatcatttcagagttgggttgggtacagtggctcatacctgtaatcctagcaccttgggaggttgaggtgggagaatggcttgagcccaggagttcaagacagtgtgttcaacgtagtgagacctcatctctactaaaaataaa

SEQ ID NO: 206767 - DNA, 214 bp, Homo sapiens
gaatgatgtcctctaaaaattcctgtgttgaagtcctaatggccaatacctcaaaatgtgaccttactaggaaagagagcctttaaagaggtaatcaagttataagaaggtcactagggtgggccctaatccaatatgactggcatctttataaaaaggggaaatttggacagggcgcggtggctcacgcctgtaatcccagcactttggaagg

SEQ ID NO: 206768 - DNA, 409 bp, Homo sapiens
ctatttccctcatcaaacttctatagctcaaattctcaaattcagacacttctcaattaaaggccacattaaaatgcaaataatatgtgggaccgtaatcacactttagcctcagcaacacacattatctcttttaattcacacacagccattttcaacacagataaaaaaactgaggcttagaaagcttaaatgattggctcaagataacacagttcttaagtgggaaacccaagcttcaagccaaagccttcaaaatttcaatcttagagtaatttaattgcctcaaattagccttaacagggggcagaatcccaaaagaaagcaaaagaggaagggggaaggtcaaagaaagtatggtcctggagctgggaatgctgccaaggggaagatgaaaagaatgaaaaag

SEQ ID NO: 206769 - DNA, 525 bp, Homo sapiens
ctcctaaagtataggacttaggtctgattcatttttgtacctctagagccaaacatggtgtattagtttgctcagactgccattattaatacaatatcacaggctgagtagtttaaacaacgaacatttattttcttacagttctggatgctggaagttccagatcaaagcccagcagagttggtttctagtgaggagtctgttcctggcatgtagagagctgccttctagctatgttctcacgtctttcctcaatgcatatgtgaagacagaggtcaggccagggggagggagagagggctctctggtgtctcttcttataaggacagtaatcccacatgtggtcaaggccctacccttatgatctaatttaaccttaattacttccttattggtcctatctccaaatgaagtcacactggggattagggcttcaatatatgaattttggggggacacagttcagcctataacacatggtcaatcatgatttaagctgatttggaaaaaattaagtctcaattg

SEQ ID NO: 206770 - DNA, 261 bp, Homo sapiens
  misc_feature (26)..(26): n is a, c, g, or t
atctaaaggatccaccttagtcgtcngaagggcttcagagtaattccatttgcaaggaactcaggtcctttcagcacactggattgagagtgttgaactggaaagtagtactggacataacaatctgcttctccccagactgttgcctgaagaggggctagccctttaaccatctctatatggatctcaaagcagtgctccatcagtccatttcctcggtcctctgccatagcaacagatgctgcagttggctggtccacg

SEQ ID NO: 206771 - DNA, 404 bp, Homo sapiens
gttattccttaaagctaaatcctagaagtagtagaactcttggttcaaaaagtatgtacacttttcaggcttttgatacattttatcaaaatcccttccatcaggtcttcctcttgaggcaggaaaatagggtctggaggcagggaacataaggccaattcacacttcagctatgacaggaaatatcctctccatgaggcatacaccaagtaaatgactttgtaactttacttcatcctcttcatttacacagggcatacatgaagtaaccaatggaatcctctagggggtatttaaactcccaaaaattctgtaacggggcccttgagcccctatgcttgggtccattcccaaactgtggagtgtactttcattttcaataaatttctgcttttgttgcttca

SEQ ID NO: 206772 - DNA, 317 bp, Homo sapiens
gttcagtcatagctacatgtacgcacaccaatgtggactaacactaaactgttatgttggaataaatgactcatttttttcagccaccagcatgcctgatggttaaacaatagaccagtctaatatttgcatggcacaaacagctaagttatttttgcctttaggacaatgttggggcactgcttacaaattcttagtgatcaatctctgaatgtttgagccaattgctttcctggagaaaaataatgtagaacaatttatttatttttttttttgagaaggggtctcactgtgtagcccaggctggagtgcagtag

SEQ ID NO: 206773 - DNA, 380 bp, Homo sapiens
tggagaaggtcccctcatttggtccataaaatacatacacataaacagttaaagaacagcagaaggcatgtagtatgagtaagtatccaggggtggtagaagcattcagtttaggagttcagaaaaaggagcagtcattatcagaagtatggaaggagaatgggagctagagagctagacctgggacacctgggacatgggtagtaaaggatttaacgacaaatcaagtttgagttctcgccttacaccaatcagtgggagagggggtcgcatgatgacacaatcagatttgctgaacagaattagttggaaggggaagcagtgttagaggcagggtaacaataatccagatgagagagatgatgactttctgaagtact

SEQ ID NO: 206774 - DNA, 231 bp, Homo sapiens
agtcggcagtttccagtcaagtcctattctctttcagttgagttttacaaaaatccctctcttgtatgtagaacaatctcatttctgccattcccaagtcctcagggtgcatctcattgtcgtcttcctttacatcctacagtaggtaccactaaatattacgtgattgattatctcccagctccagtataaaatccttaatggcgtaggctacagaaacatttattttat

SEQ ID NO: 206775 - DNA, 399 bp, Homo sapiens
gatatgggtctcatagagcctctcctccaatacacagcttttaatgagaagagcaaagggcttatgaattgaacttccatggaaaatcttcttctcctgactcttcaaacacctctcttcaatgcctgtacactccacatctcccctccagctagtctgggggttggaggaggcctgaggacttcccagtcctaaggagcacaaaggatagcagacaagcaaaaaaggacagggaagtaggtcccttagtcttgctctcatctgagcccttggtggaaagggcagaaaagatttctaagcctccctatggcccattccttccagggatgtggagcaaaagtccagtattaaagagcaaagccatcaccaccctctcatgtcttctgggagacatgcatt

SEQ ID NO: 206776 - DNA, 370 bp, Homo sapiens
agtgatcaccttttgggggtccgaaaatatcctgagattttaccttcttattcttttaaaataaatagtgcttactctaaaaaaatgtgaagactaaatttttcttctctgaaatatatgcttattcttgtttatgtagtcttggacagttggaaatcaatgcttctattacaaaatataggaaatgaaaaggagaagttgtaggaaagagattaatcatgtcttagatatgctaaataaataagtatatacaagggatataaagtaaatgttgtcttgttggtggttacagatgtagggctggaaattgggagatatttaaaggcttttggtatacaagtgagttacaaacatgtatgtagtagttgaa

SEQ ID NO: 206777 - DNA, 465 bp, Homo sapiens
caaggatttgatgcaaattagtaggagggattatttagtaaatattatttgagaataaaattggctaatcatttgcaaaagagcagtgcattcctatctcactcttggagcaaatgcaaaaagccccaaagagtacatagaataatagtgagcattcatgtacccatcttctggcctaaatcatcataaccttggtggaagctttccgtgcccctcccaaatcacattctcccatggcttctgagaagtaagcattatcttaatgctgatgtttaacattctcatgaatccttttataattccacaatataagtatgtacagtattcccccttatctctggttggccttcacagtttcagttacccaaggtacagtacaataagacattttgagagagagagaggctacattcatctaagttttattacaatacattttataattgttctattttattatgtttg

SEQ ID NO: 206778 - DNA, 183 bp, Homo sapiens
ctgatcttgtggaagaatacaattgaccattgaacaattcgtgggttaaagggcagcaacccccgtgcagctgaaaatccatagataacctttgactccccaaaaacttaactactaatagtctactgttgaccagaaaccttgctgatgacataaacagttaattaacacatacttggtcta

SEQ ID NO: 206779 - DNA, 403 bp, Homo sapiens
atctgtttttattcaaagcctacgggtttcaatgttaatctcatctataagaatttcttcacagaaacatgtttgaccaaatatctgggtaccatgacctagccaagttcacacataaaattagtcatcatgggtggtcaattgagagttgtcatggcagctgtgcaccatcagcagggacctaagatctttcagtatttttttatttttatttttttgagatggggtcttgctatgtttcccaggctggtctcaaactcctgagctcaagtgatcttccacctcatccttccaaattgttgagatgtcaggtgtgaaccaccatacctggccctttcaatatttgtatttcatcatttttaatacatgccttttatcttctaggttgcctcacggtcacaaa

SEQ ID NO: 206780 - DNA, 269 bp, Homo sapiens
atctgagttttactagtatcatctctctgaaagacattttacagcgccaaaagaaaactgacttgtcatgttctgataaagtttgttaaatctaaaaatgttttctataggaaaataataaaggaaaactaaatgtggagcattaggagtccatgttcatgcttcacagacactgacttgttgagccatcttaatcactgacagttgagtcagatgctcttacctgaaattctctgacagaaaaacaaaggctatagtgttttttcaag

SEQ ID NO: 206781 - DNA, 586 bp, Homo sapiens
cctggtcttggaagaatatccctgtgatacatttagcagttcagcagctttaaggcagacatttctatagctctaattgcagccattttagttcctaacaaacaggtccagcccaggcccccaatctgcatcagttacttctggaaaaggagtcaggatctgcttcttggagggtagagtcacacacatacaaatgcacacgtgaatctctccatggcgtttagtctagttctgtggttctcaaccatcccctcccaacgaacccaaccccagtgcagttttacactcctcccactggactccaccctcaccctgtacacaccggatatttggcaatgcctggagatacttttggttgtcacaactgttggggagctgctactggcctctagaggccaaggatgctgctaaaagtcctacaatgccccctacaacaaaaaaattacgtggcccaaaatgtcaatagtgctgaggttgaggagccttggtctagtgaatgctgttaaacacacacacaactgaaattacttaggattgaattgaccttggagattatggcaaagtaatgaaattgaaggtattctct

SEQ ID NO: 206782 - DNA, 523 bp, Homo sapiens
gtcagagaagatgccctggcagggtcactagaggagtggagggaagggcacttcgtaccgtggcacttcatatttgggagcaaagaaagcatccaccacataaggcgcttttcacaaagttgctctggttctggaaagctgtttgaccaagcgaggtgaacctagatagcctcaccctttcaccctcaagttggactcacagtggcaggctctggagccacatttcatgtgacctttttatgtaaagtccttcagcaaattgatgaggaagacatggcaaaatattccacatgaatagacatttccttgtgtgggcatttgggttctacagttttactgttataaaaagtatttgctggtttctttattttaatttctattaactaaagttatcagctcaaaagatagaaacaacagaagtataaatgaaagcatctttgattttgaggaacttttgagaggacctatctgactcattaaatcttttttgttctttagtactcccacaggattttttaaaatc

SEQ ID NO: 206783 - DNA, 622 bp, Homo sapiens
ggataatgaagctgtgagaggcaaaaaagaaagaaagctacttttattttgttttgttttgttttgtttttttgaggcggagtctcactctgtcgcccagtctggagtgcagtggcgggatctgggctcactgcaacctccacttcccaagttcaagccattctcctgcctcagcctcccaagtagctgggactacaggtgtgtgccaccacgcccggctaattttttgtatttttagtagagacgaggtttcaccgtgttagtcaggatggtcttgatctcctgacttcgtgatccacctgcctcggcctcccaaagtggtaggattacaggcatgagccaccttgcccggcccacaaagctacttttaataagtcattgcttatttagcatcatagccctcaagggtatccaaaaatctaatgcaaacattaataattaaaatgaaattagatctaaaaataggattagacatcaaaatagacctgtgacattgacataaaagtagaacaaagcgtgttgtcttagtccattttccactgctataacagaataccacagactgggtaatttattttaaaaaaggaaatttatttctcatagttctggaggctgggaagtc

SEQ ID NO: 206784 - DNA, 393 bp, Homo sapiens
actcctcacagacaacatggatagcaagtgtagctagatgataaattgcttagaagtcatactagtgcagttacttccctggtttaaacaagtacttgggtttaaatgcagttcctggttacctttaagtactgcaatttaaaacaaacacttgaaggctacagtagctttctagattgttcccaaagccacactgagatcaaaggcagtgttgttctcccagactggcgttcaggcagaagcacctggttaaaccagttccatcggctatgggatcggcccagcccaagatgtttatacaactttctgactcttgggggaaggcaagtctacttgatttttctgctgcttctgtgagtctcagaagtttccgaagctttacctgtcaggtag

SEQ ID NO: 206785 - DNA, 370 bp, Homo sapiens
aagttttcccctctctgggcctctgttttctcatctgtgaaatggggccagtagtagatctattgcgatgcctaaagaagctgctccacctactcacgcctgtaatcccagcactctgggaggctgaggcgggcggatcacgaggtcaggagatcgagaccatcctggctaacacggtgaaaccccatccctactaaaaaatacaaaaaattagccgggcgtggtggcgggcgcatgtagtccctagctactcgggaggctgaggcaggagaatggtgtgaacccgggaggcggatgttgcagggagccgggattgcgccactgcactctggcctgggcacggagctagactccgtctcaaaaaaaaaaa

SEQ ID NO: 206786 - DNA, 698 bp, Homo sapiens
gaaagagagaaagccaaaatgttcatgcccttttttgagccacttttttcaatgagttggctactgtctccctagctaaacacatctcagccaagcccagaaccagtatggaaggtcactaaccaaagctgtgggtaaatggaggcatggaaatctgtgacctttaatgcaatcatctacaataacaagccaatgaccatgaagctggacagagaaatagattcctgggaggaagaatagcaaaatgtctggagtaagaggaagtagggtatttcagggaactcagcaaacagtgtgatgacaaaatgaaagcacagtcatgcaatcagcacctgggtaaatatttaggttggagtctgtgttgacccagtctgcaggtaaccctcagcctggcccagcatttcactgccctcctactacttacccagaaacaactctcctgtattgattaagcaggaaagaggaaactctcctggaagacacaagggcagatccaagcaggagctaaggttttccagaatgtggtcttaggtctgtgaatggcttttggacagaggcacagctgaacattcccatggtttctgtgactttagaatcactaccacctcttgactatgcacctcttgactaatttctatttctcaaattatagaataaaaaatgctgattctaaggataaaaacacaacaaataatcca

SEQ ID NO: 206787 - DNA, 139 bp, Homo sapiens
tcctagaactgattaatgaattcagcagagtttcaggatacaaaattaatgtacacaaatcagtagctctgctatacaccaacagcagcaaccaaggtgagaatcaaatcaagaactcactccttttcacaatagttgc

SEQ ID NO: 206788 - DNA, 380 bp, Homo sapiens
acttaccattgtgttacagttgcccacagtatccagtacagtaacatgctggagaggtttgtagcctcagagcggcaggctataccacatagcctatgtgtgcagcaggctataccatctaggtttgttactctgaagctgaacctaaagatttagagctgactggacaaatataaaggatgtcaaaaacagtgaccactgacatgccattcaaggcacatggaagacagctcaggcttgaatgcctctaaactgctcattggtaagatcagctatcagtgagacgcagtgtaagtcagcattattcactgagcctgctatgaccttaaaatcattgctcctggggtatgttcacccaccaattagtttatatgctcact

SEQ ID NO: 206789 - DNA, 595 bp, Homo sapiens
attagccgagtgtggtggcacacacctgtaatcccagctacttgggaggctgaggcatgagaatctcttgaacctgggaggtgaaggttgcagtgggccaagattgtgccactgcactccagcctgggtgacagagtaagatcctgtcttaaaaacaaacaaacaaacaaaaaaacatgtttgtaaaatcctcactcttctgtaggttggcttaaaatgattaacactactgagggactgtgatgttgcagacattgtgggtatccacacagcagcccagaaacatcaccattccatgtcacaggccaaaaggcagagattcagtgagcttaaacaactgtaccaagatcacctgttaagtggtataactgggtctcaaattcaggtgtgtctgactctaaaactcacaccttttttccagtctgacctgccacttgaattaagtggctccacggttaacttttttatccatgatgttgaaaccccattctgaggactttctccttgttcaatacgtaagaacgaggtaagggaataaagatggctacaaattctttgacattccttccatggagatgtggggtctaactcccct

SEQ ID NO: 206790 - DNA, 394 bp, Homo sapiens
atagctgattctagagtacccctccgtgactccatcattcgcaggcgaagacgtgcctcatcctcccagcttctatgctgctcctttcagatcccttaccctgtccccattttcatgacacgggctctccagccaggaagaagacactgtttctcactctctctctttcccatctttgcctgtccctctcgctgtgtaacttcccttataactcagcctgaggccagtgctagaaaggcacatcacctgacttattctgtgcctgattctacctagatcagtgcaaccactggcttctcagggggacccttgagtactgggcactgatgaactgctgccaacacagtcatcatttctgccattaaaaggtcctaagtcctctccagtggcaggg

SEQ ID NO: 206791 - DNA, 489 bp, Homo sapiens
gattttgggtcccagatcctctactctggattttaagttttatacatttcctctgcaatacttcagctaaggcagcaaaagcggaggtctccatacaacgaaagtttgtgtagagtttcagtcttgttacttagtcaccagtatattggggttttctaatgaaacttttgaagggcaaagtgtttccctgggcctgagaagttacctgcattgaatcaaataaacacatgcctggggcaatccttggatctttcttcattgttgaccaaatggttgaaatactatcacacagtttaaaatgcctgtgggagcttcagataccttctcggcacctgaatggtggtcactcttgtttattctttggatattaccactttctttgacacttgtgatttatattaaaaatagttcattacctaccttcccacagagcccctccctaaggggtgatccacatctaaaaataaaatactcattatgcagtgaata

SEQ ID NO: 206792 - DNA, 418 bp, Homo sapiens
ctcagtaggaatcctatgaaaaagtttgttgttaattaaaagacgtaatattcaagaagtattatggacattacagttattaagctaggcaataaatctccttgacccataaattctcatttttgaattcatatgtcacctactttgtgtaataattgtccttatatgttttctcttgcatcatcaactgttattttttttcagagagtttcactttgttgtccaggctggagtaagactgtgtctcaaaaaaacaaacaggccaggcgtggtggctcacgcctgtaatcccagcactttgggaggccaaggtgctggaattacaggcatgagccaccgtgccaggccttgcttcatccactgttacagttgtattctaattcccctatgtatatatggatacattgggtctttgttt

SEQ ID NO: 206793 - DNA, 659 bp, Homo sapiens
gctactttgaatatttgaaagttcacagcctggcagctagtgagggtcctccctagtataagcattacagagcaaattgaccatgcctgcaggaagatttaatacagcagagcagcaagccttttaatgcctaaaaattctaaagttatacgtattagaaagatgtatatttaatttagctcatgtctttaagacaaaggcgtctagtggatatttagtaaatacctgaaggaaggaaatacaataccagtattgcagatgtctgtaaatcccaagtaattgaaatcttcaggtcaaaggaatagtgattgcttctaagaaagagtcaagttcaaagaagtgtttgctaattaagagaactgaattactccaggcaaaccaaagaaggcaatggaaaggaggaaaactatacaaatattttcagggtgtggagatgggtgtttcagaaatcaaatatggaaagaaaacaaaaggagaacagaaagagttatggtatcagcaatgggaaatggaagagacaaattagcctgaactgttcagtgtcaatcaccagatacgccaggagtagggagctgtctgacttgccctaagtggagtggtagagctttagaagtaactgttgtggctataagagaacatgaatttatcaagggacaaag

SEQ ID NO: 206794 - DNA, 191 bp, Homo sapiens
atcaggtaattcttatttggaaagtacgacctttgaaatcttgaacaaaactcagtgaaaagtccattttaaatcaaatcaacaatcagacacaaaatttgagatacaccaggatgatcttcggaaattatctaaaaattcatttttttccatatctatcaatattttgatgatgccaaaatttttcccta

SEQ ID NO: 206795 - DNA, 398 bp, Homo sapiens
aacgtcaccaccatcaatcaccaccacccaattcctactttttacagaaataaccgctgtttattcattatgggttgtattttttctatgcagctgtgtacatgtttacatacaagattttatcttggctgggtgctgtggcttgcgcctgtaatcccagcactttgggaggctgaggtgggcagatcaccaggtcaggagttcaagactaacctggtcaacatggtgaaacccccacctctactaaaaatacaaaaattagcctggcatggtgtcaggcccctgtaattccagctactcggggggctgaggcaggagaatcgcttgaacccgagaggcgaaggttgcagtgagccgagatcactctagcctgggcaacaagaatgaaacttagtcta

SEQ ID NO: 206796 - DNA, 398 bp, Homo sapiens
gctgcatctataaagaaaggatatggaacctcagagagcctggaaagcctatccgagctctcatagttactaacaggaaaagattggattcaggctcaggtctgagccactcccaaacccattctctttcccattccgtcaaatttcctgtgggactcaaagtttcagatggaaacccctaagtctccaaaaaacaaaatccttgtctaaaggcttttactagtggtggtcaacctgatgcatatcagaattactcagaaaacattttaaaaccatagatttaaggaccccatctctatcttgatgatttggactatccagtgggttaggccaccaagcatgtgtccaaggggccttggggatataagcaagcaagcctgggccctgaagtcccacct

SEQ ID NO: 206797 - DNA, 598 bp, Homo sapiens
aatgagacagctcaataaagataggaaatattttttcagttacttaaagagaaaataatactggtggttctccctgtaaagaggtagaattgccaaaaaatgcagaattgatcagcaaaacccagctataaagaaagggcaaaaggaactttattttagtgccttatcccaatatccttttatttagttttttgattaacatgatgtgtgcctattttcagaatcagtgactgccagctgcagctcttgacattatcaagtgagctctggaaaattctgggtagctctttcctattctctcacatgcccaaagaactaagtaattttggtcctaactcttactattctattcttcttcacatgaaatcacattgtttcatactgaaaaccaggatggctattagttcttattaatctgtcattattaggaatgagaggatataaaagaggtatataaaatgtatgagtgtagagcttttgtctaaggcaattactctgtgaatctgaggtgagacatttcttaaattttgaattgtggagctctccattttttgataaattatattcatataaacattataataaataacactgctta

SEQ ID NO: 206798 - DNA, 192 bp, Homo sapiens
atctttttggattctctactcaagacatacaccaagcctcagaaggcagaagacctttatggacaagtaattcaggcagtaaagtaatagattgtaacaggatcctcaataaaatttgatgcagaacaaggagactctgaataggaatcaagaaccaaggccaggcaatctgagactgtattaactgctgtg

SEQ ID NO: 206799 - DNA, 310 bp, Homo sapiens
ctatgcccatgtctatttatcttcttataatttttgcttaatgaaaactaatgatccattatctgctgcataagtatttatgtttgctttctctttattatgccttatggcttttgtgttaaaaagctattgatttatttaatattttggaaggattgaattttaccctatctaatatcaagatcatgactcttgattcctttttgttttcacttgtttaatatatctttcttctatctttattttaaacacaagaagagctttgctttcagtttctattttacatagtctacaatcggattttacttat

SEQ ID NO: 206800 - DNA, 575 bp, Homo sapiens
atagaaataccccacttctggtaccaattttctgtattagtctgttctcacattcctataaataaatacctgagactggataatatataaagaaaagaggttcaattggctcatggttccataggctgtatggaaagcatggcagcatctgcttttggggaagcctcaggaaaaagcaggagcaggtgtcttacatggcagaagcaggaccaaaggggtggggaagatgttacacactttttaaatcaaccagatcttgtgagaactcacactatacagtaccaaaggggggatggtgcaactctgccctcatgatccagtcacctcccaccagacatcacctccaacactggggattacaatttgacatgagatttggtggggacacagatccaaatcatatcaggagccaaagcaaagatgaaagctggcaatgcctgttttcttgttggagtaacctcacctttttgccactccagacaaaaaaagaaaaacccatgtgcccatgagccttttgaaccaggcagagtaagaaatctacctagcaataaccaataaaatgtctttaaagctga

SEQ ID NO: 206801 - DNA, 292 bp, Homo sapiens
tgccattccatgttaaagtggaagataaacataccatagggaaaaacaattctactcctacatgtattacctgaaattaacccaaaacatgcatattaagagaaacactggttaacaatagccaaaatgctcacttagagcagagtgaataaactctggtatagtcacaaaataaaatatcccacatcaactaaaaaacaaaaaaatgaaccacagctttataatgttttattaaggaagcctgatgtatacaaaattatatctcctggatgcatccatgaatataaagctc

SEQ ID NO: 206802 - DNA, 368 bp, Homo sapiens
atgatctggctgctaggaatagaaaatgatgcccttgctgcggaaaacaatttggttgttcctcacagaatgagcattgggtgaaaaatgaaatcaagatggaaatgtaaaaaatttcttcgaactggatgacacaacctatcaagacctctgggatacagcaaaggcactgctaagagcaaagtttgcagtcctaaaaacctacatcaaaaagtctgaaagagcacaaacagacaatctaagttcacatctcagggaactagagaagcaggaacaagccaaacccaatcccagcaaacacaggaaataacaaagatcagagaagaactaaatgaaattgacacaaaaacaacaacaacaaatacaaa

SEQ ID NO: 206803 - DNA, 408 bp, Homo sapiens
ccagaagaatctctttgggaaaagacagtgtacagttgtggaagagcccccttgcgcaaaacaaatgttctcttgcctaaaattcatccattaaggaaagctatccttaaaaaaaaatgggccaggcgcagtggcccacacctataatcccagcactttggaaggccgaggtgagtggatcacctgaggtcaggagttcaagaccagcctggccaacatggtaaaacatcacctctactaaaaatgcaaaaattagccaggcgtggtggcaggcgcctgtaatcccagctacttgggaggctgaggcaggagaatctcttgaacccgggaagctgaggttgcagtgagccatgattgcaccattgcattccagcctgggcgacaagagtgaaactccgcctcaaaaaa

SEQ ID NO: 206804 - DNA, 413 bp, Homo sapiens
ttagatttatttaggagaaattgcacttggtgaaccactttctctttaattattagcattaactttatcatttttgtttcaagatgtcacagctattgttcagcactagaaattatataaattattagctgaagatgatgactggcaacatttatgtctgttcctcctcttaaatttcttgttcagaaagtctgttgttgtaaacatccccgactggaagctgtaagacacagctaagctttcagtcagatgtttgctgctaccggctattcacagacatcctcttgatataattctgtcccggagtggagttgaggaggctataaaatgtgtgggaaaacctcagaaatctttagctgcattcttttactgcactgacagtgcacgtattatgatagttgaatgtagggtgc

SEQ ID NO: 206805 - DNA, 340 bp, Homo sapiens
ggatggatggatggatggatggatggatggatagatacgtaaaaatttagaaattaaaaaaatgtatcttgggaagagagtcttcaagatagtggggaaatgaattttgagtaaagactggctaagaagttgtagccagactacactagtcatgttttggctagagaagggagccttatttaaagaagggcaaccataaggaaaaacagagttaggtagctgctctcatcaaaggcctataggctcgaatgcaggcctggaaagataaataggacatgttgaaggaagaaatgatagcgtttgattatttttgtggtgattttttttttgtaaaggtgat

SEQ ID NO: 206806 - DNA, 591 bp, Homo sapiens
aaggaaaattatgcccagagtgactctgttctatggcctgggagggaaactggggtgaatgtcctaaattgttgtctttgaaaagaccgtttctaaaattcgtggcccaacgtagccttttactggttaactctaagtatttaagatgttctccaagcgttttaactgaagacactgcgtcttattttgtcttcattgaatttcgaagaagcatctgtagtaagaatatttacacggtttttctaggtaattgtttgtctcctggaccatagagtaccttaaatacgttacattatataatttactaatagtaatacaattttatgaagatatctagaggtaacaaattcaagattatgtatttctatctctggaataataattactgttttcatttgtaaaagagattgtaagggaaataaaatgtaaagttaaagctaaatgtcattgtattctatgcttgctgtaaggtcaaaatatgtgatcctgatggaatatggtaatatccctttgctctcctccgcacactgaggaaccttttcctgggactaatagacccccctaatgggatgcagacagtgcctcagagta

SEQ ID NO: 206807 - DNA, 462 bp, Homo sapiens
gctgacctagaggatcccggctatcacattatccataaaaaaaatcaacaaaatggattaaagatttaaacctaagaccttaaactatgaaactaccacaagaaaacattagggaaaatttccaggacattggtttgggcacaaattgtttgagtaatacccaagaaacaggggccacaagcaaaaatgaacaaatgtgatcacttcaagttgaaaggcttctgtaccacaacagaaacaaccaacaaagtaaagagagagaatgggagaaaatatttacaaactacccatctgataatgtgatagcggcatcacattacctggctccaaaacatactataaagctgtaatgagcaaaacaggatgatactgatataaaaacagataaacaggtcaaagtatccagtgagcccagtaataaatccatgaacctagagccatgggattttcaacaaagatgtc

SEQ ID NO: 206808 - DNA, 400 bp, Homo sapiens
agaaacgccgcgctcaggtgaatgagaaatgttctgatacaggaaagaggagttcgtgtttctttcagaaggtgaccgttttcctccttctgaggtcacgagctgtccgtccgatgcccagaattccgaggcctgatgtggcgtgtttccggtagctgggctcctcggagagctgtgggaagaggcgcgggcgaccgggggcgtcagcgagccctgtcttcgcctgccttcgccggcgtggactcttcccagtgcccgtcttcccccgcgaagtaatagtgtcctgtatttcctgactgtaagaagaatagtgcttttaaaaaatgcctgctccctgtaatagcagcagtagttcgagagtacatacatgtttataaaagaaacttaaactctcattctt

SEQ ID NO: 206809 - DNA, 354 bp, Homo sapiens
ggggtgggtggccagggctgtctagagcaaaactacccagcagtgctgaagcagcatgcagcagctgagtccatttctaagaagtgagtggtgagttgtcagggcgcctgagggccaaagaaggaaagatggggctctggcaggaagccccagacattcagcccaaaggccgacctgcctccagccagtcgggcctgcccggcctcccctagcgggactctgctccctgaatccagtctctggtggccagctgcctcccaggacaggtgctgaagacaatgccgagtctggcccacctgtctaacagtcaccaacacttcccgaagtaccctaaagaacagaggacgccttggg

SEQ ID NO: 206810 - DNA, 236 bp, Homo sapiens
acatgactcattgtagccaagttgactcctgctcctcatagttgttatctattagtctggttgtttggttttgtacctcagattccatataggttaggtgctctatcagaaatgcatatggctgcaagttattgaaaagccactttagcaacacctaatcaaacagaggtttatttttctcacataagtctggtggtggctggacacagtggctcatgcctgtaatcccagcactt

SEQ ID NO: 206811 - DNA, 283 bp, Homo sapiens
gtcccatacagtgctgtatgctacaggctcatcagggccacatggcacccctcagggaagtcatagttccagtatagatggtcctgttcaatgctagcattaatgctaattataaaggactatacattattaataacactcatgtcttatctaataacaacaataaaagtaacttgccacttaccgaacatctattatatgccaagacataggcattttaataggcattttatttattcttcaagacccttggatgtttcaataaaggatttacataaatgta

SEQ ID NO: 206812 - DNA, 375 bp, Homo sapiens
gggaggagccccaggctgtggatgtctctgggggaaccttggttgagcaacggccagaggagctcctgaggccaagcggtatctgtcgcctccctacctttgggcgtcttctggtcgccaatgtgctgcaggtcatggctccggaatcaaattgggctcaaattgtgtgagctccaacgcagtggagcctggccctactcccaccttcacctcgtggatctcggagctgcaggatggctctgcccaccgcaccctaagctggcctcgcttggggctggcatcggtggacagcatgttctgggcgtctctgctcctttctgctggtgcctgtgcctgtgctggccgcccactcatagatatcaaagccacaggacg

SEQ ID NO: 206813 - DNA, 767 bp, Homo sapiens
aaagtaagcaaaactgtctaaaatcatattgttactcttctaacttttccattagaatattcaataccagtctgtgaaactggatatataactttccttatgcaaacaaaaaactagctgaatatcatactactatgcacctgagtatctgttatctgaaagatctttggatcttttataaacatcaatcaatgctgtgcagacagagctaagagggaaaggcaattagatactgtgaaaaaatggaggcaatcagaagaaatacagtccatggtggcagtgacagagctaagcaggaggtatggataatctgggtaagtgccatggaaaaataaatatcatgattgaacttgaggcaaatggaaacagttcaaattggcttcatacactactctgtggaacatatgatgtccatatgtccattaccaacaaactgaaacatggaaaataacaaaagccgatgctatgatggctataagaacacacccaatgccagtctctaccacaccgcagcagcataacttactacagctgccaggtaagttggctaagaagtcagaagcaataagaaaaaaaggagaaagaactaactataaactgttctctttccctacagaagacaaagttgggatctatactagaaagtagaatgtagcaacgataaaggctgaaagtaaagcacaattttttctctgtagacagtttctaaaagtataaactactttggaattaaagaaggcaacattttatccaaaactacaaacgat

SEQ ID NO: 206814 - DNA, 809 bp, Homo sapiens
cgctctgctccgaacccattgtatacggccggctgcggactcccaggccgggccgtggcgggggccccgggacccccgagtgcccctccggctggtcccgcgggccgcggcatctccgccgccgccttcctcgcggcggcggcgagggcgccctttcctccccgcgcgggtgacggggacgcacccccaccccggggcgccccttcgcggggggagagccgggcccgagcaagtcgaggcaggaaagggccgccacggactgcccggcccgccgatcgtttttattatcgagattattattaaaagggggcggggaccccaggacgcgggggaggggctggatacgcaggtatttttattaaacagattattcctgaaataataatacgcgcaagatggctgaaggtggctgtgatgagagtgttggggttgggatttttttcttcctgttttttcttttttgatctgaggataaagctctgaggcgacagcggctgcggagaccctgcccgaagcgccctcccctcccttgagaagccgcgggcagacagacggacctcggaccgagcaacgggtgcgggcccgccccggacgcgtcgcctgggcagcagccggggaccgcgggctctcgcctttctgccgacttcttccaattctcatcttcttttattttttggacaggaccggggtgggtggagcagaggtggagagaaatcgggacttggcattttctccctctctctctcctaatttgttggaggccgccagccctccccttggaaaaaaaaaaatcccaccaaaaaaaaaaa

SEQ ID NO: 206815 - DNA, 411 bp, Homo sapiens
ctaactatccaaatctcacccacacactagggtccagataaagactcactgattaacagagatctgctcaaaccatcctaattcccaattcttcctttgtttaaactcctaaagtgtttatcctctttctcattcattttcaagtttaaccacacactgcctcacattttaatctgacctatatgacatctccctaactagaacacacacacacacatacacaaaagaatagaataccttgtacaagtagttctcaatcctagatcaggataacacataaaacttcaaaaaatacaggttcacaggccctacccttaaagatattgaatatattatgtcttatttagaacccatagatctgtatttaagttcccccaaaagattctaatagggagccaggattagaaacca

SEQ ID NO: 206816 - DNA, 775 bp, Homo sapiens
agatgatgctgtgccgcgtgtcgattgcatgtcagaagttacatgatctttacttgattcatgatgaggagatggccactgaaattggacagtgacagtcttttctgcccattgttcaattatattcgtctctttacattagaaagtatttggggtagtagtattttggtgctgtaagaaagttcattttctcatcaaccactcacctattggtttaacaccatttgttgatctttgagtatatcagtaatttcatcagggtttgcaaaataagactttaaattctattgttttacattattaattgatgttttttgataaggtagaacttgtgaaatgggactatttgtttgtctttaaatacagtctctataggaaagacaaaataaatacttaaatctcactctttaccatttttcaaagtgaagaactattccgttaaccacctcaaaagatgataaataaaaagggtatttttagttgtttcaactttttttttttttgagatggggtcttactctgttgcccaggctggtgtgctgtggtgcaatcatggtacaccgaagcctcagtctccctgggctcagatgattctcccacctcagcctgggactaaaggtgtacaccaccatggccagccaatttttttgtattttttgtagagatggggttttgccatattgcccagcctagcctcaaactcctgggctgaaggaatccacccgtctcggcctcccaaagtgctgggattacagacgcgaccacaatatccggc

SEQ ID NO: 206817 - DNA, 623 bp, Homo sapiens
ctgtaaaggttttttttttagtcttatgtgattttgtaggttatatagagcatctttctttcttactgtttaataagccaactaactaaaagaatacttttcacaggtactctagaagataatcactttaaggcattagcctaacattttgggaacctggagtagttttttgttattaatattttcttaaattgattatggtgctgtgatgtggatgtgttaagatttatactgtgtaaatgaatgactgtaaactgaagggctacatttaattaaattatcaaaacctgtgctataatcgccctttttaaggaaagagctattttctaactcattttactgaataacaaactcactgaacatatgtaaaaacttacctgtgagaaaattagtatttattgtatttgttgcgtcatgttataagattattatttaagcataagccattaacatgggtaatttcattttgtggctttaacgtaggtttccctacgtttcagataagaatgttgacccaaagaagtgcaggcttcaaatatatcactttgatttggaatgagttctctgaatatttaaataatatccaagttgtatacatttctaaagtaattactacattagat

SEQ ID NO: 206818 - DNA, 265 bp, Homo sapiens
gcttataagcacttggctgtcgaaatggaaagcagaagtacaaattaactgtgggatatttaatgcaccacagatatctacccaacacagaaggtaaccagtcaataactacctttttttcttttaacattaatctggagaataaaggcaaacagaaaaactattggaaaggagtggttaatatgcatatccccatattcccatcttatgaaccagcaggatgatttgcaagtaaaaaattaggtcaatctaaaatcatgatcca

SEQ ID NO: 206819 - DNA, 335 bp, Homo sapiens
tgatgcagtattttacctgtaatttacaagcaacctgacactttcatgttactggtgggtataaattgatataaaagggggcaatatctttggcaaaacctttcagaaaatataaaaattgcaaattttcatctaataattccacttttgcatgtgaaaaatcagtgtataataactttgtaatattaaataggtatatataggcatgttttataatagcaaaagattagaacgtgaaatatcaggtcactggttaactaattatgacacatccacaaaatagaatattatgtaatacaaaaagtgaagaatgtcttcatatacacacagatctg

SEQ ID NO: 206820 - DNA, 798 bp, Homo sapiens
ggccccgtcccggcctcgcgcacctgctcaggccatgatgagcttcggcggcgcggacgcgctgctgggcgccccgttcgcgccgctgcatggcggcggcagcctccactacgcgctagcccgaaagggtggcgcaggcgggacgcgctccgccgctggctcctccagcggcttccactcgtggacacggacgtccgtgagctccgtgtccgcctcgcccagccgcttccgtggcgcaggcgccgcctcaagcaccgactcgctggacacgctgagcaacgggccggagggctgcatggtggcggtggccacctcacgcagtgagaaggagcagctgcaggcgctgaacgaccgcttcgccgggtacatcgacaaggtgcggcagctggaggcgcacaaccgcagcctggagggcgaggctgcggcgctgcggcagcagcaggcgggccgctccgctatgggcgagctgtacgagcgcgaggtccgcgagatgcgcggcgcggtgctgcgcctgggcgcggcgcgcggtcagctacgcctggagcaggagcacctgctcgaggacatcgcgcacgtgcgccagcgcctagacgacgaggcccggcagcgagaggaggccgaggcggcggcccgcgcgctggcgcgcttcgcgcaggaggccgaggcggcgcgcgtggacctgcagaagaaggcgcaggcgctgcaggaggagtgcggctacctgcggcgccaccaccaggaagaggtgggcgagctgctcggccagatccagggctccggcgccgcgcaggcgcagat

SEQ ID NO: 206821 - DNA, 475 bp, Homo sapiens
tgggaatatgccgtttgagtgtgttttttaaaaaaagactgggatggagtttagggtagcggcaagagtgttactgaaacaatggatcatggaatagaagctggacaaaaggagacatgataaaaagaaggttgatagggtagaaaaaataaggcaacggttgaggtggtagtcaggaaggcctccctagaagtagataagtggaagctgagatccaaaaaatgagcagagaattggccaggggaatagggttaagtggagtgataagaaacagtgtcccaggaagagggaatagtgtctaaaaggtctggagctgaaaaacagcatgtacttgaagaaccaaaagatgatcaggattgatggaaaacagaatgtagaatggttggggagggtaggaatgctgagaaagagaatgctgggagatgaggcgtgagagccaggtagggccatgtggtgagggccacttcgtgggcag

SEQ ID NO: 206822 - DNA, 294 bp, Homo sapiens
  misc_feature (177)..(177): n is a, c, g, or t
  misc_feature (185)..(185): n is a, c, g, or t
  misc_feature (194)..(194): n is a, c, g, or t
  misc_feature (245)..(245): n is a, c, g, or t
  misc_feature (268)..(268): n is a, c, g, or t
  misc_feature (286)..(286): n is a, c, g, or t
acagggaggtggcgtccaggtagtagagaacaataagagtaatgctcttaattcaaaagtgctgtcaagatacagttcagttcagagtaaaaacaacaaagcaaaacaatgacaacaacaacaacaaaccaaaaaatgacatattctctccctgccccgaaaaaaaaaaaaaaatcntacagaanaaaactgcngcattctcatcaccatcattactaccattattaccattttcatggactaanctgtttctcacttctctttattntcccctcttacttcctanatgtggcc

SEQ ID NO: 206823 - DNA, 517 bp, Homo sapiens
tgttgttgtgtcacatgcttggcacggacacaagcacctcagagcctgctggtggaagctgggaaaacccaagggagggcaatgcccatccttccagtaaaggtgtgtgatgggtgagtcacagtgctcaggcatcctctccacctccgggacttggcaagcctaacaggttcctcatctgagttggaaattcaagtgtgccctgaaatgccaacatctaataagaaagaagcataattgctgtggtggaacagaggggcaaggaaaggacccagcagccctgcctttttagccctgtcctcaaagtctatgctggcccctgggaggctccatgggattccaaggtttccagaactatagtttgaaaaccacctctctgcagtaagaggaataggtggggttgggcacagctctagaacccgtgtagaaaacagatcaggaaatggagaaagcagaagtctgataaacttgggccatacttacacggatcaatgaggccctcgactcaggtggtgtg

SEQ ID NO: 206824 - DNA, 811 bp, Homo sapiens
ccttccttttaattatgttttatctttaaatcatttctacctctcacatcttactatatgcagttaaaagaagccatgtagctctttcagtattttccttagaaatttcttccaccacatattagttcattgctcttaaattctgccttccaataaagcccaaggcatggacacaaattcagccagattctttgttaatttctaataaggatggcctttattccagtttccaataccttgtttctcatttccagctgagacctcaccagaattgcctttgccatccctatatttatcaacattctgatcacaaccactgaagtaatctctaaaaagtttcagactttccatacagctcttctgagccctcaccagaatcaccctttaacattccacccacagcaatagtctttttctgacatccagttcaaaactttttcagctcttacccattacctagttccaaagccacttccacactttcagttattcattatagcaactgcgtacttttccagtaccaattttctgtcttagtctgttttgtgttgctataacagaatactacagactcagtaatccacagcaaacagaaatttattgactcatggttctggagactgagaagcccaagattgacaggctgacatcttatgagtggcctcttgctgtgtcatctcatggcggaagggcaaagggggtgagagagagagcaagccagcaaaaggggccaaactcacccttttataagaaacccactcacgtgataacaaacccattcctgtggtaacaacattaatccattcctaag

SEQ ID NO: 206825 - DNA, 370 bp, Homo sapiens
ttatgtcattaaattcaggcaattaacaggataaatatttaacagatggattgttttatttaagagggagtctgaatgacaatttgacttatatatgagtatgtttttagataggttgagatgcttttttcctgttagtggggaaaaaataccttctatgcataatcgtcaatgttactttgtaaactctttgttcattgattattcactgctaattttttttttagggagatatacctaatgctaaatgacgagttaatgggtgcagcacaccaacatggcacatgtatacatatgtaacaaacctgcacgttgtgcacatgtaccctaaaacttaaagtataataaaaataaaaaaaataaaaataaa

SEQ ID NO: 206826 - DNA, 506 bp, Homo sapiens
cctgcctaacacgagtgttgacttgttagctaacacattccacctggaagagtcagcagggaaaccccaagctggcctggctctggctacaagaattcctggcacatcaactgccgaataatggagtgaagcttgcaaacagaggagatattttgattcttaagccactagttccggatgttcacttctgagatttctttgcagatgcaaaggagttgcagggtataaagaatatgaagaagagaatcaagaaacctgacttcttgccagagctctgccaaccattaaatgtgtgaatgtggccaaggcactgtccttttgggagcctccattttgtcactggtaaaatgaggaagctgaatatattttctcttgggaacctttgaggtctatgtatatgtcttattcaagtgcataaatactctaagagagaaaggatctttgcatcttagagaagtatataaactctaatatgcataaagaaacagctgggaatcttacagtga

SEQ ID NO: 206827 - DNA, 471 bp, Homo sapiens
gggtggtcaggaagggaaaaaacaatagttatgtttaggacatgttgagtttgagatgcttctgtggccttcaagtagagttcagttggcagctgggtagccaagtctatacttctagagagaggtccaggctacagaagtgaatctgggagttatcaccatctcaatgacatttaagcccccagaactagaagaaatcatctagggcgtctctcttttctggagagagagatctgaggacaaaagcctggtggactttaaccgaaggaggtaaagaataaccaacctgggaggaaggaaggcaattaggagagtatggggtactaagagccaagaaaatgaactgtttgaagtagtcagtcacgttatattccctacctttattacaatgattatcatcataaccacttacaggactctctagaagaatgagttcaggctatctcctgatttccccaataacttgctctg

SEQ ID NO: 206828 - DNA, 364 bp, Homo sapiens
taccaagtattgtgattgccaatataatgagaattctaagatagacagatgtaaatgaggaataatgggcaggatttttcttttaactaatgacacacagtaatgaaacttgattaaaagtatatgtcttttggccgggcgcagtggctcatgcctataatccctgcaatttgggaggccaaggcacgcagatcacttgagcttaggagttcaagaccagcctgggcagcatggcaaagctctgtctccacaaaaaatacaaaaattagtgagatgtggtggcacatgcctataattcccaactacttgggaggctgaggtgggaggatcatctgagcctggggaggtcgaggctgccatgagc

SEQ ID NO: 206829 - DNA, 499 bp, Homo sapiens
agcaacgtataaatacccaaactcctcaccccagcattgaggccagattcccaatgacagatgaaactcatgcaccatgacacacacacagacacgcctgaaatatatgatagttggtctgttcattgaggacctgtcatgcgcaaagctcgaggcaagcggctctccatgagtgtcacaggttgccctgagaatgtggtcaggtccactttaccatacagaggaggagggtgtttagggtgcaggttactgagccaagggcattcagtgagtcggtagcagaaccgggggtgggcccactttgatatggaaggcatcctcttcccactacatggccctacatgaagttccttcacttgaagtatttcagagataagtccttccttagacatcctttttgatctacctcccgcccgaagcaagagcatcctcagcagatggtcattcatcctttctttttgtatgttttattggtgtttttgggtactacgctttggca

SEQ ID NO: 206830 - DNA, 420 bp, Homo sapiens
gttgcagtgagctgacgtgacaccactgcactccagcctgggtgacagagcaagactccatctcaaaaaacaaaaacaaaaaaaacagatagagggaggatggtcatgtctgtgtcatttccaaggtcttactgctttggggttcattttcacctcatttagttcgtgcgagacagcgatgatttttgctgttttatgaaggaggagtttgtggcttgagttgctgggagttggccagtgtggcgagctcttgtggccatgccagccggcgcaggagttgagccctcgaccacccgctgcccggtccccactctgggtccagggacagcactgaaatccacacctttgacctgtgtcactggaagcacctgtcccagatacattcactttgacttgcgccttgtaaaacccacattccct

SEQ ID NO: 206831 - DNA, 293 bp, Homo sapiens
gtggggctatatcttctgtttggatgtgtagaaaggggtctgattgctgtcaggactttcccaaggcttgaggagaagaatgtgtgcagtttagtggtgagtggtctctaccccaaggagacaggtaactgatcttcaaagctaattcctcttaatattttaagcagtgaattagcaaaaaagctcttaaattgattactctttccttctacaactctagaaaaatttacagaacttcaacttggtaattatttatatgcattcttgagctgttttgaaattgtttcttgtaa

SEQ ID NO: 206832 - DNA, 354 bp, Homo sapiens
cagactctggcttccaccagggccccggacacctgcttcctcagggcagacagagaggggtgacacactgcaccctgtggctgggaaaaggggcctgggactgtgcccgtctgggacggagcagagccaccatcccatgcaggcactatcaccgcaggcaaagctgggactggggaaggcagcctgcccgggcggcctcagggactggggtacaatgtgggagctagggtggaagccaagctgcttcccaccctcccaaacacccgtttgggctccaggggcgaggggtgaggggcgcagccatgggtgatccacgtgctcggggcaaatgcagacactccagcatcaccatca

SEQ ID NO: 206833 - DNA, 446 bp, Homo sapiens
ggaacttgccatcattcctgaaaggtttttttgtcctccccatagaaatgagagaggtttttgttttaatttttattaaaacaagagctgtagtagtaataacactaactaacttaaaaaaaattatttagccaggtgcagtggctcacgcctgtactcccagcactttgggaggctgaggcgggtggatcacgaggtcaggagatcaagaccatcctggctaacatggtgaaaccctgtctctactaaaaatacaaaaaaatctgccgggtgtggtggtgggcacctgtagtcccagctgcttgggaggctgaggcaggagaatggcgtgaacctgggaggcagagcttacagtgagctgagatcgtgcctgggcactatactccactacactccagcctgggcaacagagcgagactccgtctcaaaaaaaaaatagttattta

SEQ ID NO: 206834 - DNA, 473 bp, Homo sapiens
gaatgaccctgtacaaggaaagggatttgcttgagatccacacagctgtttaaaggcagagttgggattggaaccaagtcttagagaatccattgttgcttctacactgcattattgctttggttccctagtgtacattcactttgcttaggagtgatatgttcagtttatcttctctaagaatggcagctgttatttaggacagtggcatgctgagaaatagattgatttctattctatactgtgtccagtaaaggtcgggggagaaagagtaaatcttatcttcttctgtacttttctttgattaatgtaagagtctagagttttatcagaagattattgtcctttaaaatattgatggactgattatcacttaaagggtataaacagtgggtagtaattcagtgattgagaggttaattgcaggttttttttttttttttttctggtaaccatagaatgaatgtagaatg

SEQ ID NO: 206835 - DNA, 270 bp, Homo sapiens
aaggttaataatgaaaatcactaccagaacaccgggttggaagtttaggatggcctaacaggaaaaacatatttttaggagctctctctccagtaactgcttaattcactcagtttaccagaaagctgatttgatgcagctgccgactgaagagtaaattattctaccgtggtgaaaatgtggaggccattctcacatcctcaaattcagaatgctcataattatgattcctgagtagtggaatgataaagatgttgttgtttcttttct

SEQ ID NO: 206836 - DNA, 561 bp, Homo sapiens
ttggccaaggtagatggacaatgtcatggtgccataatcaggcaaaaataaaggaatctgtcctcactacagcacagcctgtccccaggctcctgattatttttgtttttaccacctccaaggaagacatagtgtttgtcacttaggatgatgaccgagccacacataggtaatataacccagtagccagagggagtggtttttaaacatttggacagatcttacagtactggtcagaaagtgaaaaaagcagtgtggtctttgggtttgaggttttgtgcccgtgaccgggtcatgcaggttacttttgctcagtagttgatcatttgttctgttgtttttgttgcaagagagacatccagacctactcacacccaaaccttgatttctcccccttcattctgaacccttcagtttattagtatttgcccattcgtttagtccacaaatgcatctgtgctaggtgctggggatagaattgtgagtaaagctaaacagtccctgcctcgtggatgtttacatgctattggaagagacagacaggaaacaattgtggtaagt

SEQ ID NO: 206837 - DNA, 709 bp, Homo sapiens
tggaagagggagtaaccacataaaaaggagttggggaatagaacagatcttctagtgtggaatttaaattgggaatatcagcttatgaaatagttaaatagatacatacatgtatagatatatgtatacatgtatggatcagtgtatattatagacatatattaatatattatctattctagtgctctaaatatcaattctgagacaactggagttattcaagacttcttccgtacactatatggtcagtttcatttgggtctcaaagtacaagatccgccagttacttgttattaatttttccatggcatagtcacacatatttttacctgctttgaaacagcttttatgatgttatgttttaaaacttatgaaaatgaatatttgcagggataaatgattataaagtatttaaaagtttgatgtaatatcatacaaattgacagatcatattccgtgaaaacattacagctaattagaggacaatatttcttagatttctaccccccaaaaataattcattttatcctccattttgagtggtgctgaaaaaaagtattaaacagagttcttaaaatatgctataactagtagaaattatttttttaatttctattgttttcatttttcaaagtaaaatttatttaaaatttatatcaaaaattaagatttatcagactatgtctactttggcaaaataaactgtttt

SEQ ID NO: 206838 - DNA, 510 bp, Homo sapiens
tcccaagtatctggagtataggcatatggcaccatgccaggctaatatttgtaatttttgcacagacggggttttgccatgttgcccagtctggtcttgaactcctgagctccaacaatcttcccacctgagcctcccaaagttctgggattacagggaagagccactgcacccggcctatcactgcatttttaaagggaaggaggactatagtgagattcactaaggcttacagaaaaggtagaaccccagatagatttaaagacagagattataatattcttgagatgataatatccaaatttagctttcatagatagggaaatttgaagtacatcagactataagttggcattttgtgcaactaattaaaactacgtttgaaagagagcaattgcatatttgttactgagtaatattaagcaaccatgaaaataaatagaaataaccaagaaattgttatatttaaatcctccctccttttttggaaagagaagtattgatattttt

SEQ ID NO: 206839 - DNA, 328 bp, Homo sapiens
taatttccacgtgcccctggcaaccattatctcatctcaggacagggcagaagggggatgaatgcactctgggaagcctcttggagccagccttgctgtgtgcctaactaggtccttaatatatactacgtatttctgaagacaaacaagttatcagcatatcatcatcaaactgcgatggtctctccatgaaaactcaaagcaagaatactgatgtgaataaaaactctgtgaaggcatatgctgcctggtttattttccacaggagaagcctcacatgtagggtccttgaagcctgtgttcaaattaattgtgggacggaagatca

SEQ ID NO: 206840 - DNA, 438 bp, Homo sapiens
ctggaccacaggctgtaatttgctgagccctggtatatatataaaatataagaatattagacttggaagaactcatttttcgataacctcattggatggcaaaaaaacagttgcagccccaaataattagtgacctttctgttgcttcatatttttaaaaagtcaggatggtgggtgacgcctgtaactccagcactttgggaggccatggcaagcggatcacttgaggtcaggagtttgagaccagcctggccaacatggcaaaacactgtctctactacaactacaacgattagccaggtgtggtgcctgtaatcccagctacttgggaggctgaggcaggagaattgcttgaacccggtaaggcagaggttgcagtgagccgagatcgtgccactgcactccagcctgggcgacagggtgagactctgtcttaaa

SEQ ID NO: 206841 - DNA, 325 bp, Homo sapiens
gggcagagtttgtggtgaggagccagcaacagacaagctaatatccaaaaacatctactcacatcaacttaatttccagtttctttcaaattgaaggtaagttccaagacaaactttttattctattctctgaccaagtgttgggaaaagaaaactgttaccattttcatttctagcatactaaaacaaaaaacataaaaaccccaaaatctaaaacacttttaaaaataacatggtgttaagagtagtttgttcagtttccctatagaaaatgatttatggaaggagaataaaagattattctgaacactaaaacaataagacc

SEQ ID NO: 206842 - DNA, 262 bp, Homo sapiens
gagcccaagtcctgcccacactgtccattgcaggcagggcccttcctgctcagccccgctacggggacagggccttctatgccccgtgccccttcctcctctggcctaggtgtttctgggagctgggcttaccttgaccaagctggagtgagttagacctgctgtgaggtgacctgcaggtacctgggccagatcaactgccctgcggggagtggtggtggtggagagggctgatagtaaactgtgctggcaagtatggcca

SEQ ID NO: 206843 - DNA, 481 bp, Homo sapiens
ctatcatttctcacctgggtttttccacagcctttgaactgttctccttgcctcagatccttctcatgcttctcaccattgcccctacaatccattctttttagagcagccagtgatccttttcaaatataggcagatcctataactcctctgctcatagctcactaatgccccctcatctaattccttcagctgaaggccaaagtcctatcatggcctacaaattgctgataactgcctgctacctctgtaggcttctctcttcacattcacactctactactgctgtgcctgaatcacaccagccatacccccacctcacagactacatacaagctgtgctgtctgcttgtgtatcagttaggagatacacaagttatgactgttatttatttatttttttgtagagacagggtctcactatgttgcccaggctggtctcgagcctctggcctctagcaatcctcccacctcaccccta

SEQ ID NO: 206844 - DNA, 278 bp, Homo sapiens
aaccacagcaatgggtattagacaggcacgtaataaatgtgtgatactataaaacaggaatacagatacgaggggtcatcaaaaatttcaaggaaaatgaatattatgaaaaaactacggccaggcatggtggctcatgcctgtaatcccagcattttgggaggctgaagcagatggattgcttgaactcaggagcttgagaccagccttggaaacatgtcaaaaccctatctctccaaaaaatacaaaaattagccaggtgtaatggtatgtacctg

SEQ ID NO: 206845 - DNA, 376 bp, Homo sapiens
ctcccttgagtctttgtgttgtgtttcctcatgaaaatacccccaaagtagcttaatgagatttagcagaaacagatcttccaggtcatggcccattcaagacaacatttttttcaacttctattttaagttcaggggttcatgtgtaggatgtgaaggtttgttacatgtgtcatgggggtttggtacacagattatttcatcaccctgctattaagcctagtatccattatatctagttataatatttttcctgatcccctccctcctctccaagagaacattttattattccctaggcaggtggttcttaacatttgccagtaaacttttaactgggaagcctctttaaaatgcagaatcctgggctccactc

SEQ ID NO: 206846 - DNA, 517 bp, Homo sapiens
ggatccccactgaaagccatgaattactcttattagaccctgtagaatcccagtttatggcagtgacattaaaaacatctagtttatgacttggattaggcagcctgtaaaatggcttccagtgatccctgctttctggtatgtatgcctttgtataataccctcctcatgagtgtaggcagaggtaacatcacttttgaaactaggttatatatattcaaacaaacaaacaaacctgtggcttccattttgggtactttatctcacactctgatttcttgctccgtgggaaacagactgtaatattgtaagcagtgctatggagaggtccatgtggtaaggaagtgataggtcctgataacagccagtgaggatctaaggtggatccctttctgagttgaatattgagatagatgactacagccctggctacaccttgattgcacctcatgaggaattctgaacaaaaacactgtgctgaaccgtgtccaggctcatgagccacataaactatgag

SEQ ID NO: 206847 - DNA, 437 bp, Homo sapiens
catgtagccctaaaccaggtaagtgtcagaactgagagcactttcttttctctgtagagcatcagagtcttctatgaataattccttcctttgtttattcaacgaatatttattgaagtgtctgctctgtgctaggcactgaaaacacaaagatgagtaagaaactgcctaagcctaatcagtttaagactaattttggaaaaaaacaaggagatatgctctttcaatttcctagaaaaataaatttcacaactttaaaaaatgtgatggaattgtcaaaaatagattaaatatgttgcataaattgtgaaatgaaaattatcattctatttattctgtgaacaggtacaattcttaattttttattgaatatcataaaagcagagaaaaactttgagttttcagatattatacccaaatgacagtgacacttcaaa

SEQ ID NO: 206848 - DNA, 568 bp, Homo sapiens
cagagtggactgcagaggcaataaacaaggatgttgtgaagaccctgtttctttctagcgtggcatcccaggataaaatatacaattaatagatactggaaggcacactttctgattatggagaaaccatcaaatttggccatggttttgcataggggctaggttggaaattcaactagaacaatttaatgtctactggcaaagcttcttaattatggaatgaaagctacctcaaagtgcctggaggcttgagctgaatggtgagatcttcattgacctgacctcctctgtgctgaagtttgctgacttgaggagacctcccctaagaacagaccctcccctcagggctgccttcagcgatgatgattgacgctggcaagtcagtcaagtgggaagtttgcggcacacacggctcaaaggactcacccagtttgccctgttggaggatgttaacctttgcacactatttttgacatttaatttttccttccatttagtgcatgactctttttttgtctttctagtaaattcatttagttagtattattctttgcctattttgtctttt

SEQ ID NO: 206849 - DNA, 525 bp, Homo sapiens
tgtacggtttaatgaattttgataaatgtatacatccacttaacctccagcctaattacgatatggaaaccctgtgtgttccctcctgtctttttctagtcaatctttcctaacctttattctgattcccataaccacaactttttccttcctgtcctagccaagttcatataaaaggaattatgcagtatagaaggaattgacattccttttatcccaagaggaataagtgattgaagacttttaagaaggaaataggcacaatctgatttatgtttgtaatgatctttttggctactgtgcgaagaatggtgagtatgccacttaagtattatttttcttcccatcttccagggggaatatgactcaatgaaattcttgggtcgaccagaatttccatactggacccattattaagggaacctggaattatttctgccattcccgattcttcccagcagatggccccaaagttcagttcctgaattgcctcgcggagccgcgggctgcaacgtgaggcggccg

SEQ ID NO: 206850 - DNA, 515 bp, Homo sapiens
actattgatccataaggcaactgggatgaattgcaacattgttacactgaactcaggaagccaggctcagaaggttacatacttagactcctagtcagcattaaaaaggaaaaaactacgttgcaattgagccacctggaggaacacccagaaaactatgctgagtgggagaaagccagtccccagaggtcacatactgtatgattccatgtgcagaacattcttgaaataacaaaattatacaagtggagaccaaattagtagttgccaggggctaaggaggggtttgggacagtgggaagtgagtgttcctgtgaaagggcaacatgagggatgtttgggagggaagcattcccttcttgctgtatcaatgtcagtatcctggctctgatccattactgtagctgcaaggtcctacccttgagggaactggccagagtacctaggattcctctgtattattcctcacagctgcatgagaagctacaataatctcaaaataaaaagtttaattt

SEQ ID NO: 206851 - DNA, 245 bp, Homo sapiens
cgcctggcctcaattttattattgaatgttacacaacagacttctccagttgtatcttgtttttaactaaatctcctatagaaatttcataatcactataggctattatgtataaatttacttttttgaaacattgatctacagaattaagtatttttttatttaaattgggcctggtcttatcagaaattgaaaaaatattatcttcttgttagcattgttttttactgattataaaagtgaca

SEQ ID NO: 206852 - DNA, 280 bp, Homo sapiens
tgatgagtaaattaaataagtaaagttccattttcatcccaaagagctaattgtacagaattagttcttcatatggttcagaagacatggttccataaataagtaaaaagctatctaacttcttagtacacacgtttaaagaagccatgacaaatcactggaactcaatggaccttacactgaaataaattccagatgactctaatatttaatttttttattcctaaatcctgagaaaagttttttgataagacacaaaatctaaaaccagtaaggccaa

SEQ ID NO: 206853 - DNA, 622 bp, Homo sapiens
ttctcaccagacaaaagtctaagttatctttctttggcaaaagactcactgttgatacacagcaattaatgttacggagttttagtgaggatttttttgagccatcttaaaagcacgtctgttggttagagaaatgggtatttggttctctgtactggtatgtgttaagaagattatgtcttactatttctgagctctttcaagatcaaatgaagacagaattgttcaaagcgtgggttgacctcccctactcagtttttggctccttttggaaatctgatgtctgcccttctaagcgtaaggtgagcattatctggtcagtttcagctgaccactatgtgactgagatgtttctgaggttaagaattgagtgcgagtcaggccctccctttgtggggttaacatgagaaagaagacaacttcaaatttaattttaatagaatcagacttcagtatcctacaagaggtattaatggagtcctgcaggagtgtaaaggggagaagatcttctcccctgacactcaacattcaaatcatccaaccttcccttcccttttcccagctcataagccacttcaggcagtaatagttgtactgtaattatgccaggcttctgattggt

SEQ ID NO: 206854 - DNA, 741 bp, Homo sapiens
agatagatcagtagaaattaacccacttaaggaagatagagttagaagattgagaaaataaaggaacatagtctcatgaaactacatatttaggatcaggaagttggatgctaccttctcccttagggagaaactaattcctcatagttatttttacagcattaaagtgttcacaggttattgctctgtctgtaagtacagaaatggtagtagagaatcaaaagagcagcaacatgactgatctaatggattctattagttaatggaatctagtagccaactgagtaagcaggttaacaaaacattttcacctgctccatgagactctgactctggatcaacaacctaggtctgtatttaccagataaaacagtatgtgttaacaacactgctaggcaacattgcttatgataaaaataatccccagctggtaaagtacatctaggcttagagaactataaatacctgagagaaagtaatagtttaggctttcctgagtatagtgacccttgtaactggtacatctctttcagtgaccccaaggtctatatatgaaatgtaaaaatagatattggctcttgtggaaaactgaggcttctttggtaagggagattgtaccacccactgatgtagatctcatctccttgcatttgagctggagaaaaaatagttcctacacctatgagtacacctggagagaaaatacctcctggagctagctgcctactgctacagggactg

SEQ ID NO: 206855 - DNA, 730 bp, Homo sapiens
ccttatcaggaacacgggaaattgggaacacaggaaaatgctgattttgtttttaatgtcacatgtcctgattttttgctaagtaagttatggttcctgaggatgaactttgatgtttggatccctcatgaatgtttaatatgtctgacaactccttacacatttaggttgcaggttttggccaggctctaaggcttccgaagagcgagccagtggccctgcctgagccccgtgggtttctcctcttcctgttaacttatatgtcatgtaaatagtggccgttggagaatgagtggtatccagcttcccacagaagcctggatgagagcataaaaatagatcgtttggaaaagggcccgtgaccctctgtcacccttgttctgggtaaaggaaatgaaggaggtggaagccgagaggagaggagcatagacattcctgaagtcccagaacgacgggcacgcgcctcccaagttctagcccggtcccggggggctgccccgcagcagcagccttcccggccacctcacccccgcagggcaccagggacaccagctgcttaggcggaataccagaaagtgagatgagtgttgtttccacacactaacggtattatgcctcctgctctgggtctgagcagcaaagggaaaatgtgagaatattgtgggaattaagggcagaaggaggccgagccagcaggatgctggaactaaaaggagcgtctgttcagggc

SEQ ID NO: 206856 - DNA, 419 bp, Homo sapiens
gtacctttcatttgttgattaatcttcacaattctagaaaaaaagagttttgataagtgtcttttgataatgatgacatgaattcatagaattgaaatgagattcccaaagtcacacagattataggtaacaatatcaagattccaattgggtctaccaaatcccaaaactaaagctacactgattctcaaatgcttgtctctttccataagggtaaaaatttaagagcacaattagttgggagggtcatgcatatttgtaataacaaataacagaaagttgtctttcttaccatcttatctgacaaaattttaaatatagaggagaaaaagaaaacataatgatagatgaaagctagaagagtggaaacggctacagaatagcctggaaggaagggacagctgggggaggatgagaag

SEQ ID NO: 206857 - DNA, 341 bp, Homo sapiens
tccccaaagagccaaagtttggaatcaaaaagactgtggtttaaatcctaagtactactgcatactgcccctgtggccatatgcaagtagcttaacctctctgagaggcaaatgccttatctctaacatgaagatagtaattcttactcccctgtgctacaaattcaatacaggaactgtgctacagcactcaatacatggttgcagtttttgtttgtgttttgttgtcattgttagtaatattaggtacaaagctgggcaggaagatctgaagctgcacacttacctgtgtcaagcagagcagactgtctgggtctgaatcttggctctgttgcttactt

SEQ ID NO: 206858 - DNA, 399 bp, Homo sapiens
gtccagcattgcgctgcctccgtcttaggagcactgaggtgcaaggggtaaagcactgagggctggctggggaaatgaagtctggtaacctcactctagcctttcattccagtttgctccgcattcccctgctgaaacatcttgtgggctgttcagtgcagtgaaggaagaggctggggcccgctgccttagccctcccaccgacctactcagcatcccaggcaagacactgagctctgtctccagggccccatcactgggtgatgctgacccagcacctcactgtagcacagggaatgtcaccaggcagtgctatcctggtaactacgtaagctggacaggtgttatttactggtatgacatgactatcattcaggcttcatttaatccagtaagtgt

SEQ ID NO: 206859 - DNA, 294 bp, Homo sapiens
  misc_feature (21)..(21): n is a, c, g, or t
  misc_feature (38)..(38): n is a, c, g, or t
actcgtaccctgcttgtacgntccgtattcccgggtcnacccacgcgtccgcgcgctcgttccgcacagttggctggccgccgtcaggctgcacggcgccggcaggacatttaaagagtgaatgaacacacagagttatatgacctgctaaaatgaaagatccaaaaaaaccgtgctgttctgatttggtactcagtaaatggtgaaatgttatcaatagcaggaaaaacagctttatatttaatatgatgatgacaatgacacctggcaaggaatatgttgagcagataaaaa

SEQ ID NO: 206860 - DNA, 429 bp, Homo sapiens
agagagaagaatactagtaatattaataattaagtataatgctcacttttcttgagctactttatgcaagacacattctaagctctttacccgcataacttatttaatcttcacagtcaacccattttacataccaggaaactgaggtagagagaggttaagcaatacgcccaaagtcacataactagttaggaggagagctggaagtgaacccaagcagagggctccagaagtgccgttacccacccactctgatgcagacaataacagacatcacctccaagcacctgctctgagcaagcaatgggctaagtcctttataggattatctcatttaatcttcagagaagccctatgaagtgggtgctaacatcatccacattttaaaaaaagaaattgaggctcacagagatgatgtgatttgcctag

SEQ ID NO: 206861 - DNA, 529 bp, Homo sapiens
aatttatcgatatgttctgttaattccatctgataaaataagctaataaaatatttaaaattaaatttaaattatggctgcagcaatattataactcttgtaatattttgcagttctttttagtgacttaatggtttcttaccttgtgacaatttattaaagctagccagaatagattaaatattgatgggaaatgtactaaaggtctcggacagcccgtaactctaaatatagctctttatttttgtaatgttatgttgagcttgccccaaaattaaccttagaaataagatcttatttcattctgttgacttcccatgtataatgtatggaggcgaatgagaagtaaaggcaagttgagaaactcctccagaactcctgtgtcatggccagtctacatgcctaaagtgtgtcttcctgtgaggacagtgccatggtacctcctaaaatgtacagatgtgtatttatgctatcaagattgtgattacttttcaatatctagactgtattaataaaatagtatttcaga

SEQ ID NO: 206862 - DNA, 181 bp, Homo sapiens
ctgattcagcagggagaaaaagaaactaattaaaaatttaattgatatcatcagagaataaaatactcataatataagaactggctgctcagagaaagtaacaatctgagaatacaaaagagttattgaaagttaaaaacatggctgctaaataaacatgtcaatagaagaactgaataat

SEQ ID NO: 206863 - DNA, 111 bp, Homo sapiens
acctggctgggtgcctgtagttggtgctagctggtgttggcatagtgttagtgtggtattagcctgctgctagtgtggtgtccacatggtgtctccatgatgttagcatgg

SEQ ID NO: 206864 - DNA, 452 bp, Homo sapiens
ctactaaatacctatgtgtggttactgagtgtggtatacttggacaccgagctcccccacccatcagatgtcacaaagagtcctcttactcttggataatttcaaatcaaactgacctccccagatattgagaagcaaaataatcaacaacaacaaaacctgccttgtaaatatgatttacattgattatgtggggatgttctgaagggagaagaaaggagctgtcaccaactcaaagcaacatgagagcaagaatcatgctaattttgccgtctgcctctcctatgttcttggtgccaagtctgtagttgaggttcatttacctgaatgagtgactaaagctttataacttgaacactttgaatacatagatctagcataaataagcctattaatggcaactttgacctgtcaagcaataaccaaatgatttgtgtgcctgctggattgtc

SEQ ID NO: 206865 - DNA, 106 bp, Homo sapiens
caaatgtgtgactctccaatcctaaaatcctcatctataaaataaaaatgactacatcccagggttattgtgaagattcaataagccagtgtccaaaaagggccgg

SEQ ID NO: 206866 - DNA, 496 bp, Homo sapiens
tctcgtgttgttataaatacctgagactgggcaatttataagaaaagaggtttaattggctcatgattctgcaggctgtacaggaagcctggcagcatctgcttctggggaagcctcagggagctttgactcatgacagaggcaaagcgggagcagccatcttacatggcaggagcaggacctggggtggtgggaggaggtgctacacacttttaaacatctggatctcaggagaactcgctcaccatgatgagaacagcaccaagaggatggtgccaagccgttcatgagaatccaccccatgatccaatcacctcccaccaggccccacctccaacactggggattacaattaaacgtgagatttgggttgggaacacagaaacaaaccccatcacatactaaagattatttccttggaagggattcacttagatccttttaaagtaattggtacatttattttaacttttccccaaatgtaaaattgatcttc

SEQ ID NO: 206867 - DNA, 256 bp, Homo sapiens
cctccattttggaattactgatagaaaagaccccaagtctgaaaagaaacatttacaatctattctctgtgaagcgtgctacctggagacattcctaagtcttacgtcaataactctttcaacccattgccaatcaaataatctttgaatctacctatgacctggaaggccagccaccttccagctgtcccgcctttccggagggaatcaatgtacattttacatgtatttgattggtgtctcatgtttccctaaa

SEQ ID NO: 206868 - DNA, 394 bp, Homo sapiens
tcagtcttcaaatttcagacccatgaagggaggaaactttggaggcagaagccctggcccctatggtggtggaggccaatattttgccaaacctcgaaactaaagtggctatggtggttctagtagtagcagtagctatggcagtggcagaagattttaattaggaaacaaagcttatcaggagaagagagcaagagaagtgacagggaagctacaggttacaatagatttgtgaactcagccaagcacagtggtggcagggcctagctgctacaaagaagacatgttttagacaaatactcatgtttatgggcaaaaaactcgaggactgtatttgtgactaattgtataacaggttattttagtttctgttctgcggaaagtgtaaagcatt

SEQ ID NO: 206869 - DNA, 273 bp, Homo sapiens
tcttaaaacaaacaaatgaaaaaaccattttctctcctccaagcaagcctaaggccacatgtcctattctcacacaggtgctttaatttcagcccagtctctagagcctaaatttggctcctctgcaatttccatgggctctaggtttccagcttatacttactgctttggctgtggtttctctcttccatttctaccacgtgaggatttccttttattttgtttaaagacagcacacattaaaaaaaacttttgttgttatcgtttacccaa

SEQ ID NO: 206870 - DNA, 310 bp, Homo sapiens
cagatttcagaaaatatttccaaaatgaaccactttgctgtgtgtcgcaagttattgctacttctgaaaccccctttttctttccttgtaattttacattggcaattacatttcaacatgagttttgactgggacaaaccacaccatctaaactgcagcattctgttttaggtatattgccttcttggagacagactattcgacttccgtaattaaaaagaagtccaactcttaggcctgttcattatagaaaaattgattcataattataagtgaaatttatatttcattaaacattttttcaacgaat

SEQ ID NO: 206871 - DNA, 387 bp, Homo sapiens
atgccattttcctgcctcagcctcccaaatagctgggactacaggcgcccaccaccatgcccagctaatttttttttgtattttttttagtagagacggggtttcactgtgttagccgggatggtctcggtctcctgaccttgtgatccaccaacttcggcctcgcaaagtgctgggattacaggcatgagccactgcacccggcccactttgttaagtactttatttattagttatggtggttttgttgggaaactggtccacagacttttcacactagtattctggacctgatgacctttcactcaagtattcggcatgcattttgggatagccactttgattagcacatttagaaatctaacattgattctgtattaatagctg

SEQ ID NO: 206872 - DNA, 414 bp, Homo sapiens
catggaactgtctttgagtttggggttcaggaatctatttggccttttctacccaaagaaaaaaaaattatcatcttcatctctaataaatggcagcaccttaatttataattcaaaaggagaaataacacatatgtggctgtcaggaaaggggaaacattttggaaatggcttttgtgaaagattatgaagtctacctactgtaccttatcactgcagaaggaaaatgatgtttcttttgatcaaaacatgacaaggagcacatcaaaatcaatacatggagaatttaatcctctgagctgtcagaatcacaaacagagaaagtgaatgttaatgacagaaaggcaaacatgtttattgtggaaaggttactgctgagatgcctgcctaccctcttagaaaaagtaaagaaag

SEQ ID NO: 206873 - DNA, 342 bp, Homo sapiens
cttcttaatctgaacagtgggactaacagcagaaacctcatttttaaaagcagctttattgagatacaactcacataccataatccattgaaaatacacaattcattattttttaggatactcataggtttgtgcagccatcatcacagtctgattttggaacatttttgtcttctgtgaaaaacgccaaaccaaatgtaaatgagtagagccattacggagaatattatgggggctcctcaagaggtgagaagggatagagagaggttggctaaaggctacaaaatttagctagataggaagaataagttctagtgttgtactgggtgactacagctgacc

SEQ ID NO: 206874 - DNA, 446 bp, Homo sapiens
gaaagatttggtggttagaagaatagagttcctgtttagttgcttatgttttttcagtaaagtatgtgagagtggggccaatgaggaagggtttatgttctacagtatttatcttagaaaaagaaagggaaaaaaaggaaaggaaaaaaagaggaaggttgaaatttttaggaaaaaaaagatataaaatagttgactcagagagcaaaatattaatcttactaggaaaaccttttaggattatggagcagatatagagtgtttcagctttgtggtcagaaatttaaagcactgtgccagtgtttggctgctctggtgcaggcccagagaagttatactcagatgggcaagtgaatataaaagaagtacaattgcttttcataatgacgaccaggacatcaaaggtggataagggagagaatgaacacagaatagacataagagtt

SEQ ID NO: 206875 - DNA, 489 bp, Homo sapiens
cacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaa

SEQ ID NO: 206876 - DNA, 604 bp, Homo sapiens
tgtcacacacctgactcatttaattcccccagtaacaagttatgataacatgtatgaaatgtctactagggaaacctgttaaagactcggtgcccagggtttttatcaagggctgatcatgtaggaagccactgcttggcacatacccagcttctagattcccaaaaggaaggcaggtgttcagcataagccgtattgtttgcataaacaatttaggcacagtgaacaactcatatcagttagggtggttgggaaccctcctgaaatctaagttcccagatgtcagccaagggctgtgtcttttaagtaggcctttctaagagtaaacaatcaggcctacctactatgttaactttttatctacacaggaaatatgaatggttcttttgtttgttgttttgctttttcgatcaaggagttgcttggtctcactttaaggaagagtgaatttcccttatagtagatgtgttagctctgtccctataagagcatgatgtgagagagcctttagaagagacgtgttgttttaaaactgggagattcagctgtccataagacagacattaatatcccgaatgcacttactagaagaggtttatttctc

SEQ ID NO: 206877 - DNA, 397 bp, Homo sapiens
ggacgcggcagtgatccgtactcgtggcctggctgtggccgtgtgtgaaacaagtatttatcaaattttctcaccaagagccaaatatttcaaaaatgaaattatacttcaagggcataatacaataataaggaccagacttaatctctcaccatgaccagccaggaagctagagagaaaagttctatgaaataactgttttcagacatggaaagggttgcggtctttcagagaaggaaaataaactaggaggatcccaggatgagctggctcttggcctagaggtaccttaggacagtggtcaactgcactgaactgcagcgctaggagggacacccaagcagaccttggtggtcttgctgaggtgagggcatcaagagttcagggatgcagaggt

SEQ ID NO: 206878 - DNA, 517 bp, Homo sapiens
cagagcactgattccgaagagaggcagcagggaggtgcatgcctccagaagtcatttgaacccgggaaagcaatgttttttcaaatcatgcttgccactttgctatgaaggagtgataacccactttgagaatcccttcaatagagtttctgtcattggtactacacgacattttgggggctctgagataggaaaagaaaaaaaaagccaaatcctttagcatagagttggattctctaaatagtttgtcacagtttttctggagtctaattgtctataatctgaagaaagagaaaattaaaacaaacaacaaaccaaaaaaataataaataaaccaaaatgcatcttgctaaattttgactctaattctgatacttaaaaggtggaataggggctacttgtctgttagaaaattgctaagtccttaattgtgatgaaaagtctcaaaagtgatgtgctcaactaagattataatttctttttagtttttatgattacagatttaatgatatggcaa

SEQ ID NO: 206879 - DNA, 466 bp, Homo sapiens
ccctttgtttgattcactaggttaaaaacactgttgttgtagaatctatgaagggacatttatgagtcaattgagacctacagtaagaaaccaaatatttcgtgataaaaattagaagcaagctatttgaaaaaatgctttgcaatgtgtacattcatctcaccaaatataacttgtgttttgaatcacctgattggaaatactctttttgtaaaatctccaaagggacatttctgagcccattgaggcctataatataaaacagactatcttgtgataaaaactagaaagaagctatctgtgaaaaatgcttgtgatatgttgattcatctcagagttaaattattattttgattgaacagcttggaaacactctccttgtagaatctagaaattgtaatttctgagctcattgagacctatagtgaaaaaccaaatatcccgcaataaaaaccagaaacaaggc

SEQ ID NO: 206880 - DNA, 356 bp, Homo sapiens
ctgagtcaggtgattcgcctgccttggcctcccaaattgctgggattacaggtgtgaaccaccatgcctggccagtatctcactttttgaagcaaaaaaatgtaatgtattgtgagatttatgtcatatagaagtaaaatgtgtaacagcacaaagaatggagtggaaaatgttgtaatgttctgacactatatgtgaaatggtatactattatctgaaggtagactatgataagttaaaggcgttcagtgtaaaccctagaacaacatttaagaaattatttgaaggtacactactgtaaatcctagagcaaccacaacaaaacccaaaaagataaagagccaatagtggaaata

SEQ ID NO: 206881 - DNA, 519 bp, Homo sapiens
tcatctcggcctcccaaagtatgggattacaggcatgagccaccgcgcctggccaataaagcaatcatattcatccagcatcctttgagagggtagagaaaatcattattcacagactgtcacctgggtttggcgtgcattcctacagattttacctatttaagagatccttaaagtttttctgattcactgttaaggtaagcctagggatcttgcagtgtatatgtgaaggaaatgggtaacggactgttgagtgaatacagtgtatagattgtagcacatatggtgatctgtgaaacgggggtgtcatgacacaccccttcctgcatcccaaaattgtgggggtcagggtggataacgggcatttctgcagcctgcacagcagtgccgaatgcaggctgcaatccagcaatgtcactgctgggtatttatccaaagaaaggaaatggctgtgttgcaggcatgcctgcactcacacgtttatcacagcgctgttcacacagcagcctaggtgaggaa

SEQ ID NO: 206882 - DNA, 543 bp, Homo sapiens
tataaacatgtttgtgaatataaacatgcaatcagtttttaaaaaatttttatcaggcatgagccaccgcgcctggccaataaagcaatcatattcatccagcatcctttgagagggtagagaaaatcattattcacagactgtcacctgggtttggcgtgcattcctacagattttacctatttaagagatccttaaagtttttctgattcactgttaaggtaagcctagggatcttgcagtgtatatgtgaaggaaatgggtaacggactgttgagtgaatacagtgtatagattgtagcacatatggtgatctgtgaaacgggggtgtcatgacacaccccttcctgcatcccaaaattgtgggggtcagggtggataacgggcatttctgcagcctgcacagcagtgccgaatgcaggctgcaatccagcaatgtcactgctgggtatttatccaaagaaaggaaatggctgtgttgcaggcatgcctgcactcacacgtttatcacagcgctgttcacacagcagcctaggtgaggaa

SEQ ID NO: 206883 - DNA, 237 bp, Homo sapiens
attactcagctatgtgtctttgagcaagttacttaacctctctgtgcatctgggtcagcatttctaaaatgggaataataatatctaccttacagatgaatattaaaagaggtaactagtacgaggtgcttaacagtaaatgcatttcagaaaacaatttttttttcatttatgaatttctgttgttatagcgggataaagtcacaccaggggaaagaggttgacagggacagacaa

SEQ ID NO: 206884 - DNA, 572 bp, Homo sapiens
actgattcttcaaagaaggatgttgtttggtagatcagtggttttcacattttagattgaactttttaaacacagagtccaatactgctttcccagagaattataagcagcgtatctcagatgtgacccagagcctgtgttttgaataagcttccatctgatcttgattcaagtggtcccaggaccaccctcagagaaccacacagccgacagacagagctgagtagtggagctgggaggggcacatcaggcagaagaaccatctgtgagaccagagtagggcagaaggcacaggcacagaaggatcgagaaactggagggtgacaatcttagacatgcaggcagatgtctgatcatgaaggccttgcttatcatgtgtagatgcttgtacatgatcctaatcagtttaactatttaaaacaaatgagaaataagatcagatgtgcttaataactttcaatgttagtaacaaaaaattgaggtaacaaattctttccatttgatttactgctccatctttttttttttggaaggaaggaagccatgaagaaacaaaaaaaagttggcggccg

SEQ ID NO: 206885 - DNA, 561 bp, Homo sapiens
ggaataacttgtagacggtgacattttaaagtgcaaaaaaaaaaaaatagaaaaaagaacaagctcatatattgaggaataaaagaggccacaaatattaaagatgagtgttaacctatatctttctgtggaaaagagtcacgctaataaataattaatcacattaggccatttgctccattccgaatgaagaatgtaaatgccagatttagagcacatcttcaattcacatttgcattctgaagaattagccatttggggcaattatttacttttatttctcttcatttccttctacatttgagactttataaaaaagttttcaaaggaagtgctatggacataggttttttattccaaactattttacaaatcaaaatggtttgtaacctcttgcagacatttttacaacacaggacctactttttttttaaattttgtgttctttttttctataggttttcaatcataattttctatgataatgagccccaccttcgtatatttaagtctcctatacaattagaaaaagcataccaattaattcaacaagaagcaaat

SEQ ID NO: 206886 - DNA, 338 bp, Homo sapiens
tggccatttagggcttcgaaaacgtttaatttcatggccatcatttaaaaccagataaggctggttgtggtggctcacgcctgtaatccaaacactctgggaggccaacgaggtgggtggatcacttaagtccaggagtttgagaacagcctgggcaacagggcgaaaacccatctctaaaaaaaaaaaaaaaaaaaattagcttggcatggtggctcagtcccagctattcaggaggctgaggtgggaggactgcttgagcctgggaggtcaaggctgcagtgagctatgattgcaccattgcattccagcctgggtgacacagagagaccatttca

SEQ ID NO: 206887 - DNA, 481 bp, Homo sapiens
aagaaaacatgatcaaacagaattcagcaatatataaagaaatatataccacgaccaagtggtacttattccagagatgcaagggagagctcaatatttgaaaattaatcagctcaatatttgaagaattgaaccatattaacaggctacagaaaaaaaatcacatggtcataccaattgatgcagagaaagtgtctgacaaaattcaacactgattcataataaaaaaactctcagacaaataggaacagaggggaacttcttcaacttgataaagagcatctaccaaacacccctacagctaacactgtatttactggtgacaaactgagtgacttatccttaagaacagaaacaaggcaaagaatgtccactatcaccattcatatacaacataatgctagaagttctagctagtgcaataaagtgagaaaaaaagtatagtggccaggcgcagtggcccacgcctgtaatcccagca

SEQ ID NO: 206888 - DNA, 509 bp, Homo sapiens
tgagaagaatgcgaagaagaaaggaagagtgagcctctctttcccatcgttaccctccattgtcctcttgacaccctgctttcacagagaaagagtttgagaccctctcccaggagccaaggagaggggaacagctggcttcacatcatctttctattcaacaagatacaaaaagctgaagccaggatgatagaaaagcaacaaagaagacacggtccttactcatttcccttcccacttcagagcaaatgtgagaaaagatttcatgcaatgctttagagaggggatgcctcagacaatcggtcatcagtgaggaagaactgaagcaaaacctgctgagctgtgaggctgacttgcttctcaggcagcgctgggatgatgtattgtccttcctgacttgtgacaaagagaactattcggtgctggggttgagctagggatatgatagatatctttaattatatgataatcagagatgagctaattagatatcacttgataactgatca

SEQ ID NO: 206889 - DNA, 504 bp, Homo sapiens
ggtgcctatgagttaataattaccttctggatagtttgggagggtaattgccttttatacatacactcccttaacatacaacgataatgattaagaattttcttgtaattcccacgaggtgattatttaacagagcaacaggccagggtaggctggcgtggggagcagcgctgctgagagtcactgactcgcagcgttacggacacggctctgcagaacgaggcttgcacccaacagagcaccagagcccagggaggccgagctcctcatcgccacacatcatcgccacacatcggacttatattcatttacgggacctaagagtatgacacatcatcatgacaaagttgaagaagaactagcactgcggcaacctgagtgggattcaggaaacgcagtgaggtcccgctgaaaatcaccttcgagtttcagaggaacatctgaagtcagactttacataatgtaaagaataaagagcaaaactcgagaaagtcatataactta

SEQ ID NO: 206890 - DNA, 364 bp, Homo sapiens
gaaactctccaaatatgcaccccacttccccattctccacagggaatatgggtctcctcccagcctgtcattgcccttcctacttcatgcccttctggctcaaatgtcacctctagcctgttgtcacctctacactaatgactcccccctcaactcactcagccacatctctgccagacactgacttcttgtactagagtcttactgcctcatttgaccttaagaccctggagaccaaggaactcctgttattattatttttttgtctctcaccctggcccccgcagcacaatgctcagaacgtagtagatgtttgttgaaacaatggtaataatgccggggcggtggctcacgcctgtaatcc

SEQ ID NO: 206891 - DNA, 555 bp, Homo sapiens
tcacatacaattcggggagttaggaaggctatgtacatatatgaagctacgttcacttaggagaaatcagagaaggatggagcaggcttgaaagaattcctcaagccacacacagacctataaacatagggcaaaagcaccagtggcacagggacttaaacacaacttctgagcaaatactgactcaaccataggctactctgacccaggggcaaatcctagaaatccaggatgaaaaataaaatcagtatcatccctggaagtctagaagaatgtgtgtatgcccaaggctatgcccttgaaggagcaatcacagaaggatcctccaaggtactagtggctgaatgaggtggtggataggggacaaggaaatatgtaaattcactgaactatgagagccatctccaagccatccacatatccaatggcaaaggataaaaatctaattggctaaaggatgcttaagcacaacctttaactaataaatagcttatgccaagctacggtcaaaacctaagtagccaggctaaaagataaaaataaagaaaaaatatc

SEQ ID NO: 206892 - DNA, 245 bp, Homo sapiens
ggggtcgattctgaggatcccttttttgcatgtggttccagttttctcaacacgatttgctgaaaacactgtccttacctttttgaatggtttttacactcttgtcaaaaatcatttggtcatacatttatgaggtcttatgtctgagctttgtattctattttttggtccgtaagtctgtatttatgttggtaccacattattttgatgagggtagctttatagtaagttttgaaaacagaaag

SEQ ID NO: 206893 - DNA, 481 bp, Homo sapiens
tgttctttttgcctggaatgctttctcccactgttttgtctagacaagggctgtctattaggactttctgtgatgagggaaaagctctgtatctgctccatccaatgtggtagccactagccactagccacatgtggctattgaatacttgaaatatgcctggtataaatgactgaaattgccacatgtggcaaagagctgccttatagggcagcgtgggtccagacaactgttacttactttgaaatcattagctcagggctccaggtctccactgggaaaccatcccaatattatggttgatgtaagtgcccccgttcccccacccccacttatgttcctgtagtaaccttgttctccctctatcccaatactcagaacaccattgtcagtgattcactgatctgcctcctctgctagaccaaatcttttttaggtcaaagatatgcagtgcagtcaataaatggttgatgcctagatg

SEQ ID NO: 206894 - DNA, 1043 bp, Homo sapiens
gactatccttgcttcccctccctctcaaagctgccaggggaaactgaggcaggcacactcatggtgaactccaagaccacaccaacccaccggcctggctggggtgcagtcttttctggttgtttctctagcacagctaaggtcagagtcacaggacagtagcaatcactgtcaatcttgctattttctgttttctttgaattaccaattctggctcatttggaaaagaaagccatgccccgtctaatttctaaacacgcctacctttttgagcctgtgcctgcttgccctttcagagtccccttggacaacttcaatatctggaaacttcctgtgagataaagtggcttcatcatataaaccacagaagacccctcaaataaaatcaccttgtgggtctggtgagccaggcaagctcaggagggctgggatcctacagaacagccaccagcccacatctccaaggttaagccccgtggtgtggtgtggtgtggtggtgacggctgacagcacgacagccaatggctggactttggtcctgccccagctccactgctgcccttggacaagtgtcccctgagtctcaccctgatcacctgggaaaagggcacgagagggacacagctccccaaactgcccgcaggtcagagtctataagtgaaagcatctacccatgatggacacagaggaggcactgactgagcaccactgtgggcttcatgactgttccaaagcaaatggggaaaaaaatccctgcttcgggccgggcatggtggctcacgcctgtaatcccagcactatgggaggccgaggcgggcggatcacgaggtcaggagattgagaccatcctggctaacacggtgaaaccccgtctctactaaaaatacaaaaaaaattagccaggcttgctggcgggcgcctgtagtcccagctacttgggaggctgaggcagggcaatggcatgaacccgggaagaggagcttgcagtgagccgagatcgcaccactgcactccagcttgggtgacagagcaagactctgtct

SEQ ID NO: 206895 - DNA, 259 bp, Homo sapiens
ttgttaattatctgccctcttgcctattgcctgcataaggacagggatttgtgtgtctttcattccggctgcgtccccagtatacagcatagcccctggcataaaacaaacatttaataagtatttgttgaatgaatagccacaatatataatacatgtatgtagagtgaacactgaaaataaaaacgagcttagaattttctaagggtacatattttaaaaattaatttgcgttttttgtttgtttgtttgttttttg

SEQ ID NO: 206896 - DNA, 286 bp, Homo sapiens
atcaatgaattataatttcagtaatcctttgctcaccctgcaaggatgagcgtggagaagaagagtggagaagtaacccacaatgtaacttaatttcccagcgagaacctgaacccttactaaagtccccagtagtagtcagccaactgcaaattgctgtgggaatatttacagtaacaactattaggaaacatgcagtattttgtttgccacgaagccaacttaatcttcagtgtcacaatgcaagttaagatttcctaaatatatttttaaagattttctatga

SEQ ID NO: 206897 - DNA, 547 bp, Homo sapiens
ctgtttggatacccaaaagttcaaatgttagtgggaggggagacaatgtgccttccctaacctgactgataatactggatgccttccctaacctgactgataagactggatggccgacgtctagctgcaggcagtctctgtccccacagggagtggcctctgcctcccgcttgcccctgggtgggctgaagcagtaagctgactctcagggcaagcgtgttcctaagggtcttgtctcttccttagggctgggttccagtagaaaaactggccttcagagaaaggagagactcttccaaatcttttgttaggtcagtagttctcaaagtgtcccctgttgccccagagtccgcatcacctgggaccttgttagaaatgcaaattctatggccccattccagacctacagaaccagaactctgcgggtaggcacagcaatctatttaacaagacctccaggtgacagtaataatgtatggtcaatttaggaatcccagggctgggcgcagcagtggcctgtaatccccaaaggtttgggaagccaaag

SEQ ID NO: 206898 - DNA, 114 bp, Homo sapiens
tgtcacctgtaaagcttaatgttgtgctaactattccatcatgcagatcactggcagaaacatagaataccaatattcttaagtcaaagtcaaaaagaaatccactagtgatgt

SEQ ID NO: 206899 - DNA, 529 bp, Homo sapiens
gtatgctaatgagagaactggtggctgggggccctagatatagcttcaggatgggagctggtctccagaaaggccaagggaggattagcgggttagcgctttcaaccttaccttcctataccgcagaaggtagtgccagactttacttgaattgtaggacacccacctagtgtcggagagttggagaagtggggttgaaagagacacccatgtttgttattaaaagcatgagtaaaaacagctcgcctaggaatataatttttgggtcatatggtaattttgtggttattctcttgaggaattaccagactgtttccaaagtggctgcaccatttcacattcccaccagcagtgtaaaaaggattcaatttccccatatccttgtcagcacttgttattatccatcttttgaattctagccatgctagtagatgtgcagtggtatctcactgtggctttgatctacatttccctaatgagagaagatgatactgagcatcttctcatgtgcttattgaccactgtgtat

SEQ ID NO: 206900 - DNA, 292 bp, Homo sapiens
acgagagattcgggtagctacatgaaagcttctcccctgcagtccctggaagaagctttctgtagctccctgggggtggagtcggtgccggagctatgaacctcgggagtcttaggatgaagggaggagggaggggtgtccaaagggccccaaggcaagaagctgggggtgggagaagctggcagtgtgggtgggatcctgcccctcactgacatcctctgaggctggtcacaccccacccaggcttcctcagcccggggcactcagagacagacaaagagggccatggaac

SEQ ID NO: 206901 - DNA, 1142 bp, Homo sapiens
tattcaaactgtttttcagtctttgtttgttttgctttttattgtgatttccgatttttaaaattattatatttttgaaggcaggatgcccatactgtgaaattaacaggttacatatgtgcagtattgatacacttcccctttaacaaaatttaattcactaatcacatgcatttctaaagccctttgaaaatgtgtgtcatgcttatgggtggccacattccagagggctgaatatgtgctagaaaaggagaggaggcttgggggtggggagaaaacccttacaaggcaagagaactgagcatgtgcaagactccttactaaacgaaggagggcagaggagtgccgttttggaaatatcaaggggaatgaaaagagaaagagaattgacgggagagagaggaatctgcccacactcaggggatcatccagaattcacagatgaacagggtgcactcaaggaagactgcccctccatcagagcaccacccctcagtgactgctgacgtgtaagacacttccagcatctttttaccaggccccacccttggggatgcccagaccaagatatcactctttgcactaagtgactcctgagataccagccctttacctgacttacattctgtcatcctgcatcagaattgtttcgaatttttagaggtattgtgttataatggtgttcaatgaagttggaagaattctggctctgctgcttagaaactggcaagttacctgatttcttgggacctccattctctcatctgtaaattaggactaataatacctacaatgcaggatatttgttaggattacacattagttggtactcaataaatggcagctattgaaaagcagtgtagtatggtggttaaaagcatggagtctggatctagacagaggttgaatccttgctttgttacctactgtctgtgtgactgattttctatgtgtctcattttcctaatctatcaagtggggataataatggcacagtttctatctcgtagagttgatgaagagatatgatggttataattcagagtctgtcagataaaaagcatttagtagatggaagtagcagtggtagtatcaacagcaggagtagtaataattgttgttgttattattattacaaaata

SEQ ID NO: 206902 - DNA, 585 bp, Homo sapiens
ctttacctgggtgggttacagtgttttcactagactcttcaatagaattaatattttaagaaatgccacttgtttatttgaaaagtataagaatcctatcaatgcagtaggcatgaatgtattcatgtgtctggctgttcatgaagcagctgatatcttaagtgtaagaggtgagatttactgactaccagtaaaatatgcgagttgggaggctaatgattttaaattgtaaatgcgtctgcataagatcctttaaaatagcttttattgttcttaaatttatgtttaaaagaaattgacattaatattttcaaatcatccataatctcccaaaccttttttggttttctgtttagtaccatttaaatctttgtgtatgtgtatatgagctacctttaaaagagcagtcacccatgcgagcatttgttacccaattagtttgtacttttttttggtttttattttgttgttgttatttgtttctttttgagatggagtctcgctcttctcacgcaggctggaatgcaataatggcataatcttggctcactgcaacctccgcctcccaggttcaagcgattctcc

SEQ ID NO: 206903 - DNA, 578 bp, Homo sapiens
acagtggagatggtttgcctcagttgcactgtgcactgtaaaagcagtaccaatggctgtgcagacattcctaaagagaatcttagttttcttcctccactttaatagtggtcacccagtgggttgagcaaacaaacatttattgagcacctggtgtgtacaagcattcggctctgctttggtgctgaggagagtaaagctgccagggaaaaccgaggggacacacggacagctccagtggggtagctttgcagtgggactcacacctcttcattctaccagaagccagaagatactcactggggacagtcgtgatgggagtttttccatgagcagcaagagctaatgggccgtttgcctacaagagaaggtgggacagcagattcctcctggagaatctcccttgtggccctctcattgccctctgacagattgcaagcctgaaatctgtcagctttgaaagattgcctgaccctccagtatttggctatgtaagacaggtactgaaagacggcttttgttgaggaactgactcccaataaaaatggttaactatccagtgtgagaaaacacgccgt

SEQ ID NO: 206904 - DNA, 248 bp, Homo sapiens
aaggtttgggggctgccctccttaatcagagcagatagggcacccaccaccccagcagctgccaacacctctccccaataagtatttatttcttgtaagaacacgcttgatacacatgtggtcacccatcagggttcatgccagatctttctccagtccttcctatcacctttggggatctgctgccaagtccacaccctgaggtgcataaatggcataaagaaaatttcagctccacttcctcaact

SEQ ID NO: 206905 - DNA, 670 bp, Homo sapiens
ggaaagagtatgggactagcaaacagcatcctgagggagcatgtgtgcctgcgagaacaccagttggcaatccatatgctcattctgtgaaggggctgttcctgaatgaaacttatgtgcaggagaacaaagataattatagaacaaaaaatgatactacttttgtgaactttgtgactctgaagtagaggattgctttgtacttggttagccaatgtgaggaaataatgacatgttttatacaatgaggaagattacattcatgccttgtaattttgtgtacaaataattccattattccttataaacttcaagccctcaggagcactgatttaccatactggtcttggacctttgacaagttgttggtcatttttattcttagacaagactatttctgagtacctgttacaaaattctgaggttctttaagactttacaagtccataattgaatgaaatctttacgtttatccctgttttacatgctgaggtcaccagaataagtatggtcataatatttaccttttagtatattagcctttgacttactagccaagttggttggtggtgctattaagggtaaagtaacaggtaacccctgtgggccagttgggttcatggcccaaggttgctccactgcttagccatctcagaaataaatgcagggt

SEQ ID NO: 206906 - DNA, 760 bp, Homo sapiens
ctaaggttttgatggaaatatgagataaggacataagaaattctgttgtccaataaaatgtgaaaaaaatgcaattttaccagtgatcaaagaaatgcaagctaaatcaactataccattttttttacttattaagctggcaaatatttaaaaatacataattaaactgagacacattaaaaatacatatgcatttacattgataaggatgtgaggagacagatacttttatgcactactagtgggaatgcatatttgtataagtccacaagcccttgtctaagtcactttggccagatatgtttcagaattcagaattttttggattttataaatgtaatatgaagactttcacttcaggacaagatgcatttggagttttttgcggggggtagggaaggggcaaaatatataaaataatggttcataagacattggacaccaggcagtgaaagatagtgacccctgaaagataagaaacaaatgacataaaccctaagatttctaccaaattactccctggagaaagttttcacggcatgactcagagagggagaacgaaggcagagcttagtctctccgggtcaaggggacagggctcagagtccaggaaagacaaggtggctagagtttgcagggtggagtattaggtgagagccatacagagggctccatagatctgcagaaggtaacttttgagtattcagttgagtacttacccacttatttacccactgtgtgaggaaactacttcaggtcc

SEQ ID NO: 206907 - DNA, 257 bp, Homo sapiens
tccagataaatgaccttaatacaaatattagggtggaaaaacccctagatccaaagatccaaagatgcttttgtcaactgaaggcatagaaagtgttaatatttaatcaacacagtaggaaaagtcatttcccaaccttgtccaccttcaagggtcccattcaatttcataaagctacatactttttactttgcaaaaaaattttttagtgtttttttaaatttgatttcgacatctcttgaattaatctgatcgtt

SEQ ID NO: 206908 - DNA, 244 bp, Homo sapiens
aaaatattcttagttaaccccccatcccttccctctacacacatacacactgatgactaggtgtggcatttgctctggattgcttataatatccttctgtaatttgtcttaacagtgtctctcaaaccttggttgtttgtttagcatttgcatgtccactgaataattactgctatggagggaaaattctgtggtttattcttttagtaagaaacctttaataataaaaaagagtccaagtcac

SEQ ID NO: 206909 - DNA, 525 bp, Homo sapiens
cagttgtatgggaaaccccattcagaagggccctgtgcttggaattgaatactctgtggttgccatattgaagttgttaatacttgcatctttgaatttgtgtttggtaagtgaagtggggcaggacacagaagcatgcgctgaggcttgagtcttgattcacaccccaccctgccttccatggcctctcctccttcctgagacaggttcttggccacccactctatgccaccatgtggtgtcctgggttgcccagctagcctccccatttgtgcttctgccatgtgattactgccgcccctcacctgggctcacctctctgccatgggttgggacagtaggcccttagaaagagggtattgacttgttcatttccaagcagggctgcatattttctttctttctttccttcaatttctttctttccttaatttctttctttctttctttttctttctttctttctttctttctttctttctttctttctttctttctttccttccttcttttctttctttcttt

SEQ ID NO: 206910 - DNA, 930 bp, Homo sapiens
ggaaaggctacttgaggacaaaagagaaagcggcccatctaccagctgggaagagaaccctcaccacaaaccaaattggctgaaaccttgatcttggacttctggtctccagaattttccagtggctagaattccaagatcaaggtgtcagcagcatggttctttctgagagctgtgaagaagaatccgttccatgcctctcccccagtttctggtggtgtgctggcagtctttggcattctttggcctgcagacgcatcaccctaatctcagcccagctccggaacgcctttcccatgtttggtgtgttttctacctaatgagttttgatggaagtgaaggctgttatttacctctggaagctaaaaataccagctccctggtcatctcagagttggtttccgatgcaactaaaaacatcaactgatatgaggtccaaaagatggaattttaagcaccaaagacgctcccttatgggcaaagtctcaataggacatctgcatgttcagttgagattctgctttcccctcagatgacagaattattggcaaccagttaaattgacgcaattggaaacccagaaacatgatcaacaaagataaggagatggagataccagtcacccctatcaaagtggcaagtgggagggggatgctggttggtctgtcggagctgacgaaggaatgggattggaatgtttcttttaccaattatgtaaacacagcctggagttccgagatgagtccatctcacttgctcagaactttgcctggtgagagcggttacaagcgaacaaggtggaaatgaaagaaaccctgactttcccactaggaaggaagagactgttccttcttgtgatgtactctgaagaaaaattctaggatttggacagatttcttgggttataaaacatgattttcttctctgttt

SEQ ID NO: 206911 - DNA, 238 bp, Homo sapiens
atcctgtccacttccacagcttcagttaccacctatgtgctgacaactctcaaatcttcatctctagctcagttctctctccgggactccctgctatatatcccttcacctgctgagcacctcccttcagacgtcccactagtgggccaaactcaacaatctaaattgacctcttcatcactcgtgttccctgtctcagtgaggtccatcatcaccagccaataagttctccaagcca

SEQ ID NO: 206912 - DNA, 391 bp, Homo sapiens
ccactgcactccagtcggggcaggagagtgaaaggctgtctcaaaacaaacaaaaaatatatgctctttgggcctggactggacaggccacacaaaatacccctggggaagaaggagatttgactcctggcttgcagcctgtgtagggccaccaagtgatcaggtggggtctggggtcagggaatcctgggcccagctgctagttccatcacttacaagctggtgcttgctgagctcacttggtacctggggatggtcctagcatcttatgcacaggggttaggctccaggtgaggttgcagatcttgtgctggttggcatggactggatgcatcaacaagccccagagaccaggagatatcccacactggaaagtattcctcatgcatca

SEQ ID NO: 206913 - DNA, 528 bp, Homo sapiens
accgcacctggcctctgagtctgttgtaatctaggttctgccatctctttttccttgcttttgttgttgttgaagaaactaagtcatttgcctacagtcctacagcctggattttgcagattgcctccttagagtgccatttaacatattttcggacgttctgtatcccctgtaaactggtggtaaatccagaggcttgatctgattcaggttccgtttgttggcaagaatattttgccagcggtgacacacacttccatcatgaggctccagatgcctggttgtctctctttttgtaatgtccacagctggccaggcacggtggctcatgcctgtaatcccaccagtttgggacactgatgccagaggatcatttgagcccaagagttcgagaccagcctgagcaacatagtgagactctcatctctgaacaaaaactttaaaaaataagccatgaaatttaaaagaaattaaaaaaaaaagctggatacagtggctcgcacctgtaatcccatctatttgagagga

SEQ ID NO: 206914 - DNA, 561 bp, Homo sapiens
ggcgtgtccacagctcgatcaaacagcctcagccccactgccacggaccagccacgtccacagcaaaaggaatcgtgtccgacactaagaaactgtgaccacccagtaccaaagatgcctttatatagaaacggactgtggcttgcattctttccctccaccagctcctgaaatgaaagggttccgtcacacaatgaaataagtaacagcagggagagagagagaggggaggtaaattgtttggaaagtagaagacagggtggaaaagatgaaattcaagacagatgtgtgagacccgcaaacatatgtctttgaatttatgcatccaagtgattgatgtagaataagaaaaaacagctacaagcccaataaagaaataaatataggagtaaatacagaacaaagtatcacgttccccacttcttccagaccaacatcaattctcgtctctctttctgctacataaagttgttacaaaacggggcgagtgaaggatcgaagatgaaacactacgaattaagcagaggttctctgtgtcctgacaccctcaggaggacgtca

SEQ ID NO: 206915 - DNA, 511 bp, Homo sapiens
ggctatcacattatcctagagaagtgctgccaatacagcaaccacaagccacattggccattgagttcttgaaacgtggatgttgtgactgaagaatggaattttaaattgtaattaatctaaacttaaattgtcatatgtggctagtgtaccatgttggaatgtgcagttccagagcagcgcttcttagaacagggtgtctaggccagcagcatcagcgtcccctgagaacttaggcatattcttggacctactccagacatggtgaatgagaaactctagggtgggacttacattctgtgttttaagaagtgcccccatgtgatgctgatgtatgcaggagcttgacaacctctgttctaaaggaagtttatgaatattattatactgtcaaataattggaaacaatctacatgtatacctgtagggtatacgctacttacattctgatgcatttatacaatgataatgtgatagcgaggctatcacataatgcaacctcgaagtcagc

SEQ ID NO: 206916 - DNA, 228 bp, Homo sapiens
atcgcttaggaccagagtggaaaacattcaggaacacaaaagacccaaccaagctcattagctctgtttgcctctaacttatctctatggcaactcacagagggtccagggaaaaaaaggtttttaaaattagatcatcaagaacttcatccagaacagccacaacacaaaactctttcaaaaagcctttggttgttgaaatggtgagggcatgtttcctgcttaagc

SEQ ID NO: 206917 - DNA, 374 bp, Homo sapiens
atcaaatcgaaaaacagaaagtaatccctttgcggagttcagttttatgggctggaatttaaacttgttgttgtgccactgtgaactgggatgatcactgtcagcaagtagtcaccaagctgctgggattggggtggtgtttgtaaaaagttaatctggtgcagggtggcataacacataagagtctgtttcttttgagatatttggcagaggttcctaatgtgcttggactctggagccacactgcttgacttgaatctggcttctagtatgtcaggcaagtttttaagctctcagtgcttcagtttcctaacttctaatatcaggataataataatagcaattttatatggttactgaggggattaaaactg

SEQ ID NO: 206918 - DNA, 268 bp, Homo sapiens
ctgggcaacagagtgagactcaaaaaaaaaaaacaacagctggggctgaagattgcttgagcccaggaatttgggaccagcctgggcaatataatgcgatcccatctctagaaaaaataaaaaattagccaggcatagtggatagtggtacatgcctgtatcccaaattctcaggaggctgaggtgggaggatagtttgagcccaggaggttgaggctgcagtgagcagtgatcactgtcacctgggcaacagagtgagaccctgtct

SEQ ID NO: 206919 - DNA, 365 bp, Homo sapiens
ttgggatttatattatgtagatttgctacttttttcattcattcattcaacaaacatgaagtaactactattaatatacatatattactatgttaagtgctattttaagaggtttattttatccaaagtagaaaagggtaggcaacttgcaaactgttcaggtttgcctatgtgccaagtactgcatttatacaaccatgaagggggagaaaaatcctgtaagtgggccgggtgtggtggctcatgcctgcaatcccagcactttgggaggccaaggcgggtggatcacctgaggtcaggagtttgagaccagcctggccaagatgatgaaaccccgtctctactaaaaatacaaaaatcagcca

SEQ ID NO: 206920 - DNA, 565 bp, Homo sapiens
ctcctggttcgcaggcaagaagcatgactgggaggcctcaggaaacgtagaatcatggcagaaggtgaaggggaagcaagcatgtcttagcatggcagagcaggagagagagtgtagggggaagtgccacacatccccttcaagcaacaatctctaatgagaactcactatcacaagaaaaagcaagggagaagtcctcccccatgattcaatcacttcccaccaagcacctcccccaacacatagggattgcaatttgagatgatatttgagtggggacccagagccagaccatatcaatagtgtaaatcctccaattttatttttctttttcaaagttgtttcagcgttagcttttctaggcccttggaatttccatatatattttagaataagcatgttaatttctataaaaaaaaaatgtcatgaggggaacagggctgaacaactacctattagatattatgcttactacctgggtgatgccatcattcataccctaaaccccagcatcatgcaatatacccatgtaacaagcctgcatgtgtactccctgaatctaaaa

SEQ ID NO: 206921 - DNA, 442 bp, Homo sapiens
caggaggagcaagtttgctgggaaagagcaatactttggttttggacatgctcagtttcaggtatagaggagacatcatggtggaaatgacaggaaggcagttgaatatgaaagtctgtatcaggtgagagatccagatcggtagagacttgacaaacaatggcatatagactttgaagtcttgtgattagatgaggtgtaagagatacgcagaaggaggacagaagactgcaaggactaagcttgggacatgtccatgctaagactttggaaagctgaggaggatgcagcaaaggaggatgcagagtcctcaagggaaaagggggaaagccaggggaatgagatgccttgagaccctggggaagagaggtgtcttctctaaatggtaggtattcagcatcagtgtagagacacctgctttgtaatatttatttggtcatgg

SEQ ID NO: 206922 - DNA, 689 bp, Homo sapiens
ctttcttagagaaacttagtccttcccatcatatgtattgaagggtttttttgtaagtttgtcttgttattttttatgggtttttttaagtatatatagaagttttgtttatttttaatgaaatcaaaactgtctcttctgtaatggctctggtttttttgtgacgcttagaaagtccttctcattaaagatcaccccaagaatctccctcactttgacttagtatttttagcatcatagccttttaatagttatctgcatggattagaacattggtgtttaaagttttttttaaccagaatagtatgaaatacattttatatatcacaatgcagcatacacacatgaaaaaatatattaagaaaatgttatttactcatactacatctgacatgttattttctactgtttcatttaagaaaacagtactaatctgttcattagtttcatagcctactaatagttcagaacccagtttgaaaaacatcggattagaggattccagttttaagttctgaaaaatttctgaatttatgtaaatgtaacttgatgtatcagaaagttatctttaatgagattcctcgagtttctgcttttaaataagtagtgtttcatatttgaaaatttttgaaattcgaggtaggcatgcttaattgtaaacagttttaactctgtttaagttgcttgat

SEQ ID NO: 206923 - DNA, 503 bp, Homo sapiens
tggagacagtatcttgctctgttgcccaggctggagtgcaatggcgcaatattggctcactgcaacctctgcctactgggttcaagcgattcttctgcctcagcctcccgagtagctgggactacaggcatgcgctaccacacccagctaattttcatatttttggtagagatggggtttcacaatgttggccaggctggtcttgaactcctgatctcaggtgatccacccgcctctgcctcccaaagtgctgggactacaaggcaggagccaccgcacgcagcaggttcctgtttttaaaagtgtttcctaacttagccttaactttacttttacccaaattaattcattttagctctactatgcttgggaatccctgagggaaaaaaatcaaatatggattttaaaaatatatatttgagaaaattatttccaaatgctcttctctgaaatttgctgtcccaaccattcactaaacccctccaacttcatcccctttatcc

SEQ ID NO: 206924 - DNA, 584 bp, Homo sapiens
ctataaagtgagtgcgattactttgttcatttcaaaggcaaggagatagatgtgcaaagggattgaatgagcgacttcaggatacgcgattggaaaagcagcagagatagtactggaacccaagtcaacctggtgaaagagtcaacatacagcccattgctttcagtccctttttccctctccatgaggtttttccctcatggagaaaatgaggattctcttgctgcctgcattctactgagtgttcatcactttagatagatgatagtagctgaaggcatggggtaggtgagatcaccagggaaacatacagagaagagagaaaggccttgggaacaagccctaagctcagaaatgggacaccttcccaggtcggggctggtggagaagaggcagcatcagggaaaacacagtggagctaagcttggatctgaacattaatggttgagaaggaaggatggagaagtggaggtgcgagaagaatgccacaagcaaagggagcagcatttgcaaaggcatatcagatgcaagagacaatatgttaccttggaaaatcagcaagcgatttcaggatggccgcagca

SEQ ID NO: 206925 - DNA, 414 bp, Homo sapiens
acatctcaaacacttcaattttacataatctgaaaacttcagaagtgagatggtttagactccagttttttacatattggcctctactactaacctggttctgatgtccttcattcacttattaaatatttgagcacctgctgtgcatctgacacccctaaagtctgcatgctataaatatgtagttgtggacctggtaatgggaaaaacgtgttaatgtgtcctcggaaattagagtgatatgggaggggctggcttgttactcggggtaggaaagcgcccagggatgctgctttttgcaaaccatgctgaccagcatgctttgtgcagctctggtctccctgtattcattcaatgttaatggcagactcatggggcagtatttttccccttaagaaactgtaaatctattat

SEQ ID NO: 206926 - DNA, 707 bp, Homo sapiens
gcagagcgcagtggctcacccctttaatcccagcattttgagaggctgaggtaggatgattacttgaaactggagttcaaggctgcagtgagctatgatcgcataactgcactccagcctgggagacaatgcgaaaccctgtcgctctaaaaaaaataataataaaagaataaagattcaggtatctgtgaactgatagggagagatttccaggaggtattgttaaatggaaaaaaaaaagcaaaaaatgtaatgatcatctagcatatactatgttttatgtaagaaagaaggggaaataagaaaaacatacagttgacctttgaacaatatgagtttgaactgtgtgagtccatttatacatggattttctttcaataaaagttacactgagtgtggctgcctctcctgccccccttccacctccttcacctcttctacctctgccacccctgagacagcaagaccaacccctcctcttcctcctcatcctcctcagcctactcaatgtgaagatgatgaggatgaaaacctttatgatgatccacttccacttaatagtaaatatattttctctttcttatgatttttaaataacattttcttttacctagcttacttttttgtaaaaatacagtattaatacatataacaaataaaatacgtgttaatcgactttgttatcattaagacttctgatcaacagt

SEQ ID NO: 206927 - DNA, 431 bp, Homo sapiens
caggagaaaaaagagtggtaggcagtacaatagttattgattatattagggtagtagaataactaccctattccattttctaaatttttggcaattaattttattatatcttctttttggtctcatcagcgtactagaaaaacaaaaggcagccaggcggggtggctcacgcctgtaatcccagcactttgggagaccgaggcaggtggatcacctgaggtcaggagttcaggaccagcctggccaacatggtgaaaacctgtctctactaaaaaatacaaaaattagctgggcgtggtggcaggcaccttaatcccagctactcaggaggatgagacagaatcacttgaacccgggaggcagaggttgcagtgagccaagattgcgccattgcactccagcctgggagacaagagcaaaactccatctca

SEQ ID NO: 206928 - DNA, 305 bp, Homo sapiens
catgtgagggatccaggttgtgtgttccttgtgaaaatctaatgcctgagatgatctgaaatgaaacagtttcatcccgaaatcatcctcagcaccccctgccctggtccatggaaaaactgtcttccacaaaacaggtccctagtgccaaaaaggttggcgactgctgatttaaagtatacaaaaggatatgcacaggttacatgcaaatactacaccattttatagaagggacttaagcatctgaggattttggtatcccagggatccttaaaccaatctcactgaagatactgagggatgac

SEQ ID NO: 206929 - DNA, 447 bp, Homo sapiens
caacctgctcaaaacaaggtcccgttctgaggtgctggcttaggactcggacatatctttagaggggtgggaggggagatgcaattcaacccacagcaaagcagtggggctctggcttgaatgcagcctctgtcatgagcgacctgattccacctcgcaccctccactgatgtgagccatctctccctggatgctagttacagcctcaaagaacgccccttggggctgcagacagaactccgccctcatggaagaagctgccggcaagtgctgggcagagggactagctgggaggaaatgaaagcaattcctccaagatgctgtcctcggggagcagcctggccaccctgcctgaaattgctgccgctgacacctgcaagcaagaagctcctccggccggggctggctccgcccacttctcaggccccgctgggcctcccgcggccg

SEQ ID NO: 206930 - DNA, 586 bp, Homo sapiens
taagtatgattttgtagttatagtgatcctctccacatcttaaatgatggcatacatttcagcattgggtgtgtgctaatctgaacgcataaagtagatggagtgattccagtattttaaagtagtgactcttaacactggctgcacattttaattacctggaaaaattttagaaaatgctgatggctgtgccccattcctaagaattttgatatacttggtttggggtgggcagactgattcaactctcatgaatgcccacacagtgatcatatgctgtgggtggacactgggatttttaaagcttccctcagattattggaatgtgcaaccaggttgagaatcatttttaaagttgattttctattgtagtaaaatatacctaacatatttacaattttaaccattgtaaaaagtatagttcattggcattaagtacactcaattcatattgttgtgtaatcattactgctatccatctccagaacactttcaccttcccaaactaaaactctgcacctattaaacaataacatcccattcccccttccaccaagcccctttgtaaccaccactctactttctg

SEQ ID NO: 206931 - DNA, 557 bp, Homo sapiens
ctagcaaaggggtctcgtgtctctgagtccagtgaactaaatccagtaatctataaaactgtgccgtgctgcctctaatccttacccactttttttcttcacatgctgataatgaggattcatgggtctgtatctgtttagtgctttgatattttggcaaaagatgtggggagaaggtagactagttgaagctgatatgatttttcctatgtactttttgggtaatatacatgtttgcagtgacatttgctagtcctaaatgaaactaaagattggggggggataatagtgtgattggatgatactgggaatgagataataagaaatatcctcagctttattgccaaggccaagcagtttgatactttgcttgtttgtttgttttggatgcaatccctaagaccagtccattcaccctaatgaaactgttgacaacacttagcagaaattctggtttgatgtttatattcttaagccagataatattttggtgacctgatatttctagtggcccagtgcctcagaagtagagaaaatagtgtgtagcttaacaaaaa

SEQ ID NO: 206932 - DNA, 543 bp, Homo sapiens
aagcctctctctctctggactatagaactatccctaagaggccaggtgtggtggctcacaccttataatcccaacgttttgggaggacaaggcaggaggatcacttgaggcccggagttcaagaccggcctgaacaacatagcgagaccctatctctaccataaaaaagacccagaacatcctcgccagcctgtgctccctatggggcaccccctccagtggaagtgagggcagccacgcacccctgggaatgccttagagaggggccaattgccatcgccaggggcctgactctgcaaccatccacacctacggggagtccatttgagagatgaggaagctgaagctccaggcccctggctcgtgctggtcacccaaccacccggaacctggtcgccaacccgctgtcagttgctcggcagtggactcctctcctggctcagggcgcggttccggcaggcgtccaccaggtggcagcaccggcacattctgcaggctgttccggctcagagctcgatgtagtgctctggggtaacctgggcc

SEQ ID NO: 206933 - DNA, 430 bp, Homo sapiens
caggcgaagaggggaaggagtaaccttccaggaagaagaaacaacagtgcagaacgccctggggcagtcagatgcttagtgttctgaggaagttaaaggagcccagggcagctcaagtggaggaggaggaagcagaagacagctgaggagacagggaggagcagacccagcagagctccgtacactgtcgaggtggtttttaagaacaaagcaaaaagaattaatagaagtagacaaaatggaggactattataagctaattaggctttatatttgcttccctacatctggaaccctttgttttcttgagaggttcatattttaagctaatgactgtttttcggtgtggccattacgctttttttgtttatttgtttttttagagacagggtctcactctgttgcccaggccggagtgcagtggcatgat

SEQ ID NO: 206934 - DNA, 270 bp, Homo sapiens
tcaagatcgagccactgcactctaggctgggcgacagagcgagactccgtctcaaaaaaaataaaaataaaaaaaaataaataaataaatctgaattggcttttaaacaatatattacgccaaagttgtgatcagacaaacttgatctaatgttagagatagtatctctaacattagaactctttctcatagacgttgaacgttctctctctcttctttcactgatgtggtccctttctttttctctctttttatccttcttatttctgc

SEQ ID NO: 206935 - DNA, 787 bp, Homo sapiens
gaacccttggaagtggatgaagagccatgggagtatggttcatttaagggagaggccagagaagtgggaggaaacccaggacagtattaatctctgaagccaaaggaagagagcatttcaaggagggagtggtggtgaatagtggaatgcactgagtggcctaagtatcctggattttcactttagactgggtggtatggtgaaaagagtatgaactttaagtcctggccagtggcttcaacccctgtgacataggacacatttgtaacctctgtgagctccagtttaatctgtaaaacgggtttaaaatacctagctcataagatgctatgagattttgaggtggtgtctatagatgcctcgcccagtgctactctgggagcagagtggagggtgggttggcatagttgaggctggagactgccgcagaggtcattaggatggatcagtggaggccagactgggaagattgagggcttggtcagtgggacttggtcatgtagcagcaggcatggtgagttttatgtgtctctgaggtttccaacctggattcctggagtatcccagtgtggattggagaagaggcaagtgtgtggagaactgttgaccaagtttccattttggacatgttgaatttgagatgcctgtgggccatttgagggaagacaaggagacattagcagagtctggggagaggccagcctgggctggagatgtgggcattaccagcatgtgtgtgaagcctggatatgggtgaggtactctgaaaggagataagaggagcagt

SEQ ID NO: 206936 - DNA, 443 bp, Homo sapiens
gtgactgtcaggtctggttctcacctatcatctcctctgtgaagtcttatctgcacatccaggccccaggaatttcttcttcctgtcatcccctagagcaatgatctctcacttactatgtagcacaagttactatgtattgttgtttcttaaaatgtcacaacaaaagctcccaattagatattaagctacctaggagtagagttttgaatttgttgaatctccagtgactaacattggattcttaagggaatctccatatgcccttttacccagtagacattaaacatttgatgttgaagaagaggctgatggtgttaccgccagaatgctgctaagaacatgatttctgtggctaaaaccagggttctggtccaagttctgctctatctttgtggcatgaacttgggcaagactcaacttctgtaggtctcaactatcta

SEQ ID NO: 206937 - DNA, 307 bp, Homo sapiens
ctcattacagcatttgctttgtataaacttgaagaacctgtacatcatccaaactctcatctctccattaatactgagtcaaatagcactgccttgatacataacaataattcagagataactgataaggtacttacagaaaatgaccaagcatttaattgactccttaattcttaagggtcatgctatgtaaggtagaacatatatgttccaaatatgttcaaactttataattcaattaacagtaaatatgattcacatcaaaatggtgtcataggtgagtggaattttgatgctctaatttatg

SEQ ID NO: 206938 - DNA, 425 bp, Homo sapiens
taaaggacctccagcaatgattttacttctttatgcttcagtttccttgactgttgagtcggggtggctatgatagtacttgctactggtgacaattgggatggttttagaacaatcatggtcaaggagagagtgatgggtgttatgacctcagctgtaatcctgatgaccacaagtatgacgggacttagggagcatctggggaagctgggaaggcttctcaatagcaattgctgggtggacctggggaccctcgccgaggggggtcaggttatgggccatgtaagtgtatctctgtctcattccggcccctcctccaagccacatgtctgtgacctatgctttttttctattcctttttcaggaaaccatctatcgacacctggtaagtccctccgatttccattccacttccctggtctcca

SEQ ID NO: 206939 - DNA, 489 bp, Homo sapiens
gagattcattctacatctgtgtaaattttttaccatctgttatgtggtgataatagttcttacttcttaggaatagtgtgaaatagctaatgagataatataaagtacatagcataatacctggcaagagtaaatacccaataaatgttagcattattatttatatctccatcagatgatcaattggcctcttaaatacttctggagctggaatgcttgttatttaatgatacagcttattccacttctggatagattgaatgatgaagaaatagttcacttatcaacctttcagttgcttaatgtcaatgattgttatgattcttaggtttttgttctttaggctaaatatttccacattgtcttgcaaatagtggatgatggatatatatttgtttaattgtcaaatattcttgattcaaaaataccattgatttaggttatacattttcatttaaaaaatcgcttcattaaatgtatataattttt

SEQ ID NO: 206940 - DNA, 453 bp, Homo sapiens
ggagttcttaaagtgagctccaaggaagccaaacattgtaatatgatgccttattctttaataacaacctgtcgagtgcggcttcctgataacagcctttgtccaagtcttaatgcaaccaagaatgaagggtcgttttcacagcagcttattataacaattattattaactgggaatataattaaatataaaattaaatataaattaaaatgagagaaaggggagacctttctcatctattccatcatctgtgtaagagttctctcctcttcaaagtcctattctggtttctgggaagcttttactgtttcttaggaagacacgccggatgtaagactgttaaactcgtttaaaccaattttgaataagctacttcttaggctagggtttctgtaaggcccggatgagatgggttggaaaggattcagcatatagatcagaagtgtttaaaa

SEQ ID NO: 206941 - DNA, 461 bp, Homo sapiens
tgtcaaactggaagttgtgaaatggtatctcactgtagttttaattttcacttctgtgaatacaaaagtttgataattttttcgttgtttatcagccttagtatttttttgtgaaatttttcataatttttcccattttattgaattggcaatctctgtattattaatttgtaggaattttgtatacattctaaatactaaatctttgtttatattagttgcaaatatcttgtcacaatttgtggcttgtcttcattgtctttatagtgttttttagaaaaaaaattttcaattttcatatattgttttatcaatcttctcctttatggattatactttgtatatttatatttttaaatttttatttttaattgacaaataacaattatatgtacttatgaggtacaatgtgatgttttgatatgcttacaatgtggattgattaaatcaggacaattaac

SEQ ID NO: 206942 - DNA, 608 bp, Homo sapiens
gaccctccccaagtaagacagaattcttcctgcttgactgccttgtaactgggacattggcttttttccctgccttgggactctaactgaaacattggctcttcctgggtttgagtcaagcctaccagccttcagataggaactacacccactggcattcctggttctcaggctttcagattcagactggaactcaaccactggctctcttgggtctccagttgcccacctccataatcatttaagtcaatttcttataataaatcttctatattttttgcttatttatatgtgataatatagatatagctatacatattgtatcctattggctctgtttctctggagaaccctgagtaatccatttacccttatcacttctatttgaaattgtactgggattcttagccagtgcatacaggaaagaaaaaagtttggaaagaaagatgtaaagctgccaccttttttcagattttgctttaacattctactggagctcctcacctgtgtagcaaggtatatctacaggaaaatcatgtcataattacatttaatgtactcacattcaactatataatcctgctggggagaagaaagaaaaagagaac

SEQ ID NO: 206943 - DNA, 553 bp, Homo sapiens
gttgacaaaattaagatgtttaccatgatcttcccaataaactgaatgtactttggtaaagaattaatatcatataaatttgttactgcaattatatttatttattttttctttttttgagacggagtttcgctcttgttgcccaggctggaatgcaatggtgcgatctcggcccaccgcgacctccgcctcctgggttcaagtgattctcctgtctcagcctaccgagtatctgggattacaggcgtgaaccactctgcccaaccaaaaaatatttaaagacaaaggaaaacaaagtagcaagctactctgttttactatgtttcgtattttaacatctctgaaatctgggtccatttaacagtggatggatagtggtcctccaagcttgtcaaccaatgccatccatttcctgtgcttactataagacatcaaaaacaccagattggaaaaaaatccaaactataatggtgagagaattgatgaataagatgtgttgtacaacattcccaaagacagctaggtacctagcaccacagctttagttctttta

SEQ ID NO: 206944 - DNA, 711 bp, Homo sapiens
accaatgtaatttgcttgtattttcatttttatgtatgggcaatataataaaaatgtgtctaatgaagtctaagaaagctttctaagtaagtacaaaattaaattctaagtgatttttcctatgtgtatatttttcttcattttccagactacatatttttgaaaaatgtaccattagtcttttgtaacttaaaacgagttctgttgtttatcatataaaatgaatgcttttttcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccaatttaacccatccaaacaagggggagcaagctaataacactggaaagcgcgcggtgtgcacccctagtgtcgtcaaaaagagccgctcaggaacaaaaaaaaaccagatgcacattgctgaggcagacacgaactgcaagagagcaaccaatatttacttccggggaggtagacaaaacatgctgaacacaacatctaatacaggatctatatagccgctaaggggacaatacaaagcagcctcagatggctcgacacagtaataacacatgcgaaattctaattggagctagctgaaaagttttttatatcgcagatcatacatcagagaacttaatcagaggatatgtacaaaaagcagcggtgcatgagtaaaga

SEQ ID NO: 206945 - DNA, 622 bp, Homo sapiens
tggtgagagaattgatgaataagatgtgttgtacaacattcccaaagacagctaggtacctagcaccacagctttagttcttttatggattctgtaaggaaatgcttgttgccagtgctttcagtgctgcaaaggataaattctgtggaaaaacccagacaatctctgagtcggaagtaatagttcaaaagtgatgaaattttagaaatacctttaccaatgtaatttgcttgtattttcatttttatgtatgggcaatataataaaaatgtgtctaatgaagtctaagaaagctttctaagtaagtacaaaattaaattctaagtgatttttcctatgtgtatatttttcttcattttccagactacatatttttgaaaaatgtaccattagtcttttgtaacttaaaacgagttctgttgtttatcatataaaatgaatgcttttttcccaattctctgaagtccatttattttaataacaccatttgtttttttgccttcttcctcaaatgatccctttgttttaatcaaccctacctgctatccattcatgcaaaatacttttcccaatagtcattccttttcagtatgatgtattaaaaggaccactgaactgaatg

SEQ ID NO: 206946 - DNA, 354 bp, Homo sapiens
aggttgcagtgagcggagattacaccattgcactccagcctggatgacagagcaagactccatctcaatttaattcagccccttataactcctacacacccaaagtgcctgcgaatgatcactggcactttgggcgtatagaagttgagagacttagtcaatatgactaataggctgtcaagtccttccgttttctttcaggtatccggttgaaaacttaaaaatccaagccaggagggggatgatggctcatgcctgtaatcccagcactgtgggaggccaaggcaggtggatcacctgaggtcaggagttaaagaccagcctggccaacatggcaaaaccccatctctacaa

SEQ ID NO: 206947 - DNA, 494 bp, Homo sapiens
gctggaaccgcaggcttgtgctgccattcctgcctgacttttgtagttttggtagaggtggggtttcaccatgttgcccgggctggtcttgaactcctgagcccaggcaatctgcctgcttaggccttccaaagtgctgctaggattacaggtgtgacccaccaggcccagcccacttctgaaatgttaatgtgcataggaatcacttcagggttttgtatcaaattcagtttcttagatcctacccacagagtttctgattcaatcaatagggtggtgggggtgtcccagatcctgtgttgttaacaggactccctgtgtttcagaagctggtgctatgaaaactacaccttgaaaactattgtcagagtgtggtccacctctagaaaatattggcctgtctttgccagagtttcacccattccttagggagaacgggtgtagctgtctcttcctttccagtctgtgtaggaagcagaaccaagctcatagag

SEQ ID NO: 206948 - DNA, 603 bp, Homo sapiens
gtttaacagggcatctaaaatgataaaaataaatagaaaatcctgggttttttgtttgttttgcttgggtttggtttggttttgagacagggtctcgctctgtcacccaggctggagtgcagtggtgcgatcacagctcactgcagcctccacctcccgggttcaagctatcctcccacctcagcctccaaagtagccaggactacaggtgtgcgccaccacgcccggccaatttttttatgtattgcagggacagggtttcaccatgttgcccaggctggtctcaaactcctgggctcaagccatctgcctgcctcggcctcccaaagtcctgggactgtggtgtttgtttgtttgagacagggtcttgttctcgtcgcccaggctggagggcagtggcgcgatctcagctcactgcaacctccacctccagggctcaagcaattctcctgcctcagcctctcgagtagctgggactacaggtgtgagccaccacacccagctaatttttgcatttttagtagagatggggtttcaccatgttggctaggctggtcttgaactcctgacctcaagtgatttgcccgcctcgtcctcccaaag

SEQ ID NO: 206949 - DNA, 451 bp, Homo sapiens
cctatctatatgaagcacttaaatgcccaataagtacgaaggtcatgaaagtatcacaaattcatttaaaaaagttaagaaaacatagaagttatattcatgaagtattcataataacataaaaagtatttaatgttaactttaaaaagaagaatataaagctgtatacgaagcataactatttaaaaataaaaatgcatagaaatgactgaagaaaatgtgtcaaaacattaatagtggttgcctgtgggtggtagggtagtattatcgctggtttgtccgttgacacttttctgtatgttctaaattatataaaatggccatgtattattaatacactcttataatccaaagaatatagagcattaaaacagaattttaaagaattaacaaacatataatgttcaactgtgaacatatgtatctccccaaggtcgtctggggatcctct

SEQ ID NO: 206950 - DNA, 363 bp, Homo sapiens
ttgacggatggatggatggacagatggatggaaggatggatggatggatggacagagggacagacagatggatggatgaacagatgtttaaaaaccacgcagatgaagcatttagtaatgtttaaaattaagtgaatactaaagagtttcctgagttatcccctccttcagaatgagccacttttagaacattagagattcagagacagcctgtgcagacatcccgaattccggtgatcatgagtataaggagataacgctggaatgaagctgctcctcctaaaggccagctggccaaccccaaaccaggcaccccagatgagcagggcatccgacagccgccatgtgacgcacgtcttcttc

SEQ ID NO: 206951 - DNA, 164 bp, Homo sapiens
gttgcaggttattcttggtgggcacatacaggttcatggccacctttgctcctgagcatgtggctttccattgacggatagaccaccagttgtttgtcctctactcaaggatgtttagcttgttctcaatcttgctgctgtaaacagtgctgcagtgaacaccc

SEQ ID NO: 206952 - DNA, 531 bp, Homo sapiens
taatgagtggttgaaaggcaggaatgccatcttaacctcacagttttacacagtacctggcatagttgatatgtggacgtgtatgttatgtatggacttgcttagaaagaacttttaattcctgcatctcttatcaaacctaagttgacttgcatttttcttaatgtttgcaagttttgctcttgatgatgactttcattttaaggttacttagtccatttattggatcatttatataggtaaaaatgtgttaacttagacacagtctcatctctacccccaagaaatgacaagcagcaaaaccagctcaactttccagactaaatttttcattcttatatcctttgttaataaggcctctggttgattttttttttttaacagctctgttaaggtgcagtttacatgtaatagaatctgttcatttaaatagagtttgatgacttttggcaaatgcatgtagttctgtaactaccgtttcattcaagcagtgtaacgtttccattactgcacaaagttccctcttgctca

SEQ ID NO: 206953 - DNA, 569 bp, Homo sapiens
aagggcagtgaatcgagactcggtacccaccactcctatagatcagtattcctggtagttccgagacttaatggccacaaatgttgaaaaatgttagctctacgggaaaacgaatcgaagcgttttcaggggctcgagtagttatgagcttagtgtaggcccaagttttaagctatagaaacatctccctgtatgtgccaactcaaatccccgtccctgtaagaaacctggacaccagcatgattttaaacacttctacacctctccgtcctatttttccatgctccacgctcgaaggaaaaccgccacccaagaaacacacggagctagccaccccgaagcactggaagggcgcaatagtttttaggtcaccccgcaaaggccacaggtggcgccacccccctgcccccgcaccgccgccctccgccccgcgcccccagcttctctccagcagcgcacacttggagcagtccttcccgcggccatccgaccctgacccatcgtccccgggaccggctgctgggcgcgaggaacccaggccgcggggctacctcgcgcgcgcctcgtgc

SEQ ID NO: 206954 - DNA, 641 bp, Homo sapiens
gtatcaagtgctgaactacaggggcatcaaattcatgtaaatattgcctgtggatgatcatatttgcctgtgattcctttatgttaggctttttctcagcatgatgtttttgagatgtgtccatgttactgagtgaatgactcttttgtttcttttcatcactgagtagtgtttccttatgtgtccattcacctattggttgatattcaggttctttccagtgtggaacttttatgaataaaactgcagtgagcatttatgtacaagtctttatgtggaaatggtttatttctcttgggtaaacttttaggaatggaactactgtgtcatgtaagtgtatatttaaccccataagaaactgtcaggctgggcacagtgggtcacacctgtaaacccaatactttgagagggcaaggtaagaggattgcttgagctcaggagtttgagaccagcctgggaaacatagcaagaccccatctctaaaaaaaaaaaaaaaaaacttaaaaattagctggcatgggggcgttcacctgtagtacctgcctgaggcaggaagaccacttgagcccacgatatcgaggctgcagtgagctatgattgagccactgactgcctgggccacagaatgagaccctgttcaa

SEQ ID NO: 206955 - DNA, 504 bp, Homo sapiens
ctcatttatttttcccaccgaaatttggaatttaggaagagtcgatatagctatatttagatgatttatctccctgaagacattttgggatcatttatacatctctataaacaatgctctgatgttcctttattttgtttagagactgggtcttgccgtgttgtctggagcggagtggctcgatcgtagctcacaatacacaatacaatcaaactcctgtgctcaaagtgatccttccactcagcctccacagtagctaggtctgcaggtgtgtgccagcacgtctagcttttgattactattattatttttgtagaaatgagggtttcattatgctgtccaggctggtcttccaactcctggcctcaagcgatcctcctgccttctgccgtctgaggagctgagattacaggtgtaagccaccgtgctggtcctgatgtcatttaaatacaaacatgatactgtattccttgtagaaagtgctacataaatataatttttttg

SEQ ID NO: 206956 - DNA, 601 bp, Homo sapiens
gtgaagctacacatttttcacagtctagaggccctagacctgtcagcggccaattatttcaaaggccagacatgtgcaccttaaagagagactggaacttgcagacggcctctagaaagccataaagatatttactgtactattatgttctggtagtatacttggaagataactgccaaaaatcaccagaaaaatacttttcaatttatgagcagattattacaagagcaatttaccaagacctaccaatgaacaatgaaaactatgaactgttattctaaagctaatagaaagatgtggttttcatgtccatttccatcatctgcacaatgtaacctttaaaaatatttcttaaagtgttaagtttatgggagcaaaaaaatattgaaaaattatcagaaagttcacaaaaaccttacaaactcacatgtcatcagattaaatgttctcagagagcctgcagtttttcacactccctgcaacctcatggtcatcgctccacagcaagataaatgggtgacaagacaatcctcttctagtttggttggacaaatgtcaatatcagcataactttcaagtctttctatgtaaatctgcaaaa

SEQ ID NO: 206957 - DNA, 393 bp, Homo sapiens
ataaaaataattttaaatattaatatggtatatttaccctgataatggagaaataaaaccttaaaattacaaattattttaataattcaagatggatactgatatcaatacaataatacaatatatttgggtctagctttcaagactaatagccagtattatgcatgataacatttgagtttgtagtaattaagaaatatccctagtcatgtaaagttttctttaaaggtttaaatttgatattaatatgatataagcaacattaagagcttgaaatgatcaattctggtattaaactaaatattatcacatatatttttgtctggccttgtagtattatgatttcactcactgaataaagataaactataatattgatcatacctaaatatg

SEQ ID NO: 206958 - DNA, 201 bp, Homo sapiens
gctatttgttgaatgcatctatgactcctcaaagtactctgctaagggtaattaaaaggaataggatgttatgaattagatgaaaaataaaaatcaaacactattggaattaactgtttttttccttcaaagcaactgatgacattgatatgaaattggaaatatttaaccgtttgcaaattctttttatgctaatagagc

SEQ ID NO: 206959 - DNA, 325 bp, Homo sapiens
gctatttgttgaatgcatctatgactcctcaaagtactctgctaagggtaattaaaaggaataggatgttatgaattagatgaaaaataaaaatcaaacactatagggcaacctcctcttctggtttaggaacaatctgttccttttccgtaaggatcatctcaatgtggcagggagagctcatgtatgggttaatccgaccatgagctctgtaggtccggcggcgcatcttaggtgctttgttcacttggatatgctcaatgaccagagaatctacatctaaacccttaagttcagcattactctctgcgtttttaagcatgtg

SEQ ID NO: 206960 - DNA, 772 bp, Homo sapiens
ttaacctgtctctccccgctgctagcctatgggctatttgttgaatgcatctatgactcctcaaagtactctgctaagggtaattaaaaggaataggatgttatgaattagatgaaaaataaaaatcaaacactattggaattaactgtttttttccttcaaagcaactgatgacattgatatgaaattggaaatatttaaccgtttgcaaattctttttatgctaatagagccaacatttcaacagttattacttcactttttacttgtgtaatgagaaaatttagaattaaaaatgtacaaaattgaaaaaaaaaaaaaaggaataggaggctgagtatggtggctcatgcctgtgatcccagcacattgggaggcagaggcaggaggatcacttgaggccaagaattcgagaccagcctgggcaacatggcgaaactcagtctctacaaaaaacaagttttaaaaattagttggccgtagtggtgcatgctgtagtcccagctactcaggaggctgaggtgggagtgtcacttgagcctgggaggttgaggctgcagtgagctacggtcacgtcactgcactccagcctgggcaacagagtgagtccctttttcaaaaaataaaaaagagaaataggaaatagcatagaatggaggagctgagccacaggtgctgctggtgggcgcacagggcaaggtggacaagggacggggagggagacaaaggcagaagaggtcccttctcctcctcctctcctcagggagtaatg

SEQ ID NO: 206961 - DNA, 213 bp, Homo sapiens
ctatttccatctccacacacatagggcctatacagggcagtaaatatttgctgaatcaattcacttctggggcctgatgttgcacagcagacaacatattgggtttttagtcagcttctagactttacttttagtattgctaagttttgcacgttgggttttacagttggtttttaattgttgacccatatacttatccttgttagtttttat

SEQ ID NO: 206962 - DNA, 178 bp, Homo sapiens
gatactgatgaataatggtctagctaagtatccaatttgcattgttgccatctactaatttcagaatcattgctcattttcttccttgcagaacttttgaccctaatagcatgcctgttgaaattatttttattgtatttgccttcagaagtggtttgaattattacccaatgaatat

SEQ ID NO: 206963 - DNA, 268 bp, Homo sapiens
tgccttttattcgaccttgtttcacccatgtatctatggatctttcctctcagtcttcatcggggggcctcttacctgtatgcagacctatagctcaggcctccagcagctttgtgaaataaaatttgtcatgtgactgatcttctatagtcagagagaacagagaatatatgctagagctctttctcacatgtaactgaaagcctcactttaggcatgactggatctagggatgtaaatgtggcaaggcccttgatttcactccctg

SEQ ID NO: 206964 - DNA, 581 bp, Homo sapiens
ggcaccatagaagaaacaagtgatttcagtcaaagggcctggactcacgagctagcaactttggacagattcttgaactctcagcctcagtttctgcttctgtaaagggagataactacagtgaccttcaggttatcttgaagatgccaatgagctagtgaaaatgcaatttaatctgtacagaactaaacaaatgtaagtcagtgctaatattctgttcctagtggggacatgccaagtctctttactgcaaccagtggttcacatatggaaatattgtgctaatttccaactcctacttatatatatgatttgttaactctggaggatgcagccatcagcataagcaaccaacagaagaacacgctggatcctctccttttcctgacagtgtgtagtcttcatgggggtggacaggctagatttaaaacgatgggcggattgattatttttctgcatctatttccagggttgtaatgtatattctctttctcccacatcccgccttctattttcttctccctacacaggctcttttaatacaaattaattaaaagcaggcatcttaagaggtggcttaa

SEQ ID NO: 206965 - DNA, 420 bp, Homo sapiens
cttgtcatatccaactaaatcaattgaggggccaggaggaaaaagcacttagggcatataatgttgctccatgaatgtaattctctgcaagcccgctgctgaaactgcctgtggtaacctgaaaccagtattatctaatagctgccgaaacaatctgttgtgactctaagactaactacccactgctgtcaccaatcacagcttgccagctcctcaaaactttactagtgccaaccttctctttgttctttgtacatactgaagatcacccaatctgtcccaaaatgcaattcttgttttccaaataaaacatttttaatttagagattcatctctatattttctttgacttcaacagaacgacccaccgagacactcagctaagagcatcgagggggcgccgagagaacgacccaccga

SEQ ID NO: 206966 - DNA, 367 bp, Homo sapiens
ctttctgagattgctctctaatttctctagaatccccatattcccacagctttgatcaaaagacagtggggataaaagacttccctaaaagtttctctttactggttcttccgcattaaatctgatgctctatttgtgggtttaactcggtatctattaaagactgtgaaatgctggtttattttgttagtttttcataagctttcccactcctgatgcagggataatttgagtgagtagtgttcagtcaataagcaaagaatatgttaggggcttggctgttttcctagcaagggtttacatcaaagaaaaagcatggctaaatagggtttcttttttttgtttgagacggagtctcactctgttg

SEQ ID NO: 206967 - DNA, 176 bp, Homo sapiens
cccaccttattaatattgaagtgccttagggcttagttcttgccctttatgttgtatcttacttcctcacttggtgatcaggtcctatctcatggttctaaataacatcattacagaagtgactctcacaaggaagaggtaggaaatggtcatttttagttaaatattgaaaatgg

SEQ ID NO: 206968 - DNA, 386 bp, Homo sapiens
gcacgtgagaggcacagagtgggccctgctcctaaagtcacagcacagcccaaacaattacctctcagcccccagcctcacaggggctgcacaggacacgtgagaagagaggtcgcttgcacctccgttctgactccgtggtcctcccactactgtggaggaggaggctgaggatgcctgcttgctgcaaggaaggaaaaccatggccctgaccgttggcagctgacagctagaccagagtattctcacctatgcacgagcgtttacagaatatcagcaataatcagaccagctcactctgtgatcatggtggaaggagatggagacaagggcacgcggtgattctatctggacagagaggcaaggacgctctgcaaccacaaaaa

SEQ ID NO: 206969 - DNA, 465 bp, Homo sapiens
cttggccttccaaagtgctgggattacaggtgtaaacaactgtgcccagcctatcccttcttaagaagatcccttaagaagatcttttctcaaattgattaaggctcagtattagtaagtaaaaaagtcatcagctgagatcttgaactctaggacttaactgcggttactgaacctttatttctccaaaagctctcctttctgaattacgagtaatctgaaagaaaaagtacagagaaatatatttgctattttaatatataaacagagctctgttttatatttaaattgttgatttgatgaattagtagggaagttaaatcagtgataaactgggacagaagaaagccaagtattcaatgcctgaaactctaaagtttttggactggattgtcttttattcatgtaagtactccatctgttaatgcattttctctccaaaataaagctatgcttgaaacatca

SEQ ID NO: 206970 - DNA, 526 bp, Homo sapiens
actcagtaattgtgtgtgaagtaagtgaaagagcataatgaaaatcctgtagactttggtgtttcatatcctggacagagagaagatgaagtaagagagaaaaatgagcataattttggcatttattaataccaggctgtttcaatgatctcttatgtaatctttcatcatcattccactgtgggttttattttgatgcacaagttatggaagatgaaataaaatttcagagaagtgaagtctattttaaccaaggtcagctgggaaaaggtagagaaagaattcaaatataactaccctttaattttttgtcaatatgctactgactcgtgagtcagaggtaagatgataaaaagagtgtaagcaacgttaatgtgtgtcttttccctcacaaagatgatttcttcttgaagttggcttaaaggtcactatggatgttgagactaagtcaaggcagtacttgataatgaaactatattgtctgcaggcctgcaaacaagcttagtttgaggagaattattgaatg

SEQ ID NO: 206971 - DNA, 446 bp, Homo sapiens
acactaccttattcccactctcatatggaattctacctaactggaatgacctctttccatctgtctgcccatgtcttataaaaccaccttaaaaaaattagtaaaagcccacaaggttagaattgtgataaggacttaaggtttgctaaggtatgggcatagttaaatcataaccagttattgtttcataacttgctttgctttgctttgcttttctataattgcttacagcttaggagtcacatagctcatggtcacagatttgtaacttctcccattgcttcatagaaaacatcagtatcataaaacctaagactggtgtttgaggtatttttcagactttgcattctgatgagccaacgatgccacccagatctgtgacccacaccaaggaactgactcaccagctctgtaagccccacccagaaactgactcaggcacaaag

SEQ ID NO: 206972 - DNA, 281 bp, Homo sapiens
tgctttctaaaacaaacttctatcttctatgcaaatggaaattaatagacatttataaacatgagaataatctaatcacacttaggaagattatctgatggcagaataaacagactggcggatgcaaagacttgggttaaggagtgatcagatgaaactactaggcattgctggaggagaaagacaagagtctaagctagataataatggagagggtgagttcttgagtcgttgtcttcttcacggaaaacccaaatttcatctattgattagacttcacg

SEQ ID NO: 206973 - DNA, 234 bp, Homo sapiens
ctatcacattatctatgtgccattaagactgcctgggaaaagaagctagcatcacttaggaaatctgagggaaagtaagacagtttgcaaatgatccctctgtcaaagagatttgacacataaaaaaatcaaacaacatacttatagttctaggggggtggggaacttccttaaaattgaatagtgtgtctgccaggataaaaataatattgtctgtgtttgcatatgtgtatg

SEQ ID NO: 206974 - DNA, 742 bp, Homo sapiens
ggcctctaaattgttaccaaaacaaagatccctaatttcataagcagcttcagtgagcacatagaattaacagccatatttcttacgctgttttttccacaatacctaccttgtatccagggattaaattcatgtaattctgaaggaaaggatttggctcttagcctgcttgtcagagtgagcatgacttagttgtgcacctgtggctatctctacctggtttcttctcttgtaccgtgagcacaagtagccactgaaatctcccgagttccagaggcccgtcccccctcagctgtatctccccatagtgcacacattcagcccacattcccccgtgttcaaggccagggcagatcatgcacatcttgcgctgccggtcagagaacagaattcctcatatttctgaaagtccaaggaacagtgcagcagtaaaaataacttaaaagtgggctgtagtgctcttgttttcacagtaccattaaccagacacatttgatagaaaatttaaaaacttcatttaatttgtctctgatcaatgttgtgttcatggagttacctactaaagaaatggaaacccaaaggctctcagtggatgagttgaaccttttttttttttttttgcattactgagagaagtcgtggaagcccaaaactagtttcatgagttaagctaaacctatgttttggggtttcttggtttcacacctgtctctgggtgtatctgctattttgtgtgcatgtg

SEQ ID NO: 206975 - DNA, 381 bp, Homo sapiens
tggggtgatctacagaccttaactgagtggtagggaactaccagtacattgaacacatccatgggatcacagcaaggaggccaaatgagataggatagggattcaaaggagaaaaacagaaccacagaagtacacagctctcagatgaaagccacttaatcagcctcatcccattttccaaaattcagacaaatgcagagaaacactgggcttatttagcagtatctatactctaacacacacatacatgcacctgtgtgttaatctaattagacagcttttctagttctaaaggtgaaatgcacgaagagcaagttcttaggttattttctctttaagcaagggggactcttacatccaacgcatgcaacagctatttag

SEQ ID NO: 206976 - DNA, 356 bp, Homo sapiens
gacctgaaaggatcaaactatctccatataactatattcccgaatgagctgaagaaaatgtacaggaatacaaaaatatcttggacccaacaaggtaaatttcacaaagcctagcattcaataaaaaattaccaggcactggacaggcctgatggctcacacctgtaatcccagcactttgggaagctgaggcaggatgattgcttgagcccagaagttcaagaccagcctgggcaacacagtgagaacctctctcaaaaaaagaaaggaaaagaaaaaaaaattaccaggcgtgcaaaagagtaggaaaatacaatccataatgaggaaaatgaatcaactaatggcagtcaacc

SEQ ID NO: 206977 - DNA, 314 bp, Homo sapiens
aatgttgctttctggcctgcccccagcccccatcttttacctataaaaaccccaggctctgttggcagaggggtggcacagtggcagagtggagcagcagagaaggagaaaagagaagcagcagccaggtgtcggagagaagcagtttgacttcagagggatggcttgacagcgagacttcagagaagagttccgccagggacagctgaactctgggagaagactgcctttccactccatccctgttccagctccccatcctgctgagagccacttccactgctcagtaaaatcctccatattcaccacccttc

SEQ ID NO: 206978 - DNA, 246 bp, Homo sapiens
caatatttttttctcgcagtatttggtggtagttatgtaaatggccttgtaaccccttataccatccggcgatctagataccaaccaggaaaacgtaagccctatgaaacagatgatgatcaaaataccttttcaggtatttgtaattggcaaagctcatctggtattcacagtggaacctcctacctcactccaaaaacttaaaccttcaaaagctagtgaaaccagaagtgtgagcagcgttgg

SEQ ID NO: 206979 - DNA, 589 bp, Homo sapiens
tagatgcacaccgcaatgcccagctaatgtttaaatgttttgtagagatggacatcttgctgtgttgcccagggtggtcttgacctcctgggctcaagtaatcctgccacctcggcctcccaagatgaattactggagtggaatttctggataggaggaacgtgtttttcccttggacagatgcaacccacgtgtccccacagaatcacacctgtctacaacaaccagccacattcccagaccttcactttcatgcacacactgacataggaccttatccagccttgggttctggatccagcactctggcaggtgaagtggctcctcgttgtagttatcatggggtttagtgccaggagggaccccagaattgcctagtgccacacctttgcaatgtccagcggagctgaggcgcacctgagatcgcccgtgaggattggcacaggtctggatgtgggcttgggtcaccaggctgcagtagaacagcaggcttattctcctgacctgtcctccccctgccatgtttcacctggtccctgtgttcccacacacctgccagtaccacttgcatcactgtttcctgcagatt

SEQ ID NO: 206980 - DNA, 268 bp, Homo sapiens
gtcacaaagaaggaagtcatgcctttgtggaactattcagcagtaaacagcaaaatgcatgtgcatgtgagagatgagggatgagttccttaagccatgggctggtgaatatgtaagcaaatttaaataacttgccgacaagctcctttctccaaaaatgtatttccctggcagcaattgttgggtccctctcttcttttcaatagccagatctagaataggtttcctttagtaacttgtttccctatttggttatatatatatatat

SEQ ID NO: 206981 - DNA, 199 bp, Homo sapiens
aagtgacctcacccttgtgtgcacacgctcccgggtctctgctccctacactgactccggcaccaaagtgatcctccctcatctcttcccgcagctcacacccctttgtctttccctaaccctcctctccccacaacccaaaccgggtcacacattggcggcaggtgggctgggattcgaccatagatgggttttgttt

SEQ ID NO: 206982 - DNA, 241 bp, Homo sapiens
ccccgagactgctgagcaagaacggaaacagacattttccattaagctaggtccagtgggatctgctaatctatcagagcctcattccccacggcggcctctctcttatcttcccaggctctggctctgagacactccctctccaaaaagcaatcactagcttccaggactaaaagccaaggaggaaataagaacccaagaacagacgccccctaagcaccacaccccggggctccaaacc

SEQ ID NO: 206983 - DNA, 833 bp, Homo sapiens
gcccactcccgaggggacggtctcccgcccgccctcacacacagctagctcttcaggccaggcccccagggtttcgtccacctctcacctttgacgacgcgaatgaagaatgaggaggtgctgcgatcgaacgactgcgaggaaacacacccgctctcatggcattcccagtaaactgagaagacgtgattaaacctcaggatctcctactaatagagaaatgtataacgatttagctaccagatctgaatactgaagggttggtaggggaccagagaatagaggaagcattgtaggttctagagtggagaagggaccatccaaaatggagtttgaaagagaattctggcctttgtgtttagagtctggaattgtcaagagtctgaaagcacagaataagactgcagctagagcaatttaggcgccatagtttgtcaaaacaggtaaggggaataaaggggatgacaccaagagatgtgcaaagaatctgaagaattcacctgaaaaggatacaacctcctcctggaaggcagaggagtaaatagggaattggaaattaattccttatttctgcacatgcacagaatctgggcccaggtgacttatggaacctttatagagaccacggtgactgacactcatgggaaagggggttagaggggcaagaactgactgttcatcaaaaattattagatgagtgtgtccacgacaccaggagatatgttgaatcatggacagggaccagcatatccactaagctctatatatcttgatggtgcaggatccaagtgggatggaacaaccaattcctgcccatcctcctgctcaataat

SEQ ID NO: 206984 - DNA, 410 bp, Homo sapiens
gcccatagaaacagactcagaaataaagatatgatggaattagcagataaatacatttaagcagctattacaaataagttcagagatttaaaggcaaccgtgcacataatgaggagagaaattaaatgtataaaaaagtctaaatattgtaatatgtgctgttttctttcagtgaatggaagagtttaacgaagaaggaacattggaatcaagagttgagaacataagccaggcgggctcacgcctgtcatcccagcactttgggaggccaaggcaggagaactgcttgtacccaggaggtggaggttgtagtgagctgagattgcgccactgcactccagcctgggtgacagagtgagactccatctcaaaaaaaaaagaaaaaaagttgagaacattatcacagcatg

SEQ ID NO: 206985 - DNA, 151 bp, Homo sapiens
gcacatttcagcttgttctgaagaatcccaggctctgggacctgaacatatggtctaagttatttagccagataagacatgggatttcctacaagtagggttttgtcagcaggttggtaaacagtttttcctcagcttggacactccatat

SEQ ID NO: 206986 - DNA, 337 bp, Homo sapiens
cttttaatcttatttaaacttctttttttttttgccttgacaaatttaaacttatttttcttaacttttatgggtacatagtgtgtagatatatttctgccatatatagcatattttgataccagcataaaatatgtaataatcacgtcagggtaaatgagggattcttcaccttcaacatttattccttgaattacaagcaatccaaatctacacttttagtcactttgaaatataaaactaaattgttatctttattatagcgtcatttttgtggtcataataaaaatcatataggaatgtaaataaaatctatacatatctggaaaaaaaaaaa

SEQ ID NO: 206987 - DNA, 1029 bp, Homo sapiens
ttcaaaaattctacagggcaggatttatggtaacagatctttgtaccagttctcactggatcttcagattgaaggtgactgcatctcagtaataaagtggcaaaacttaagaaatcatgggaagaagctggtacctccttcaggccaaaataaaacgatgaagcccaaggagggaagtgctggaatcatggctaaaaatatcagatggcaagtgtctatactctggtgcaaacagcattagagaaagcccaccattaagactccagaactcagtgaaacttgggagcacaaaccatgatcagcatgtttagactggtcactagaagaagggataacatccaaatgccaattcaatcatccctccagatcccgggatgaagggcacttttgcatgcagaaagaagcaaagcacaattccactgggtggtcaggcccagaggccaagatggctgcaaaatttgggcaggtttcccttctctcagttgccatcctatagagaggttaatgagccttctagttcttctcctgagtcagtcctgttttagggatgtgccctcaggatacctctcatgaagtcccttggtgtctgtacctctgaattaatgcccagataatattttctcgctgggaaggatctatcattgaaatccagggtaacattcaactggagagtccgatagctgatatttaaacccaagttggtctgattccagacctcttaataacctggctgagtgagggggacatatcaacaaataggaatacttcagtactagttgcaaatcagccataacataattatctgtgtgttttgggaagtcattttaacctctctgtgcctaaatttcctccattgtaaaggctggggatcaagtcaaataatttctaatggttcccttggctctaacgtttaattattttagcttacctggctctactcacgcaactatttctgtatttgtgcagcaatctatgtgtaatatctatttacagtcaaaatttattttataagtgatttcacattacaat

SEQ ID NO: 206988 - DNA, 394 bp, Homo sapiens
ttcaaaaattctacagggcaggatttatggtaacagatctttgtaccagttctcactggatcttcagattgaaggtgactgcatctcagtaataaagtggcaaaacttaaggtaggttccacatggaaagacaatacctgtaaaagctaagccatttaattcatcccctaaccaccacaacaaacgtttaggactagtgatgaccactaagcactgttactaacgtaacctcatccttcccttgtattcagatatgctttcttgagagggagagtgaataggtgggtattatagccaacaggtaagacacaggcatgggcaatcaaagccattacaatttaacctgtttattgggacagaaaaaaatgagaagtgtttttctagatgcactttt

SEQ ID NO: 206989 - DNA, 304 bp, Homo sapiens
agttaaaaagaccttgtcaaggttggagagaaacaaagaggagtctgaggaagaggccataaaggatctcattcaatttaaatcacattatgcgtgactaccaccaaagagacctcataaaccagggagaatgatgggtgtggccttcagactgggaaagcaggtggagtctggtttggaattaaccaagaggtctagctttctatcagatcctgaaagctcagagcccaagagatgctttatggcttatttatttcctctccttattccagggaaatgctttaagcttcatacctagcagatc

SEQ ID NO: 206990 - DNA, 485 bp, Homo sapiens
cttccagccctgtctctgtctagcactgtgcccataatagctagtaagtgttttctaaatacataagtgaaaacaagtatttaaatggatgaatcaaattattaaggaagaatggaatcaatggacagatgaatttactgtggcggacagcttgaatcaagccaaacctagaccagtagttaaaaaacaaatcatcagctaggcgtggtggctcacgcctgtaatcccagcattttgggaggccgaggcaggcagatcacgaggtcaagagatagagaccatcctggccaacatggtgaaacttggtttctactaaaaatacaaaaattaactgggtgtggtggcatgctaggacctgtagacccagctactcgagaggctggggcaggagaatcgcttgattccggaaggcagaggttgcagtgagccgagatcgcgccactgcactccagcctggcgacagagcaagactctgtctcaaaaaa

SEQ ID NO: 206991 - DNA, 147 bp, Homo sapiens
tcagtgcgtgtgcatgcatgtgtatgtgggttcagctctatgcctgtctgtgtgcatgcatgtcccacatcgtgtgtgtgtcagtgtgtgtgcatgcatgttcagctctatgcctgtgtgcatgcaagtcccacatcgtgtgtgtgt

SEQ ID NO: 206992 - DNA, 305 bp, Homo sapiens
tggacaaaggtacaagttgctcccatggaggatgtccctgcagaaaatctgcaatccacaagagaaggcagcaaagtcctcatggaacttccctgtttagattgataagccaagaccacaattaaaccaagacaaacaaacgcacaaagtttatctctgaatttctgtgtaatgcccagcctggctcttgatgactcagcgatgctctatcctgatttaaactttcccctgtcgtcggggttcccaggctgctgtctgtggccacacagtcctctacattcgaacgctttgcctttcgtcccccg

SEQ ID NO: 206993 - DNA, 518 bp, Homo sapiens
ggcagaaggcaccagaagtgaagcttgcattcacagctcttgccaggaatcatggccacaggttcagcagcttccagagggtttatttctgagcaattatagcaagttaaaccttaaacagagaaggttcgtgtacttacactgcaagagctgatctcctaaaggaactgaacagagaagcacacacacagtggggtattcctttgtcagatttaagtcttcaacaaattggagaatagccaaaaggaatgtacacattttttgaaggagaggatgtggatagcctggaaggtataaatgaagctttgagaatggtggcactctccggccattcagtttttcatagaacacctctagagaaagaaacacaaactacttcaaattatcctcatacgataatctaaccgagctacactgagtagttgaattggccagaatgcatcaacttgactgccagtttaagatcccaaaactgaattccaacatctcttaggaggaaaataaactattcaaccaaa

SEQ ID NO: 206994 - DNA, 578 bp, Homo sapiens
atatatttttgtatctagtatgaggtagagatctaaattcgttcttaagcatgtggatattcgcctgtctctgcactatttattgcgaagagtatccttttctcattaaatggtcttgacacccttgttgaaaatcagttggccatagatacatgggtttatttctgtgctctcagttctattccattgatctgtatattatacttttgctagtaccacactgttttggttactgtaattttgtagtaagttttgaaatcagaaagcatagagttcttcggttttttcttctttttcaagattcctttagctacagagtttcctgcaattgaatgtgaatttgaggattttcctttccatttctgcaaaaacagccaattaggttttgataaaaattgcattgaatctgtagatcaatttgggtagaagttgccattttaaaaatatttagccttccgggccaggtggggtggctcacgcctgtaatcccagcactctgggaggctgaggtgggcagatacctgaggtcaggagttcgagaccagcctggccaacatgatgaaaccccgtctctacta

SEQ ID NO: 206995 - DNA, 538 bp, Homo sapiens
cccttctacccagcctacgagggcagttttctctggaggagaagagcctgtcgctgaaaatcatgcagtacctttgcccagcttgctcagagtctgagcaagctgggaacccacacgtgaccctgttctactcatcacagtccaggcagccctgcaggatctggccctatcacctctgtgacatctcctctcccactccccccagcccacttcactgcagacacactggcatcctcactcttctccatccacaccaggcacattcctccctcagggcctttgtactgatcatttgtcccacagatgtccatctcaccccaccttgaagtttttcttcaggtatccccttctcagtgaggccttttcggacctccttattaaatatcacaaacaattccacccccacccccttccctgatcctctatggcacttactacctgacgcctacccctcacaatcatggcaagccaacgccacttatccagtgaaccactagcacgaaaaaaactctacctctctagtacttatctccctaga

SEQ ID NO: 206996 - DNA, 710 bp, Homo sapiens
taacttcctcctcctgggttcaagcgattctcctgcctcagcaatcccgagtagctgggattacaggcatgtgccaccatgcccagctaattttttatttttagtagagacagggtttctccatgttggtcaggctggtctcgaactcccaacctcaggtgatccgcccaccttggcctcccaaagtgctgggattacaggcatgagccatcacgcccagtggagatccccatctcttaaaaaaatctgaagcagatcacatcatccttccctgctgggaacccacacgtgaccctgttctactcatcacagtccaggcagccctgcaggatctggccctatcacctctgtgacatctcctctcccactccccccagcccacttcactgcagacacactggcatcctcactcttctccatccacaccaggcacattcctccctcagggcctttgtactgatcatttgtcccacagatgtccatctcaccccaccttgaagtttttcttcaggtatccccttctcagtgaggccttttcggacctccttattaaatatcacaaacaattccacccccacccccttccctgatcctctatggcacttactacctgacgcctacccctcacaatcatggcaagccaacgccacttatccagtgaaccactagcacgaaaaaaactctacctctctagtacttatctccctaga

SEQ ID NO: 206997 - DNA, 219 bp, Homo sapiens
aattagtggattttttttctcctagccaagttatttagcctcttcctatatgaaatactccttcttttcatctgtttttgtttttaaatgagatgacaattcatgactagtcttggtccccttaacacttagtgagtgctcaacaaatggtaggaattattatggataacaataattagtgtaagttcaatatgtaaataaaactgccttttgttcact

SEQ ID NO: 206998 - DNA, 413 bp, Homo sapiens
aagtggaatccatgtttgttctgtttgttaaaaactgtcaagttgattgaatgttttgttagtgcttttccttttcttgacaatttgtcaagaatgtcatttgtaaactttcttcccattataacctattgatatctcctcacagtccataaatggccaatctttaatacatgctgcatgggcatgggaaaaggcgcatgtctgagacatgaaatggttgcagtgaacaagtcagttaagtcacttttactaagtatgcctttctcagccctcatgcttttatttatgcttggcccatttgtgttgaagattgggagtggttcgttaaagtttccaaatattaccaggtttccagctgaactctacccattttagggtggtccctgttgcatgagcattgctagttaatggct

SEQ ID NO: 206999 - DNA, 235 bp, Homo sapiens
cgtggaaaacagggaattcgtgggcaacaataaggtgtgtgcacagcccctcaagaagatgtgccagtccttatctaagccacaggagcctgtctcctgtgaatgccatcatctggggctgccttgttggccagtgtcctccggatttggtcattgggaagcaacaacaggggggttggatttggtcactgggaagcaacaacaaggaaaggcgtcggggtttctcttcccagga

SEQ ID NO: 207000 - DNA, 386 bp, Homo sapiens
gcttaagaacagtgtgaaaagtttgaagcaagcaaggataaatgaaatgataaccaatcaactccacttcttaagattaagtaaatgagagaaagcacaatcaatcaacaattgtgggcatgctttgtttggatgtggaagtggaacatgaagtggaaggcaagctgcatttcatggaattagattaagtatgaatttaaaaaggtaagtattaagaattatcaagaaaaatcactaaatgcacacccatatagcatgcaattatatatgggctaatactaatacagtcaatgtagcactaccatgagtctgaacctgtcactattacttagtagcaatggcagaagctagaaggttcacacaatgaaggcaggcaacagaacctg

SEQ ID NO: 207001 - DNA, 337 bp, Homo sapiens
agagaagctggctgacatccccaggatgaatcatcctttccatctgatcggtacaatttgcttgatgtcatcaatacagtgagccagtgtgatattctgcggaattgaagatgactacagtccctttggactacactatgacaaagaacaagagtgttagcacagccctggggtaagacaacaaatgtgtccccaccatatgaagatgaactgactttgatcctccctactgatggggaagaaggcatttgcttgatcaatagcctcttacaaatgccagaggctatttgacctgctctagtaaaattaccacatctggcacagaagctgcaatcag

SEQ ID NO: 207002 - DNA, 291 bp, Homo sapiens
tagagggaggtccggtggggaaagtcagtcaaattagttgtgactgaactagcttgtcaattcagtgagacagatcaaaccatagccccatgtagacaccaccagggtttgcactaccagtcagtaggtcactgagtcctgcccctgtgaaatcccccagccacttagagcagtaaagattgattaaacatgtttatatgcaatttgaaaatggttctttcaggaaacgtgtggttctttaaagtcactttaacatgagagattttactttagtttatttatatgctagcc

SEQ ID NO: 207003 - DNA, 356 bp, Homo sapiens
ttagtggaaagaggttggattttcaggtcactcagcctcaaatctctgatccatcatttcctggctgtttggatagctagtcaattaacttcttcaggcctattccataaatgtgatatgaaaacaaggtaatgcaacctacttccaatagtggctgcaaagattaaaaaaagacaatggatgtggaaagcctaacccagtggctggcacgtaataaatcaaagcagtttctagaaaaggagagaactttaaaagtgtgggaagagagtagttggcaattaatgatttagctagcatatcaaggacagcaacaagctgaaggtcattcttagatttttacccttcgtaactatgaa

SEQ ID NO: 207004 - DNA, 323 bp, Homo sapiens
gctaggggcaaggggagaaggtgggacagatctgattaacagctgggaggtaggatagacagctcttggtaactgattagataggagtacagagagggaagagctgaagaggactcccaggctgctggcacagataaccaaacaggagaagtacccttcactgacagaagtacccttcactcagtctagagactgagactggttttggagactgggggaaaaaaggataattcagttctgaatatagggaatttgaggaagatgtgagacatttggagagaaattaagaaggaagttacatgtaaaggacttgggactcatga

SEQ ID NO: 207005 - DNA, 423 bp, Homo sapiens
tattaaatatatgaatgcatgaagttcttactgagcatgcagatacagttatttaagtgttatgtgtatcagctgggtgaggtatatttttgagacgtaaccctttacatttgaaagtctggtatttaatttggctaaacttcccaaaccatagggaaatactcattgatccattaacttattcagcaaatatttattgagtgcttattataaggcaatcattttataaatgcattttattttagggatctttctcttgccacaaataaaataacaggaaggattgagttttgccgtgttagagtgattcttgggttggatcaagacattggtgagggataaccagacaattacctggacttcccaaaatcatccttcagtctttttactttcctgtcactgactccctattaaccataaaga

SEQ ID NO: 207006 - DNA, 292 bp, Homo sapiens
gagaacagcttaagggcaacatgtccacctgcacatatagcactttttaaaacatgaagaaaagcaaataagaaacaacgcaattagttcaagaatgcttcagtcattaggtgtgatcatgaaggggtgagatttttaatggcaaaaggaatggggctgcttatgggatttatgatgtggggtgttaaaatgtatggatgctgggtctcttggttttgagagaattgtttaagctagctgatcctataaacctaaagaccagggtcagggtcctaaagttaatgcttaagac

SEQ ID NO: 207007 - DNA, 311 bp, Homo sapiens
ccaacgctgctcacaagttaatattatgtaaaagagaaaaacaacagatgaaaatgaggtaatcaaaaactgggttcttttaaaagattaacaaaattgatgaaacgagctacacaaatcaagaaaaaaggagaatactcaatttactaaaataaaaatgaaagagttgccattactaccaatattacaaaaacaagagaaatgtaaggaaatactgtctacggattatatgacaacaaaatagatgacatgtgaaatggatcagttcatagaagaacacaaactactgaaactaactcaagaaaaaaatg

SEQ ID NO: 207008 - DNA, 612 bp, Homo sapiens
  misc_feature (147)..(147): n is a, c, g, or t
  misc_feature (503)..(503): n is a, c, g, or t
  misc_feature (524)..(524): n is a, c, g, or t
  misc_feature (571)..(571): n is a, c, g, or t
tgagcctgccccaaactacagctcccgaagtgctcggcgttcggagcgggcttccgttcccagcgtgcccagtgagccgggcgccggaagaaccgttgtctgccacgcgcagccccttgtgcgggatcaagcccgtgtgggcgaggnggggtcgggccgggcagggcttgggctgggcctccctgagggggtgctcgcgaggatttccttcgttccacaccctcactctacgccctgccctgggcattgtcgtctactagtctattctgatgactcccacatatctatctgttcagctcagctccctctttctttttctttttctttctctttctttctttctttctttctttctttctttctttctttctttctttctttctttctttctttctttctttctttctttctttctttctttctctttctttctctttccttccttccttcttccttctttctttctctttctctatctctttctttctttctttctttctctnctctctcttttttttgagacngagtctcgactctcgccaggccggagggcaatggtgccgctcggttnactgaagctccgctccggttcgccggtctcctgcttcctcc

SEQ ID NO: 207009 - DNA, 185 bp, Homo sapiens
attcaaatttgtttcctccatgagctcctctcgtgctgcacctgcttagcaacggtgaagccagtgagctcattcaaatatttactgaccttgccgggcgcgatggctcatgcctgtaatcccagcattttgggagtccaaggcaggcagatcacaaagtcaggagttcgagacctctactcgac

SEQ ID NO: 207010 - DNA, 232 bp, Homo sapiens
caaagctgccaacaggacgccccccaagtccccgggggacccctcgaaggaccgggcagccaagaggctgtcgctggaatcggagggtgccggtgagggggcagccgcatcccctgagctcagtgccctggaggaggccttccggcgctttgccgtgcacggggacgccagggccaccgggagggagatgcacggcaagaactggtcgaagctgtgcaaggactgccaggtg

SEQ ID NO: 207011 - DNA, 366 bp, Homo sapiens
aatattcgctgatcagcttaaggaaggccattaaggtgacaatggtccgagcctcagttaagccaagtgaccacaaagcccacagctctgcacctttatgtgggcacttcaaggctctcatgttggtccagagaacaaaaaatgcaacagttaaagctaccttgagccagagaagaaaacaggcagctctacccttctaagtccagtaagactgaaggatcaaaggccttttactctcaccaacatgctaagtaaattcaaacaacaggactgaagaggacctagagaaaggtcctacctgctcctcttcacccacagaacacgtttcaaacatttcaaaccacgagtttttatttacacttaagc

SEQ ID NO: 207012 - DNA, 1014 bp, Homo sapiens
ggcgggggcgggatgagaaaggtgctggagctgttggagggacgccaggaggtggcaactaccaggggtgtgaggggctgacctgggatggaatcctgccacccggactcaggaagaaaatcctgaggtggcgacctgcagactgggctgggagatggagagcccgctcacgcccacccgaccgcctaccaccagtgttcccggatgcatgggctccagcgcctgccctttcgccatttcctcccaactggcattaaatcctggtgtggtagatatcagtgattaagagtctaggcagccacgtgttctattgccgccagtccgcaggaaacgcaagtgatcgttttgctgcgttaactctatgggcgcccaaatcttaggaatccattccacgccaccccgaaaacagcgcttgacccttctggactgccacgcaggaggcgatcaatgtttttctttctttatttttttaagagacaaggtctcgccctgtcacctaggctggagcacaatgaggctcactacagcctggaactcccggacgcaagtgatcctcctcagcctccggagtagctgagacctcaggcgtgcgccaccatgcctggcatcaatcaatgtctttcaaaataaaggctgttaaacgtagtataggaaagaagctttttaatggtaggttctaccagacgtgtttgtttgatttttaggtttggttaatgcattgtttcccgtacaatctcaacccgcggaaaccccgaaactctagaattcgtgccggtctctttcgcttccaggtcatccccggggcaacggccgccgctctaattcttgtcagaacctccaggccagtttcagcaacgtgcaggcagaagctggcccctcggtgggatgcgagggcgtgtggagcgcggggaggagagccccacaggcctttcctgggcacccgcggtggatgggaaggctccttcgggcgcctttcagggaagttgtttggctgagggaaggtggtccgtcacg

SEQ ID NO: 207013 - DNA, 285 bp, Homo sapiens
cattgtatttaagaaattgggaaagcagaaaatgcttctgtttttcttttgagttgaacaatgagaacacatggacacagggaggggaacatcacataccggggcttgtcaggggggtgggaggctaggggagtgatagcattaggagaaatacctaatgtagatgatgggttgacgggtgcagtaaaccaccatggcatgtgtatacctatgtaacaaacctccacgttctgtacatgtatctcagaacttaaaatgtaataataacaataataaaaacctcaa

SEQ ID NO: 207014 - DNA, 389 bp, Homo sapiens
cagcactttgtgaggccaagggaggaagatcacctgaggaattcaaggctgcagtaagctatgatcgcaccactgcactccagcctgggcgacaaagcaagaccctgtctctaaaaaaagataagaatgaaaataattttttatgaaattttcaggaactagtaaggttaaaggccagattctggttctttagtattaccattaagatgcaaacacaatctctctttaccacctctaattgtaatactaataaattcacaattatcatgattcctataatcaggctgttgttgttgagagccaagttaattaattaccataatatcaaaaaccagttcatcatgaaactatatatatatttatacacacacactttttttttttgagtc

SEQ ID NO: 207015 - DNA, 271 bp, Homo sapiens
actaaggacccaataggtggttctgctcttctgggctgcattcaggtaatacagactggcctttctcatgcatctgtgttcagctgctgggatggctgagggctggctggtttaggttggcctcactcacatgtctggaggttggctggctgtcgtcctccagcaggctaacatatgtggtggtggcaggaccctaagagacagaatggaagcatgccaggcctctctaggcttaggcccagaatgagcacattgtgacttgcactacatt

SEQ ID NO: 207016 - DNA, 509 bp, Homo sapiens
ctgatccccaaggtcctccccaacacaaagccactctagaaagacaggaggaagtggttatttttttttcaaatgcctaattttccattttaaaaaagcacacgacatacaaaagactaaacaggaaaacatggcttacaaaaatgaagaaaataaagcagtggaaactatccctgaagaaacataggcactggatatactagacaaagattttaccacataagtcttaaatatgcttaaagagctagaggaaaaatggactaagtactaaagaaaatcaggaaaatgatttaaaaacaaatgagaataatagcaaagagacagaaattataaaatggaaccaaacagaaattctagagctgaaaaacacaactgaatgaaaaatgctactatattttcaaaaatatattacaggagctcaacagcaaactcaaacaggtaaaagaaagaataagaaaatctaaagacaagtcatttaaaactactgaatctgagaggtagaaagaaaa

SEQ ID NO: 207017 - DNA, 480 bp, Homo sapiens
ctcgtaaacagttcttctgtagtgacagatggggtgaggcctggattaagtcgctaagatgaggaaaacagtgagaagttacccagataaagatgggactgataaaaaagtgcagtggattccaatttaagagagatcatatatgttaatttacttagggtaactggggaacataactaccttggctatagagatatttagagaaacgtactttggaccaaataacttagcttaggaaggacaaatccttaggaaacccaagtctcagattatttctctaatagatataaaaaaaaaaaaaaaaaaaaacaggccccaaatacccagggggttggggggcccaaagtttttaacttgaaaaaaaaaaagggccctaattaaaatagccgggggggggaggggggggcttttaaactgaaccctgggggggggagaggttccccaaaaaaagagggacctgaaatgggccgggccccggcc

SEQ ID NO: 207018 - DNA, 379 bp, Homo sapiens
agaccttctgcaatgataataaataaagctctctatgacatctgcctcagaaccctaaagctgcccacacctacctacagtgacttgaaccacctggtgtctgcagccatgagtggggtcaccatctgtctgcatttccctggccaactcaatgctgacttgcagaagctggccgcaaacatggtcctgttcccccacctgcacttcatgtatggcttccccctgctgaccagctgggacaaccagcagtactgggccctcatggtgcgtgagcccacttggcagttctttgatgccaagaatatgatggctgcctgcaacctctgccatggttgctacgtaatggtagctgccatgttcaggggccacatgtccatga

SEQ ID NO: 207019 - DNA, 212 bp, Homo sapiens
tgttaacccatccactcaaccagacagaatgaaaaacaaccttctaaagtgatggaaatgacaggaagttattttgtcctttccccccacttataatggaattttaatatggaatagttgtttctttttcaaatagagcagagaccccagtagatagttttgatttttcaaacatccagggtcacttccatcattcaactggattttgtggc

SEQ ID NO: 207020 - DNA, 229 bp, Homo sapiens
aaggagcgatggagggagaggaggaggacttccaggggtggcgaattgtgcttttcttgaaggatgaacagttcatcaaggggtggggaaaggcatcctggcaaagtcccaggtgccccccaaaagtctccgttactgcccagcagccagcaaccttcaatgcggcctcttccccggcgtctcttcctggtgaagctcacgtaggaatgaaaccacctctggaggagtg

SEQ ID NO: 207021 - DNA, 199 bp, Homo sapiens
gggaacccgtattcttagctttcatggatctagagttagaagcaactttcacctcttctcccctttctgaagactcgaatcacatttcctctccactgttatctttctggaccggaaagcccttatcttcattttcctggagctgcctgcccctcctcagttggtgctccctcacccctgcactccctagttcagaccc

SEQ ID NO: 207022 - DNA, 533 bp, Homo sapiens
cttttggaaagaaaaaagacactgaaagatgaaatttcctaagaacagaggaatacatgctgttaaccatggtaatagaatcctggtaaggtaacaactctgtagagcagtgggtttctgccttctgatttatgtactatgtacaccatcttcatttcatatttggtatcagagatctcccaggtaaacagtatttgcttataatttctatagtagagaggttaaaagtatcgtagttacagtcagacagacctgagtttgagtactagttctaggatgtttaaaactgattttgggtaatgatttaattttattgaaggtttgctcttttcatttttagtgtggagttaataaaacctcataaaacattttgaataagatgataaatatgctgtgataaacattaaggtccttggtatataataagtacttgtaagggttattatggtattatatttagcatagcgctagagttagatataaacatataacacataacttcaatagtatcctccttccctccactccccgcc

SEQ ID NO: 207023 - DNA, 606 bp, Homo sapiens
cgacctagaggacccccttctctagacacattgcaatttagagattgcactccagtgttttagaaactaaagtatggtggtcagtaactttttacttttccaaatatggacagttaaaaatccaaaacacaagtactatctactgtcaccatcatttcctcttaaaaaagatcattttaaaactaaaaagtttggaaggatataaactcacaataaagatcatttcatttaattgaacaaatttagctttgtgaaagattcatgatgtctaatttctgatttcagagcttgccaatgaaaattttaccatggactggcttcagtctttgcaatgacatttaggaaccaccaaacgttaacatgacagccacatttattactaagtttttctgaaagcagatgtaacagatgtaacctagatttagtaggcctctactttttccctccctctacatagaagccatattcagcaacttaatgtattttgtccaaaaatagatccaactctacaacccagtgggatgtttcctctaaagattataaaaatatagagaaacaattttacctcacattccacacagcaaagctgcataaatatccccgtta

SEQ ID NO: 207024 - DNA, 1049 bp, Homo sapiens
tatattatgtagttggcatagtatagcccaaaattcaagaatcttctagttggtactgttgccttttctgtaattccaaaagatttcgaacatgatcaagaaatgttattgtttatatgaaaatgaatttaatagttacctaccgtttacaacagacatttcagaagagaaactagtgttcttttttaaccctgcataaaatattgctaccaattcttttgaagaatgaaaccatctatttccaaaacacaaaaatattctttcaaaatcctgctttcttttttctgtatccaccaagaatctcttttcttatgttgtaagcagggtggcacaaaaataaaagatagacaagagtgtatgtgtgctacacttctcttaaccctgcacaattgagtttctcctttcacctttcaaaaattccagctctgagatattttgagttttaactctttaaatctggcataaaacttaacttagtattacatgagcatttctttaaaagacaaaatcagattttagaaaaaatgaactctttgacaatgtaagcattgtgtttacaatctgataacaactgataccagcttctgtgtttgaagtatagactgcagagctactttcaaagtgaattagtgttcaggtaaaggcagattttacctgttcgagtgtgtcctgtttggttccagcaagacatataatattttatgaacatgttttatttaccctaagtttttttaaaaaataacatttgtaatgaccttgagaagatcagagttccgtttctaaagaaggtgtttccttggtcatgttctgttgacctaaaccagttaaattcagtaaggtaagaactaagaaaatatatcaattaatagtgcatgatttggatgaattcagtggtacaatgctttgtgcacagtaccactcaaaaatgttcattgatttctaaatattgagggtgttaaggtgacaaggcttaagaaagatttagaaagagatcttacatttgaaaattgagttaaaaaaaagcaatttttttttttagaggaaaatag

SEQ ID NO: 207025 - DNA, 373 bp, Homo sapiens
acattatattcaggcttgtgctataataaaaaaaggattgcatgaaaatatttactgaagtaattattcatttatttaaagaaagagacttcatgaataaatataatgtgtatttttagaaactattttgcctctgcaaactaaataattcacaatgaattatatgtttatatgtattttataatatatttctgataattcattatattgaatgaggaatattaaataattatgttttagttatcactgttttctcaatatcaataatgttcataattttatgttctacataagacaaacagatttcttttaagaagcctaagagatcagaaagggcatgtgataaaaatggaaataaattgttattgctcat

SEQ ID NO: 207026 - DNA, 1086 bp, Homo sapiens
agtggcactgctatccacattctatgagagtcaattgcaattaacagggtcattcagaaaaggcaggtacaggccagacaaaaggagtgcagacagatcttatcagagcccaaggccaacaagctgggtctgggcctttcagatgttgcttgcagaggaaacaaaaaaaaaatggtggtggaaggtggtagcggttggaaaggcagacccagccagagggggaaaggacagggaatgaaaagagctgggcaactgaatagagaggtttaaagaacaaacacagactcctgggcctatgtcttgggttcagatcctgactctgcccctggccacttaggaaacttgggccattcaacccctccaagccttcgttggcttgtctgcaaaatgggaatacaaatcgagcattcctgttttttaaactgtcatgtaaaataattgccatgggaaacagtgttgagggtagtgcctgatattgggcagttattagaataactaagagaagagcttagcttggattggggaaagcggtacggagaacccagagagaagtggatgatgtgagcaagcttcccagggcaagaactcaaacactgcacagacaggtgagcaagttgaaagtgattctgggtctacctggtagaagaaaccatggagaccccttcccccaactcagaggaaggacggaccctgcaaggaagggatgctggtaccaattacagaggtccccctctgcgttcccaaaggctggaaagtggagacacacacaacacaataggccctggcctgggacaatgttacccaggccctaggtcccctacacatccctccattttgacactcttagctgccaccaaaggtgtttaaagctcctttcaaatggaagggcttaagcacctactccgcgcttagctctgagcccttcatcaaggagcatacaggaaaacaacgtctccagcccttccttcttttatctttctttgatctgggaatgatgtcagtgagtaaggaaaggggatgtagtagaaggttccaaagcaaccgaatttccaatgtcaggtggaccactgatgagttacatcactg

SEQ ID NO: 207027 - DNA, 435 bp, Homo sapiens
aaactaaacacaatcaaatcgcaaactaaaacaaactctcagtggtaataactattattaagcgggtatcagtaatgacacaaggggtaataagtgtttttcacacattgtaataagccacaattagttacaggagcatttgttttgctccatacacccaatgaggcctcacctcttccccaccccggcttttccagctcaaagttacttccaacaaagtcaaagctctgaggtttagaaacagagactttctgtggacagaaattagggagaaggaaaagtgaatcacagagtagccactgagagagacgcgaacatttgctcggtgtctacgttgtgtctcactccatgccaatcactttcaattttactattttagacctcaggtacagagtagttaattatgctcatcaggcacctatttttatttaatcc

SEQ ID NO: 207028 - DNA, 317 bp, Homo sapiens
caggccacatgataccaggtggagcccaattcaaaaaaaaaggtttttacaccccacacatatgaagtgtaggcctcaattagggtgacctcatctcttagtagcatcttctaaatgtcaacgccaacctcagtgatctctatacatttctactgccattcctcagcaaattactgaaagcaaacccatgtgcaaactttcatggccgccatattgtttcaggatggaagacgacaccacaagttgccaaagactctcaaatttgtagagcaccgaacttggttaaaatcattaacttctctgaaaggtacaggcaa

SEQ ID NO: 207029 - DNA, 214 bp, Homo sapiens
  misc_feature (20)..(20): n is a, c, g, or t
  misc_feature (28)..(28): n is a, c, g, or t
  misc_feature (39)..(40): n is a, c, g, or t
aatgtataattaaggagatngtaggganattagtatagnnaggtagagttttttcgtgatagtggttcactggataagtggcgttggcttgccatgattgtgaggggtaggagtcaggtagagaggaggagcagagtgctggcagtggaaagcctagctgagactggagatgcccccctgcccaaagcatctcagcgaggatgcttctccatat

SEQ ID NO: 207030 - DNA, 524 bp, Homo sapiens
ccttctaatggtaggagcattaagagggatgctgttgggctcgcagttcagtccacacagctacaatctagaggtcaggaagctataaagtccactgctggcatcacagtcatttctcacagatgaagttagtggcaatgcagaggcacagaaagtctggtcattaaaaaccacatttaatgttgcacgtacatcaacaactaccagtgaaaactaataggcagccaggcatgttggtgcatgcctgaagtcccaaacatttgggacactgaggtgggaggatccttgagcccaggaggtctaggctgcagtgagttgtgattgtgccactgtactccagcctggacagaacaagaatctttctcaaaaaataaataaatagagagagagaaggagggagggaaggaggaaggtaaaaagagagagagagaaaggaaggaagggaaagaagaggaaggaaggaaggaaggagaagagaaagaaaaggaaggaaggaaggaaggagaaagagaaagaaggaagga

SEQ ID NO: 207031 - DNA, 305 bp, Homo sapiens
tacaggcatgagccacaatgcccagccctgaaaacctgtaatttagtgttgggaataataaagatatgaaaaaaaaatggattttgttaccaccttagggcacattctagagtttattgtgtttatcagtttctcacaacttaagtggaaacggtcttaacagtgctttgacagactgtagccttgcagggggaaacctaatgtgagatagttaaccaaatacacaccttggtgtaaactactgagctacctcccagaagggaagctgctatcttcctgaggtgtgctagattgggtatcacata

SEQ ID NO: 207032 - DNA, 637 bp, Homo sapiens
tatccagtgcgaatattatgtagccatgaaaagaataaaatcatgttctttgtagcaaaatgaatgcagctggaggccattattctaagcaaattaatgcaaggacagaaaatcaaatactgcatgttctcagttataactgggagctaaacattgggtagtcatggacataaaaattgcaacaatagatacatggaactattagatgggaggagggacaaggattagaaaactaaccgttgggcaatatgctaagtatctgggtgacaaaatcattgacaatccaaacctcagcatcatgccatcatgcaatatacccaggtaacaatcctgcgcatgttctcctttatctaaaataaatctgagaagaaaaaagtgtgtctcagtcctctggtgctgctaaaacaaaataccacagactaggtaatttataaataatataatttatttctcaaagttctggatactggaagtccaagatcaaggcactcgcaagattcatcttgcgaagattcagactctgcttccaatatggagacttgaactgtgtcctcacatggcttaaggtctaagggaaaaaaatgcctcgccagttccctctaatttctttattaggtttcaaaacactactagttcc

SEQ ID NO: 207033 - DNA, 769 bp, Homo sapiens
gctctgaaggacagagatggtagctcttgcgtatttagcaggggaggtattgctactcttattttaaaacagagaaaaattaaactcaggctatgtgatcagtccaaaatcacacaactatttaaaaatagagaaaaattcaaagtaatgtattgtgtgtgtctctgaagatgaagcatattctatcacccatgttgactctcacagtttgggaaagtctgtcatgtgtctggcattggaatttgggactataaacaacttttgtcataagtcttttccaatattatacactcaagtgcaaacaattccaaatggcactcaccaacatttatttattgattatctataattttttgctcattggattattactttagatgggtgctataattaggcacatctctggaatgtggacaagacatgactggtataaaaatcaaaataaaggtgtgaaagaagtgagggtaaagtttttggggatgttcgggctacacacatccgtcagctactttttcaaaaggaacagtggagaatctgactgtaaaaagtaaaatagaggttcttcttcaaagactttcctccctgtctaattaggaataagtaataacttctcttaaaagcaaaaggtattcgaagacctgtgctaacattcttaaatatctgctagccataacagagaaatcaatgtactttaagttcttagcttatccacaattgagcttaaatatttgccctggcatgcttatactggtccaagcaagcattgggt

SEQ ID NO: 207034 - DNA, 322 bp, Homo sapiens
tatttgatctttcaaaggtaagcacacagtccttgatgatggcatgtctacaatgcaactggttcctcagaatctatacaactgacaagtccctgcactgaaaggagaaagggacttgttccccagacacctctatgactggcacactctgtccctgggcttttccttgtccacattaccacagtgctattccaagtagaatttgatccacgggtcagagtaaagcatatactggaaaaactgtaaaacactttgaaacagacccaaaaaaaggtctaactcacccttccaagttacctctgcctttcattacctttgagta

SEQ ID NO: 207035 - DNA, 475 bp, Homo sapiens
attccattccagcagtttccatttacatcatcttggccagaaccatatcatgtagccactccgatttggaaaatgttaggtttctggtttatctggatggttttgtttgcttgcttttgttgagcatgtttctacctggaacaaagttaacttagttttgtgataaagaagggatgtggccgggtgcggtggctcacatgcataatcccagcactttgggaggccgaggcgagtggatcactaggtcaggagatcaagaccatcctggctaacatggtgaaaccccatctctactaaaaatgcaaaaaaattagctgggcatggtggcctgcgcctctagtcccagctactcgggaggctgaagcaggagaatcacttgaacctgggaggcggaggttgcagtgagccgaggttgcagtgagccaagattgcgccgctgcactccagcctaggtgacagagcaagactctgtctc

SEQ ID NO: 207036 - DNA, 219 bp, Homo sapiens
tgaattcaaattccaaatagatcatgtagtagctgtgtgagttcaccaaggttttattaacctttgtaagtttcagtttcttcctttgaaaagtaggataggattactcccttcaacctccttcacaagggtactaattccatttccaagattagagacctcctaaattatttccccaaaggacccacacccaatgctatcacaccggggattaagttt

SEQ ID NO: 207037 - DNA, 406 bp, Homo sapiens
tggttaaacacaatcaagattaaatttataaaacgaaaacctccttttgtccatattgccactcccttctgagtgttcttcagaagcttaggaagcgagtgctgaaagcaaacttctcttctcttccagggaagaggggaacgtggggcctcttgacctacaaaactcagtattttggaacatccgtaattccaccaagtctgttgcagtcaaatagactccttttagcaaaccagccagccagggctggagagcaaggctttcatacctaggagttgacaaggacaggacccaagagctccttggaaaaaaaaaagcttgtacttcagtttgcattacaaagtgctggaagagacagatggggccatgacaggaaaagcagttatttcttctgggcttcctttct

SEQ ID NO: 207038 - DNA, 400 bp, Homo sapiens
agattttcgctactaaaatcaaataatggtttaatctcccttcatcccatgctaccacccatacgttttctcaggtataaataacagaatctggtgtgagaagtggtttgagctgagcgcagtggctcatgcctgtaattccagcactttgggaggccaaagtgggtggattccctgagcctaagagttagagaccgacctagacaacatggcaaaatcctatctctgacaaaaaatacaaaaaatacaaaaattagccaggcctggtggcgttcacctgcagtcccagctactcgagaggctgaggtggcaggatcgcttgagctcaggaggtagagctgctgtgagttgtgattgtaccactgcactccagcctgggtgatggagcgagatgctgttt

SEQ ID NO: 207039 - DNA, 274 bp, Homo sapiens
cgactctaaggatcccgcgatcgcttaggtttttatgggtgatcgttttaactagatgttatttttgccttaatatttgactttgtgacatctagtccttccactattaaggcatcaaacttaggtaagcaaatgcagggattaacttttcctactattcaaaagttgatttgggtttcagttttatttcttgattaaaatcgctaaagcacagaaaatccactctcccctcaatgcccaacaccatttatcattctctgaaagttgcttaagc

SEQ ID NO: 207040 - DNA, 518 bp, Homo sapiens
tctccatacagcagccagtgtgatgtttttaaaaatgtcaattagatcacaccactcctctgtgcagaaccctctgtttccttcccattcatctcacccaaaatagcatgcaaaatcctcccgtgatctgaaaggccctccatggtctgcctcacaactccctctctgatggtgtcagagagatcctacttcgtgatctcctatcacaatcttccatgtgcatcccatctgcagcctcaccagcctccttgctgtcaggtgtgtgttgctacagggacaggtacagctggtttctaaccctggtatacattccacagatagttaacaagcctctgtcttcctcatgacatttgggtctctgctcaaagatcttatccaagcaggctttgtgactcacctatctaaaacaggtatcccacgcacagacacagaaacggacattctcttcccttaagcttttttatttatcttcgtattactgtttccacttgacatgttttgtttttttgttacatgtt

SEQ ID NO: 207041 - DNA, 352 bp, Homo sapiens
gacagtgaagagttcaaggccaaatggcctaaagaggtgaagcagaacaagagccagaaagaacaataaattacacactttaagtataaaatgggccccaaaaactttataagctctgggaaacaagagagagaaacataaaaggaaagcggtccggctattagccagctctgggaggctagaacatgatgggagctcaggcaagagaaaagtcaaaccccagaagcaagcctccattgttctgaaggaacagctatgaagaaagctgggccacaatggtagatgtgttataatgggaggaggaaaatttaggcaatgaggaagccaaaggaattttgagactcacagtaat

SEQ ID NO: 207042 - DNA, 644 bp, Homo sapiens
ccaataattagtaaagagattgactcagtaatcacaaacttgtcaaaaaagaaaaacctagaatcagatggcctcattggtgaattctactaagcgtttaaagaaataacaccagtcctactcagactcttccaaaaaattgaagagaagggaatactttcacactcattctatgaggcaagcgttaccttattcagtaaccaaagacactgcaaggaaagaaaactacagaccacttgatgagtatattgatgaaaaagtcatcaacagagccctaggaagcagaatttaacagcgtattgaaaggattacacatcatggccaaaagatttattctggaatgcatggatggcttaacatacaaaagtcagtgaaacataccactttaacaagataaaggaatataccacatcatcatcatcatcataatacagaaaaagtatttaccaaaatccaacactctttcataataaaggcactcaaatacagaaggcttttcctgtgagacaaggcaacacaaggatgcctgcttttgccacttttcccaaatatactactgcaagtcctggtcagagcaattaggcaagaaaaataaaagttaatacagttttgaaaagtagtaaaattatctctgttctttgatg

SEQ ID NO: 207043 - DNA, 634 bp, Homo sapiens
atactttgtatgatagtaatactatcattccaactttgttttcattcatgttagcatggcttatatttttcagtactttttcttttcacttatttgtttctttatatttaatacatttttcttgtattagtatatgattatgctttaaaagaaaaatctatctgacagagctgggtgtactggctcattcttgtaatcccagcacttagggaggctgcgcaggaggcccacttaagcccagaagtttgagacagcctaggcaacatagtgagacccatctctacaatttttatttttttttaattagccagatgtagtgacacgcatttatgatcccatttacttcggaggctgaggtggaagaattgcttgagcccagaaggttgaggctggagtaagccatgatcatgccgttatacttcagcctgggcaacagagcaagaccatgcctcaacaaaataaaatttatttgacgatctctgctttttcagatgtttaaaatatttacatttaatgtgattactgatatggttgcatttcacttgatcatctttctatttgctatttgtcttatctctttttgttccagtttttcctctttattcttttttagattaatattttttataattcc

SEQ ID NO: 207044 - DNA, 406 bp, Homo sapiens
tgaaaatgtgctatgtttctagacaacatggaaaaatagaaaagtacaattataaaaaaaaagcaaatcacagatgaaaacttatggtagactttatataaacccccaaaacaggcaacacgcaaatgtatattgtttatagataaaattgcataaagtaaatgataacacaaaattcagatagtggttacattggaataggaggttaataggagacttcggaggtatccacttctcaggagtgtgtgagggttttatgtagccagactgaaagtttcatgagagtagagaccaatattttttcttcattttatttcctaagcctagcaaaaaggatggcacatcgtgtctgctaacacacacttttcagttaaatgaataaatacacgaccttgtaagcggtcaa

SEQ ID NO: 207045 - DNA, 360 bp, Homo sapiens
ttttttaccttcatagttaaattatttaaacttctctgaccatctatttttttggaggagttgtaataaagtctgatgtaaaatgccagttccttagtattggctgagaaatgagagaagaaaagaaaagagtattcagggtagcaaatactgtcccacaaagccaaaaccatgtgtactgaagccttacctatttttagtttagtcggccttggccctagaaaacagttcctctccctacctaggccagattccattaattccatgtgggctgttgcccactgggcatgcagctgtatttgcagtttgagagtcccaagtaagcctgactaggcttcaaaaatgaatctagatttatac

SEQ ID NO: 207046 - DNA, 193 bp, Homo sapiens
ctcagtgtcactgaccctgtgtcccccaaaaaactcccaaaagagtctcaattcctaccaaaaagcctggccaacacctcaggctggtgaagtcttgttgaagctgcttttttcatgctaactgccacatcttaattcaagtcctcatttccatctttgaaattggttccttagttgcttgcaaaatctagtt

SEQ ID NO: 207047 - DNA, 214 bp, Homo sapiens
tgctatctgaggcagacaaccaggctttgccacttgtttacattgctaccttcgacaacatactctataactctttgggactgtttcctcacctgtaaaatagggcaatcctatcagctcaacttccctcacagggctcttgtgagaaccaggtaataaacaaaagcactttatgtcaatatgagttaaggaatgtactttaataaaataacct

SEQ ID NO: 207048 - DNA, 387 bp, Homo sapiens
catcagtcaataaaaataaagaaaaaaactcttttctttaaagtggggctgttttctgagattcaggttttcaggatttgggaatgagaggcagtgctgatgggggctgatgccctcaagggagttttctgcctccagattttccagtctcccttctgcggcctgtgcacacgtgctctgtggggaccagacgcctttgttgttggcctcatcaccccctggtttgggagagcacggagggtgaccccctgcccctccctgtgctgtggctgcaactgcgaagcctctttctggtgagctgtcatcctttgaatcataaaactgaatatttggcctgttggatggataatttctaaaatacatgggacggaagtttctaaaatacat

SEQ ID NO: 207049 - DNA, 473 bp, Homo sapiens
agctactataaaacacatttaaaaaatagttgataaaaatatttctctggattgtgcaagaagggagactaggaccacggataagacagggtatttgatattaatcaaactaggcttctttctctcttgctgcgttggaggctgaaccctcctcgtttgtcgtttctccattttctgcaggtaaatcttagtttcttggttagctactttgtcctgttttccctttgctaccagttttgctttttgtttgtgcttttttgtctgaagatttatcctttcctgctgtcttttttggcttcgtttccccctttgcaggagcaagtttaggtgacaaccttgtggatagagatggaatctcactgtgttgattaggctgaggtgggaggattgcttgagtccaggagtttgaggtggcagtgagctatgattgtgccactgccctccagtctgggcaacagagagagaccatgtct

SEQ ID NO: 207050 - DNA, 422 bp, Homo sapiens
aattgtctgtccaactggggactcaggagcagcctggctgtctgcagcagctgcaaagggagcaaaggcaagcaggacttccatgagttaggaggtggccttctttggagatgagtgtcctgccaattgcaagtcctcctggtcacaccatcatctggcccatcttttgtatcttagatcggatagggtgagaggttttcaaaggctttactgaaatcaagacacactttctggggcattcccctaatcgactgttctggtgaagctcgtcaaaacaggaaatgaggttagcatggaatgactttctcttagagaacttatgttgcttccttgagaccaccaatttcttcccaaaagcttgtgagccttatttcgtgtctcttttgggttttcttggaacttggaggaagtctgttcttctg

SEQ ID NO: 207051 - DNA, 723 bp, Homo sapiens
gtcgaggctccagcctgaccaatccagggggtcgacaaaacagattcgggacaccatgctacacgcagggcctaccaggatgcagaaacagcagacggagtccggggaaagcagtgcggcatcccagcctcaggcctgcccgtacggtgttcgggaggggaggagaccaatgtgaaaggagatggttatatctcctcgcggctcttctctgagaaatgaagccaggatacgaaacaatcttcaagaagaagctgaaaaccggatatgacaaggatgtccccagaacacagcaggcatcctgaagctctgcctcctgaagctccccctccctcggtggaagtcggctcagggaggtcctgaggacaggactcctgggggtttggctgcagaatgaattaattcactaggactttatataatttttcaaatcatgaaattgcacaatcttttgaatatggaattgggaggcctttcagttcattcagtagaaaactggaacatttttgaagggtgatctgctcgacacctttcaaagagtacaaaaccttgtgaagtagcagatgcaatgattaccaatgtaccttataaaatgactttcagagtttgagattaaattggcttttctgaaatatgtaagtctctggaaaaactcaacatttctaatcttgctttggaaagcctttaagtatgtaaaaatcaatttcttatatcttctctgaaata

SEQ ID NO: 207052 - DNA, 415 bp, Homo sapiens
actctgtgaaagagaagtgaaatttgaggtgaccttcagaattatcctactaaaatgaagttgaatagcagcaagtagaaactgatgtacctataaaagcaatatattttatattaatggcaaaaaacacaattacttttgcatgaacctaatagaataggaaaaactatttggtgcaaataaagcagaaaacaataataggtagaaaggctatcccaggactagaaaggctcttctgtaggttctcaaatctcagttgtaatttctgaacaactagtttaactctttccattatggggctaggtctgtattttattttattttatttttttaggtatttccccttaatttttaccctataattactactctcactttgttctttcttccctgagacttcatagggcagaccaaa

SEQ ID NO: 207053 - DNA, 208 bp, Homo sapiens
taggaagcctggactgtgatttgtattaacatcttataaatcaggtttgaaaactttttccctccctctttggggcatactgaagatgaaggcaacttagtgttcttttagcttgttaatttttgcctatctgatatcatctttcttgagtaattgaaatctttataaactaatgcagttcctgatacaccaccttctggcacttaga

SEQ ID NO: 207054 - DNA, 283 bp, Homo sapiens
atctctgtaaaccacagccatgtccagaataattctacactcccatttccacccctagggaaggaggggagcagtagagaccctcctcctgggaactagcctgtttcctcctgagcaacccttccaggataacaaatggacccattcccaacattgtggtcagggtagactgcccagtcttcctggccattccatccactgtctctgcagctgccctcggtctccatctgcctcttcctctgctctctgccttcctcaactccttcttctctggggcctgggg

SEQ ID NO: 207055 - DNA, 535 bp, Homo sapiens
tgccctggcaaaatctcatgcatcgcctgccagaacacccagggaatctcgtggctccctgacaatgcacaaacacgctgccacattcttttttgggggtccagagagtgggaggtagggtcaaaaaccacgggagtggaactgaaatacccccattcatccaatcataggcagatcgcctccttctttaaattgcctttgaaaaatagctttattgtctccgtatgtaatgcaagtaggcattcccccggcaagttcgggggagtagctgacatttgttgactgtttactgtaggtgtgaactttatatgcaccatttcacttgatccccattttcaagatgagagaattggggctcagaggggtgtagtcatttgcctgggacggaacaggaagatgtctggaataagggccagccctgggtagatgtggtggctcatgcttgtaatcccagcgctttgggaggccaaggcagatcgcttgaggccaggagtctgagaccaacttggccaacatagtaagatcccatctctga

SEQ ID NO: 207056 - DNA, 536 bp, Homo sapiens
agcaatcctgcctcagcctcccacagtgctgggattacagtcatgagccactgcacccatctgagaatattaattctcttttaaagaggcaggaggcagaaaaatctcttgtggaaacctgggcttctgcataaactacataaaatatctgtaatttgttgatcactgaagtgatgaagagaactgggtcacctctgtctgattcaccatcttctagttggatttcagcagtatggataaaggtactaaagtctttagtgtgctagcccagggtattgtttccaactctttcttccattgtccatctacatttattaactcagcagcagagttttatctgatttaagatttgttgtcttactatttctgtttttttttttttcctccttagtatatatggaattgctgcttggattttggctggcttgtaccttttgtttgtggactgcttagaaggcactgcatggagtcatttaagctttcttatgaattatgaatagctatgtagagaggaacttttctagatacatttatgg

SEQ ID NO: 207057 - DNA, 274 bp, Homo sapiens
acaaacctttgcagtaaagttgtatcgtttccttaaagttaatgccattccagtagacttttaaaatgttttattattgctttttaatcaaatcatctgccactgttttttaaaaacatcttcatttgtaccatctttgaagccatctagttaatgagataagaaaacctttgcattccaggtatttggaattgttctcacagctgaggtggttagaattgggactgaaaagagaattgctttctggcatagtgaagtttacagtatcttaagc

SEQ ID NO: 207058 - DNA, 141 bp, Homo sapiens
gggtaacaccttgctatgaatgagtatatgcaaagcacttaaaacaatgcctgtacatggtaaggcaccatacatgtcagttgttatttctctaagttaaacaatgagtataacaatcacaaaaaagtcaaacatatgaca

SEQ ID NO: 207059 - DNA, 990 bp, Homo sapiens
aagtgtttacagttttgtctgcaggtcatccccagcacctagctcagtaatggacacttcatggcactcagcaagtgtttgaactggatttggtgtgtttaccccctagctcatggtcagtgactactgcttctgaattaaaaatagcaacacatgatcagatttaagtggggccagaaagaggctgttagggcataggatattttagcatgaagtggataggatcatgagtggtaacccatgttcttagggcccatgtgcctatgtggtcactgcaaaacaataaaagtggaggcaagaattcaaattagtatatgggagtgagccacttagtgacccagtgcccatgtttcagtgctgctttgtttttcttctaacaaagggcatttttgccctatgtaaaaattggtattggccaattaggacttcacaaaggtctccatatcttcctcaaatgacaagggtcttatgctaaatgtgactctctactgccctgtttgttaacatatgatgcagtacaccaatgcagatcacactgcagttttaggtagtatatagctgaatgcataatttgtattagaaatacaacaaggacattagactcatgtctgcattgacatggatacagcaaaaatcttgaagttagtgtgagagattacagtagtgagatttggaagatggaataatacttgttgattaagtgcatatttttcatttaagttagaaaagccctcataacaaagccacccatatttcatgtgtcaaatggaatgctaggagctttctgtgcattatctcatttgtggaggattctcatttttcacatggaagcagaggggcatttaagttcacacagctgccacttggggtagcttatccctgtaatcccagcactttgggaggccaaggtgggaaagaatgtgtgaacccaggagtttgagaccagcctgggcaatgtagagagacctcatctctaccaaaaaatttttc

SEQ ID NO: 207060 - DNA, 127 bp, Homo sapiens
ccataacaaaaacctcaaacctcaaggaaagaaattacaaccaagccttcagacagctgatggtaatttactcacacaatcccctttatcctttcaacacccactatttatctgtatctgacgttgg

SEQ ID NO: 207061 - DNA, 418 bp, Homo sapiens
tagagaatttgaacagctctagttaaatcaaattcacaataaaaacctttcccacaaataaaatccagccctggattcactggtaaattttattaaacatttgaaaaatatacacgtatatataaactccttcagaaaacagaggaaacttctcccaactgcggtcatggatcacttaatgacagggacatattttgagaaatgcattgttaggtgacttcactgtgtgaacatcacagagtatactcacacaaacctagatggtatagtctatgctcctaggctacaaacctgtacatcattgttactgtactcaatactgtaggcaactgtaacacaacggtatttgtgtatttaaacatctaaaaagagaaaagatacagtaaaaatactgtataaaaaagattaaaaatggtac

SEQ ID NO: 207062 - DNA, 722 bp, Homo sapiens
catctggtcagtggtcaagaggctgcacctctaggagcctcctctgtcactcacccgcccaggcctggacagcctggacactccagccagaggcagcccagagggtgtgggaggggctctctggggacagagcaggaggggacactgctgtgaccctgtagctgcagacatgtgtctccacgaagggaagaggctgctgtccactgtcgctttctgcagtgacactgtgccctggcccgggctctctgctgggttgcagaagtgcctgggtcaggacagctcgcatctgccttcaccgcagacccctctctgcagcccatctgaggcaatgtggcctctgctgtccaagactcacttcgaggggatccttttccttttttagtggaaacctggtgtcctccctttgagtgcttttaggggctggggaggaggtggctattggcggcagtgcgggggcttcatgctctgcctgcgcgcagcagagaacacggcttcattggtgggatttgtctggtgactgggcaggtgggtcgcctggacacgtgctcccagccttcagatgtgacaaggaggggaccatttgcggggttgctgtgtgctggggacagagcagaaaatgccaggcggcaccatttttcccactccccacccgcccgtgctcactcagagggaatgtacagatattctgtttgtaattaaaaagtaatttaattatccgctga

SEQ ID NO: 207063 - DNA, 580 bp, Homo sapiens
gtgtgtctatgtgtgtgtttgtgtgtgtctgcatgtgtctctgtgtgcgggtgtgtttgtgatttcatttctgaggtccctagtgagtgtgtgtatgtgtatctgtgtctatggtttgtgggtgccttcctgtgtgagagtgggtaaactggcacatggcagagacagcctgcctgtatacactgaaatccggatagttgtgttcacatggcttgactggaaggagaggaaatgggggaaaacttgctgaggctcctactggccaagattacattattagatcgtcttcaaggagaacaaggtagaaggatgaatcgtgaggtactggtaggaagtgcattcagaatgacatttcacttaaaagtaacacatgggtggttttttagaggaccagaggaactgaacatgtgaccttcatctctgctcctttcagaacaaaagtgaagctttctccttgcctagcacgcagagggacatcccccattaccaaggagcagaagaagcagtctccatagaacatttgtctcgccaagatctgaaagtgaaaggaaaagagagaggaggaggaggaggagggaag

SEQ ID NO: 207064 - DNA, 1027 bp, Homo sapiens
agcgcgggcgtcggaagcggcggaggtggcagtgtctgccctgggatggccttccctgcacgcgcgcgtttgtatctaaatcgcaggggaccgtctcttcctcagcttgccggcgcgaggagccagagcctcgagttagggccacacgggggaatttggggcgggttgacttttcccgcaacatattttgtcagagaccttggagaaagtcctactgctggcgccttttagtttcctcagatgataacattcccaactccgctcgaagcgtccagtcttaatcccctccagcagaatggtgctgactaactcagatgtctgagatccgcagctgtgtcaataatagggctttctggcaaacttgtgaacgtaggctcgaaattgtttttctggacgcttgaatatcagtatattcagttgaaaacatgtgattttgttgccagtttatcagttcctacctggcctcccgaggtcagtccttcaggactgacgctgcaactccaactcccatgtttcttttaaatcacaaaggaaaatatcttttaaaaatcaggatacactgattaattatgttagtaactaattggcatttgttgaatcaaaaagttttggaagcgttaaatagttttagcctctaattttacaataaagtgaagctcaaagttgggaatttgaccggatgagggctacaagcctatcctttcctcctccctcttcatctttcccaacctgtcaccctggctcgtttatgtctctgtatagttgtaggctttcatcattatacagagaaaataacaaagtaagtagtgtcttctaaacatctagccattaattccaccaatccattccattttcattcaagaaataccagagatgctgagtaaagattaattagctgcctggttccacagatacatgggaacaaatccagaatagtagtagctcaaatccaaatatagtaacaaatagaagttatatattttaaacgaaaatagtagattttcccatgatctcttgaaagaaaaat

SEQ ID NO: 207065 - DNA, 319 bp, Homo sapiens
ctcagcctacaaccccagcacacatgttacctaggggcaaattagtactttgccctcatgtcctcttcacaaagcactggggtagaagtccttcttccagggaccagcagcacccagcccctgcttccccaggctcctgccctgcacagggaccgctgccactgcccaccaaaagctgctggggggtgttggggctggctcagctgagctcacacaggatcctctgatggccaaagtgctggagtggaaatcagagaccaagaagccaatccctgtgccagctgccctggttagggaaatacagaaactaaaaatagtt

SEQ ID NO: 207066 - DNA, 412 bp, Homo sapiens
aagcttggcaccttcagggaattggaagtagatccatcttgcgggcatgtgcagccctcgtggggagtggtcagccatgaggctgggtgtgtgggcactagatcgtggcaggcctgaggaactgtgacaaggaattttgactttataggagggtcattgggctccgttgaagtactttaagggcaatgtcaggtgttttaaagaaagacctcccagtctaggtgtgaagagtcgattggggtcttggaaggcagcggggagcaggagggcagtaaagcggaccaggagacaggcaagaaggaatgatgaacgccaacagagggcagtgatagtgaccgagagaccctcgtgaggtggagccttgcaggcagttccatggatttgatgaggtgacgaatgaaggatggtgctt

SEQ ID NO: 207067 - DNA, 613 bp, Homo sapiens
cagtctctagtctgatttatattttctaatataaagagattggaagtcatcattcccatcctcacaataagaaaaaagctcaataaactgaaaagtcaacaacacttagatccattagagaattaaggttaaagagagaatgcctcacaaattagaaacgcaaatacaaagaaccatagcttacagggagcagaagcctgttgctggagccagtaccaataggaacatttatgctgtaattcctgagttgctggaggctccatgtggatggacttaagaatcaaaagctccagcctggcacagtggctcacacgtgtaatcccagcacttggggaggctgaggcaggtggatcacctgaggtcaggagttcgagaccagcctggccaacatggcgaagccctgtctttactaaaaatacaaaaattagctgggcatggtggtgcatgcctgtaatcccagctgggtttggtggtgtatacctgtaatcccagctactcaggaggctgaggcaggagaatcactttaacccaggaggtggaggttgcagtgagccaagatcacgccattgcactccagcctgggcaataagagtgaaactctgcctcaaaaaaa

SEQ ID NO: 207068 - DNA, 193 bp, Homo sapiens
gctcaaaacaacggtgattgggctcaacccagtggttagattctagaggcaatccaatgaatattgctgtttttagagccaataggaaacatttaaaacaacattacaaccttgcctttgagagctgataaatacttgtaccaaaaagtgtggcaataggtaaatgggccataggaactggggctataggact

SEQ ID NO: 207069 - DNA, 459 bp, Homo sapiens
gggtgacagagtgagaccctatctttaaaaaaatatatttttaattatgagaagagaaggaattatctgacctatcttgtctgattgtaggtcatgagacttccatttctgaaggggtcctgttccatatcctcaagaagggagtgctgcacagagaggccatgaggaatctaagcagacaggccttgctgggtttccccactcagtctgttaatattagatcatacctttttgtccagtcacatttttacatggttgtcaattatgcctgtccagtaaagtctccataaaaggcccaagaagacagagttggagttcctggatagctgaacatgtggaggttcctggagggtggggcacctgggcataaaagctctgagccccttccctcataccttgctctgtgcatccctccatctgtatcctttgtaacattccttataataaattggtaaatgt

SEQ ID NO: 207070 - DNA, 608 bp, Homo sapiens
aatatttcacttagtattgctattactatgttcttgggacagaagttcagcctgtcagatacaagagagtggtgtctccataactgtgcttagaactccgtgctgcatgaatggataaactgttaagcaggaacctaggaaagctagaatgacaaagttcaagtttattaaaactagcaaaacatattccttactgctcatgcatgagtcacggtcataagatgtttacagttaaggaaagcagcttcatgatacctgcaaggacgaactcctacagaaacacaatgtccaagataacctaatatccgatgacaatgtatgcttttaagaagcaggctggtcgcaaactcctgacctcaggtgatctgcccacctcagccttccaaagttctgtcattacaggcttgggccactgtgcccggccaaagatagctttaaatcaacaaagtaataagttttgtcacactgtcagctcaccggcaggtagacataacttagcttttacttaggcccctatgtaagaaaaacttcatgaggaggcactcccccagccttctgaggacaccctactgtgtaactggtagctttcaataaactctcctcactgc

SEQ ID NO: 207071 - DNA, 1018 bp, Homo sapiens
cgagcactttggaaagctgaggcaggaggactgcttgaggccaggagttcaagaccaacctaggcaacctagtgagaccctgtctctactaaaaatttaaaaattaatcaggcatggtggtgtgtgcctgtagtccccactatttgggaagctgaggcgggaagatcacttaagcccaggagttcaagggtacagtgaactaaagatcatgccagccactgaactccagcctgggcaacagagcaagaccctgttttagggggaaaaaaaaatctatcttagctcctatgtgccataaatgttacaacactcatagtctggaggaatcacaaagtctttaagaaaatggagacaggacctatagtgatcactactcacaaatcactagaatcacatgctgaaacactgctgcagaatatcaatgtgtggtctgttcccactgccattaacccaaccatgactttctctgcctgtcctggtatagaccatttagtccttgttaagcacagttttcattattttcaacctttaccaaccaaaaactactaaagaaaaagttaatattctaaggagtacagttaagagatatcctaacattctcactgaatcagccaaatataaaggctaacatgttaaacaggctagagcagttttcttcaaactaaagcagtagggccctggagttaacaagacaactttccaggaggttaggatagtttaaggagaatccggttaaaggtggtctgcttccaccgtactcccagagcttgatctgtctgagaattcttgtggtttgctggttgtccttcccatcctcccttataaatgtattcacttctcccacattacttcctaatcttacaattgttcatttcccagacaggtgcagcgattctacgctgcactgtctgtagagcagtcccattaaaactcatgtgtcggtgaggtacaaatcatgacatctctgaatggtaattcgtgagtataatgacaaataatttgggtatctatagtgcaa

SEQ ID NO: 207072 - DNA, 749 bp, Homo sapiens
ttaagccctaagtgaaaagtaagttaatacgactttggaaattaaaaaaataccgaagaagctatgttgcaatttggatcatgaaggcaattgtaatttgctgcctctgagcaaaatagagaaaatacggcagattctggatgcaggtaggtagaaataaaatgttaccctcagtgttcattgagtttcaaatgtcttaaggacagtttattgaactggaaatatgtatgtatggaactcaaaagaaacattgtaaacaaagacaaaagtctggtcctcctcagtgagtagaactgcacagctgagagaagagaagagaggtagaatgaaattcagaataatctacaaaagttaaagaccaggcctgtacaaagaaggctatgatgaacactaaaaagaataaagcatcaacgtagaaaaaaacgcaaagcagatttctccctaaaaggtaaaatcttccacgactatgaacagagtgtttaatttttatttaaagttaggttttcagatgctgtaaaaataaatgacagacttttagaattttctacagattattaaaaatttggtggatgttggcataattttcctagcaaaattttgaccttaacagggaaggtatattagaaatataacacatttctattttaaaataatgcttagtattgaaagacagaatgatccctaattctccaaaacccattaaataattttattttcactttgggctagcccaaagtgaaaataaccaa

SEQ ID NO: 207073 - DNA, 325 bp, Homo sapiens
accttgaaagcattacactaagttaaagatgtcagttacaaaacaccacatatggtataattatatttatataaaatgtctgaaataggtaaatctatagggacagaaagtagattagtggttgccttgggctggagggataggaggatggagggtcaccataacggtatgagatttcttttggaggtgataaaaatgttctaaaatttactatggggatggctgcatgactttgtggatatactaaaaaagtattgaattgtacttaaacagttgatttttatggtgtgaattatatttcaataaagctattaccaaaataatg

SEQ ID NO: 207074 - DNA, 514 bp, Homo sapiens
ttttatttttgttgaagtattgtaaatgggatggctttcttgatttctttttcagctaattcattgttggtgtatagaaatgctgctgatttttgcatgttgattttatatcctgcaagttcagtgaatttatcagtcctaagatttttttggtgccacttttggagtttagggttttctatatatttgatcctgtcatgtgcatacagggataatttgacttcatgcttcctgatctgcatgccctttatttctttgtcttgcctgattactctgtctcagaccttttgtactttgttaaaaggtgtgaaagtgggcatacttgttttgtttcagattatagagagaaagctttcagcactttcccattatgcatgatgttagctgtgggtatgttacttattacctttattatgttgaggtacgttctttctattattattataattttttttaattttttttttgagatggagtctcgctctgtcgcccagctggagtgcagtggcatgat

SEQ ID NO: 207075 - DNA, 806 bp, Homo sapiens
atcctatcttaggttttgaagcctaagatacgttttataataaatagacttattaaaactaatgtttgcaaacattgctaaacttaacaaattggctaagtttccctttgttaacaagcaatcagttacgctgaagaatttgaaaaatgcaaattaaattgttttttgttatattctgacaccccaaatttattatttggtcttgaaggtaattgaaaattaaattggttattttgtcacataagataaagtaaccaatagtagcagtactggtaccatgtaaatggagactacaagattctggataaaatacaaattgaattttggcattaagagaggtattcaggattgcttagtgaattgtggtatattgaggttttttaaaaatgctagcaagcatctagccatttatgacttagtgaatgagactatgcaatgaaaatttctgcataaaatacaggccctacagtttggtgtatgaaaataaatttattattccaaaatagctcctgacctctctaaattggatgatagactttcctatagaaaatgttgaaaaagaaacattttctaattttttcagtaaaagtttccatctcatccccaaaagctgtaattgaaaaaacatgcttatttttttccttgtgtcttttaaagaactacacatagattttagggtcagtgctcaactacaaattcttggcaaacaaagcctcacactgtgtgacataccgacaacccatgttgagaggctccttacacctcttgatgggtgggtggatggatggatggatggatggatggat

SEQ ID NO: 207076 - DNA, 327 bp, Homo sapiens
acaggcgtgagccaccgcattcagccagatttctcctaactggatattcaggtttctagtcaggggctcccagaaccccagctaggccactacccaggtgttagccgctctgctccctcagctctgtgagaataattgcaaaaagcaggtgatatgagaatgggctgcatggctgaaaggtgatctgggtgcaagtgctctatccccagggtgggacatcatgccggagtcctaccaggtgtacaggaaacactaatcctgtgggaaggagctgggccctggaacaaaactctctgggtctaatcccagcatcagccctgggtgtca

SEQ ID NO: 207077 - DNA, 512 bp, Homo sapiens
tcttgattttgcttctcagagttattgattagtattatgagtatttactctaaaagtaattgagtatgcatttctccactagacatcataccgcaaaatgatgcctgcttgaatttttttcttgcttatcaactacctctacctcctatgatgcttttaaacactggaattgggatccttaaaggtaaatgcctcatagttatttgtttaaataaacataattctgaggctgggggcagtggctcacacctgtaatctcaacactttgggaggcctagacagaggattgcttgaggccaggaattcaagaccagcctgggcaacgtagcaagaactcatctctacaaaaaataaaaaattaaccaggtgtggtggtgtgtgcctgtagtcccagccacttgggaggctgaagcaggaggaatgcctgagcccagtgggttaaggctacagtgatccatgatcgtgccactgcactccagcctgggcaacagagcgagaccttgtctcaagaa

SEQ ID NO: 207078 - DNA, 380 bp, Homo sapiens
agcaagatggaaataaggccgatggaaaataaacatcagtttctatttaaaacaatgatattcgggtctgtttgcaatgtgattatttcatgaagtttaacagaattaccacatggcactgctctgagatgtgaagctgttttctacattttgggagattaaaaaaatgctttcccctaatatttcgagctagtttgaaaattataaatgttctcctttctttccaccaaagtgataaaagaaccaatgagtatacattgggcttactcagcatttattggttgtagttgaggcgttttgaggagatacagaggtgaatcctagtgatacaaaagccgtgacacagggtcaggtgcaatacattctgtgagggtcgcgca

SEQ ID NO: 207079 - DNA, 346 bp, Homo sapiens
tttcagcagagttattgaaggagaagtcaaggagaggagaaggagaggagcagtgaatgttgtcgtgaagaggtgttgtcttgaaatactgtatttttttcctccttttcttttctgaacattcttgtgctgacctttcctctagtccaacagaggcattcacaattgcctgtggagaattaggattgtcgcagcaggtcagcaaggagaaagtcatttttaagattaaatttttaaaaatgttttgaaacttccaaaataagttcttgaacacctatggagaggctttgaggaaagttaagggaatgattttataccacaaaaataaatggaaaaagaataaaga

SEQ ID NO: 207080 - DNA, 477 bp, Homo sapiens
ctcttgataccactcttccctcttacaggagaaagtgaaatgttccaaaaagtcaatacctattggaaagatcctcctctcctggacaagatggcaaatgaatcactctgaccaccaggaaaatctctcagaggttccacaacatatggagtacagtacttgtggggatggttaataagtacaaacagcagctgggggctgggcgcggtggctcaagcctgtaatcccagcactttgggagcccgaggtgggcggatcatgaggtcaggagatcaagaccatcctggctaacacggtgacaccctgtctctactaaaaatacaaaaaattagccgggcatgtgtgcggccgcctgtagaacccagctacttgggaggctgaggcaggagaatggcgtgaacctgggaggcagagcttgcagtgagccgagactataccactgcactccagcctgggcgatgagcaagactccatctc

SEQ ID NO: 207081 - DNA, 369 bp, Homo sapiens
cagaaacagaactgtaagtgattattttctgaaaaaaaaatcactgtgccttaaaatagttttattaaaaaattattcctgggccgggcgcggtggctcatgcctgtagtcccagcacttgggaggccaaggcgggtggatcatgaggtcaggagtttgagaccagcctgaccaacatggtgaaaccctgtctctactaaaaatacaaaaattagctgggtgtggaggcacacgcatgtaaccccagctactcggaggctaaggcaggagaatctcttgaacccgggaggcgaagttgcagtgagccaagatcgcgccattgcattccagcctgggcgcgagactgagactccgtctcaaaaaaaaaaa

SEQ ID NO: 207082 - DNA, 234 bp, Homo sapiens
tctcttgacattatctttgaaggggcagttttaattttaatgaagtcaattttatcaatcacaaaagtttcatagatgaaactttcatagttgtactttagctttacagtaagtattaaagtcaggttgcttagtttctcgttttcatttctgtttaattcctaggttttacaccattatttgttgctagtatggagaagtataataaatgtttctgtattaatgttagagata

SEQ ID NO: 207083 - DNA, 425 bp, Homo sapiens
ttcatatttttttgtgtagttatattacagtaaaaggaatattctttagttttgaaaatcttacatataaaagcagttttctgacgaaaataaagttagtagctaaaaagaaaaattaagaatcccactgagtagtgcaaaaaacatatgtaacagatgtacacatatgactcaaggaaaaattttacaatgtgtcaatgaaacagctaattcttcagttctttttaaaaatttggtttcctgttggttacctgtagccacaacttgctgttcctttaaagagctctctcattattatagagctagctgctttgtaatttacacacactttcaaggtgattttcccccagggtcaagactgttttcccttggaactggaggcaggaaaaaaataaaatggaagaaaaggaaaaacaagaaccctg

SEQ ID NO: 207084 - DNA, 349 bp, Homo sapiens
taggtgcaagtagtttatttgggaagtgatcccaggaagcacaaaaggtggggtgggggggcgtgctcatgagtatgttactgctgtgggtgacgggtggctcggtcttgctgaggacccttgagagaacacaaagacgacccctcaacattgtcccactgagagatggggcagctgaggtgtttacctttcctctcccatctttcactgattgagaattgtccttcggggcataaaatttcaggtattttcaaaatgccatgcaggtgggctaaacaagctcctacagcccctggagaaagccaccgagaggaaaagcaaagaacgaggagttttggggtgggaagct

SEQ ID NO: 207085 - DNA, 261 bp, Homo sapiens
taaaactattgtgctacaaaggacacatcaagaaggtgaaaaaacccacagaatgggtgaaaatatttgtaactcatatcaaatatgggactttacaaaaagaactctacaaaagacaacacaattaaaaaatgcacaaagaacttgaatagacatttctccaaagatacaaaaatggccaaccagcccatgaaaagatgccattagtcagttatcagggctacgcaaatcaaaaccacaatgagatactacttcccaccc

SEQ ID NO: 207086 - DNA, 1093 bp, Homo sapiens
agcaatctcttttgcaacatgtcctctgggtaactccattgcgtagtggagtttgaaaaccactgctgtggacaaacaacctaagtccctctaaggcagtctggcactgactgtggtagcccgttaagtgtggctcctgcaggaccatcccttgttcaccctatctattaaagtttagtggcagatgagaagataacaaatgatagggtacaactttgtatctaaaccataatccgtgaaaaaatctattttcagtcttctaattagaagatacttcactcaaatttaagctattctaaataataacattttcctgaagtaagaagacatagagtcaaaggaccaggcaatcaattactaattagtggttagttaacaagaaataaataaaactattatcagaatgtcatttacataggcaaagcatagccaggtaggtaggtcgtattagaaggactataagatggataactacaaatctattctgtaacactagaaattataaaaatgacaaaaatttaattatcaaatggacaaatattgtaagattccttcacagtggtttatcttcattactggaagagtgcttcagtacaaactttccaggctcagtttggcagaatttatcaagaatttaaaaaatatggccactgacataataatatggttaaacaatcatcttaagggaatagaaatctaagccaagaactaaagaaccaggaactgaaaaggcaaaaggaactaagtgatggaaggagcaagagggagagatgtgagaccttgcaccaaaaataaaacttaaaacaacaacaaaaagtatagatagaccctgttacctgaatatgaacataaaggaaaagcaacagtcaaaattttgtctggaataatggaaattttgaaaaaacaggagagtaagaaaaggaaactaattttatagaaagaatgttaagtttgattttgggttactgaaatgacagcaggccatggaaatgaaaggagctaagtagcagagggaatgggtgatacgaagttttagatggagtggcttccgagtcatcaaataaaaataatagttgagatttcagaggtagaa

SEQ ID NO: 207087 - DNA, 586 bp, Homo sapiens
gacaaattacataaacttgtactcgcagaaaggtttgccactttgtggcacagagccatgcagtaaggacaggatagcctccctaaagcgtatttccttccttattggcagtctgagaaaaacctggaataggaccatatttgataggtttggcctaaaaaaatagtaataatcgtccattgttctccctagtcttctcattgtccttagaagctataatcagcagcctcagaagcatttatatttttcagtttctgtaattaatacatactcttataatcaggaaatttcatatgaaataaatgggctgcttatataaattactatgagagctgttcttctcagcatgatccgtactcactgattccctccctgttgccctaaaggaataactatctgcctcttgtgttatggaacttttgaggacctcttgcagtttttagttagctcctgtttatattaaacagtggttttctgaggcttcaaaagtgactgatctcaggcacagtgaattcaggcaagaacaccatgaaaaggcataagaatagaagaagaatagctttttctagttaaagagaagagagaa

SEQ ID NO: 207088 - DNA, 354 bp, Homo sapiens
tggttcttaaatgtttgaagatcaacaggttatggtcaggaaacttgggttctgggtaatttctatacaaatcagaaaagaacttcccagaggttctacccttgatctatctggagctggaaggctgaaagcttacctttccctaaacatagacaattatgggaaaatttttcattaactcagagtttgagagttctaagttctgattctgactctatctgttatatctgttcatccagtctctgtcttcatttatccatagaatggtaataccccaactcagaagaaaaagggaactcattcaagcgctcaggggggaaaaaagatcccctgctgataaaaggcattcagtgg

SEQ ID NO: 207089 - DNA, 187 bp, Homo sapiens
aggtcactttttacccctcaatatgtcttaatgggttgaggtagagagaagcgtgggtaggtatcaatcacgagagcacacaggctaaaagaaagaaaaaatgagctgggacatctaagttcaacttccacttcctcctatacaagctgggtgaccttttcctatctagaaagtgggagaagtagtt

SEQ ID NO: 207090 - DNA, 917 bp, Homo sapiens
caagattatgcacctatacaaataataattatattccaactctgaagagatgaatctgtctgacatgtagaaaaccaatatacaactcaagagtagagacaaatgacactgagatgagaaaagcaaaagtactttatatgaagaaacctaaattaggatggtaacagtctcaaatattctagcttcacagtatgagaaactaaaatcatgtcactggagtttaagtagcttcaatgctgaatcccaccacctgatgtggcaagtaacaacctgcccttgcattatgatgcctgtgtcccagcagggaagaaccagtctggtgggactgaaggtgggccacaggcagccttcaacaactccatgccagaggtagctcaggcctgttctgaactgttctaaaaatcacatcacttccaatttaacattcaggcacaggctgaactgtgtactaaacttaatgagcatagaccaagaatctgcaataagctctaaccagctgcttcaaagactataggtaagtatgttctcactggcagactcatttgtgaatcaaaattcctctgtttcagattcaactgtttttgctcaacatgtgacactgctaaaacttaatacatttccacccagtataatcattttccaagagtaattggagaatgttggtaaagtactcagaaaaataaattgtacttggtaatcaaattatattaaatttgttatgataaggaaggcaacataaataggctacaagatccgacacaagatcctcatgttttagagaagaatcttctcagttggctcaatggaccaacctcaaagtactaagcactttcaagaatgcacactaaatttgccttcctctgtggtgggattagctctcaatacagtggtgcaagatacaagtccttatatacaac

SEQ ID NO: 207091 - DNA, 375 bp, Homo sapiens
atcaatacctgtttttcattgacttaatgataccctcttcttctgtgttgctccttttctgcttcctcttttttcttttcacctttttcttatctcgtaatttggtattcattcccatcattttctggacacttttttctcaaatatcctgtcaagttcaagggagtatttgctgaagtcattttgtatgttttcactgagggtgatcatcactatatgtcacccctccattttcaaacatttttgcctaggtttttgtaatatcactatatatcgtcccttcatcttcaaacattttttccgtagatttttgtaacaattactctcatttttctaaagccattttcttgactttcttctgttttccttctttat

SEQ ID NO: 207092 - DNA, 345 bp, Homo sapiens
tttcaggctgtgcccactcagacccagccctctccaaacccttctcatatccaccacttgcacgcagctcagtgcatggaggccctccatccccccacctcaccaggcagctgcctgccatgctcagacccctctgcccagccttgtggatggcctccttgtggaacgccatcaggctgatgaaggaaggaggccttcggggaaataggaaggaacggtgtgcagcccaggccccactggccagcagcaggcttcgggcttgttccatggccataagcaacaagcggcctcctcactgtcccacggggcctcagcactgcatgaagctacaggttcatccttctc

SEQ ID NO: 207093 - DNA, 181 bp, Homo sapiens
tttgtcatctagctggggaggggaacagtcagttgggacggggtttagaggagggaagatcataggcaggcctgatcggggaaggcttcctgcaggaggaggtatctaaatcaggcctatgcccatgccatacacctccaccactcctaaaacaacattctttcctttagggctatgcaaa

SEQ ID NO: 207094 - DNA, 145 bp, Homo sapiens
ggaccacaggcaaatgccaccatgccaggctcattttttccacacccatatatatatttttaatgacagggtcccactatgttgctgaggctggtctcaagtgatcctctcacctcagcctcccaaagtgctgggattacaggca

SEQ ID NO: 207095 - DNA, 613 bp, Homo sapiens
gaaggaaggaaggaaatttacattctctcctaggaatgtgtatttctagtggtagggcaacccaccactaatacacatgaaactggtcatgtaaacatgctcttctctttctctcccccagggaaatattgtctgtgaagcaagattctcacatttcttttcaaatcctcttcccatgggctagcccctctgggaatgcacaggtccctggtgacccagctggccagctagaccaaagccactggctgcctttctttttgagcctggatcttcaaaggagatccacttacaaactgtcttagtccctttggactgctgtagcaaaataccataagctgggtatttcaataaacaacagaaatgtatttctcaccgttctggatgctgggaagtccaagaccaaagcaccagtagatttggtgtctggtgagggcacattctctggttcatagatggtgggtttttttggtttgtttttgtttttgtttttttgacacagggtcttgctctgtcccccaggctggggtgcagtggcacgatctcagctcactgcagccttaacttcccgggctcaagcgatcctcccacttcagcctcctgagtagctgggact

SEQ ID NO: 207096 - DNA, 592 bp, Homo sapiens
tcaggggccagctagaccacccagccctccttgattctctaagagtctccttccccttggagttttaccaattactgctattctctagacagatctccaaagaccaccttcccctctgactctcaacctagggtggcatcaatgggctgccaatgcctccttcccacagcatggcctgcatcatagccagtcaggaaatacgtttcagagcatcgctggcacttgagatgcatcttgtttgcctctgtagtttaaaggtgagctgagaactcctcccttagtatgacactgctcatgtagataggatagagccctaaaatgaggcattgctaaaggatgagacagtagactcaaagcttagagctcatgagagtcacttgggaacttggcaaagtttgtcatcctgaacccccacaccctgagattctgactaaggacctaaacctgtgtttcagcaagtactccaggtgattaggatcgggtagtctgtggtccacattttgagaaacagtaggtgagggcagtggttctcaaactagcagcatcaccatcacctgagcacttgttagaactacaaagccctgagctccct

SEQ ID NO: 207097 - DNA, 557 bp, Homo sapiens
aaagtgctgggattacaggcgtgagccatcgagcctgaccttctccttttttctttaaattgttatgttgttgtgaactatatcgctgtgacagtgtattaaatttgtatgtagagtataaagaataataaagctctacatttattaagaaatagaacattaccattaccttaaaagccacctgagtgcctctctcatttgcattttcctccctcatcaccatgagtaatatctacctagattttttttttttttgagatggagtctcaattctagcctgggcaacagagtgagaacctgtctctcaaaaacaaatcaaataaaatagaattcttttgtgaaaacacttactctattaccttcagagatgcagcgtgctcctacttaagacttttacagcagctcatttcaagttaagttatgtccatttcacaccacctgatagtgtgctcatacaggacaaaggaccaacttagtcacctgtatctggtgcctagtactgtgcacattgtagacacttaatgttgctgaatgaggaaacctttttaatccttcaa

SEQ ID NO: 207098 - DNA, 459 bp, Homo sapiens
aagctggagtgcagtctgaaatctcggctcgctgccacctgcacctcctgggttcaagtgattctcctgcctcagccttctgagtagctgggattacagatgaccggcacaacgccgagctaatttttgcattttttagaagaaacgggtttcaacatgctggccaggctggtctcggactcctgacttcaagtgatccacctgccttgacctcccaaagtactgggattacaggtgtgagccaccgtgcccagtcatcaattgatttttgacaaaagtgaaagggtaattcaatggagaaagaatagtttttcctgtaaattctgctggaatagctggttattcctatgcaaaacagtgaacttagattcacaacttatggcatatacaaaaattaactcaaagtggattatatacctacatgtaaaactaaaactgtaaattccctataagaagaaa

SEQ ID NO: 207099 - DNA, 268 bp, Homo sapiens
aacctccagaataacaaaaatgaatgtctatcttagaagcaagaaacagaaacacaatggacaaaaagtaaaatactcaagtaattcgaaaggtagactttatttttattttttatttttgagacacagtctcactctgtcgcccaggttggagtacagtagcgcagtcttggctgactgcaacctctgcctcccaggttgttcaagcaattctcaagcctcagcctcccaagtagctggtattacaggcgtgcaccaccacacccag

SEQ ID NO: 207100 - DNA, 258 bp, Homo sapiens
acccctcagcttgtctaaggacacgggtgcagatagcaggagacccctacagtgagtattcagtgctataaatttccctctcagcactttagctgtataccaaataaatcaaataaataaatcgaataatcaaatcaaataaatcacttctttagctgtatatatcaaatcttgatatatttacatttcattcaattcaatgtatttttaaatttctcttgagatttcctcttcaacccaaggattatttaaaagtgt

SEQ ID NO: 207101 - DNA, 279 bp, Homo sapiens
gctgcacatattcaataaagggagagttgtttttaaaaacaaatatgcaagaaataatatgcattgatgtagtttttctaaatcctgatacatagtacttagcgtttcttagagctgtaggggtaggtgtatttaactgatatctttaatttgtgaaaacttttcttttggaaatttttttccccattacctatttttcctccccccatcaaaaaaagaaaagggtaccatcctccgctttccatttgtggggagtgggagattgattaagatgccttt

SEQ ID NO: 207102 - DNA, 603 bp, Homo sapiens
tgccgattcaatgtgtccaaactgaaaactcttagtgagtgaaataaagttgcctgcactgtgcagaattgaattctgtccctcccagtgcttacttcatttcccttggcataaaaaacatagtcatagtgtccttgaactgcttgtgatacattttggtgttcaagcatactagagttaatgtttcattatatgtgctaagcattttcttttcaaagcccgaatgttgttctggagcatatcagttacgccttcttattgtttactacttatattatttcttttttttttagacagagtctcgctgtgtctcccaggctggagtgcagtggtgagatctcagctcactgcaacctgtgtcccccaggttcaaacgattctcctacctcagcctcgcgagtagctgagattacaggtgcatgccaccatgctcgctaatttttgtatttttagtagaggcagggtttcaccatgttggccaggccggtaatgaacacctgacctcaagtgacccacccaccttggcctcccaaagtgttgggattacaggcatgagccaccgtacctggcctattctttcatttttaatgcccatataagaat

SEQ ID NO: 207103 - DNA, 346 bp, Homo sapiens
  misc_feature (1)..(3): n is a, c, g, or t
  misc_feature (7)..(8): n is a, c, g, or t
  misc_feature (32)..(32): n is a, c, g, or t
  misc_feature (65)..(65): n is a, c, g, or t
  misc_feature (134)..(134): n is a, c, g, or t
  misc_feature (137)..(137): n is a, c, g, or t
nnncccnntttactgtcggcatcatgattggngcagaccggtgagggactaaggggatatgagangtgagggggtgtcaaggacaagcggtgacggagatgatgctggccactggggtggggcccattacaggnttngaccggtgagggactaaggccaatcatgatgccgacagcagaaggaaacagatttgcatgcataaggaccactctgtcagccttatggaggaagcctctgttcgggaggtgggtacaggagggcacctagggccccatattactccactacatcacagtgactgcagtggcttgggcagagtggtcgcagtggagctgaagagcaggag

SEQ ID NO: 207104 - DNA, 371 bp, Homo sapiens
taaaggtcttatccttaccctttttcttttgctttgtcctttctcagtagttgacttcacctatattcatgtttccaaatgtcatccctgggccagtaccttttaaatctctatttttggcttcctcgtctcttctcagttccagacctgaattcccaactggtcgtctgtactagaatgttcaaaactgaagccattatctttgattagtttcccttctttgttccttccctccccaacaacctgttctcatgtggtggttggttctgttaatatgaccaccatccttctagtcattctaactttacattactcttttatttctacctaaatatctgaatagctactcatatatcttttcctgtttccat

SEQ ID NO: 207105 - DNA, 515 bp, Homo sapiens
ccagtggcaagggaatccagaaacgttttctttttgcctggagatgctaatccttagcctaagaataaggaaactggtccatgtaaggactgaccatcctttcacccatctgtctgcccacttgtgcatccatcccattttatccatccattcctccagttgtggacaccagatgactttcagctccccctaccccaaccagaactttgctgcaatggccattcttatatgcccctatggacccatgggacaattctctgggatacatgctaggagcagaattgctgaatcatagggaatgcatgtgcttagcttggctaagcaatgttggagtaaaagcttttggttttgcatcttctcagcacttctagggaggcaccaaaagggaggatggcactgactgagcccacctgagatagctcctagaccccagccctctgtgtcctcagaatcacacactgctgctcatcacttcagcttcccgaagatcatggcaatagcagcatgcctgtaac

SEQ ID NO: 207106 - DNA, 327 bp, Homo sapiens
tatcttacattatattaaatgaaaaaaggcaaggccaggcatggtggctcaggccaataatcccagcactttgggaagatcaggcgagcatgacaccatacctagccttacatgctatttttagcttaaaaaatcggtcacttttgatgtgctcacttcacctccttggatatcggcattgtaaagttaagataaatcctagttattttgttgcctctgagctttcatgtttgagaaagataagaattcttttcacaacaaatctgatagtggattaacatccattctcatggttacttttatttacttcttaatgtttatagagtt

SEQ ID NO: 207107 - DNA, 822 bp, Homo sapiens
gtttaattttggggtgggatgggaattcttgaggtagccttggaagtcacttaccaagagtagtgggcacatatgcaatgagagagcaaaatagtgtgcagggatcactgaaaagaatgggagagagaggaaggagttgcctgaagaccaagggcagaaatcccaaaaggcaggcagagcccaacgaagaagggcagccagacagccctgaaagccgaatccatggcacccagatgatcttctccaagggtcatccccagtccagatatggaaggagcagggggccaagccaaggcgggatctgcacgaagcagcagcagggccacctccgggcaagagtgtgactccagggagtcagctcagctgacaagacacagaaagctgcccgtctgcatgtcacgtgacctgtccacacacagtcctcctttaccaccacgtccttggcgtacccacatcctcattgcgctgaggttgtccaagctaccaagacttgaggcagggattctcacagcaccgtccagtgttaaactgcccttaaggtcactattacagttatgatgagccctaacagtatgttagggataaacagatgcccatctgattccccagtgtccagacacctgggctttttcctaactagaagactcggagttcacccactgcctacttcccatgcctaggattctccctgggttccctgttctggtaagatgccaacacgtccactaagtcagattgaatctctcaccacctgaaggccttcctgaaaccatcggtgagccgcttgcttccctggctactacttggccttgcgatatgcaa

SEQ ID NO: 207108 - DNA, 653 bp, Homo sapiens
cttgtaccaaaatttgattatgaaagtccttgttgacatggcttgtcaactgacagccgttaactgggtgcttaagtaagcagcattttcttcagatgaagaatttctttaatcttttttcctgaggtgaggtgggactacaggaagagaagcccggttggcagctttttaggcctcagaggaggaagggggctgaaggtctgtgttttgtttacatcaactttccatttcatgtgttttgctcctaccctttgccactctagagcctggtcccctaagtccagagcctctgctaatgtctcaggagacttcctttactgtcttctgtgttggtggatgcagggacctggagagcagtgctccatattgaaaccttcaggacagcaaggtccacagctctttcccttggtgtcaaccgctgtctgcactaacctctctgtctttaatctcttagctgctctcatgccttttaaaaatttttctcccaaattaaaagtggctttagtttttctgtagtgaaaacaatcagtacatgtttatacatacactcatgcagttttatgtaagtaggactttggtatctgtttttctgtaactatacattatgtattatcaaggagatctaagctatatgcataatgatttttgtattt

SEQ ID NO: 207109 - DNA, 415 bp, Homo sapiens
aatattctcctgttgttctggggttgaaggaacaagagagtgaggacagagtccaaaatgagagacaacagtgagagtaagggagacgcataaatgaagttagaggaagttttgagatagtccttcaatctgttccctcctcccacactctctgccatccttagtcttgctcaacaatgtttatcattttggaggtaacaaaaaccactagcttatagtacttatcttccatctctcactaatcaatgtagaacatcctatttgctgcagtctatcttcttcttgactatcccaacctggttattttccattccagtatcctttatagcctcatctattgaaacatttctttccataatgtagtcatcaggttccagaatatctttcaaaataacagtgaatatgttttaatatt

SEQ ID NO: 207110 - DNA, 360 bp, Homo sapiens
gtttagactgaggtactcaacacagatttcctaattcatgttactaagaggcacccttaaagtgctccatttccatagcttggtactccaaaaaaccatcctggtcccactgccctgtcctttcaaagaagcataatggccagctattctggacgaagagagagatctttggagattttttcttctagaagattaagaaatctttaagacttataggttcagactcattacagcagtctagattgcttcaaaatatgaaatgaggccgggcacggaggctcacgtctgtaatcccaccactttggcaggtcgaagcgggtggatcacgaggtcaggagatcaagactatcctggctaaca

SEQ ID NO: 207111 - DNA, 523 bp, Homo sapiens
gtgtctcttgcttttggaagcaactccatatataacaaaatgactcacagacccttcctgtttgcagtggtgaaggaatgtctccaatcactatcaaaatgactcaatcactatcaatctgtttgcccaaaaattgagggagaaaggggacagggcttaacaaaatcttactttaatccaccagaagtattactggactaatcagaatggaagagaacctattttcctaacctaagcttaagctctagcttaaacttttcaattcctaaccagcaagacaaaatataagcatttaacccgatcattgtttaatgtttacattttgaatatttctatctactttctctatctatactgagttctaaggttctgagggacaatgacaccaatctttaactaactttatgcagaaacaagaatattctcaaacataaacagcttattagaatttatattaatgatgataagaataataaattatctagagagaggaacagcagcttttcaaggcaagggccataat

SEQ ID NO: 207112 - DNA, 140 bp, Homo sapiens
ccatagtttgttcattcatcttgtgattagtgacaccattgttttcagtatgtatttatttatgtattttttgagacagggcctccttctgccacccaggctggagtgcagtggtgtgatcttggcttactgcagcctcg

SEQ ID NO: 207113 - DNA, 761 bp, Homo sapiens
tgaaaagagtatcactcttggaattcttaacacaaaacattctgtaaaaatctcattgattccaatggcacacattaaacaagcttaactggactagatcagaatgacatagtaaaatgccaaggaaggaaaatgatcatttgctgtcttccagtgagtacgtacagccatccatcaattgctggataaaattactttattgatgtcccatgatagcctggtaactccatgaaaagtgtgaaaactcagtgaaaagtagttttatctacatggcaaacaaccagcctattttttttttcctggctaaaaagtaacctcttcttacatgattagaactaatagttggtcaactttaataaaagatacatacacgtgcacacacagatttaatttgtttgtatagagccctagcatttgctttgaaaaaggttacctgtttggggttgtgggtcatctatttttcaaaaaccttaagccatcttctacagtttccacatttcgtttctgacattggtgcatgaattaaaatgtgtttcctaagcaattttaatagatacttctggacacatttatatcttatggatatatttcattcatatctaatttgacaaagttgtgttagtgacttgtctttatcaagtttttctaaagcattcaactgatttttcatggaaacagcagcttctttttcagttattttatgcatttatgtaaaatctcatttaactacatgatttcaatggctaatgttgttagcataa

SEQ ID NO: 207114 - DNA, 693 bp, Homo sapiens
tttcctagtttccttgagagttatgtttcattttgcttgaattttaattgcctgcttagttaatttattttcacttttgatgatataggcattatagcctgggggcttctggatgtgttggccctcctcaaattatatgcagaattcttcatgtgcatttttttttagggagacagtctttgtatcagattctcagagatgtcaaaccctaaaagggataaaattgcttttatcgtttgagatgtcaaacgctaaaagggatgaaatctggcactagatttaagttgattacatcctacaagtcttgatgcttaatgttttcatttttatttttatactcttggttctttatttcttttttgatccgtttttgttaaggaaaattctcttaaagtctctcacgctgtaatattctcctatgctacaacataatcttgcattctctgaaatcttcaaaacaaggtgtgtcctatttcatgggcagtgttgcctaatataaatagaatgtgaaccatacatgtaatttaatattttctagaagccacatttaaaaagtaaaaataaacaggtgaaattaattttaatatattttatttaaccaaatatatccaaattcttattccatgtcaacctaaaatcaatatgaaaattatcagtgaactatgtagcattcttatttttgcagtaagtctt

SEQ ID NO: 207115 - DNA, 407 bp, Homo sapiens
tattgtgggacttcgtctctgtgactccgtgagccaattcctcctaataaatctccttccgtttatcctactgattgtatctctggagaacactgagtaatgcaggtacccttgggcagtaaacaacctgtcaaacaatacccagcagacttggaaggcacagtgacttcacagagagaagattgtactggaaaggcctagaattgagggcaatggaagggttttctttctcccctctaatgtataaccaagcttcctactcaaaccctatgtgataaaaaaggagaatcaagcggaacctgcatcagtatctaatcaacagacttttttccctcctagaaagggcatttaaatatcaattcaagctaagaaaactgagaaactccagaataaatgctttggcaaaa

SEQ ID NO: 207116 - DNA, 236 bp, Homo sapiens
tacattatctgcatgtctcgtattacttcaacagaaataaaaaatacatttggaaaaagaagaaaaaagaaatgctactgagcttcgttgatttgtatcctacaacttcactgaagttgttgatcagttctaatagttttcttatggagtctttagatttttacaaatatatgatcatatcatttgcgaacaagaatattttgactctttcctttccaatctggataatgtgatag

SEQ ID NO: 207117 - DNA, 639 bp, Homo sapiens
  misc_feature (559)..(559): n is a, c, g, or t
tgtatgtttccatttcttcataataaaaaaaagagtttaaaaagagacagaagtatccagatgtgtccactgaaacttggcgctcagcaggccaaatgcctttttgaggtccccaaatgcaatcggaatgaaagctcgttaaaaggcagtttcaacacccccacaggatagaccttgcttttcaacttggaatgactattcaggtagctgagtaaaaagtgattttgctgatttctacgtaaggaaagcagactgaattatgttacagcttgtgttctgattgtttttatgacaataggctttctagacatttctgctctgctacaatacaggagttgggacctgaaggggcttgtgcatgtgaacagaacagggaaggaaggagggctactggatgccatgacttatgtccctctttgtgtaaatctggagaaacacaggtttacagaaatgctttatggtgcccctggcaagcaatagtatgtatcttcaaaaattctatatggtgaaaagtatcataaataatttttagagatacctgctgaaatagttacagatnaaacaatatgatacccaggatgtgcttcaaaacagtctgtcagccaggaggagggagcatcggtaggagttgagactgtg

SEQ ID NO: 207118 - DNA, 378 bp, Homo sapiens
tgaaattagtcaatatcctgttccttatcaaacttccaactctggtcttagcatccattgactgaatcaagtgcctttgtgtaagtttccacatgatgagtgtctatttccatcattggttctatttttatgagctggtattttactataagaaatagcatattattttctatgcttaaaccactgcaagtttgaccctttcaagctggtttttgtgtccttttgacatattcccattgttcattgagcatttccttattttctggcataagaagatgttccaagtgcaacttgtatattacctgtttcagccctggaatcagacattttcctaaggatccttggtttctttgaataaaggatactatttagaagcca

SEQ ID NO: 207119 - DNA, 284 bp, Homo sapiens
gtccaaacaatttgaaatcttatggtacttatagggattcaaatctgttcctccattactttttggccaaattcaagaggagaaatctctcaaatgaatccaagctggctgttataggtgaaaagaaagtcaagatgcgccagacttttaaaagcttgcagtggttgagagattttgttatttatacactttttattttggctgaaaatatttggtttttgtttaagaattaagagaaccgtgtaggctacaaaatttatttatgtgcgaatcccagagggttg

SEQ ID NO: 207120 - DNA, 307 bp, Homo sapiens
tgccaaactgtcagaagtcagtgaagcaaagaatcgaaggtaaaatgttgattcaaagattgtctcccctaaatccttcatttctttctctgaaatggaactttggaagccatttatatagattagtctgacagcctttatatttgcatgtaagtttacttgcatccttagacttggctttatgcaaaaagaaaatttttattcgttatattgtatttcatctgtctgatttccctggcacattaagatggtcctggtccctcaggatactttttcccttaataaatgtcatatgtaaataaaggca

SEQ ID NO: 207121 - DNA, 444 bp, Homo sapiens
tgccaagggatatgatagtaaaaaaacctacaacacctctgccctcatggaagttaccttctacaagggggtagccatttaattaatggggaaagaaacaaatacaaaggataacttcagattgcagtcagtgccatcaaggaaataagcagaggatagagaggtggaaaggcactttagacagagtggtctaggaaggtctaggaaggggagctgacatttaggtagagatttagtcccaagagcaaaaatctgactttgcctctggagggaaaattctggacttagcctcaggcagcagagttctagacttagcctctggaggaagtagcagaacgtggtgtctgggagctaagttcaggacttcatgtctggaaaaagatattggggcttcaattcaatttttgcagcaaagtttctgactcaatgtgttaattaaaaggg

SEQ ID NO: 207122 - DNA, 501 bp, Homo sapiens
atctcattgttcaattcccacctatgagtgagaatatgcggtgtttggttttttgttcttgcgatagtttactgagaataatggtttccaatttcatccatgtccctacaaaggacatgaactcatcattttttatggctgcatagtattccatggtgtatatgtgccacactttcttaatccagtctatcattgttggacatttgggttggttccaagtctttgctattgtgaatagtgccaaaattctttcaaattatggtcagatgtataaggatatgtctttccaccatgaatggacattacaaatcccatgcctctgcgaaatgcaacaaaggctttctttacaaactctaatataatcaatcccccactcctgccaaaaaaaaaaagcttatagtgaaaagttacagatgtcaactttaatacaaactaaacaaaccatcaaaccattcatagaatattttgtcagaattatctgctttaatttcattcacaagc

SEQ ID NO: 207123 - DNA, 522 bp, Homo sapiens
tttttttttttaagtaaaagcactccacaagtagatttcaaccaaaagtgagagaagggcaacacaacgaaattcagaacaagatgttattctggtaaacttttgggaggaaattattaaggttattaaggtaaacttttgggagaaagtgactcttaaaagtaaatttaaagtcttttgaggaatagtattattttaccaaaggtatagtctcttaagtacaaaaaaaatactttagaagtcagcaaaagagaaaggtttttaacaaacgtactatagtttaaacattacctatcatcaccgttcatcaaaatcatattgaaatccagtttcagtatagaaaagttttaactgttatttcataaaacaatctgctagtaagttttttaaaaaaatttaatatataacatttcaatcataaaatggaattaaatacaagtatttacaaatcttagttgcctgagcaacagaagtgattctagaacagctgtgttcaaaccttagtgtacttgttaaaatgca

SEQ ID NO: 207124 - DNA, 612 bp, Homo sapiens
  misc_feature (448)..(448): n is a, c, g, or t
ggcggggacagcgtccggaggagggagccgcccagacctagcccgggtggggcgaacgaagagcgggcgtggtgggcgcctgctagctccggctcgcggtgttaggccttggggacatcgctcggggacaggagagccccgggcccccgccgccccgagccgtggccgggaaggggaacacagtccatgcgtgcggcgcccgacagcctctccccgcacgcccgagccccagtgcaggcggcggcccggcccctttgtgcctggagtgtcacgcgcgggcgctcctgccgccgcgcctgggagaggcctccggcaccccgggcccctttccaagcacaacagcagccctgccgcggccccgcgctgacccactttccctcctgcctcctcagcccgaggccgagaatccagcggccgccgccaagcaggtgcgagccgtcgggcgggngcgcgcgggaggcggagaggatgggcccctgaaccaccccgcgcgccccacctcagcctcccggggcgagccaggtttccggggcgggggccgcgaggaggaggaggagggcaaggcgggggaacgggagggagaggacccggggagggggagggggaggcgga

SEQ ID NO: 207125 - DNA, 360 bp, Homo sapiens
aatacatgtggggcttaaaacctagatgatgggttgaaaggtgcagcaaatcaccatggcacgtgtatacctatgtaacaaacctgcacgttcagcacatgtatctcagaacttaaagtaaaataaaataaatcaacaaacaaacaaaatagtacctcctataaactgtgaaagaatgaaatgagatggaaacgtatctaaagcattcaacacagtgtcagacatgtactcagtgcttgctaatgctagcttatattattctgatgaatcatattagcaaatgaaaattcacctattcactgaatcttttggggaccactactatattctcggctaaataaaagaggcaaaatgattaaa

SEQ ID NO: 207126 - DNA, 888 bp, Homo sapiens
ctgggttcaggtgattctcccacctcagcctccctagtagctgggattacaggtgtgtgccaccacgcctggctaatttttgtatttttggtagagacagggtttcaccatgttggtcaggctggtttcgaactcctgacctcaagtgatccactcgccttggcctcccatagtgctggaattgggcgtgagccactgcgcctggccccatacccttttttttttgttttttttttttaacatattctttcttgtcatttacatttgtgctccaacactagagttgagtagttggaacagagattgtgtatcctgaaaacctaagctgttactgtttggccctgtacagaaaaagttggccgactcctgctctagccacttaaggtgtttttagcctagggtgggttgggtgaattgtttagtcctgtgatctgaaatcactctggctgtattgtggaagttagatttcaggttgggattggtttcagagcgaatatttagaaaggtttttatagcagtccaggtgaaagataaagagcatggagaagttaaaaaggagagaactgattaacaatatttaggagataaaattgaaaagattttaataggtgatgagatgtgagtgaaggggaaagagtatgagtgtaggatggcttccatatttttatctacaagtacattcttatcaacatataaatatatttattcaaaaatattcactgaatatctctggtaagctggagtttactagaatctggagtttcgtatggagtgtccaggctagagataataaacttggaaatcatcagaatataaattgtattttgcagccataggcaggatgaggtcaccaggaaaatcattgtagatgaagagttgcccatctta

SEQ ID NO: 207127 - DNA, 875 bp, Homo sapiens
ttctctgcattccaagtttctgtgataacacatcccctaaacagcaaaaataaaggcagaagtgatctgaaggaagggtcatgaccaaagcaacgtgggcagctggagatttttgtttgctagtttttgatctttatcaaataggatagccttcgcgtgtagcgtggtgttcgtcctagccttaaggaatagcttctaagttccacttgaaatatcctttgccagcgtagactttcacactgagaatcatgcagtgcaaatcatcgcctacttgttctgcctcaggttggagaggtgggcagtgcggaggcctgtgtgtcatttcagccaaagctcaggtcaggcagtggttagtttatactgtgcaccgcccctgtgtccagggccaggtccttctgctccatagtgagggtaatcaagctcaggaggttcttccttgggccactgtgattttaactaagtgaccaagagtcctatcagcagggccaatgcctggcagaaggaaaaggggacctcttggtgctgatcattggaatctggagcagaaggattaatattttgggacaaggaagtcagaaacctttgagaggtggggtgtcctcttggggtagggagctcaccctagagagagttgaggggttgaggcttccctgggagagtgacttgtggctggcagggagagtaatgagtttgacaaaggacactgttattctaatgccaccaggtcatgctcctattttcttgtcagtgaggactaaactgaacacaccagtcttcctctaagcatcctcagagctgagaggaaaggtcccttcccccatggtaggctttagcaaatgaagacagcctgtcagtggcaggggggctacagccgt

SEQ ID NO: 207128 - DNA, 540 bp, Homo sapiens
tatgaatctattatttcttgactattttcagagcatcacttatgggataagtaccttaaactattgtcatccccattgaacagatgaggaaactatccaagtatttaaggtacttatcccataagtgatgctctgaaaattgtagcaaaagctatgaatctattatttcttgactatttattttaaaaaagccaatgtggattgattaaattgatgcaaccttagaaataggtgtcttttcactctgtacacacttagagtttcaaagtctagctcctttaaaaacttaataccaggtaaatatttatagggttttattatctaactgcctttttgtttataccttcttgttttttacccacaggaaaaggtgcattcctcagggagttctatggtttacatcttccctgggcatctgggttcctagctggctttgtgttccttgaccttgtagcctcattgtctctggggttaccaatatctttccctgacatggacccttcctattaatagcttcttcctccccttatcccccaggat

SEQ ID NO: 207129 - DNA, 862 bp, Homo sapiens
gtcggttcctggcgctctgcgtttcgtgaccttgtccagtagaaggctatttaattttcacaactgcttgaattttgacatacaagatgaagcaagatgcctcaagaaatgctgcctacactgtggattgtgaagattatgtgcatgtggtagaatttaatccctttgagaatggggattcaggaaacctaattgcatatggtggcaataattatgtggtcattggcacgtgtacgtttcaggaagaagaagcagacgttgaaggcattcagtataaaacacttcgaacatttcaccatggagtcagggttgatggcatagcttggagcccagagactagacttgattcattgcctccagtaatcaaattttgtacttcagctgctgatatgaaaattagattatttacttcagatcttcaggataaaaatgaatataaggttttagagggccataccgatttcattaatggtttggtgtttgatcccaaagaaggccaagaaattgcaagtgtgagtgacgatcacacctgcaggatttggaacttggaaggagtgcaaacagctcattttgttcttcattctcctggcatgagtgtgtgctggcatcctgaggagactttttaagctaaatgggttgcagagaaagaatggcacaatcccggtttaatgatcttttgggcccaacagggctaattttatcttctcggaatcagcacaagtgcccttaattgtgggacaactggtggctttaaaaacacctttaaagtggaggccggttgcgagcaagagagggataattggggcaatacaccggaccacgtttctccacaaagaacctgtcctcggttcagaccggttta

SEQ ID NO: 207130 - DNA, 624 bp, Homo sapiens
actagcgggttagtctccggcgagttgttgcctgggctggacgtggttttgtctgctgcgcccgctcttcgcgctctcgtttcattttctgcagcgcgccagcaggatggcccacaagcagatctactactcggacaagtacttcgacgaacactacgagtaccggcatgttatgttacccagagaactttccaaacaagtacctaaaactcatctgatgtctgaagaggagtggaggagacttggtgtccaacagagtctaggctgggttcattacatgattcatgagccagaaccacatattcttctctttagacgacctcttccaaaagatcaacaaaaatgaagtttatctggggatcgtcaaatctttttcaaatttaatgtatatgtgtatataaggtagtattcagtgaatacttgagaaatgtacaaatctttcatccatacctgtgcatgagctgtattcttcacagcaacagagctcagttaaatgcaactgcaagtaggttactgtaagatgtttaagataaaagttcttccagtcagtttttctcttaagtgcctgtttgagtttactgaaacagtttacttttgttcaataaagtttgtatgttgcattta

SEQ ID NO: 207131 - DNA, 779 bp, Homo sapiens
  misc_feature (663)..(665): n is a, c, g, or t
  misc_feature (667)..(667): n is a, c, g, or t
  misc_feature (673)..(674): n is a, c, g, or t
  misc_feature (688)..(688): n is a, c, g, or t
  misc_feature (690)..(691): n is a, c, g, or t
actagcgggttagtctccggcgagttgttgcctgggctggacgtggttttgtctgctgcgcccgctcttcgcgctctcgtttcattttctgcagcgcgccagcaggatggcccacaagcagatctactactcggacaagtacttcgacgaacactacgagtaccggcatgttatgttacccagagaactttccaaacaagtacctaaaactcatctgatgtctgaagaggagtggaggagacttggtgtccaacagagtctaggctgggttcattacatgattcatgagccagaaccacatattcttctctttagacgacctcttccaaaagatcaacaaaaatgaagtttatctggggatcgtcaaatctttttcaaatttaatgtatatgtgtatataaggtagtattcagtgaatacttgagaaatgtacaaatctttcatccatacctgtgcatgagctgtattcttcacagcaacagagctcagttaaatgcaactgcaagtaggttactgtaagatgtttaagataaaagttcttccagtcagtttttctcttaagtgcctgtttgagtttactgaaacagtttacttttgttcaataaagtttgtatgttgcatttaaaaaaaaaaaaaaaaaaaaaaaatttgtggggggcgggnnncngaaaannttttaaaacattgngnngggggggcccttggtacgggcttggcaagggccgaaggccggggggaaggtgggtcacataaaaaggcgggggggggttgaaaaacgg

SEQ ID NO: 207132 - DNA, 668 bp, Homo sapiens
actagcgggttagtctccggcgagttgttgcctgggctggacgtggttttgtctgctgcgcccgctcttcgcgctctcgtttcattttctgcagcgcgccagcaggatggcccacaagcagatctactactcggacaagtacttcgacgaacactacgagtaccggcatgttatgttacccagagaactttccaaacaagtacctaaaactcatctgatgtctgaagaggagtggaggagacttggtgtccaacagagtctaggctgggttcattacatgattcatgagccagaaccacatattcttctctttagacgacctcttccaaaagatcaacaaaaatgaagtttatctggggatcgtcaaatctttttcaaatttaatgtatatgtgtatataaggtagtattcagtgaatacttgagaaatgtacaaatctttcatccatacctgtgcatgagctgtattcttcacagcaacagagctcagttaaatgcaactgcaagtaggttactgtaagatgtttaagataaaagttcttccagtcagtttttctcttaagtgcctgtttgagtttactgaaacagtttacttttgttcaataaagtttgtatgttgcatttacctttcccccccccccccccccccccccccccccccccccccca

SEQ ID NO: 207133 - DNA, 591 bp, Homo sapiens
  misc_feature (475)..(477): n is a, c, g, or t
  misc_feature (479)..(479): n is a, c, g, or t
  misc_feature (485)..(486): n is a, c, g, or t
  misc_feature (500)..(500): n is a, c, g, or t
  misc_feature (502)..(503): n is a, c, g, or t
actagcgggttagtctccggcgagttgttgcctgggctggacgtggttttgtctgctgcgcccgctcttcgcgctctcgtttcattttctgcagcgcgccagcaggatggcccacaagcagatctactactcggacaagtacttcgacgaacactacgagtaccggcatgttatgttacccagagaactttccaaacaagtacctaaaactcatctgatgtctgaagaggagtggaggagacttggtgtccaacagagtctaggctgggttcattacatgattcatgagccagaaccacatattcttctctttagacgacctcttccaaaagatcaacaaaaatgaagtttatctggggatcgtcaaatctttttcaaatttaatgtatatgtgtatataaggtagtattcagtgaatacttgagaaatgtacaaaaaaaaaaaaaaaaaaaaaaaaaatttgtggggggcgggnnncngaaaannttttaaaacattgngnngggggggcccttggtacgggcttggcaagggccgaaggccggggggaaggtgggtcacataaaaaggcgggggggggttgaaaaacgg

SEQ ID NO: 207134 - DNA, 1047 bp, Homo sapiens
tgtttttaattttgaacaaagtacttgaagtataaagcaacttctggagcatacaaggactagtagctactacaaagctagtgttgagtaagaggaaacccaaattaactgtaacttagattttttcgttacataaaagtctaataatctggggcagggataacagctttacagtcaaggactaggctgggtccttacctcttgttgctttaccgttctcaatttacagttgcttctatggtcctagattcctgctctggctccctgatcatattaatgtgcattcaacaagaaggagaaaaagagttcagcatgttctttccctttgagaacacttttcataataagttacacattttcttatatcttgttggcttatgatttggaggctggtaaccatatgttcaacttatattttggggttctcttcctgaagaagattaaggcaactggtaagcattctgtgataagagaaaaagattaatcctatggaaaatgctttctgcttttggattgtgcactcttagctccctaatttgaacataggccatcatatcagaattaaaggtagtagattgcagttctcaatattaaagcaacagagttccttaaggtacatgtataaagcgacagttgtagaaaaggcactggactaacacttggctgtatcttgtaacaggcgcatgttatgttacccagagaactttccaaacaagtacctaaaactcatctgatgtctgaagaggagtggaggagacttggtgtccaacagagtctaggctgggttcattacatgattcatgagccaggtaagctatgctatgttatagtaaagcagtaattgttgaaatattggtggttatggttgtcaaaattttaaaaatatcattgacatcaaatgatatctgaaagtaactgttctgataagtttttttttttaatgactaatttcttgactctggagagagttccaattttatggtaaataaaataccacagcagtgaaagtaacacattattctacttggaaaataatgtaagaagtaa

SEQ ID NO: 207135 - DNA, 531 bp, Homo sapiens
actagcgggttagtctccggcgagttgttgcctgggctggacgtggttttgtctgctgcgcccgctcttcgcgctctcgtttcattttctgcagcgcgccagcaggatggcccacaagcagatctactactcggacaagtacttcgacgaacactacgagtaccggcatgttatgttacccagagaactttccaaacaagtacctaaaactcatctgatgtctgaagaggagtggaggagacttggtgtccaacagagtctaggctgggttcattacatgattcatgagccaggtaagctatgctatgttatagtaaagcagtaattgttgaaatattggtggttatggttgtcaaaattttaaaaatatcattgacatcaaatgatatctgaaagtaactgttctgataagtttttttttttaatgactaatttcttgactctggagagagttccaattttatggtaaataaaataccacagcagtgaaagtaacacattattctacttggaaaataatgtaagaagtaa

SEQ ID NO: 207136 - DNA, 408 bp, Homo sapiens
agttgagaatacttttgaatttctgttgagtatatgaaaatcatattaaaatgattcaaaacattttctttccacagaaccacatattcttctctttagacgacctcttccaaaagatcaacaaaaatgaagtttatctggggatcgtcaaatctttttcaaatttaatgtatatgtgtatataaggtagtattcagtgaatacttgagaaatgtacaaatctttcatccatacctgtgcatgagctgtattcttcacagcaacagagctcagttaaatgcaactgcaagtaggttactgtaagatgtttaagataaaagttcttccagtcagtttttctcttaagtgcctgtttgagtttactgaaacagtttacttttgttcaataaagtttgtatgttgcattta

SEQ ID NO: 207137 - DNA, 1295 bp, Homo sapiens
  misc_feature (1179)..(1181): n is a, c, g, or t
  misc_feature (1183)..(1183): n is a, c, g, or t
  misc_feature (1189)..(1190): n is a, c, g, or t
  misc_feature (1204)..(1204): n is a, c, g, or t
  misc_feature (1206)..(1207): n is a, c, g, or t
tgtttttaattttgaacaaagtacttgaagtataaagcaacttctggagcatacaaggactagtagctactacaaagctagtgttgagtaagaggaaacccaaattaactgtaacttagattttttcgttacataaaagtctaataatctggggcagggataacagctttacagtcaaggactaggctgggtccttacctcttgttgctttaccgttctcaatttacagttgcttctatggtcctagattcctgctctggctccctgatcatattaatgtgcattcaacaagaaggagaaaaagagttcagcatgttctttccctttgagaacacttttcataataagttacacattttcttatatcttgttggcttatgatttggaggctggtaaccatatgttcaacttatattttggggttctcttcctgaagaagattaaggcaactggtaagcattctgtgataagagaaaaagattaatcctatggaaaatgctttctgcttttggattgtgcactcttagctccctaatttgaacataggccatcatatcagaattaaaggtagtagattgcagttctcaatattaaagcaacagagttccttaaggtacatgtataaagcgacagttgtagaaaaggcactggactaacacttggctgtatcttgtaacaggcgcatgttatgttacccagagaactttccaaacaagtacctaaaactcatctgatgtctgaagaggagtggaggagacttggtgtccaacagagtctaggctgggttcattacatgattcatgagccagaaccacatattcttctctttagacgacctcttccaaaagatcaacaaaaatgaagtttatctggggatcgtcaaatctttttcaaatttaatgtatatgtgtatataaggtagtattcagtgaatacttgagaaatgtacaaatctttcatccatacctgtgcatgagctgtattcttcacagcaacagagctcagttaaatgcaactgcaagtaggttactgtaagatgtttaagataaaagttcttccagtcagtttttctcttaagtgcctgtttgagtttactgaaacagtttacttttgttcaataaagtttgtatgttgcatttaaaaaaaaaaaaaaaaaaaaaaaatttgtggggggcgggnnncngaaaannttttaaaacattgngnngggggggcccttggtacgggcttggcaagggccgaaggccggggggaaggtgggtcacataaaaaggcgggggggggttgaaaaacgg

SEQ ID NO: 207138 - DNA, 912 bp, Homo sapiens
  misc_feature (182)..(182): n is a, c, g, or t
  misc_feature (188)..(188): n is a, c, g, or t
  misc_feature (192)..(192): n is a, c, g, or t
  misc_feature (196)..(197): n is a, c, g, or t
  misc_feature (796)..(798): n is a, c, g, or t
  misc_feature (800)..(800): n is a, c, g, or t
  misc_feature (806)..(807): n is a, c, g, or t
  misc_feature (821)..(821): n is a, c, g, or t
  misc_feature (823)..(824): n is a, c, g, or t
actagcgggttagtctccggcgagttgttgcctgggctggacgtggttttgtctgctgcgcccgctcttcgcgctctcgtttcattttctgcagcgcgccagcaggatggcccacaagcagatctactactcggacaagtacttcgacgaacactacgagtaccgcatgttatgttacccangagaancttntccnncaatcaagaggttacctaaaactcatctgatgtctgaagaggagtggaggagacttggtgtccaacagagtctaggctgggttcattacatgattcatgaggcatgttatgttacccagagaactttccaaacaagtacctaaaactcatctgatgtctgaagaggagtggaggagacttggtgtccaacagagtctaggctgggttcattacatgattcatgagccagaaccacatattcttctctttagacgacctcttccaaaagatcaacaaaaatgaagtttatctggggatcgtcaaatctttttcaaatttaatgtatatgtgtatataaggtagtattcagtgaatacttgagaaatgtacaaatctttcatccatacctgtgcatgagctgtattcttcacagcaacagagctcagttaaatgcaactgcaagtaggttactgtaagatgtttaagataaaagttcttccagtcagtttttctcttaagtgcctgtttgagtttactgaaacagtttacttttgttcaataaagtttgtatgttgcatttaaaaaaaaaaaaaaaaaaaaaaaatttgtggggggcgggnnncngaaaannttttaaaacattgngnngggggggcccttggtacgggcttggcaagggccgaaggccggggggaaggtgggtcacataaaaaggcgggggggggttgaaaaacgg

SEQ ID NO: 207139 - DNA, 725 bp, Homo sapiens
  misc_feature (609)..(611): n is a, c, g, or t
  misc_feature (613)..(613): n is a, c, g, or t
  misc_feature (619)..(620): n is a, c, g, or t
  misc_feature (634)..(634): n is a, c, g, or t
  misc_feature (636)..(637): n is a, c, g, or t
actagcgggttagtctccggcgagttgttgcctgggctggacgtggttttgtctgctgcgcccgctcttcgcgctctcgtttcattttctgcagcgcgccagcaggatggcccacaagcagatctactactcggacaagtacttcgacgaacactacgagtaccggcatgttatgttacccagagaactttccaaacaagtacctaaaactcatctgatgtctgaagaggagtggaggagacttggtgtccaacagagtctaggctgggttcattacatgattcatgagccagaaccacatattcttctctttagacgacctcttcctaatgtatatgtgtatataaggtagtattcagtgaatacttgagaaatgtacaaatctttcatccatacctgtgcatgagctgtattcttcacagcaacagagctcagttaaatgcaactgcaagtaggttactgtaagatgtttaagataaaagttcttccagtcagtttttctcttaagtgcctgtttgagtttactgaaacagtttacttttgttcaataaagtttgtatgttgcatttaaaaaaaaaaaaaaaaaaaaaaaatttgtggggggcgggnnncngaaaannttttaaaacattgngnngggggggcccttggtacgggcttggcaagggccgaaggccggggggaaggtgggtcacataaaaaggcgggggggggttgaaaaacgg

SEQ ID NO: 207140 - DNA, 719 bp, Homo sapiens
actagcgggttagtctccggcgagttgttgcctgggctggacgtggttttgtctgctgcgcccgctcttcgcgctctcgtttcattttctgcagcgcgccagcaggatggcccacaagcagatctactactcggacaagtacttcgacgaacactacgagtaccggcatgttatgttacccagagaactttccaaacaagtacctaaaactcatctgatgtctgaagaggagtggaggagacttggtgtccaacagagtctaggctgggttcattacatgattcatgagccagaaccacatattcttctctttagacgacctcttccaaaagatcaacaaaaatgaagtttatctggggatcgtcaaatctttttcaaatttaatgtatatgtgtatataaggtagtattcagtgaatacttgagaaatgtacaaatctttcatccatacctgtgcatgagctgtattcttcacagcaacagagctcagttaaatgcaactgcaagtaggttactgtaagatgtttaagataaaagttcttccagtcagtttttctcttaagtgcctgtttgagtttactgaaacagtttacttttgttcaataaagtttgtatgttgcatttaaaaaaaaaacacctttatgctaactttcatctatcttttactaactttacaaattccccttatatctattctagggggctaattttaataaaaaa

SEQ ID NO: 207141 - DNA, 416 bp, Homo sapiens
cagggagctcaggttaccagtttcctttgtgtttttctgccagtgtgaacaggagaaatattagcctttagagatttctttacagttccttgaaagctggaggggtgaaatcagccagagaattatataacagcaaagctcatttaaagcaacagtgtctttctatagggctgtggtggttccttaccagtttttgttactaactataaagaaaaggatgctaattttgtgaataaaatagaggggcattcccttccctcattactttctgtttgttcattggacggacacaattcctagggtgttgatttaaaaaaaaaaaattgaagcctctttcaaggaagactaggggaaatcatgtacattaacctcaggcagacacggcatacttattcttgttagaagtcagaagaaaa

SEQ ID NO: 207142 - DNA, 288 bp, Homo sapiens
tcaaggaagacttaaaatggcgatgctagtccaagatggcggtgctgctgctctgccagtcatcatcagggcagcacatcacacacagcaactttttaaggacaattcggggttttcaaatgcaccatcgagtcttcgcacatccgaagctgaccgcagtccttggcccatgctagcttatttaatgaacatttgttgactgggtgcagggatgagcaagatagatcagaaactgacaaattccgaaaatatctcaagtctccagtgcaatctagtgaatttgtgaaa

SEQ ID NO: 207143 - DNA, 787 bp, Homo sapiens
cctagaagcagatgctgacatgcttcctatatagcctgtggaactgtgagccaattaaacttcttttctttataagttacccagtctcaggtgttactttatagcaatgcaagaacagagtaattcaatgagaaaggcagaaccactatgagtgagacagaccctaagcaatcatgggagctggtagggcagtttgtgcaaaccattgcccctgtgtgtggtgtgcagcataacataactatgagtcagccaggggagaaaagctaaatgtgggtaagaataaagaaaaactgattgagaagtggaacccatgtccatcttaccacctccaacttccatgtcatgagtaacctgcaggagaagctggtgtcctttgtccagagcttcatgtacatttggcccacaattcagaaaaactgaaggaagagagcctctgagaactaaaggagctacaggcctgactgtggccctgaacccacaaagtgaactggcacattagtaacagtatggacaagtgttcccaactgcctagcactctaaaccaagcttcagaaagtaaaaaatacaggtgtatggggtaccccacctcccctttatagtctgctctgtccataacaccagctggaggctttcctggggccacctgagtccaggccccaatcagatggacattggaaggggtgagaccaggactggcagggagcagttagttgcctttctagtctccctccctagccatgcacttttgcctttagaaaaatgatggggaaaaccttggctccttctt

SEQ ID NO: 207144 - DNA, 317 bp, Homo sapiens
gctacctgggaggctgaggcaggagaatcgcctgaacctgggaggcagaggttgcagtgagccaagatagggccattgcactctagcctggatgacagagcaaaactctgtctcaaaaaaataaatttaaagacaagcagtaggaatcagttgggattatgacaggcagctttgggtttgaaaaaggaagttccagatgtcaaagcagttcagactgaggggaggcttttaactttttaggataacatctataagtttcaatatatggaaaagatatctgcactcccatctttatcgcagcactattcacaatagct

SEQ ID NO: 207145 - DNA, 247 bp, Homo sapiens
gccgtccttctccaaaccattgcccaaagaacataaggaaattctccctgtttccttgggacactaagcaacccagagacctcttgaagtatctgctgacttggtcctaatgtagctttttcacagttctcagaggcttttgtcaggccagccaagtgaggaatgcccaggacactcagtgtgaacagtgacagaagtaccaagagtgcagcagtgcccttggttcctctaggtcggtcttcacctg

SEQ ID NO: 207146 - DNA, 575 bp, Homo sapiens
tgctcacactaagtactgtcatgacatttgcctattctttgaatcattttctgttttcgaattgcatggattatacaaagaggaaaattttttggtctttcttacacatgtactttacctatcacatatggttcatctctcataataattaacacagtaagcactatgaaaattcctcctgcctccccagataaggtgaactttaaatgttagagtaaaccatattacttttatatttaaggaaagtgcatttggctttaaaaggtaaaggctcctttcaaataaacatagatttagtatattattatagcaaactacaaccaaatttgtttgaaagggtgggccggacatggtagctcacacctgtaatacaagcactttgcgaggttgcagcaggcggactgcttgagcccaggagttcaagaccagcctgggcaacatggcaaaacctcatctctattttaaaaaaaggttgggcaggggaggggtgtttaataatattttccttatagtactgatggagaaaaaagaaaagcattacaaattctactctatgttcaaaaaaaggggaagct

SEQ ID NO: 207147 - DNA, 210 bp, Homo sapiens
tttatttttttcccaattggataaccagtcatccttaggtatttattgactaatacatcttttcacatttgatcagaaatacttctttgatcatatattaaattcccacatatatacacatgcttgcttgtctctggaatctattttcttggtaatcttattgtcagggaaatccgccatgtcatatctctaccatattttgtcactttg

SEQ ID NO: 207148 - DNA, 941 bp, Homo sapiens
cttttactccgcatctgtgaagggtggggagcgctttcgggatggaactgcgatccctcgcacgcgcagatcacgacagggctcacgctcctacgagaacctaatgccgctgctgctcggatgggaagtggggttcagggggtgacgcttgctcacccaccactcacctccggctgtgcatcctggttcccaacaggccacggactggtgccggtccatgcccgggggggctggggacccctgtattgaacaacagctccccgtttctccagcccccagctcctggccaccaccctcctactttctgacttgatgaatctaactgctctaagcacctcatccgagtggaatcatgtggtatttgcctttctgtgaccagcttctttcacgtagcctaatgcccccaaggttcatcgatgtcagaattggcctgtgtcggaatataagccgaataatatccgttttatgtaaaggccgcgttttgtgtatccattcatccacccatagacacttgaggtgtttctgttttttggcaagtgtcaataatgctcttaggaatgcgggtatttccccgacaacctttgggcttacttcactcatcagcagcaagcaggccatccttgaagcttaccgtggggtgggcccattgaccagcctggggagagtgggtgggtcattgaccagcctggggccatcatgctggctgggaaggcgtggccctcaggtgccagcttctacccaacactaagccgttggtgctcctggcacttacttacttgctggaagacattccaccttgctttcccgtctttccccagaagagggtgctgggtttctgcttctctcctgaatgggaaaagggcggctgcagcttgccatgaggctggcgtgggtggggttaggagaaaggactgtcaggtgctgtgttgggaagtgtgtgt

SEQ ID NO: 207149 - DNA, 229 bp, Homo sapiens
tttgtaaattcctggaagattgatgtgcttcgtgcagacctttaaaaggggtagataagtggtccatgactctggtccctgcttgttctttaccttcagggcaaatgagtcagacacatctcattgctataaacttcttgactatgcacctggatacttaggcttagagaaactatgttcagtcacttgcaacaattcaagggtggaagagttaagaataattcctgtc

SEQ ID NO: 207150 - DNA, 339 bp, Homo sapiens
actcccgcggctcgggggagagctgcacgcgacccaggtgctggcctctgagcggctcggctcggagactacaggatcaggaggaggttggaggtgaagcgtctggaatccggtgcggaggttgagactgagtattaagtctgttcaggcggaacgcgccgagaagggcggttgtgaaattgtgtttttgtgaatgtatgtcctagcacagtgtgtgtgtgattgtgattgtgtgtgacaccttgtgtacggatgtggggaggactctgcgggtgtcccgtgagtccctgtgttaggactgttattgtgtgactgtgtaacgctgtgtgagggtgtggg

SEQ ID NO: 207151 - DNA, 308 bp, Homo sapiens
tagatgcagccaggaagtacatctgccatcaagaaacagacatcagaaagattggtacactctgagcagatcttcagagtgaagccttgagaatggatgtagcaaggacaaagatgctaggatgaagggggaagatgatagaaaccatgtacagagctaccatgcactgggacttgttcctggattgcagcaactcctggggaaggggtgagttaaacaggtgaggagcaacctactttcaccatggacctctggaatcctggcagcaggagacctcacaaccactacagacacttcagctggcagca

SEQ ID NO: 207152 - DNA, 498 bp, Homo sapiens
ctctcactcccagaacaacttcaataccaactcctgtttacagaatggaggtgcaagaagtgataatacagattgtgtttctcaaatgcaacctcgaaaacacaagtacataattagtgaatagatgcacttatgtggaagacacgctctgacagactgtgttggtccaaatgctggaaacaaggacaagtatgcacagtttgcaagttacaaacactccatttaactcacctttgtgttcttagactttagctaacaccagaaatcacctagagcatttgttaagacatagattgctaggccccattcccagagtttctgattcagtaggtcttaaatgaggttcaagaatttacctctctagtaagttgccaggtgatgctgataatgctggttctgagaccgctttgaaaatcactcatccacattacttatgccataactagtacatagaagatgcccaataagtgtattttgattcattgataatacactata

SEQ ID NO: 207153 - DNA, 851 bp, Homo sapiens
ccctggcccagaagggtggatgaagtagggcctcagcacagctcatcctaccgagcaggccggaccctgagttcctggcttgcactgaagggtctggatctgaagacagcatgtacacagccattccccatagtggctctccattcccaggctcagcgtgcacggcatccaggtctgcatggtgtaggcagggtggagaagctgtaagccggtgcctgtgagctgcaagagtaaccagagacgtccttcttctccgggggacgtcctacacatagtgctgcacaatggcccagaagaggtttcccatcttgcacctgtggataggctcagcagtgtcatcccgggatgagcatggggcctgtgccgtgctggctgtgcacctcaagacgctgctgggagagcgggcctgtgctgcaccgggatggtgcagggcgaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggacttgttcatcctggaactggggccggaacatcttcgcctggtgtggtggaaagtcccaaccatcctggaacgcaacaaggcgaggacctggccctggcatcccggacagtgagcgacagggcacgcccagtggagattgtcactgatggggaagcactgtggaaaatcacaggctgggcccaacctgtcttaagggggcaccgggaaaccccggaaaggaaaccgg

SEQ ID NO: 207154 - DNA, 162 bp, Homo sapiens
actttcctggtggactttagtacatgataaacatggcatttcacattagaaaggaaaagaatgactatagtaaatattgttgggacaactggttatccgtttggaaaaaattatatgttccagtcattctttatatcatatacagaataaattccagtttga

SEQ ID NO: 207155 - DNA, 423 bp, Homo sapiens
cttttccccccctggctactgatccctggataaatgaaagcgtacaccaagctggagacagcatgggttggggatggtggaagatttcaaagtgctactcaatcctgcctgtagcaaagccattctccctgtgagctgactctattgttcttcacctcattcctcggacttaggtgaaaagtttttctcttcctttttctgcgcaatagcccatcaatttcagtaaatttgagtacttgtccaaggactgtggcagactatattactcttctgggctgagaactatggaaactctagttgtcgtgaaacaaaacaaaacaaaacaaaacaaaacaaaacaaaacaaaacccacaaaaccagaacatttgcacgccaaatgcccattttcaaggacttttaaataaagatgttaatatctgtgg

SEQ ID NO: 207156 - DNA, 889 bp, Homo sapiens
cctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcgggggctggctgcatcccaacgacaaagtcatgggacccggggtttcctacttggttcggtacatgggttgtgtggacgtcctccggtcaatggtgtcctggaattctcacaccgggctcatgtcccacggaggccgcccagctgctgtttgaggctgagcggtgagtaagggggacaggggaaagctgtttgcggcgactctctgggcgagaactcgactggcgagggcacacaacgccacactagcttgggaagacaatcgcc

SEQ ID NO: 207157 - DNA, 403 bp, Homo sapiens
aagaatgtgcaatacaaagtctcataatttacttgtatgtggtataaatagtgtgtgctcatggactgtgcttctgccatccccagttcccagcaatccctaatacaaatagacccctgagcaaggacaccttctcgtcttaggatgtccatgagagggcagtgctctgaatagaaaactttgccaagaaacatgtttgcttcattgttttcaaagctaattagttgattaatgccaagtaaactttctatgtttcctaggttttcgtctaaccacaaaaaacaaaattaaggaatctagctgacctgacttcactaattatgacagtttgagtccagctgaaatgattccattgcttggaatcatctagccaagaaagccctctgagtctgtatttgccgtg

SEQ ID NO: 207158 - DNA, 311 bp, Homo sapiens
gattttgaaaatcaattatgggcctagatatcagattaagtaatgtgaactttcgttatgaggctttttaactaaagaaataagtagatcataggatcatcaaggctgaaaatggcctgacaccatgtttcggtgttttctttatcatagtggtgatatattcatgtgtatgctttctttccaagtggtagagaagtgtatgcaaagtgaaaatctagaatgtcattgtccagaggctaccacttgctacacatttttttctaacttcttttattattatcaactctgaacattaaactttttaaaagttc

SEQ ID NO: 207159 - DNA, 431 bp, Homo sapiens
cctattcaggtcctctttcactgtctcaggtctgaaacacgacagtatcttctaaacttcaatcttccttcctaacctactataataacagacacatcttcctaaaaatggctttcctttccttgtctaggtgcctcataactcacagagtgcaaagagaaccaaagtgtgacccaatgacccaagaagttaacgtctagtgttggttctgcctgaaatgccacaaacattgagcaaatcattttgcctctctggcctttaattaccccatcaataaattcagtagatttgctctaaatgattctggatctcttccaactctaatattcttaattttaagtttcacattcaaatgacacatcaaaaacatcattgcaaaaatcgatagccaagacaactgtttcaaataacgatcagaataggaacaatga

SEQ ID NO: 207160 - DNA, 195 bp, Homo sapiens
atgtaaatagaagatgataatttaaaaaatcttgaaatcttgtatgtggattggaagtgtcagtatgcatatcgtggctctgtccataagaaaagcctagaaacaactgccaacctagtagcaatgagcatccctaaattccaattgtgatcttgaaataccatttcccaataaaaggaagcaacctcttcttag

SEQ ID NO: 207161 - DNA, 484 bp, Homo sapiens
ataggggagagggaaggtggtgtggaaggaaaagaccagggggagcactgagtctctcagtgaccttgaagatagcaaggttaaccattccttagctgttttggcatctgctctgttgtcaccacctccccacggcacgggtcagggtctgtcacagcctcgtggccccacgcacttcacctagtacatgcccctgctggataataaggtttgtgtgtgactgatgtgggggatatctttggccagtggtggcatcccctcaagactttgtctcgaatgagggtgggtagggcctgtgtgtgtctgtcttggtcattgcagtcttgaccctcgttctccctgctccagaaatccttgcggacggaatggctaagcccagagctagggccaagtcaggcagggcttctgcattggaaggggcttgagagggttgggggcttcaccatctcacctctcccctgcccttctctcatccatctgcagg

SEQ ID NO: 207162 - DNA, 303 bp, Homo sapiens
caagttcgaggatgggcacgaggtccaatactgccaacgagagttaggcctggggcattacatgcatctgttggaatgaaaaaagcaggttctacttctggagtcactctggaagtggagcctagagccactgacggccgttttatcacatggagaagaaacctgcttaagaatggagccaaaggaaagcagggccaagagatggctccagactggactctggtcacatcatctgagtccctgagaccagtattaacccttgacctttcaagtatgtaagtcaataaaggtctgtgttgcttt

SEQ ID NO: 207163 - DNA, 280 bp, Homo sapiens
  misc_feature (200)..(200): n is a, c, g, or t
cacacatcccttctggctggctgcacattccatggttgatctctgcttcaggagcatgggctgctggaggcagggagggcacccgcatattgatggaggtgaactgaatgagtgaatgaacgtttgggacacaatccatttaaggagggactgcagcttgcatttgcattcatggaggggaaagaatggagggttcaggnaacggtgaggaggcatggaaaaggaggaatggagggtgaagcagcagggaagctgagatcaaccatggaatgtggcaggt

SEQ ID NO: 207164 - DNA, 373 bp, Homo sapiens
ggggagtcaagcccaggtgtggtggctcatgcttgtaatcttggcactttgggagaatgaagccagaggatggctggagcccaggagtttaagaccagcctgggcaacaaagcaagaccctgtttctttaaaaataaaaaataaaaaagtcaagaaccaagtacctttttaatggtggcttcctggtcaataataatagcacaacaaaaaagccacagaatttgcctatctgggcaagggctgtgggaacaaacctttcaatatttattttaactctaatgaaaggacatgagttgctcattgtgcaaaagtctatatctgcctctgtattaagaaatttgccaaagaaataaacatttttgaaaaaatgtat

SEQ ID NO: 207165 - DNA, 347 bp, Homo sapiens
ttggttattttaatagagatgtggatgtagtctcaaaatatacaaatataattctttagcagtcctcctttcataatatggggaaaatgtagatgcttgaatgtttagcattagatagatagttttgaaacattcattgtttgcatttgacttgcttgaaaggctaatttaagaggcctgctcctttctggaagttttcaaatcctcttctgtcaggtcatataggaaaggaaaagctttgtataaagcacatagagggaagttgcaacttagcatagtattatctgtctttaagtcctcatcttcttcctcttcccctctctcttcaaaaggtggttattgaagat

SEQ ID NO: 207166 - DNA, 334 bp, Homo sapiens
taatttccttcatctcccttcctccttacctattaaaaaaataatttttttaatagagacagagtcttgctatgttgcccaggctggtctcaaactcctgggctcaagtgatcttaccttggcctcccaaagtgctgggattacaggcatgagccactgcgaccagccctccttgcttttttaatgataaattcttcagcattttgcaaagggatttcctctttgtgattagcatttctcctgaatgttttctagtattgtcttccccagttaccgtcatgaaaattaatagacaaaacccattaaaaccacgtcttttgggagccatatcaca

SEQ ID NO: 207167 - DNA, 233 bp, Homo sapiens
ctccctagagaccgtgttgcatgacgccgagatggcgtcactgcactccagcctgggcgacagaccgagactctgttctcagaaaaacccaaaaaaccataattgcttaatgccaacatactgcatatcaaagacaaaacaaagctgtgaattataaataggctgtaaactaacagcagagttaactttctcccaagataattgttcacatccattgcactgtagaatcttta

SEQ ID NO: 207168 - DNA, 815 bp, Homo sapiens
cgtgagccaccatacctagcaaaatcaactctgaatctgaatcaaacctttgaaacaaaaattaccaatcaaaaaaacgtgcaatccctgctcctaactttgaaaaagtgacaaggaaggacatttggaaagatgtctctaagcagtcaacaagaaatgaaatcagggagagctttttcagcacctgaaaaaatacatgcaaaaacgcccgaggcgggcagatcaccggaagccaggagtttgagaccagcctggcaaacatgggggaaaccccgtctctactaaaaatacaaaaattagctgggtttggtggcaggcagctgtaatcccagctcctcgggaggctgaggcaggagaatcgcttgaacctgggaggcggaggttgcagtgagcctagatcgtgccactgcactccagcctgggcaacagagtgagattccatctcaaaaaaacgaaaaacagattcagagtttatttccttcccaaatacttcatagatgttggtttgtaggaataacttaaaagtctcactcgctttctgtcttttctagtaatttttatcgtggattctgattgcctagatctgctaattcattgagggttacaaaattgtgatactcgaattctttattcctccttcctttattacctgtaatacttcttaagaaaaactctttctcatcaactctatgactaccctaaattacagatccacatataggatctgtatacatgtatataaatatgtacatatcatatacgataatgcttaattctttcccattacttactaattttcaaaataatgtgattcc

SEQ ID NO: 207169 - DNA, 561 bp, Homo sapiens
tgtgtgtatgggtatgtgtatgtgtgtgtatatatgtgtgtatgtgtgtatatgtgtatgggtatgtgtgtatgtgtgtgtatgtgtatgtgtttgtgtgtatgtgtgtatgtatatgtgtgtatgtatatgtgtgtatgtgtatgtgtgtgtatgtatgtgtgtgtgtatgtgcgtgtgtgtgtgtgtgtgttatcatttaaatgggtcttatgcactacctaccacaaggtcattctataacttgtggcacttcagtctcaataacctctgccaataacagggctcaagtgataataagtttgcctgtgtgactctttctttcatgcaaatataaggcatttgtatgttacggcttaccttttccctgcaatacctggaaatcagagtcagtgagacactgtgtgttttagagttgggaaatctgaggccaaaaagaaaaataaattgtagaattcagtagatgtgtctgttcaagaggaggacccctcttctgaatttcctcatccagtagcacctctttgtggatcttctcatgagtccatatattttcttatttcc

SEQ ID NO: 207170 - DNA, 398 bp, Homo sapiens
ttcactgctcaggtgacaggtgcactaaaatttctactacataattcatccatgtgaccaaaaaccacttgtaccccaaaagctattgaattaaaaataaataagtagataaataaatacaatgtagtgttgtgtatacaccacggaatactactcatccacaaataacagtgaaagaatgtcttttgtagcaacttggatgggactggcagccattcttctaaatgaagtaactcaggaatggaaagccaaataccctctgttctcacttataagtgggagttaagctataggtatgcaaagacttacagagtagtgtaatggaatttggagactccgaaggggcagagtggaaggaggactcaagatgaaaaagtacatattaggttaaaatgtat

SEQ ID NO: 207171 - DNA, 344 bp, Homo sapiens
gtttaaataaacaatctaatgatgcacctcaagaaactagaaaagcaagaacaaaacaaatccaagattaggagaaagaaagaaataatgtagatcagggcagagataagcaaaatagagactttgccagttttcaatctctgcccatcagaatagtaaagaaaggattctccaaaaaaaacatgtgccccattatcggagccagacacagttgagtgtggggacgaaaccagtgctagctgggagcagtgctttttacttttttcccccaggtaacagtaatgacatggtactaatactttttattagcagtaagacctcaaagattctcaaatcactcacta

SEQ ID NO: 207172 - DNA, 232 bp, Homo sapiens
ggaacaccatgtaaggccatagatttttgtattctatctttgttccggctctttggttttccttgggagggattctacgacagacttactaagtgagactctgcaactctgcccccattttgtacccttctcccccaggcatcttgttcacttagctgagtacactcttggggagaagagagaatatggtggtagctcatgaggacacatccagttttcattcacagcctac

SEQ ID NO: 207173 - DNA, 507 bp, Homo sapiens
atgtgtctttctgtgtctgacatttttcacttagcgtaatatcctccaggtttgggaaaaagacaatctcttcaataaatggtgttgtaaaaactggatatccacaacgcagaataatgaaactggacctttattttataccatatacaaaaatcaactcaaaaacgattaaaaacaaacatgtagttttttttttttttttcatgtaaactggatctgtgggactaattgggtgatcaaaataaaagccagtggttttgctctttaaaagtatctcagtacttatttaataattggattaaacttctacttaggtttactgacccaggcatgaaaataggtaactaatgtgtcttactgactgattctgatccactgtgtggtggtctgatcacctgcccaaacctgatcttcaaatatgtgatcttgctgaatagaaaaccactgctctaggttagacaggaaaatggttcaaggaacacattttgtatatgcaattgcctactg

SEQ ID NO: 207174 - DNA, 546 bp, Homo sapiens
ataaaaggaatgacagtagagcattaagagaataaacagtatcactgaaatgtgaggaaacacaataaatgggattgtgtctcctgaaccttagtttcacacttcctcctccacttctgtcagagggtgtttgtgatggccgtctgttatcagccgtgatcaaaataatataacagtgaaactttttatacttatgaaggccctttcatcaaaaatctcacagccatttctaaatatagagcaactgatctttaaaacacttttatgttttaagcaattaatatggtaacttagctgttagactttccatcctgcgtatttgccatttggagcgtggatggaacatttcgtaatctactcagcattaaaactttgctggtattgagtttagaattccaacttttcgatggttcatgtaggtcttttcactgtcatctatcaaaacaaaacattgctttataatggaataaccacattcatttccacatatcaaaacccagattaaggattatagaccaaatggtatgtctagtttaaaaaaaaaag

SEQ ID NO: 207175 - DNA, 474 bp, Homo sapiens
tcattctacaacctttttgactcaatatgcataatgcttttgaaatttatttctaaagatacaaggaactatatagtattccattgtagaaatagaccatcatttgttatatttatccactttcctgaagatttgttctttctgttattttgctattacagttaattctgcaacaagtattatcatacacctcttgttgcacatatgccagactttttctaggacagtgtttttcaaacttagattacaattagtaggttacaaccaatgggatttttttaatgaaatggaatagaatagaaaatatcaaaaagtgttccctacagtatgttagggtaattactgtttcttaaagctttttttttatatgtgtttgtgtatatgtgacataatgtgtgtggggccacattgaagaatgcagttcttcgtgtagatctcaatcaaaagtgttgggaaggtgtcattctattacag

SEQ ID NO: 207176 - DNA, 291 bp, Homo sapiens
ttggttccttgcacatcctgagttccaacggacaggcagggagttcaagtgtccttcacagataagaagtgaatctctctgggttggccattcccggattccttagcttagactctgaacacatattcttcttagaccatacagtcattctcagggtatgcttgagttaatccgtgcccgtccacttgttcgtttttaagttgccatagtcaaccagtgttggatccatgctgattacatgtttcttttctttttttgagatggggtctcactccgtcacccagtctcaaa

SEQ ID NO: 207177 - DNA, 549 bp, Homo sapiens
tctgtgtcctcaccttctctgcttcaattctggtgctgcttaagccgattatcatttcatgccctaaaccaaaaaataaactctacaaacatcaacattacataggacaggatctggcccacaggtaagaaaagcacctacaagagagctgcatggagctgtgggtgcatttcctgttaccaccagggcatcccagaatgctgacaaagagaaaactaagaccttcccactctgatttgttacatgtcataacaccaagcaagtgacagaggagacaattatggggcccagaggaaggtgcctgtatcatgtagacaaaatccaaagcagcttgtttcagacaaaacattttgctttggaaacttttgaaacttccatggccgttgaatatagcagagatgatctaaaaattttagaagcggttgaggtacccgtggtaggggcaaggcatgggagtggtgatccttaaggggcttgtctttagtttgagggccacacacagaggaggtgggcagaaaactgaggtctccccagagcagctttccagac

SEQ ID NO: 207178 - DNA, 371 bp, Homo sapiens
acagagagttggaatctaaatcataaagcaacatgtatgtcaagctgatatgctggcgggggctgggaagagccctgaaaagtaatttccagccacaaagtgatatgaccagaccatcatattaagaagagcattctagtagcattgtggaggatgataccgaaaggagaaaacctgaaaacaattacaatggccccaggtaacagggaagatgatacagattcaagagatattttcaaggggtagaatttccagactttagtatttaatcagatggggagaaggcagggagagggacagttacagaagggagaagtttaggaaggttcccagattcctccagccaactgggtggatggtactaccattta

SEQ ID NO: 207179 - DNA, 395 bp, Homo sapiens
ttaaaaacctttaagcgcaaaatttgatttggaaatattaatttgaacatgagatattttttctgtaaaaaatgtatacataatagttcctagctttgtcaatgaaaaggcctcaaaacaattctctaacctctaaatcgtgggcttaaaacattattttccactaaaaagaaccagagccccttgaagaaatcaccaattctaggtcagaggaaggaaatatacaaaaggagcctgggacatgttgtaacaccagaaagcaaggaagctaccaaagactcaggagccaacttgaaggagattccactggccaaagatgggacagtgtcatgtgtaacatggaaaataagacaatggattaaaacatagaaatgtatacagccataagtccataa

SEQ ID NO: 207180 - DNA, 357 bp, Homo sapiens
tttttataacctgtctttaatttggtccttttgctaaagattgcagtcactgcttatttattataccattgggcatagggtagtaatgcattttcattttgctttactggcagtcctttgattgtatctaaaagaaggctgtattctagaagttgttgttttgttttttttttttttctgacatgagatgttctttaacagtttgggtttggtttttttgttttgtttttttactgtgataattctaattctccctatttattgtttaaaaacaataataggatacataagtagttaaacttatgaatttgtttttcattccatcttaaaggcaaaaattaattccacaaatataga

SEQ ID NO: 207181 - DNA, 597 bp, Homo sapiens
agaatctagacagtggctcaggaggatggagttactggatgacatgggaaggcatcttgaaacagttggaatatatgggacaaagaggaagtctttgtttgtgacaatgagtgaaagttggcttaggctacgtgtggcctgaagttacttaaccaatattctctaatgatccatttcacaactttctgagagctaaagtgaaaatgaccatcattggctatggccactgatagaatgcctgtagactttcctttagagcaactggggattgggcagtagaagccagggttattttaaaaaggaaataaccctttgggctgggcactgtggcacatgcctgtgatcccaacaatttgagaggccaaggtggatggatcccttgagcccaggagttcaagaccagcctgggcaatgtggtgaaatgctgtctctacaaaaaatacaaaaattgggtgtggtggtacatgtctgtagtcccagttactcgggaggttgaggtgggggatcacttgagctcaggaggtggaggttgcagtgagccaagattgcagcactgcacttcagtctggatgacagagtaagaccctgtctcaaaaa

SEQ ID NO: 207182 - DNA, 105 bp, Homo sapiens
tggtttctatttatctttttctttcttgtttccttttaatccttaccacccaatttcactatagtttcttttgtagttgggcaccctgttggagagttgacttat

SEQ ID NO: 207183 - DNA, 606 bp, Homo sapiens
ttagacaccttttcttgagttagcataagataattgccttatgccagttacttcatctatttgagcttcagattcctcatttgtaaactagcccaattgtttcctcactataaactctagcctacctccccctgcagtttcatattatgcaaatgctaggtcatttcagaattccgtctttttgcacatttgttctctttccctggaatgcatttcttcccctggtaaactcctgtcttcccctgacttggccccatgatacacacagcacttcatacagataaaaaatattttgtctagtgatagttgtacaactgtgaatatattaaaaaccattgaagtgtaaaaaaaaaaaaaaaaagaaaaaaaaacaaaaaaaaaagaagcggcagagccgcgaacagaagaaaaatatgaccacgccgagaggaacaccacacgatgaaacgcaccaacacaccagcgttttctgagtaaacaagggcgatcgcacgaaatagggacgccacatataatcactaagaccgagcactcgcagttcaccacgtgctgaacgggacaaaatcggcacctggaaccctggcgaggacccccacctggggggcc

SEQ ID NO: 207184 - DNA, 476 bp, Homo sapiens
aagaggccatataagtgattagagaaatgatcaaaacctctggagggattacaatcaggataaaccttccctgatccctgaagttcttgaagactgtgtctggttcatctttgtagctccttttagtacctaacacatactgggtactcaaggtatatgtagcagattgagttagaacaagtgtggagaataggcctaacttgtaatcttcatgagggcagggccatgtctttctagttcttcactgtctgctcaggacttagcatagtcgaagatgcttagtagtagtctgttgaatgaaaagcatcagtggatgaataaactggtcaatgaatgaatgggccacatgggccctataggacttaaatgcttgataactcttcataggtagaaatcctacttccatccctatgtttccttcttgatctctatagcttcttgcagaaagcaaagtatattggcctccttcttccacc

SEQ ID NO: 207185 - DNA, 368 bp, Homo sapiens
gtgggtgggttgggttcggacctgaccaggacaaggccatgcacttatatatttaatggccctgtcttaacaatctgccattacagcaagcatgaaaaaaacaaatggggacagaactcttttccgttgttgttgttgttcaaactcaacatcaaaagttattgagtgattttgctatgccatagccagaggtggtgctaatagagagaagctctaagctctgctctctgtgtggaaagtagttcatatgctttatcatctcttagaacctgtcaagctcggttagttgagtggacatggattgcctcaaacagcatttgctatgcatttgttttccaaacacactacaccttccttggaaggtttat

SEQ ID NO: 207186 - DNA, 597 bp, Homo sapiens
ggagaattgctgtgatcagaatggtatttaaggctggattatagaggtgaggatttaagtgtagtagattaactatcttacagtaccatctgtcctaaattctgggcttggggagtagtagtacaaataagtggggaggacagagaaagaaataatatgacagagtggaggatgagcagagaagtggagaatagttcccagatgttgaacctgagcagtggggaaggtgatggaccatcaatagaggcgagacaaagagcagttcaagaaagatagtatattgggttatgggcgcatgctaagtttgaagtgtatagttgggccttccatgtggaactgtttggtagagttgaaattttggagatgttgctttgaggatcgtggtagagaaattgttgatactactcaagtgcctgagacagccagagagaaaaatgtaattcccactcaactgccgctcttttcttctcccaccataggtacttctacatccctttcccagagcctgagatgaattttgtgggaccctaccatgtgcccacatcctctgcacaaggccactctatcttaatgataagaatataactagttctgaga

SEQ ID NO: 207187 - DNA, 353 bp, Homo sapiens
gcttctaaggtttcataaattccttgaaaatttatgggggattgtatgctaatataatttttttttttctgggaggaaggtccacagttttcataaggttcccctaaagaaccgtgaatccaaaatgttaggaatgattgtcctagaatctatgctgtgatgttcaacactgtagccactagtcactaaccacacatagctgctaggcacttcatacttgcctagttcaaatgagatgtgctataagtataagatacacactagattttgaagacaccatgaaaaatagaatgtagaatatctcattaatatttttctgctggttacttgttggaatactattttacatattg

SEQ ID NO: 207188 - DNA, 549 bp, Homo sapiens
gaatttatctcatgaacagcaattttgcctcgaaatcttaactcttgagaaattcacccatgagtacagagaatcagataaaagaatcctcactacggcactctgtgtgatttcaaaaaagttggaaactaaatacctattaacaaaaaaatatattttttaaacaactgtgtgttattcttactgtgaaatacagtcatcctttggtatctggggggattggttctggaatgtccctcagatgctcaagtacctgatacaaaatgacatagtgtttgtgtataacctacacacatgctctcccatgtgctttcagcatctctacatgacttctaataccttatagtatgtaagtgctatataaatagttgttatactgtagttttttaatatttatatttttgatccgtggttggttaaattgcatgtagttggtgcggaacctgtggatacagagggccgaatgtattatatagcaatcaaaatgctgtgtgtataaacccctaatacataaattatattgaaaaaatatgtactgatgataaaact

SEQ ID NO: 207189 - DNA, 887 bp, Homo sapiens
  misc_feature (38)..(38): n is a, c, g, or t
tgggggagagaatggcccagtcaaaacaggcacttcanctgagaaatcagccagcagtgttttccaggctgactgagcatttttatattcatatgaattacctgaaaattggcatttttaagtttatagtcagcggtagaggacatttcgggaatcaaagactaaggcctcctcaggtcctctgggctggcccatataggaatgctccctggagagtgtttgagcctcaggttccccccatgacccatggggatagatgagatctcttttttttttttttttttgagacggagtttcactcttgttgtccaggctggagtgcaatggtgcgatctcggctcaccgcaacctccgcctcctgggttcaagcgattctcctgcctcagcctcccaagtagctgggattacaggcatgcaccaccacgcccggctaattttgtattttttagtagagacagtttcgccacgttggtcaggctggtctcgaactcccgacctcaggtctgcccaccttggcctcccaaagtgctgggattacaggcgtgagccactgtgcccggccgagatttttttttttttaatctccagaacacagctctctcagtgtgaccctgaggattgggagtggggagggcgagacatgacttcccttgggactgacatccttcagagagagggcagccagctgaacctgctccctacgcacctctggtcaactttacaagtgaccccagcttcccccaacattgaccttcactctaagtcactgcagagagacaaagagaggcagaaacttctccaccccatcacacaatatgccctgatgggcttctgagggtggagggtggaataacaactcggagggccccaagggagggcttggagga

SEQ ID NO: 207190 - DNA, 377 bp, Homo sapiens
tgccttcagaatcatcagtggagcttttgaaagggcagatcttggggcctcaccccaggagatccgattcagcaggtctgcggggactgaggtatggcaggggaaaccgcccccatctcaagggtgaggttaggacttggctcctgtgtatgtattccacccagaaatactgagttaacattagctgaattaactaaacaaagtatcaagcataatacccacagggtaagccagtgaggatagaggataaatacattattagtctggctttgccgctgtggttatcctcaaacagtagggtttagtgtatgtatgtatatgtattatgtttttgttttggggttttgttgagacagggtctttctttctcacccagg

SEQ ID NO: 207191 - DNA, 464 bp, Homo sapiens
ctggctcagaaacttttaggcattgcttctttaaatctgaggactgtgtgaggcagctttctgcatcaagaaaagcatcaagtttctaactccgcgctggtgtagctgtcaggaggacttatggaggggtgagggaagccctttctaaatacgtgactttcaggagtggaggagaacttggttaacacatactgaggttttttgtttttgatgaggtttttttttttaaattttttatttttttgagacctagtttcgctcttgttgcccaggctggagtgcgatggtgcgatctcggctcaccgcaacctccgcttccctgattcaagtgattcttctgtcttggactctcaagtagctcggatcacaggcatacgcaacctcgcccggctaattttttttgtattcagtagagatggggttttaccatgttagtcaggctggttgcgaactcctgacttcag

SEQ ID NO: 207192 - DNA, 104 bp, Homo sapiens
ttttttggtcctaattatgctctcaggagttaagacagtataaaattatgttttttaaaggaaacttcatcaaatacttggaaattagcaaatattttttagag

SEQ ID NO: 207193 - DNA, 170 bp, Homo sapiens
gactctagagcatcccctccttctggccacgctccttctggcccgtctacccttttctctccaaagctatgatggcctatgccctttattcccacgttcaagcatttgggccatttttttatattaacaagctcagatgaatgttaagtcctggtggtcaaaagggcctg

SEQ ID NO: 207194 - DNA, 235 bp, Homo sapiens
ctaggaaaagtgtttggtgctctggggggccttctgggctgtgcctccaaagaagtgtgcaggggagagattgctggctggaaaatcagaacaacctgggctttagttctaactctgccactatccagctctgtgaccttgagcctgttcctttacctcaccaggcctcattttccacatctgttgaacaatctggctcttagggcccctttcaattctagtgttctggaggtcc

SEQ ID NO: 207195 - DNA, 437 bp, Homo sapiens
gaaaggttccagcctgccaggccagattcacgaaggctgaatcctcagaacacatagaagagggggttctctggcagcacccctctcaggagtttgaagcaaccaggggcagtaaggagcaagcagctgcgagatgtggattcctcaggccgtgccccatgtgctggaaaacaggtggcagaggttactctgcctggtgtgtacacatacatggtttgtttgatcatatccggtataaaccctactcgaaaatatttgtcatccggcacctacggagttcaaaatactaacacagtacagcctgcactgttgtccctggggactgaaaggggtcatttttgggtggcctgacagaaatgtgtcacagagcagtgtcgccaaatagtgccccactctagttttgctcagaaggggccacatcagctgggcagggtgtg

SEQ ID NO: 207196 - DNA, 406 bp, Homo sapiens
tcattctccttggagagtactgctgaagcagagtgcacccacaattccacttactccagcatccacagtcccagccagcccctgacctggaggaatccactcatggggggtgggggggagtcctccaaggatctgcaccaatgtgacctgcctgatagtgtctgtcacattgatagtgacctgcctgatagtgtccctccattgacagggtctctattgtgctaggcctatgagcctaggggcagccaactcacacacaactcgccctgccatgtcagctctcagcttggttgcagtccaggcaccaggaaggcttggtcccgtgcccagtcccaacactgataacattccctacagctgctgcccagaacggaaaaggtaaaagattcctccctcctgagtgtga

SEQ ID NO: 207197 - DNA, 362 bp, Homo sapiens
gcggtgggaagaccttggggggagtacctcaggcagagaggagaagccgagagggtgaggtctgctaagctaggtgtggtggccatgtccagttcccagctggccgtgtcaccttgaggggggactgaccaggttgcagttccttcttctgtaaaatgagggggtgactaaagcgtacacaagttctgattctgggaaaaccacagagaatcgagttttgtaaggtgctgccagcaggggaggaggtggagggtacgtggagagctctattattgcttacagaattgaacgtgaaacgacaatggttgctaaattaaaaagttggttattttaagcagtgaaaggtcgtagggccgttccct

SEQ ID NO: 207198 - DNA, 422 bp, Homo sapiens
ggctagtactgtgtacgaggtgagacttttttttctttttggccttcccctagtgttacaaatcctgtcgagtgtctgaaataccatccatgtgaaggtttcccatgataactgtaacagctgccattcatccattcaacacatatttattgaacacttctatgaggcagccactgttccaggcacttggcaagcagctatgtacaaaactgacaagtccttgccctcatggagcttttgtttaggggggaaagaagatagacaataaaaaagcaaatagtaagacagtcttggcattgctatggggaaaaagtaagtagaggggagggaggttgatgggaaacattgaggtagaacagggaagaggaatttttaattttttttttttttctttttttttgagacggagtctcgctctgtcg

SEQ ID NO: 207199 - DNA, 634 bp, Homo sapiens
tcttttttattgagtggtatggagagattaagcataagggaaatcataaaagatccagttgacattctttttgtctttatcaaatttagttctcaataacaatagcataattggcaaacatttaatgactataaccttcagttttgttttacttaacacagtactgatttgtcaggattttgattttatgatattccagctctgtgaagaaaaggtcatctggtgtgtgcctctcatttggtacacacagataatgtgtgttcactcaatggatatgataccttgacattttagaaaacaaaatgaatgtgcgctctggaggacaatgccttttaattgatacgttactgtcttggtgcgtttatactgctataaaggaatacctgaggctgggtaatttgtaaagaggtttatttggctcatagttctgcaggctatacaagaaagcacacatacacacacacacaaaaggcatggcaccagcatctgtttctgatggcctgcttccactcatgcatagtggaaggtgaaggggagcctgtgtgagaagagatcacatgatgaaagaggagaagagaggggccagactcttgaacaactagctcgtacaggaactaagagtgagaattcattc

SEQ ID NO: 207200 - DNA, 741 bp, Homo sapiens
ttaaaaactttcaaaactctttcttctcatggggtcatctgtcctcccccacacttttcgagtctcatttctttgcaagtacgtcttatccttgtttcacaatttaactgtgatgtacccctaataataactgaaagtaaagtaaaatctggtcagtagccacagacccttctacactgacgttttgtcttatagtataaagtcttgcaaaattccaagggaatgttgagagagaattcaggtcactgaagggtttcagtatttttttcattaacatagtaatcatacttagcatttatatactacttttcaatttagaagtgccttatgttacttttttaatcctcatactacattactacataaacatattgaatgactgaaaaattaatactaaatcaaatgtatgaggtataatgttcaaagtgtattccctaattaataccagggactacatgcatacatagttatatgtaaattagatactttggatttattttttcaccaaggaaccaaaacacaatacagaatagtattgtaaatagattaagatgattgggttgaaaatgtagatactgattttaggttgaccttaaaaaatatatatattcttattaaattatagcttttggagaatataaactttctgtgttcccaacaaaatggatagttttgctgccaggttaccctccctttgtttatcatgagtctttagaggtttaagtaaaacaaaagagagac

SEQ ID NO: 207201 - DNA, 529 bp, Homo sapiens
aggcttattaggaagagaaaattcccgcctaataaactttggtcagacgggttgatctcaaaaccctgtctcctcataagatgttatcaatgacaatggtgccaaaactttattagcaattttaatttcacttccatcctgtggtcctgtgatctcaccctgtctccacttgccttgtgatattctattaccctgttaagtacttgatgtctgtcacccactcctattcatatactctctccccttttgaaactccctaatgaaaacttgctggtttttgtggcttgtggggcatcacggatcctaccaatgtgtgttgtctcccccggatacccaactttaaaatttctctcttttgtactctgtccttttatttctcaagccagtcgacgcttaggaaaatagaaaagaacctacctgattatcagggcaggtcccccgatagtgttgggtggtggtaatgcaatgatgaagatggcaggcatgcctctgccctccaggagtttctaggatacagagggggacaaac

SEQ ID NO: 207202 - DNA, 570 bp, Homo sapiens
  misc_feature (31)..(32): n is a, c, g, or t
  misc_feature (34)..(34): n is a, c, g, or t
atggtaagttcgtcccgtatttctacagagnngncagattacagtattcctctgttcaaaattccagtgcgtccccatttcattcagataatcctataattttacagcagatatatgaagtccaggaaatggtgatatttttcagttgggtatattaaaactctaagttttatttcagaaaagtattcctattttaaggcagctaaattgttttgctttctgccaccaggggatgtacactatacaatatgactctaagcatacaatatatatttgtatgtgtgtatgtttgagtgtgtgtgtgtgtataacgtttactcaaatacagaaaaaaattaaattttaagcctgcatgatgactgactgtggtattgtgctgtgctggtaaaataggcttactaaattgtcatgctttgggaggccgaggtgggaggactgcttgaggccaggagtttcaggccagcctaagcaacataggaagacccccatctctacaataaaaaattttttcttctttttgagacggagtcttgctctgtcacccagtgcagtggcgcaatcttggctcac

SEQ ID NO: 207203 - DNA, 719 bp, Homo sapiens
ccgccaccagtgcaagtgcacatgcacagtccccactgccccatcagtatgggcatgaacctcactgctgccaccccgatgaaatgcttttgccagcaccccacatcagagtgatcttgccagcagactgggaacatctcaggccctcgagcacagcaggtgcttaaatttgaggtcccagataacaaagccgtgggtctggtaccaggccctgtgggttagagcatgcagcccacgagtgctgagagagccttggccccctgaaataatccaaaaacaaagccagtcatctgaacacaacttataccatagtcaaaccttcaatggcatcaaataatgtaaaagtaaaaaactgcatccaaaggacagcagcttcaaagattaaaggaacatcagcccacacagatgagaaaaagccagtgcaagaacaatggcaactcaaaaacccagtgtcttcttacctcaaaacaatcacactggctccccagcaatgatacttaaccaggccaaaatggctaaaatgacagacatagaattcagaatctggatagccatagagatcatcaagattcaggagaaagttgaaatgtaatccaaggaatccagtaaaatgagacaagagctgaaaaatgaaatagtcattttatgaaagaaccaaaattatctgatagagctgaaaaactcactagaaggatttcataatacaatgggaagtatta

SEQ ID NO: 207204 - DNA, 705 bp, Homo sapiens
ccttctccatacagtcctaaaggcattttgtcttgatagtactgccaactgcaagcttccagagaaacttgggctattttgaatgaaaaaaataatgataaagatgtcaagcataagtaatacattcctaaaaatatttagaagttttatgaaatacctaatctaggaaggaaactattcaatataatggatacatataagctacaaattaaatccaagagaactaaaatatgaatataaaatgaacctttgcctatgaatgtaaaacagttgaagccaatccctaagcctagaatgaacaaagctgatgatgaaagcaaataacagggagtcttactacaaccacagaaataaaacgtctctaagaaaataaaattactcaactgtctttgctgtgaaagcatgtcattcaaggacccttttagcagtcaccaaatgcaaatgcaaaagcagataatgcctgagtccagcaaaagcaagtacagtcttcccatcaaagaggaaaagaaacctaagcctttcacttgtccttgatacaaaaaggtaaatggattgtgaaagaactcaaattccagaaaaaaagattccagtccaacctgcataaagctaaaaaaacttcatgttactttgttctaaaattagcacacacaggtccctatactaaaaacatatatacgatcccaggtgaggtgtcaggagtaaagt

SEQ ID NO: 207205 - DNA, 584 bp, Homo sapiens
aacaagaattgtgtctggcctttgtgatagttactcaacaaatcatatctgtgattgttttgattttaacaataatggtttttaaaaaccgtaggtgatcacatactacgcagaaagggaagcagttacagcattcacagcatccgtgagtcatagactcactgcattgctccaaggtgcagattctagttggaaatgttaagttttttagagcaatgaaaaaattgatctctttctcttccataacatagatttcccatctagctcctgggctaacttttgtttagtagttgtattatgaaaacaccgaagaatccttctgccagtctccatagcagtgatataaatcagagcccgcagtttcatgaatgcctcgctgtgccaccaggattttcttggagggagccacggtcagatttcaagtggtcatttcactctttctccctctgggggactgagacatgattaacttgcaataattgtgactccctcattaaaggagagctgtagcaagggaagaaatcattgagactgatcaagacatcccgtgctattttttttttcttgcatatcagctgtgtggg

SEQ ID NO: 207206 - DNA, 393 bp, Homo sapiens
caaaatggttttagtatattgccttataaacaaatttaagatcatgagtttcttttattatcctctttgttttgctcatttccttgaactgtacatccctaacctaaatcagctggagacaggggaagaaagtgttagattcttactcagtttagatcctctgccaggaaaacccactctattcattgtcaactaaattaacgcttttttaaataaaaggagtcatttttaacaataacgtcagggcagcaggcatccatgaaatgtatggtcactgatcattagggttatcattctaatgtgtttactattttgaaactctagggagaagaaaacttatttttgcatatgttggaaaaatgtatcctcatgtaggatatcagggtaatatct

SEQ ID NO: 207207 - DNA, 173 bp, Homo sapiens
aaaagtattaaatcacatttatacttaatatcatctaataaagataacagcatttcttaattaggtgtattttcctctgattttttcccccactgaaaaatttgcatatctctaattataatcatttctggaaaaaatgctgctagggattgacatgatattaatttagattt

SEQ ID NO: 207208 - DNA, 220 bp, Homo sapiens
ttagcttcaaagcctagccatcatttatcccttccgtgaagtttcagtttccttctctgtacaacagtaaggaatgttatgaggactgaacaaattgctacatatcaagtccattagaggacttggtacaaaataagactcaataaaatggagctatggtaataatgataaaaccttccttaaaagggggcttaaatctcataggctagattttatgaat

SEQ ID NO: 207209 - DNA, 601 bp, Homo sapiens
atagcttggctatgacacctccagcctaactgcactgtacatatttctggggtggacacatgatgggtggatagacagatgaacttgattgagttccctccttggactagaacagagaagaatattcctgtccttgcctctagccagctgttctgggaagggtttggaagtacaagttgaaagctgtctcccaagatccatcagttacagcagttctggaatgggcttcgggtttatgtggacaggaatctgcccaggctgcaggtgtggcccagcctgccatgagggtgctctgggttttgtggcatcagttgatctctagaggtcagaattatgttatgcccctggaattcacaattgtctgtgaatccccagtctatctggggctaaggctagactacttacatgaccctatgtttcttcccctctcttctgcacacccactccatcgctgtttgctctggttgctacatctggctgggatgtcacctcctgcctgcagccacagctctttgctctccagcactgactttctcaccattgctggcacgtgcacacattcaccaaagtgctggggtgcctccgagggcattactgactt

SEQ ID NO: 207210 - DNA, 804 bp, Homo sapiens
catcaaatgattctaaaatttatgatgtcattgtttattatctggctttactctcagcctctagaaagtaagttccacaagggcagggatgattgtcatttttgttccctgatatccctgcctatgtatttgataaatatttgctgaataaataaaccaccacctccaacaagagcaggttgttttctctgtgcccttcaaactggctatctaagatgcacattcctccaaagtgaagtctgtttctatgcagtctaccggcagctgaaacctagtgaccctggctttgaactcccagttattggagataatccagaacacagtcagaggtatggctggcactggggaaattcgtaatcccacgctgctttggtacatagatctgaaagtcagtaggcgggtcattcagcccttccatccctcaaccagctcctcctatttccaggggatgggtacacatcaagaggatgagtcaagacctttggagccatgacaaaatgagtctttggagtattttcacatttttgtgagcacttaagattctttcctccaaacaaattttggaggagagtgctatttgtgtcataagaatgagtttatttaactactatttattatctactgtggttcaggaacatataatggagatacagtggtagaagataaaatccctaacccatggaatatggtctagtgtgttattcagagtgaagcaaataaatgaacaaacaaataatagcatttcagaaaaaaaatagaaagattgaagtagaaagataccagggaggtgtgggcacagaaaga

SEQ ID NO: 207211 - DNA, 327 bp, Homo sapiens
aaggctgattcagctgacctaatctatgtacctgaaaacctgaagatgttccacagtttgctttccctaaaggctcacatttatttctgtgggtatgggaatgaaagagaccataaatagaaacccagaaacaccactgcttctttgatctatagaaataagggaggtagctttggtaaacaaaggtcatgggctgtctatggccaacactctccccaaatgtgaaacctccagttccaatcaaatcctttaacaggatggttgagaaatggaagctgtagaatgaacaagttaaaatccggtaactaaagccctggagctctgcct

SEQ ID NO: 207212 - DNA, 624 bp, Homo sapiens
taagtgagacaaattttgcagtccccagagacagagtgggagcacaaaggtggccagcgggaagtattccccacccctctccttgctcgaaggactggggtggccatccttaagaggtcattgtgtgggaattcgcagtgtttaaaaaataataccactgggcctggcgcagtgactcaggcctgtaatcccagcactttgggaggctgaggcgggtggatcacctgaagtcaggagttcgagaccagccaggccaacatggtgaaaccccgtctctactaaaaatacaaaaattagccgggcttggtggtgtgtgcctgtaatcccagcttcttgggaggctgaggcaggagaatcacttgaaactggaaggcagaggttgcagtgagctgagatcgcgccactgctctccagcctgggtgacatgacgaaaactccatctcaaaaaaaaaaaagaacctgggccctaggaattagacctgttagctacttggaccccagggaagtcacttctctgaaccttgaatttcttgtctctaaaatggggtcgttggtggtataatgaagcaccattcttgatccagaaaagtattcagttaatactaactgtagataatactcttg

SEQ ID NO: 207213 - DNA, 368 bp, Homo sapiens
tagggacatatcatcaaacactctaaaatagaatcctggccgggcacggtaggctcatgcgctgtaatcccagcttcttgggaggctgaggcaggagaatcacttgaaactggaaggcagaggttgcagtgagctgagatcgcgccactgctctccagcctgggtgacatgacgaaaactccatctcaaaaaaaaaaaagaacctgggccctaggaattagacctgttagctacttggaccccagggaagtcacttctctgaaccttgaatttcttgtctctaaaatggggtcgttggtggtataatgaagcaccattcttgatccagaaaagtattcagttaatactaactgtagataatactcttg

SEQ ID NO: 207214 - DNA, 650 bp, Homo sapiens
agtgaacaggcaccactaatgagtgaagatgagctgattaacataagagatggtgttttgagagatgatgacaagaacaatgatggatacattgactatgctgaatttgcaaaatcactgcagtagatgttatttgttcatctcttggttatatgcaaatgtgacctgggataatgtgattgaatactttgataatgcaaattaactcatttctaactactgctgcagcattttggtaaaaacctgtagcagtttgttacactggggtgagaagggatcaagagaaatgaaagagaggagaaatgggacatctaatagtccctaagcactattaaataccttattggacaagggcttgctttttaaagcatcctttcaagaatattgaataattggagctgagaactcaggagcttcactgtagtagaatactgctagtttcttaattttaattcatgttaccttaaaagtaaaacaacaggctttgccaattggacgtttttcagtaacagtgaaggagtggagtgaatgccaaatatttgccctggtggttcctatctcttcagttaaacatggtcagtattctctaaagttcccctgtcctaaaagactacttgctctgggcaaatggatatttattagactatttc

SEQ ID NO: 207215 - DNA, 408 bp, Homo sapiens
aactaaattaaaatacagtaatgtaatgggacagtgggataagaaagaaaaccagatgactctgacatgtgaccccaacctgaacttactgcttttctagttttcggtatactcaaataaaaatagagtccagtgtaatgcttgcaggggctggggggactggacagaggaataatatatttagttaatagtggggtatgtcccacattcaatactgttacattattaatatatgtgaaatcagtgtttctcaacaggactcccaacacatcagtgagcgtgccagtagttcatggactatttgcagtccattattatttatcataggacagcatagatgctttgtgttctgatatgaagtaatcattgaatttaataaagctttattttattggtgttgcatgaaag

SEQ ID NO: 207216 - DNA, 482 bp, Homo sapiens
cagcacatcttgttatttctgcttataaaaatacatcgaatctgacagctttgccccactctatagctgccctcctaattcagcgagctggagaggcaattctcggtcaggatgatttaggatattcctaactggtctctctgccatcccactataccctcctgcactgtccacttaacagtgatgtttaaaaagtaaataaatggctgggcgtgctggctcatacctgcaatcccaatacttttggaggcagaggaaggagaattgcttaaggccaggagtttgagacaagcctgggaaacatagggagaccccatgtctataaataataataataataaaaatagccagatgtggtgatgcacacttgtggtcccagctactcaggaggctgaagtgagaggattgcttgagcctgggaggtcgaggctggcactgcactccagcctgggtgatagagtgagaccccatctctgaaataa

SEQ ID NO: 207217 - DNA, 286 bp, Homo sapiens
cattgcctggctaaacatctgagaataagacagacatcgtctctgcccttggagcccatggtccacttgggaagccagatgccaaacagtaaccttggccaggcatgatggctcgtgcctgtcatcccagcatgttgggaggctgaggccagaagatcacgtgagctcctgagactggtctgggaaacatagtgagaccttgtctgtactaaaaacaaaaataaattagccaggcgtggtggtgcacctatagtaggtgcacctatttgggaagctgaggcaggag

SEQ ID NO: 207218 - DNA, 165 bp, Homo sapiens
tccagagaacaaaaggaatttcaaccaaaatatattctacccaattcctgtttgtacaacatcactgccagtacaatccataaccctctcccctccagctcaagttttagaccacaaacaagattgctaccctcaagaataattttaggtagtaagaccctgtcc

SEQ ID NO: 207219 - DNA, 571 bp, Homo sapiens
tttgagttctcccgtttacatctgggatcttgctaggtattatgcgaataagattctaacactctggaacatttacgcttgtgggtttagttgcaggtgcctgctgatagtttccaaacttggaagtatgtatggtgaacagatcctgtcagttgtagctatgtctcagcttggactcatgaagaattaaaaatctcccaacttccactatttttaatatactctgagaaataagtctataaattcacatagtctgatattttacttaaaaaaaaaatggaactgaacttggcaggaaaaaactcagtcattgtcattacaatcttacagaggtggcaagtatacaccacaagagattactattgttcagtttttgcatgttgatattatctcccctttttctttttgagacaaggtctcactctattgcccaggctggggtgcagtgatgcctgcagcctcgacctcctgggctcaagcaatacttctgcctcagtctcctgagtaactaggactacaggtgcctgctaccatgcccagttttttactgttgttgttgttcgtttcttta

SEQ ID NO: 207220 - DNA, 281 bp, Homo sapiens
agccaaaggagtagccaaataggatgaggactgagaaatgattacctgacttgccaatttcaaggtaatagatgactgttgaaagaatatttcagatgagtgccgtgcagcaggagccaatgtacagtgggtccagaaagcaatggagattaacaaagtggtgacaggtggggactacaggtgagcaccactatgcccaggttttttatttttagcagctaggaggtctcactgtgttacccaggctggtcataaactactgtgttcaaacaatcctctca

SEQ ID NO: 207221 - DNA, 366 bp, Homo sapiens
acccgccttggcctcaaagtgctgggattacaggcatgaccaccccacctggccagcttgggcaatttactttatgtctttaagcctggtgtgtaatgttgatggtagagtggggaacaattatacctatccaatgagttgtgagtactatatgagttaaatacatgaagcatttagaatagtgccttgcgcataaatatagtaaatacattaagtactatttaagtgctaactgttgttattgttattaatattagatcactatgagtttgcacttgtagcctgtaattcaaagcaatttgaacggcggaagcataaatagataaatgatcatctaaatatggcatctcttcaacccttgttgtt

SEQ ID NO: 207222 - DNA, 494 bp, Homo sapiens
agatgccccctgcaaccttcccataaatgaaccaactgattctcacaaccgaagggagaatggacacctcccattgagggagaaaaaaaaaatcacactctggcctgctggcaagtcacctgtcatttccagctcatcttcatagttccatagttagtcctattctttagtaaatataaagactattaaaagcttctacgaggtgcaactatgtgtgtctctggggtcagtcttgtgcttgacacagtgaaagttcattttagttcggtgtgaaaaaccagacctcaccaactcatcacaactaactccatcggaagcagaggattgctcctcatctgactcctcctgtgtgagacctgattctcagtcagaggctgatgccggaggatgaggagtttagacaggccaaggtgggagtgtggggtaaaggggtggcttggcctgtggtgggaacagaggcagtcagcgtggttggattattaggagcaagaagg

SEQ ID NO: 207223 - DNA, 554 bp, Homo sapiens
agatgccccctgcaaccttcccataaatgaaccaactgattctcacaaccgaagggagaatggacacctcccattgagggagaaaaaaaaaatcacactctggcctgctggcaagtcacctgtcatttccagctcatcttcatagttccatagttagtcctattctttagtaaatataaagactattaaaagcttctacgaggtgcaactatgtgtgtctctggggtcagtcttgtgcttgacacagtgaaagttcattttagttcggtgtgaaaaaccagacctcaccaactcatcacaactaactccatcggaagcagaggattgctcctcatctgactcctcctgtgtgagacctgattctcagtcagaggctgatgccggaactgagaccatcagccatagagagatccttccagaatatggtgtcattaaccccgcagttcactactgcactttgccgtgattcaggactggaactcttgtcatcgacttgaaagatcctggttgagaggaaaggcaatctgaatgccgggcacatctattgaattaga

SEQ ID NO: 207224 - DNA, 353 bp, Homo sapiens
caaccacttgccatgttaactctgtaaccttggacaaattgaacatcctcaaaatttatgaaaagaggataatatgcgactaccttataggacagttttggaggttaaatgagataatctaaaacattcataatagtccttggagagtggtatttaagaaaaatatattctgttccactttgttcctctggtcataacttctagtgtcaaataactttttctaatatatagttgttattttattaataaagtagatcagagctcagtatggtgagtttcagacagaagtacatgatatcacaagtttattatatttttttcttagctctttattctgaagtaattataaataa

SEQ ID NO: 207225 - DNA, 159 bp, Homo sapiens
aggtcctgcccctgtggtccaggaaccatactttgagaaccatttcctctcttttttcacaaatgggtcttattgtaagtcaaatcgtgtattttctacaccggaactgatttggaaagtccttcagtaacttgacttacgtgggatcctcttatgtgt

SEQ ID NO: 207226 - DNA, 554 bp, Homo sapiens
cttacacccggggtttgcgcagggaattttgcccattttcggacacttagaaaacgcgtacgcagcgggtctgttgcctcgtgccgctctggatgtgaggcttccggaaccccgattttccaacataggttctcacgcgtgtctagcaggggtttactgcccgctgccccggccgggttgtgagcacaggactccgtcacctcagcccatggggtcgatgtgtcccgtccttcgtgcctaccaatgcaggacgtcgcgtcatgctgtcagctgtcagctccggacttggggtggggggcggcccgggatttggcgaagcctgagcttccagagctcttaaggccggttccgtgtcgttcgattcgcgagtgctctactcgtggcgatacacttaggaaacaagcaattttgttccttcagaataagaaccaagactcagagcttctgccgaaatgaatatagcctgactggactgtgtaatcggtcatcctgtcccctggcaaatagtcagtatgccactattaccgaagagacaggacagtgctacttgtcag

SEQ ID NO: 207227 - DNA, 387 bp, Homo sapiens
aattttatatgacactcatattgtttctattgaacagctcagcctcaggctgtctaatttttactggacagccctagaatgattgaatgactaaagactagaagttggaaggggcctttgcctgagtcctctggaaaatagagactcaaacaaagcttaattgttaatattttggggggcgaggttccatctcagaatagtaagagtgtaagaaaagggaagtgaggctgagaaagaggggaagaacatttgggcagttactggaaaagcccgatcccatttgctgtggcatggaacttcatctgagtctgtaatttcccgacgacaattaacactgggcatggaaatggtaagagatgctccactgactcccttcggttccagaca

SEQ ID NO: 207228 - DNA, 368 bp, Homo sapiens
acaggagatgggttatatatagggagattggccaaatacaggcatacctcagagatatttcagaattggttgtagaacaatgcagttccaaaagtattctttggttctagaccaccaaaacgagttacacaaattttttggcttcctagtgcatataaaagttatgtttacactgtgctgtggtataagtgtgtaatagcagtgtaaaagaacgatgtatatgctttaatttaaaaatactttattgctgggccatgtgtggtggctcccacctgtagccctagcactttgagaggccaaggtaggaagattgcttgaggccagaagttcgaccggcttgggcaacatagtgagactccatgtttcca

SEQ ID NO: 207229 - DNA, 477 bp, Homo sapiens
tctttattgttgagtttttggaaaagaagagagacatgaatgatacaaaagggacataatagaaaaggaaaatgatcaataattagagaaaactcttatcctttctttggctggttttcaaacccttcattggagccctgcaagttctaaggaatctaggcaccggggtggcatggaggagatgaggactgagccttgacaaactccagcctctgttcccagctactcaggaagcagaggtgggaggatggcttaagcctgggaggcagaggttgcagtgagctgagatcatgccactgcactccagcctgggtggcagagccagaccatgtctcaaaaaaaaaaaaaaaagccatttccagaaaacaaagataaagagaatttatcactagcagttttacactacacaaaatattaaagaatgcacttcaggctgaggaagatggtcagaggtggatgagaaaacatgaatctgca

SEQ ID NO: 207230 - DNA, 315 bp, Homo sapiens
aggttcctgacatggagcttctaaaactgttggaattttctgagtaatataagtgtctttgttatgttaatgagctaactcatggcagggcctgtagatagcttcaggatggggtctagtccctgaaaagaccaaaaaggtaattagagttggggctttgagccacatgatattagccaacccttcagacctctagggagaagagggacactggagattgagttcaagtacatggccaatgatttaatcaatgatacctatgtaatgaatcctccctaaaatctctggacattggagctcagaggaacttcctgg

SEQ ID NO: 207231 - DNA, 374 bp, Homo sapiens
aaaatttaaaagctggataagccaaatgttggcatagatgggttctgtatcttgatggctgatggggtgtggatgctatagcctttctggaaggatctagggctactaatgctatgacccagcagttatgctgcttagtatatagtccagagacattctcataggatccacaagagcccacaggtttgaggttgtttggtgtggtgtatgtacgtgggagagcactggagccaactgagtgcccaccatcaatgagagaatgcacaggtgaaatgtggcagatgacaccagggtgatgttcggcaatgggaacccagattagataatgcctgtgccacatgtatgagatttcagaacctagcagttttttagag

SEQ ID NO: 207232 - DNA, 853 bp, Homo sapiens
accccagacagtcacatacatgtctgactgtgttatcattcttatttcagctcaaatgtcacctcctccaagaagacttctcagactaccaccaaagaggccaccatattattctgtctcctgatcctgtgtagttccttcaaccctcttgtcccagttgatctgtttcattggggtgtcttcttcaccccaaggcataagtttcatgaaagaaaagaatgttgtttgagtcactgctgtatcctcagagcctcagacagggctggacacattagatgccacataaatgtttgctacatggatgaatgagtagaatagacagatggacaggtgggagggtgcaaggatgttagctcaggtggtcaaactctctagaaaaataacccacccttaacaggcatggttggcttgatctccataaacattcccataaaggaaacgtgggaactgggaagcccaaggctcaaagcaagaaatgactagagacagatcacaggtcactcagtcagcaagggggacagtcaaggatagaagcttccttgggtgaggagggggctgctctgctcccacagtgggctcagggttcatacggtcctgcggaggcctccccaggcctacctctgctgattaaagtttccccaaaaagcaagctcctccttctacttgccctctaagctttcggggtactagaagctaatcatgcaatttttcttttttctttttcttttttttttttgagacggagttttgctcttgttgcccaggctggagtacagtgcgagactccatctcaaaaaaaaataaatagggccgggcgcggtggcttacgcctgtaatcccagcactttgggag

SEQ ID NO: 207233 - DNA, 398 bp, Homo sapiens
gcagaacgtgcaggtttgttacataggtatacatgtgccatggtggtttgctgcacctgtcaacccttcatctaggttttaagccccacaggcattaggtatttgtcctaatgctctccctccttttgccccccactcccctcgacaggccctggtgtgtgttggtcctctccctgtgtccatgtattctcattgttcagctcccacttacgagtgagaacatgtggtgtttggttttctgttcctgttttaatttgctgaggatgatcaatcagctttttaagcctcttactcttaaacataagtagcaagcaaggattaccaaattcctgaggaaagccctaactaacacaaaggacaggaccaaagcaaacagaataggaatggagtgagagaga

SEQ ID NO: 207234 - DNA, 752 bp, Homo sapiens
ctagtggacccactgcatagtgtaactttgggatgaatttaaaagaatatttaagtcacagtcaattttctgttggtctaattttaccaaataaccccctaaataagaagtctgatttatctaaaatagaagttaacatagcatcccagtattgccattctaaaactctggcatgtaaatgggagaaatggaaataagctcaaaatgggtagagtaacccatttctgcatgaaccatagaatttaactagaatttggctggctcatgcctgtaatgccagcactttgggaggccaaggcaggcagatcacttgagcccaggagttcgagaccagcccgggcaacatggtgaaactccatctcttcaaaaatatatatttgtgtgtgtgtgtgtgtgtgtgcgtgcacaaaaattagctgagtgtggtggttcacacttgtaatcacagctacctgggaggctgaggcaggaggattgcttgagcctgggaggcagaggttgcagtgagctgagattgcaccattgcactgcagcctgggtaatagagcgagacaactctatctcaaaaaaaagaatttcactagaatttatatcttcagtgtttgcattagattgtcaccagcactatctgccttgtgactgtcaggactaatccttatatcatttatcttatgtcctttacctcagtttatgtctgtcaccacaagaaacccagacctccctaatcataccatatgccctggtcttaccca

SEQ ID NO: 207235 - DNA, 339 bp, Homo sapiens
tgtaattatactttctaaacgggaaaccatttcccagttaagtaataagaactgcagcgttttcctaaccgcagacctcccagtgaccacagaaccaagaaagtggactgtgttattgcgagcgtcaatttttgggttttgttttgagtcctttctgaaactgtcacttatcaaagagggaggggagaatccactgggaagaggacaggagtagaaatcaagagaattctgtcctagggtaagctcctgatttatggtgggttcttgtgaatgtgtctaatgacctggccgggcacggtggctcatgcactttaaaggaccgaggtgggtggatcactt

SEQ ID NO: 207236 - DNA, 483 bp, Homo sapiens
catcttggccaggctggtcttgaactcctgaccttgtgatccacccgtctcggcctctcaaagtgctgggattacaggtgtgaatcaccatgcccggctagaagagctttatgttcatgatgctgagatgaagttggggccagaagaagagtcagttgataaaagctaaagtatttttagatcctgattaaagaagaaggtaatgggttgacttgagagagaatgagcgttctgttatgggaatgctcatatgggaaatgttctgtctctttgtcaaaaactgcaggaccacctgttggtgacattggaggaattcctgctttgtgtgggagggtgaactagatgcggtcatgttcacaccattctccccttttgtaatttttcacacctccctggctccccttttataatttagaaagaggtttagaagtctgtaactttttgtattagatttactttgagaaatcttgtacttaatttagt

SEQ ID NO: 207237 - DNA, 580 bp, Homo sapiens
gcacgagctgacaattcccttttgaatgtcaactccctgataacagctatcttgtttgtcttgttctgattgtatccgtcataccttagcatctggcatattgtaagctctcatatattcagtgaataattaaaccatgccctgatatgatcaggctctggccttgctatcctctcaacttcccctctaaatcctataaactagtgttactcaaagtgtggcccatgggcctgtagcatcagcagcacctagaagcttgttagaagtaggttcttgggccccatactagacttcctgaatcagagtttctggatgtatggcctaggaacatggatttaagcaacctgtattggccattcttatgtatgctgaggtccgaggaccactgccatgatcatggaaatctcatccacatcaatttttgccttctaaaaaagcctgatctttgttgcagtgtggagtttgctacacatgcttggctgcatggggccctggattatccacaggaacttgattctagaaataccaaagcactgttgtttcacagcagcccgacgagtaggccctgcatggaatgagg

SEQ ID NO: 207238 - DNA, 529 bp, Homo sapiens
gcacgagctgacaattcccttttgaatgtcaactccctgataacagctatcttgtttgtcttgttctgattgtatccgtcataccatgccctgatatgatcaggctctggccttgctatcctctcaacttcccctctaaatcctataaactagtgttactcaaagtgtggcccatgggcctgtagcatcagcagcacctagaagcttgttagaagtaggttcttgggccccatactagacttcctgaatcagagtttctggatgtatggcctaggaacatggatttaagcaacctgtattggccattcttatgtatgctgaggtccgaggaccactgccatgatcatggaaatctcatccacatcaatttttgccttctaaaaaagcctgatctttgttgcagtgtggagtttgctacacatgcttggctgcatggggccctggattatccacaggaacttgattctagaaataccaaagcactgttgtttcacagcagcccgacgagtaggccctgcatggaatgagg

SEQ ID NO: 207239 - DNA, 435 bp, Homo sapiens
tgaatcacctgagatcaggagtttgagaccagcctggccaacatggcgaaaccccgtctctattaaaaatacaaaaattagtcgggcatggtgacgcgccactgtagtcctatctacttggaggctgaggcacgagcaggaggcggaggctgcagtgaaccaagattgcaccactgcactccagcctgggtgacagagtgaaaccccgtctcaaaaaaacaaaccaaaaccaaaccaaaacaaagcatcaaagtctacactgtggcctgtagggcccggcctggtctggcctggtctgtgactttgggcctcgtctttctcttctcccctcctgggtctctagactccagcaacgttggcctccttgctgcctcttggcatgccaagctctctcctccctgcagacttcattcctgctgttccttctgttctaga

SEQ ID NO: 207240 - DNA, 575 bp, Homo sapiens
ccctcacagtctaacagggagacagacagttacacatttgggtgcaggagttgacactttacaattgctcaggcaagaaagtattttatcatttgtggccagatggagtcctttgaacagtgaggcataatatttgtcacccaattcctgttggaaaaaaaccctttgagcctctgacctagatattttaaccattgtttgctttaatttgtgttgatggtaatgtggctgtgaacgacacggaaactggtggacagtcatgtcaaggtctaaaaccgtgggttccctataccccaagacagacagaaatagctttttgtcctgtctagtctaatagactcactttttagaagacgggtctcctggaaaccttggatgttgctaattgacagccactaagtggtccttccttgacagaatatgtgagtgatctcagcctcctcccaggagcagcacaacccactgctggagggtgtgagagagaatatgaagactgctggacctcttttttaagggccgatttcttttagcagaggggaatatacttgtaatctattccctttgtaatcatgaaa

SEQ ID NO: 207241 - DNA, 177 bp, Homo sapiens
tctctcaaaaggatttccaaaactcagattctgaataaaagccaatggcagatatgggtcatcaggaagactagacatgaggccttagcagagcctgtcttagtggattagacgggcgggctcttggagtcagcacagccagagcttagccgtgacgtcggcaccggaggagaggag

SEQ ID NO: 207242 - DNA, 147 bp, Homo sapiens
ccactgaatgcagttcctcaaataaacgtggccttactgattagtataatcacagacagtatactcagagaaatttcccacttaatgtgagaataattaatcagtgtctacattatccttaccacatcttgctcatgcataagtgcg

SEQ ID NO: 207243 - DNA, 210 bp, Homo sapiens
aacatcttggtgagtatgaaaagaataccaggtgtttctgttggtctactttttctgtaaatggataatgcttgttgtcttataggacagtgcacttacaagaatgacaccacaaagtggtgtattatagaaacagaaatcccagtggtcactgtctacattggtgaggagggaatgctattacatgagggaaaatggaagcccagaatc

SEQ ID NO: 207244 - DNA, 600 bp, Homo sapiens
tgagccaccatgcccagccaaacaacttaatcttatgtgaagcagatctctttaagtaaacggaagtgtatgaatttgacaaattctgtgtttattaggagagatttaggcactggtggtgttggggcccacgttcacagctctgcgtgtatatacatgtgtgtattcaagagcatatatattgtggtctggatgaagccgcggctcataaataaggggtggccttgaatgaatgagtcagtctgctactcacaactcttttatggggaataataatggattcgctcaaataagatcttgtgacttctgtcactgattctgtcgtagacctttataatttatcattattatgatgattactactaataattacagtgaacacttcttgagtgcttacattgtgccaggcacttatatttatttagtgtttatgaaatatcatgaggtagatactattattaccttcattttatggacgaggaaactgaaactcaagttaggaaacatgtatagccagtgagccatgattgcaccactgcactccagcctgggcagcagagattctgtctcataacaagaacgtgaggaaaggcaaggcga

SEQ ID NO: 207245 - DNA, 427 bp, Homo sapiens
aaaccccatctctactaaaaatacaaaaattagctgggcgtggtggcacatgcctgtaatcccagctacttgggaggctgagacaagagaatctcttagacccgggaggcagaggttgcagtgagccgagacgatgccactgcactccagcctgggcaacagagcaagactccatctcaaaaaaaaagaagaaaagacagtagggagaaatggatgtgagtaatagtaaatgagagaagctgcatgaaggaggtaagacttgtgctaatttttttaaggatagagaacattttatttgaaaagactcaccagtagaaacatgtatggggaaccagtgcgaattttgacttttttttttacctaaccataaaaatatatctcctaggaagttggagtcctttttggaaaagattaatacactgatgct

SEQ ID NO: 207246 - DNA, 662 bp, Homo sapiens
ggtgcgcacttaggatgtttctgagaggtccatccctgcagcaagatgctaccaccaggccaggaatgagacctaggctggaagcgaactcagaggagacaggccagggcagctgccaccttcagcaaagcttgccctactcctgacccaaaccagagcagctgtggccagagcattctccgaatgtgcaccataggcagaagattcctatcagagtagcatcgtgaggcagctaaaatgccaaatgtcacttcaaaaagaagccaggatggaagtgaagggcctgcacttgccccacatttgcacgcttccagacgaatcattaacattcctcaacacatcattccaaccataccttccgctgcatagtcttcttccttgctcacttgtatttttgcaataggagaaatcaactatgcctacttagcgctttcttttcttaagccttaagatgcttacatacacattttgaaaagtatactataaacagattcataataaacttcacaaaagattttcccacactgaggttattttcaaaacatatgccaaatagacgaccattcgtttttctccaataatgagcttggatttccaagttacccttgtcataagttacactttccaggaaaaagaagtgaacatgtggaaatgatatgaac

SEQ ID NO: 207247 - DNA, 904 bp, Homo sapiens
tggacattccagcgtatcgcagaaccggaattcagctcccattgcccacaacagtgcttccctgcctcagtttcatagaaatgatcccttcgtaactcagcagctcatatacagtgataaagtatcaagtccatcgttttcccaaatcaagagcaatgcatcccacacaaatgggcaagaattgcagctgacagaggaatctccctatctttgaaccttcaggattttgcagtgatgtcaaggtttacacccatgtcttcactcccaaaatttggatttgagcctcagatctactatttactaactctatgatctttgacaaatcactcgaattcctgatgccttaagaatccttttgttcctgagcagagtgacacagtctcctgcagttgaggatcattgatctagagcattgattacaacggaaggcgtctaaaggatgaggcaaaagtgaaagccagattatggttgtatgtttttcctgtaagccaccacaaaccttttgtgcaatgagataggtgatgaataaagcatggatgaatccacgcattagatgagtatgtgaagtggatatggagagcacataagaaccaagagcagacagagccctaaggaaagacctggctgacctgccggaaggaaaataggtattaggaatcctgaaaaccatacttcagaggattatgtttccacgcacagtggggtctaagtgagagtctgtggattcgggttgacttaaaattttatggcggacttccacgccctggcggtcattccggggagtgtcccaactttcttacccgggggcagccggttgggaacaccacgaaactccccgacagggtcttgttttctacactgaacggggctctggttgtcttctccgatgaccactgttttggga

SEQ ID NO: 207248 - DNA, 603 bp, Homo sapiens
aaaaaaaaaaaaagacaaacaacagaccttctcaaatcaaatatcactgtgtctgtggtttggctaaaggataccaaaagttgttccccagtgagacatgcaaggagggtagcaaggcctacccttttacccagaaagatcagcgttaacgagaatcagttgtaaatgtgaataaattaggaaaacagccaggatattgtggtagatagttgccaagatggccttccagaagacgctgtttctaatattgagtagttgactgtaattcctctccccttcaacctgggctgtcctgagtgcttccttgaccaataaaatgatagagaagtctgaacttccaagactaggtcgtatgaaatcttgcagcttcctttagtatcttgcaatggtccctatgggctgtttcttgtcaaaagctagtctcaatgctctgagaagcccaagccacctggagaggttacgtgtaggttctccatttaacagacttaatgggctttcaggcaacagcagcatcaactgccagtcctacaagtaagccatcttagatgtgtccatccagcccagttgaacctttagatgaccaaagatgaaatcaagatactg

SEQ ID NO: 207249 - DNA, 251 bp, Homo sapiens
tggaccagtatttttgaaggaagacggagacaccaggtttcatatatcatggggaattaaaggttgaactagactgaagcaaatggatgaaaaaagtagaatatggtaaatccagaagaagagcaatcttgtcagattacttaaaagaaaagttcgagcttgcagtgagctatgatctcaccattgaacttcagcctggaaaacagagcaagaccctgtctctaaataaataaataaataattaataaagc

SEQ ID NO: 207250 - DNA, 233 bp, Homo sapiens
ggaaggtcacaggcttttggctcagacgtagctggaattaaaggccagctttattacttctttagctctgtgtgtacagggacaactcgtgcaccctccctgagcagctctctgctcttctgtaactgggtcacttatctgtgtatggctgctgagggaattggattgttaaagtaggtaaagggcctggacagagcctggtcctctgttaacatggtaacatctggagccca

SEQ ID NO: 207251 - DNA, 191 bp, Homo sapiens
caacagacagaagaaactgaaatgatcatcaatagctcccatttgtatagtacctaaggccaaagtgcattttatggataaaacattgaatctgacccacataaagagtaattccgccttattaaagaaaagttttttcttcccttattccacaatctaggcttggctatatgagctctgcacggtgggga

SEQ ID NO: 207252 - DNA, 625 bp, Homo sapiens
tcccaggaaagcagcaggagccagcagtgtgaggagcatagaagtgtttctgtcctggtggcacattggaaccacctggcatgctttaaaaaacccaacactgacaccagagagtctgacatgatgggtgtggcgccacctggcatccggctttcgaaagcgccaccattggtctaatgtgcagccaaggctgagaatcaccactagggcaggtggactcaaattccacacccttgacattttgggccagataattttttgttgtgagagccatcctgtgcactgtaggatgtttagcagaatccccgacctatacgcactagatgcctgtagcatgacccctcattatgaaaccagaaatgtctccagacgttgccagatggcttctaagagacaaaaatctcccctcctggagcatggctttggaggatagcaaccccgaacttgcaatcctgactgctatgtgaccttgggggggcgctccttacccacctgggcctcggtgccctcctgggcgaaaggggaataatcctaccttcctggattgttgggagaatatggagggcaataggaactcacatgtattaggtgctcaataaatagtactccacttttctctggaatc

SEQ ID NO: 207253 - DNA, 610 bp, Homo sapiens
cagggagaccattatagtggtagagggaggcaggaagcatgagaattgcatcaacaagagcacaaagggaatgagcaagaagttttcaaggtacacgcattttgtagccaacatgtattgcatgcttgcacatgctgggaattaggccacatagattaactcaatccttacctcacctctgtgaagtaggtattatcactacctgcttttttcatataacgttgttgaagcttagagaaatgaggaacattgctgaaactaggaagtggtggaaccaggattccaacacaagctatctcttccagagttagggaatatacggcctcccatggagaccgagagagcttccctgtcccacacaggtatggaagcccagagctccaagatcaccacagctgcccaatcatccagaaagaggtgtggagagggaaacaatcatgacgcggaccgccacgaggtttctccctgatggacggggaagtcttctttgtggaagacactgagccacgctaagaagccgccaggcttctcagagacggggcagacccagcaaaagggaggtcagagcagaggccagagcacaggcaggatacggggggaccatgccacc

SEQ ID NO: 207254 - DNA, 421 bp, Homo sapiens
ggttttctttatagaacgctcctcaaccgggattggtccggtgttttgctcatggttaaaccagtgaggtgggtttttaggagggagaccacaaagatcaagtgccataactcatcatatcatattaaggttacctacgacaccatgatttaaccttgatcacctggctgaggtagagtctgtcagttttctctatggtaaagttatgcttctcttccttcacccacccctgccttgtaccccctgtagagggaagtcactatgcacagcccacacttagggagtgggatgttagactccccctccttgagggcagaatgtatatgtacatgttttgcaatttttctgcacaggagatttgcctattttattctgtatttatttcatgaatatcagtataaactcatgaatttttttaata

SEQ ID NO: 207255 - DNA, 170 bp, Homo sapiens
catgcttatttcacattgcatgcctgtatcaaaacatctcatgtacccccaaacatattgatatatacctactttgtacccataaaaattaaaaaaaattaaaagatatgtatatacatatacattagtatatatgataattaatacaaataaaaataataaaatgtttg

SEQ ID NO: 207256 - DNA, 597 bp, Homo sapiens
ctcaactttcctaaggttaaatatttaagaaaaaaatatgtataaaaaatggcagaataaaagagattaagatataggtgcattataataaaattttaataaaattaataataaggaaaatacaaaagaaagccatccactataaaattttaataaaattaattataataaaaatacaaaagaaagccatccactaaaattagtaccccaaaacactttatattagttaactagctacagattaacagttgttggcatgcaaagtttcatacatacttgacttctcatctggtctaatttcttccttgaatcctgcatctcattttctaaatagatgcaatgacgcgatgaagcatccagcaaagcttttgttgctgattgtttaagacatcatcttgttttcattgaagctgtctcacagctacctgatgttatttttgttactgattttacaaatcaccttattattaaaccattaataatatttaactctaaagcatacactttgaaaaatatcaccacacagatcgattcaccttcttttcctcatgtgtacacattcctgtgtattactgaatccagttaaggatacagaag

SEQ ID NO: 207257 - DNA, 443 bp, Homo sapiens
ctacggtaccgagacagcctcaagccaaatttaatttaattaaacaatcatcacctcaatcttaatcttggcaaaggaaatactaaaataagatgggccattgaggaatctttgagccttccaagtaaaatggcaaatttcaagttacactgcgttactacaggaactacagaggttagagttttgatcaaagacttaaaaaattgccatccagtgaacagatacctgattaaagttacctctaaagagggcaaatatttaataaatggcaacaaagagctggccgggtgtggtggctcacgtatgtaatcccagaattgtgggaggccgaggaaggatgatcgcttgaagccaggagtggtagaccagcctgggcaacatagtgagaccctgtctctacaaaaaataaaaataaattaaaaaaattaaaataaataagtaaa

SEQ ID NO: 207258 - DNA, 943 bp, Homo sapiens
aggtggcgccgcggagtaagcggcgctgtgtgctggagcggaagcagccgtacagtggggacgaatggtgctctggaccggacagtgaggaggacgacaagcccattggggccacccacagtgagtgcctgtcgatgccagggtgctgtagcccgtgatgttcctgggggatggacttgagaggactgagcctgggaaagaagtgaggactgggagtcctggatttttctctcccatcctacctctcagactctgtccctccctacactgcaactgcctcgcctctgccttccaggtgctcagtgaccccctctccctagggaccctaggtggggcagagtggagtggcctccttcttggtcacgtcacctgcacctctacctgtgaattcctggcctatgctgccacctactggttagtggagggagggcggtgaagcgtccagggacactgggagccgggcagttggctctgctgtgcaaagccctgctaagcctgggtgtgagttgccacttggccgtgtctctagtgcccttccctaacctctaattgactcctggcaagtacccagggtgtgtcaccaggacaagaagtgggtgtggagggatgcccactcctcctctgattcttttatggattcgcctatatcttgtccttccatgagtgatgggggagagccagatgtaacccctgcccctgggaagcttgtacatattttttttccctcaaagtttacgtttacatctttttgaggagagagacataagaaactagccagagaggctgggtgtggtggctgtcacctgtaatccccagaatttggggagctgaaaccggagaattgcttgagcccaggagttcaagaacagcctggccaacatagggagaccccatctctaaaaagagagagagagagaaagaaaggaaagaagtaaagaaagaa

SEQ ID NO: 207259 - DNA, 344 bp, Homo sapiens
gagatcacggtattgcactccagcctgggtgatagagcaagactcagtctcagaaaaataaataaataaataacaataacaacaataataataaattatggttgttcacataggtaactgaaacaaacatacgatttttgagtcaagttacgtttggctgcacattttagaaactatgcttcatgcataaaacaaaccacatcacacattatcttctgtaacatggaagtatattttttgttcatataaaagaaatctctaggtagcaaaggtgtactatagaggttttattatctggctcgcttcttccttctattccactttcttgacatggtttttattcc

SEQ ID NO: 207260 - DNA, 229 bp, Homo sapiens
tgggacttcaccttgtgatcgtgtgagtcaatttttctaataaactccccttcctatatacatatatcctattaattctgttccttcagagagccctgactaatacactacccaaaggaaaagaagtcattttatgaaaaaggcacctgcacacacatgtttatggcagcccaattcacaattgcaaagatacggaagcaacctaagtccacatcgatcagtgagtgga

SEQ ID NO: 207261 - DNA, 177 bp, Homo sapiens
ccttgggaatggtgggagtttattttctggtaacatttgtcaattgccttgcaataaaaggagtctttcaattaaatctatcctttctgtttaccaggtgctgcaggccacctatgggttgggtagtgggagaacagggagtctcagttaacaaagaatagtagaccattaaaaaag

SEQ ID NO: 207262 - DNA, 435 bp, Homo sapiens
tgagccaatcacttaatgcctccatttcaattactttcttaatgccatggctttgaattcctcacctgtgaagtgagatgagtaagaacagaaactatcaagttctttctaactctaaaggtccagggttcttgatgccctcagatgaagatctactgcctgtccctgtctctttgtagcagattacttctcaaaggataagggcaggacttccaggagagcagagcagtgggaggtgtggatggtggagccagaagacccggcatccatcagttgtgaagctttcaggcttaaatacatgtttccatctgtataatcttcgaagaaacaatggcaatataagtaaaaagaaaaacattgtttagcacaagtttgtatcaaaatggatattatagtagctcttgacaatttactaaagacaaattttgagttact

SEQ ID NO: 207263 - DNA, 308 bp, Homo sapiens
actccgtctcaagaaggaaaaaaaaaaaaaaggaatgctagtgttatttttttcttgcacttagagacttgataaggactagttatctaatatctgtatgtttttagaagttgttgagagcagtgaaattactaataacaaccaccaaatgacattaaactttatatgacattttcatacattaggaccaagaggacttgtcaaaatttaacaaattaaagagaattgataaggctgtagaagggacaatccgtgttttggaagtcttaatgttttttaaaaataggaaaaattctgtaagaaaaaaa

SEQ ID NO: 207264 - DNA, 313 bp, Homo sapiens
atacattaaattaaagcaatttctgctgattgctttgtttgcatttttcttacatttgacatgttagcaaagtaaactttttatctctaggtctttcatttgtcatcgtttttggtgttttgcctaagtatttccatatttttattttacttgtctgtggaggtttgctattaagttctgcagttttgtgtgaggataaggagttttgagaatcctgattcttaaacatgtttgagggtaaggaaaaaactttgccttgaaaagtagcttcactacccagacatccaattaatgctaagaagcctttgcattt

SEQ ID NO: 207265 - DNA, 287 bp, Homo sapiens
agggtccggaactcctttcacacatggtctgaagcctccctttacaaggtcttatcctaaagtaggtagacttgagacacactgacccgccagatgagacaaagttgcaaatctcaggtagttgtcacctccactctgcggcacccaactgctgccataaatttccatcatggccctcaaaaactcccagctcacttttcagcccaacgtccatgtgcctaaaacaacttcagcttcacagtccatttctcaaaagtctgcttttgccaaggtctctaatccacaat

SEQ ID NO: 207266 - DNA, 696 bp, Homo sapiens
tcatagtctgggcacaatgaagtaaagaaggcatcaaagaaagttttagtgtgaggggatcatgtgaacagcccaaaagtcactgaaacatacaaatacaaatcctagtaaggcccttcttatgagagtggttttttcgtttgtatttctaaaaaggctaaaaagttgtggctcaaaagattaagtaatccactttaagacatgttgtgtggctgggcgtggtggctcacatctgtaatcccagcactttgggaggccaaggtgggtggatcatgaggtcaggagttcaagaccagccggccaatatggtgaagccccgtctctactaaaaatacaaaagaaaaaaaaaagttgggtgtggtggcacgtgcctaagaaatgagtaatagggccagcatcaagagcctaggaggatcaatgagttacaggacacagcaaacacatgcaggccagaggcactcttcttaattccaggttccacagagaaactagttaagcaggaaaaattgttgtactccataactcctctctccgttctacatatagctaaaacctaagaagaacccaaaatagtctcagtggccctcaaaaactcccagctcacttttcagcccaacgtccatgtgcctaaaacaacttcagcttcacagtccatttctcaaaagtctgcttttgccaaggtctctaatccacaat

SEQ ID NO: 207267 - DNA, 432 bp, Homo sapiens
cgaagacctcattccgggccagggaacggaatatccctgatgggattttatgtgaggggtctgagagccgcagggccaccggggtcacagatcaggcctgctcaccagccctctgcactcacctagtcctggctcatcatgagtccaggcaccgcccggcagtgatgatcaccttattactgaattccactctcgctgaagaacccccacatttcatcaccacccgaccttccagcgggcctggtgagacgtttcctcctgcagcctgaacttggtggagatggggcagctcccaggcctgtggtcagaggttgggtggggagagtagggacagtgtggccagggcaaatgggccctgagctgtgctttggtcacttggctggaggaaaatgtgaaggggctggtgggagtatttttggggggtgtcagaga

SEQ ID NO: 207268 - DNA, 396 bp, Homo sapiens
ccaccatgtgtagacaaagaaaaatagctattttataaagaataaagattaaaagaaaaataaatttgagacacctgaaacataagactgacttagaaagataggagaatttactattaagatactgaaggagaaagctgcctcagttcctacagactgtccaccttccaagtccagttcctcatgagacttagttatgctcctcaccctttgtctccatgaaaaatcctcagatcccatagttattctctctcccactccccgtctgttttgcggaagtcagttttagtgaacttctgttaaacacaatgaacagaatcttaatccatgtttgtcgtgggcagcatccaagatgggccccaatgtatctcctggtattcacactcttgtattaat

SEQ ID NO: 207269 - DNA, 158 bp, Homo sapiens
ggggctacatacagtccacgaaaccgcctcccccttcctcaccccactaccaagtaataatgctaataatgcaattatctgaatgtttcaggtgaaagagtttgggggtttacttcatctacatcacatgcatacatagtcccaatactaaagccaga

SEQ ID NO: 207270 - DNA, 540 bp, Homo sapiens
gtgggcagataacttgacgtcaggagttcaagaccagcctggctgacatggtgaaaccccatctctactaaaaatacaaaaattagccaggcatggtggtgggcacctgtaatcccaactacttgggaggctgaggcagaattgtttgaactcgggaggcagaggttgcagtgagccaagatggcaccactgcactccccctgagagcaagactccgtctcaagaaaaaaaaaaaaaaaaacccagtaatttccaagggtctgagaagctctgtgccagggaccagggacaaagaccaaatattttttattttgccacatctatcttcttagcaatttagattactttcccttaaatataacaaattccattaagcatcagtttaagttgaggcgtaacagaaattattattagcaaaaaccttgagagataagaatactaagcgggagaaataatagaagaactattttaaccctaatatactttgtcaagtctgacttttttaaaaatcgcatttattaagcttgcatagagctgact

SEQ ID NO: 207271 - DNA, 288 bp, Homo sapiens
gaagcttattagtgttaaaatcttcttttcaaatatgaatatttaaggcttcagggtttcacacacgttttaatatgtcctaagtttctttttctttgaaataaggtcttgcgctctgtagtccaggctagagtgtaatggtgttatcatggctcactgcagactcaactttgcaggctcaagtaatcctcccatctcagctttctgagtaggggctacagggggacaccactgtgccgggctaatttttatttttttttgtagacgcagggtctcactattttgctc

SEQ ID NO: 207272 - DNA, 471 bp, Homo sapiens
agaagtgggaggctggaagtagggggctggcagaacatcagggaagccttcttaaagaggcctctgagttgtgaagcacagaatgaaataggatattccaggcagaggggtagagatgtgtgcacgtctgtaatgttctgttctcagggtcttggcggggggcccagctctccaagcccagaccgccctcgtgactttactttattctggtggctgatggccaaccaagcacgaagtcctgaattctttgctctaacacaatgcttctcaaactttaacgtgcttatgaattgcctgccagtctgactaaaaggcagtataagattccttagttctaaggtgggggttgagattcttcgtttctagatggtgccatttattggttacattttgaatagtgggtagtaagaaactcttctttctcagcacaggtccctcatgtcagactgttgtacccaagcgagttagtga

SEQ ID NO: 207273 - DNA, 225 bp, Homo sapiens
gcctccattaatttcttatcagctcaggctatgatattgcactttacacacatcatctttcttcagctctccagtattctggtgagatccatgatactatcaccctcctttttacagatgagaaactgaggcaagggaaggttaggtatcctcctcaccccatgtccttccagcatggcctcctggaaggtcttgctgctccttctaactggatctctgttgatt

SEQ ID NO: 207274 - DNA, 302 bp, Homo sapiens
atgttactaacatgctaactcacattcatttaccccacattttgttccttagggggataccttgatttggtttcatctataataaatgcaagattcaccagatatgacatatttcattagtaagtaagaaatgtcctgattttaaatatttaatttatatatgaaaaaacattctctggcattttatcatttacagtgtatttcagttaaaatttaagatataaaaaactgatttaatttattgatattactaatgttctttctgcactaaaaggtagataataaacctaaactgaaaagca

SEQ ID NO: 207275 - DNA, 467 bp, Homo sapiens
ctgctttgccatagaaatctacttccaggtaacagggtggctccaggtggtgagggaaagtatagctaatcaatatagatgaatgacaggaagccatcattggcaatttctaatgaaatcattgattcaggcaaggatcatcaatggatgctattgtctgaatgcttgtgtcccccaaaatttgtatgttaaatcctaacccccaaggtgatggtagtaagaggtgggactttgggggctgattaggtcaggagagctccctgttcatgaatgggattagtgccccttacaaaagaggcttgaaggagcctctttgccccttctgccatgtgaggacatagcaacaagatactatctatggaagcagagaatgagccctcaccagacaccgaatctgctggcaaccttgatcttggacctcccagtctccagaactgtgagcaataaatttctgttgtttataaatt

SEQ ID NO: 207276 - DNA, 352 bp, Homo sapiens
taggtggtggcagcagcaaagagaggggacatttgaattgggctttgaagggtgcataagagtttaacggggccgggcgcggtggctcacgcctgtaatcccagcactttgggaggccgaggcgggcggatcacgaggtcaggagatcgagaccatcctggctaaaacggggaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctca

SEQ ID NO: 207277 - DNA, 285 bp, Homo sapiens
atatgtttaatgatgtgtgtttgtgttgttgttgtttttttctctgtaatgcaattgtttaacatagatttaacaaagacctcaatgttttaattaaaagaatcctttgaggctaagatgactgcctgttccatttgctgaccttgggttacctttccatgcgtggctctttgaaccattgtggcccttggctgaccaaaaacaggaagccatgtgacgaccgcaacctttccccattagacctgggtggtgaggatcccaagggttagacacagatgagattaa

SEQ ID NO: 207278 - DNA, 169 bp, Homo sapiens
ttacctcatttgattctcaatatacgacacaaaatattgtttctattttacacatgcagggaagttaacagggaaatccacatggtcaggatgtgaaagcaactgttcaggccaaggaccagacttgtctttcttccctcactgcctcctaattctgcagagtcctaag

SEQ ID NO: 207279 - DNA, 697 bp, Homo sapiens
agctgggcatggtggcgggtgcctgtaatcccagctactcaggaggctgaggcaggagaattgcttgaacttgggaggcagaggttgtggtgagccaggattaccccactgcactccagcctgggcgatggagcgagactctgtctcaaaacaaacgtacaaaaaaggaatgaaatactgatatatgctgcaatatggatgaaccttgaaaacatgctaaatgaaagaaggccacatattttatgaatccatttatatgaattgcccagaatcggaaaatctgtggagacaggaaatagattagcggttgccagggaggaggagggaggatggagagtgactgctcacaggtacacggattgtttggggtgatttgggaactagatggtggtgatggttgtacaacattgtgaatgtaccgaaaaccactgaattatatacatttttaaatggctaaaatagtgatttatatattgtatgaattttacctccgtaaaaatggaaaaaaatctaaagttataatgaccgaatgagacatactgattttgtaacaaaaaggcaaaaacagagccggttacattagcacatgcttgtaatcccagctactcaaaaggctgaggcagaaggatcgcttgagcccaggagttcaagtccagcctgggcaacatagtgagaccccatttatatttaaataaat

SEQ ID NO: 207280 - DNA, 152 bp, Homo sapiens
ggattcttaagcacgttctccacgtatgcggcgtgctagctggatgtcttttggcataattgttacacgtttggcatggatagcccacaggttgttgtcttcaaaaaggccaaccagataggcctcacttgcaaagcaactatagctgctct

SEQ ID NO: 207281 - DNA, 546 bp, Homo sapiens
cctcccctaaatgctaaccttttaataaattatttccagtactctaattataaggatgaaccaatttaagactaccagctaatcatgaaaacatacctaagacaacaatccactcaactatttattacgaacctgctaggtcctgttctaggtagctgcagacagaatgacacataaaatagagcccctccctgttctcatgcagtttaaattctggagggacgtttaaaaaaaaaaacaatgatcaaagttacttcagagagacaaaactgcaacgtggagaataagggtctgatggctgaaaactgccgcgggtgggcagtaatttcagtgtaacctctctgaggtgttggcattggaactgagagggaatgacataaaagaatcagctatataacaatctcagggcagagtatgaggcaaagaacaaagtaattaagacgctgagacaggaataagcttgttcagtgggtgtggagctggaatggctgggcacggtgaacaaggtgaaacaagataaggtttgtgaggtggccaggggccaga

SEQ ID NO: 207282 - DNA, 684 bp, Homo sapiens
gttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagca

SEQ ID NO: 207283 - DNA, 385 bp, Homo sapiens
cttctttgaattgtaaactgagttttaaccaagcagtaaattttttagtaactggttttcatcatctctgggtgctgttaacttaaacacagaaattataaaacatgcagttttcttgtgtagctttaatagtagtgttttttgtatagtgtatatgtatgtgactttctcttaaaacccatactttttataaagttgaatatagtttttaaagatttgtcttgtgtatcttgaaataaggagtatctcctattttcagttttgtagaaagaaagccattggaatgccactttctaacaagtatctcttaaagccattcagctaattacagtctttgattgttttgttagaatgtatttaataaatgaatgtaagtttattatac

SEQ ID NO: 207284 - DNA, 491 bp, Homo sapiens
gttttggggagacgtcaggagaagtaaagctttaggattatatcaaattataaattaaaaatccattataaatccaacaagagctactactaaaatatctttcattcattccctccttttagggagttgggttctcttacctggactatcatattagtttcttatagatcttcctgcttttaatcttcatatctgtccaccctgtactttattgagtggccacagttctcttcacagaacagtcttgttcatttccattttggttttcaaagccttcagtgactcctatttgctgtaagataaaacccacacttcttagcagatgattacaagcaatccccaatctgtggacaatcaattttgacaaatgcatgctgcgttattctcccctgcctggcccccaccccactcatccagggctgtagttccatatgactgtcctcattgccggaatgaactttcatgactccctccccagtctttccatcagc

SEQ ID NO: 207285 - DNA, 480 bp, Homo sapiens
gtccagccactgggcttgtcctggtaccatgtctttctctccaaattttccccaggatggagatctaggattctctatccaccttccccaggagctatttctcagccttgatgtaccctagaaagctggtggaaatattcccacatgtggggttcccaggtctatggaggcaatctcaggcctagcttggagctggcagaacatgctcccacagctcctatctctggtctcaggtctcttcctctaccatatctctcaaatgatgttaaaaagacttctcggccgggcacagtggctcacgcctgtaatcccagcactttgggaggccgaggcgggtggatcacaaggtgaggagatcgagaccatgctggctaacacggcgaaacctcacctctactcaaaatacaaatattagctgggcgggtggcatgtggctatagtcccagctaccggggaggctgaagtggaggactgcttgag

SEQ ID NO: 207286 - DNA, 101 bp, Homo sapiens
ccgggagggtgcagttcgggatcgcgaaggcagccccggaaggggggcgggccggtcggggtcgccacatcttagttcggaacccggccgggggcagaggg

SEQ ID NO: 207287 - DNA, 493 bp, Homo sapiens
taggataaatttaataggagtaagacttaattaactttgttaaatatgtctttacaagatgtatgtctatctatttatttacttattagacatgatagtaagcattagacattgttctaatgagcttttgtgccaacattcaggatttcttctcagtacatatctatatgggaaggaagaagaagaatagtgagcatataaactagaatgaatatgaaataaaataatcaatgctaaaatcaaggtgcacaatagatgacttcatagcactaaacattgctttcataaacatatgaggaagagttttcacagaggtttatgtgagaaaatccttgaaaattttatttgatcacaagttccacaccatatgacaatgtgatgtatttgataaataaattaatgtaatctttgtctgtttcaaaatataaataaatgtactagatatttggagattcttttagaaactaagctattaaaatgagaaaattatatt

SEQ ID NO: 207288 - DNA, 467 bp, Homo sapiens
aacataaaggtctctgggggaggggagaataaaaggatctgtagggttgcaaggtttctgtgttttaagtgaattagtataataataaccctaagtagcctgtaaaaagttaggtatgcatactgtaatccctagggcataaaaaaagtaaatacaaagagatattgctgaaaagaccaatagagcaactaaaatgaaatactcccaataatcccaaaatataatcccaaagaagcagaaaaggaggaagaaaggaacaaaaaaagagaaacagaagacaataaagtggcagacctatcactgttgatatggtaaatatgtcaataattaatcatattaaatattaataatctaaacactccaattgaaaggcaaagattgacagtggatttctttttttaagggcaaggttctatactagttgcctaagaggagaaactttaaatataaaaacataaacatccaaa

SEQ ID NO: 207289 - DNA, 408 bp, Homo sapiens
acaggacaagaccctgactgcaaaaaattaaaaaataagcgaggtgcagtggtgcacccctatagtcccggctacttgggatgctgatgtggaaagactgatcccaggagtttgaggctacagtgagctatgattgtgccactgcactccaacctggatgacagagtaagacctcatctctaaaattaaaaaaaggatgattgtaataatactctggaatatgaaacaaagttaaaaacgagatctacacgtatcaacaagtaaaaaaaagcaaattgcaggataacgtgcaccataacaatgtatatatatttaaatacacagaaatgagtcccgaaggggctgggcatggccagatgcagtggctcacacctgtaatcccagcactttgggaggccaaggggggtg

SEQ ID NO: 207290 - DNA, 124 bp, Homo sapiens
gcctggccttgtggctgtctctgcctcttcctctccggcactgtcagacctcagtggctgtgggctggccaggaggctgcaactggaacctgagccttggctgtacattggcatcatgtaggtc

SEQ ID NO: 207291 - DNA, 538 bp, Homo sapiens
actttatttgttgtttattgtttttgtttttgcttctgttttcagagatagagtatctgtctgtcgcccaggctggagtgcagtggcatgatctcagctcactgcaacctccacctcctgggttcaagagattctcctccctcaacctcccgagtagctgggattacaagtgcccgccaccacacctggctagtttttgtatttttactgaagacaggggttcaccatattggccagactggtcttgaactcctgacctcaagtgatccacctgcctcgacctctcaaagtgctggaattacagacatgagccaccacacccagcctaattctgccttaatacttaaaatcaaagctagtggagtaatttaaggagagtcttgcttagtttctctaagtaaagggccacttttattcaattttttttccctttaaatggaaatggtacatcagattgattatttttttctttgcattgatgttgtttgagtttgatattatttcttctgtggcatcattaataattcctcctcccttc

SEQ ID NO: 207292 - DNA, 467 bp, Homo sapiens
ctgggactacaggcacttgccaccatgccaggctaatcttttctaatttttgtagagacggagtctcatgatgttgcctaggctggaatattttctctttattgctgatttttagcaatttgattatgatgtatctcagtatggttttctttatgtttatcatccttggggtttattgagattctcggatttctgggtttctaaatataaaatgtgaagaattgttggccatcatttcttcaaaggtattttctgccaccccttctcccatcctggactcccactctgtgtgtgttagactgtttggtatcatcccacaggtcactgaacttctggttttttaatttcttctgttcatttcttctctgtctttttttccttccgagctttaatttagatagtttctactgctatgtcttcaaattcacttatctttacttctgcatttttattaaacccatccagtg

SEQ ID NO: 207293 - DNA, 224 bp, Homo sapiens
aatgtatacaacaatttagacagtggcaggctgtatttgaagcctatggaatggctattcgttaaggagaagatgggagcacacactcactgggttcccaggggaagctgactttgatgttgcccgggagcagggctgattctgtgaggtgtaactagagacaggatttaccaggagagtctgcttcctggagaatgttgaaatatctgatgccgtttactttg

SEQ ID NO: 207294 - DNA, 473 bp, Homo sapiens
aaaaaaaaaaaaaaaaaaagaatgataatgtaaagctgcatgtggtggtgcatgcctgtaatcctagctactaggctactaggctgaggtgggaggatcgcttgagcccaggagtttaagtccagcctagttaacatagcaagacctcagtctcttggagaaaaaaaataaaaagaatgataaagtggaaaccaagaaacctggcttctgatcctacctctggctagtctttaacgtttaggcttcattttcttttatggggaaataagaaaattgtgccagaaaattctgagaccacgtcaagctctgttattccatagggtgtatagagttctgtaaatctatattttgccaaatatagaatgaatgccaatagtatgttaagtatagtacagagattagggcttgtctaaccttggaataggcaagaagtctatttctgcccctccctgtgtgtctgcctatcactatat

SEQ ID NO: 207295 - DNA, 2342 bp, Homo sapiens
gaaaaacgtttgtcccatgtttgttgggacaaaaatgctggatatggtacaacattcttcctgcaggttcggttttgttgaagagagtgaggccagctcgaggtgaaggaaaaacatcagaaaggtgctaaagtgcagaaatatcttccagaggcactaatagccgactttagttcttgacctttagctagatccacaaagcactgagttaaaattgtacactgatcccttccagaacaaattaattaattaaatggtgcctcttcccagcgttaatcgtttaaaaggactcaagtacccacacagtttaagcaaactaaaagaacactgacactttctcagagaacagggatgggaactttctatctgcccattagtatctaccccaagctacgaagacttccattcctcttattaagcattcagcaactacatttagtgcctactatgccagtgatgcaagaatggataagacagtccctacactcaaggataacgcctctagtaggtgagagacaaaccgattaattctgcataagggataagtgctgtatgtgggaagcaatccaatgagggctctgaggatggcaaaggaagggttcctggaggatttacatttaactggtgccttgaaaggtgtgtagaagttggcaagatcaaaagggagtagagtccaggtggagaagagaaaagagcagggcaggctggatggcatggctcacacctgtaatcccagcactttgggaggccatggagggaggattgaggccaggagtttgagaccagcctgggtgacattaaaagaccctgtctcaaagaaaacgaaaggagcagggtatatacaaggggtctgccagccttctcagcctttctgtgagaagcgagggtagggtagtacaggagagtggcaggagatgacactaaaagtaggtctgtgttgatctaacgagtctcaactttactgccaaaactaatgaactaggaaagtttaggcagcaagggccagagatggagtctggacttgtattgcagaaagttcctgtgacggcagcttggagggtgaatgagagtgtgggatggaggggtgaatgggtgtggacagactggaaaaatgactcatgcagggaatgaggaagggaggagccttgggagactctcaaatccctggcttagcctactgaattgcttgctacttgcctttttatgtcttcattttgcctcccattgtctgtgatattaaaggcctaacttcttagtagagcaaactttgcatctgctagcaggttggtgccctagctagcttccatgcccctctgcttagaatgcctgcgaaccactaaggactaatcctagtggtagaaatttattttcaattgttctcaaacccttgtagaattccaagttagaactgtagtgttcttttttcatgtgggttagaaaatttgctgtttggagcaacatggtgaaacacaggacttttgaacctgcttatggtgcaaaaggggaaattatatttctacttcaacactggaggaggggggacttctgggagcaaaagagaaatggaaactgagatgagacatgttttttactccatgacagaatacaaagaaatacaaggatgatcctttaatgttagaaacagtagaataaccatcctggtaaataaaaaaggagaaaaaatgttattttacattagatacagaaaaacagaatggctaagaaaactcacaaagcaatggtcaatctataactcgagtccaaataaattgtgatataacactaaattaccactgatttggcctaattgactatcactggataacattataacatgaatgataatatttaaaattttaaagcactgtaacaaacaccagatcatgttaaaactattcaatcatgttgtcagctttcaactgccagtagcatcctaaccacatttcaaactatggaaattactaaaaaatcattattgtaataaaaagttaatagttcctcatttagaataccattgatattccctcagtgccaggagaacattatggtttctcctatttctgtgaagtgtatagtctacaggttcataagtgagtatatccatgagtataaaaagaaggtcatttatgggtggagagggaaattatagaaaacaatttcagatgaaataaactacattttcagataaaggaaagagtgttcactgcaggttcctgaaatatttcagtccattcaagttttaattataccaatgaatctcaataaaaatacagttaaggaatatggtttttatagataatgtcagctccttgtttaccaataataaagataaagataatggc

SEQ ID NO: 207296 - DNA, 545 bp, Homo sapiens
gggaaacactgtgatgggtattatgcaatatgcctttccctctctctctgctttttccgcactgctgtagcacttgaccttctgtggtagtggtttctgtgtgggcccctcagtaacagtgtggcatcattaggagccagttattgctttcaaaccccgcgtacttgtcacataacattgggaaagtcactttgcctctttgagcctcagtttcctcatctgtaagatggggaaaataatatctcccacagaggtgggttggaaactgaaggaatcccttgtttgtaaagtgttcacgttgcatggcatcatcttcatggtaattataatcacagctaacctgttgagcccttgccgtgtgtcaggcattggtagattatctcatttcaatctcacagtaaccagaatgggtgatccattttacagatgaggcaactgagtctcagatagggtaattctgggcaagttactaaaactatcaggaaatgcttggagcatgtttggaactaaattatctgactctaagaagtgttctcttaatgatt

SEQ ID NO: 207297 - DNA, 126 bp, Homo sapiens
gagaaacaagaatgctgccaccaccgtcagcaaaaatagttattgtactttacatttctatatttattaatgactaatagtagaagttgccccatatagtgaccttttgtgattttttaaaacatg

SEQ ID NO: 207298 - DNA, 581 bp, Homo sapiens
actgggaatacaggcatgagccaccgtacccagctagtgttgcatactttcatccacagtatgttaataacagttttcttaggccaggcacagtggttcacgcctgtaatcccagcactttgggaggccgaggcgggtggatcacgaggtcaggagatcaagaccatcccggctaacacagtgaaaccctgtctctactaaaaatacaaaaagttagctgggcgtggttgcaggcgcctgtagtcccagctacttgggaggccgaggcaggagtcccagctacttgggaggccgaggcaggagaatggtgtgaacccgggaggcggagcttgcagtgagccgagatcgcaccactgcactccagcctgggcaacagagtgacactctgtctcaaaaaaaaaaaataaataataataataatacttttcttacacacgtaagaaagactgtctggtacataggcccttaataaagactgttaaataagtaatatatatgttgtatttctatacgctggcaatggacaatctgaaaatagatcaatttcatctacaagagcataaaaaaaattaagaatatat

SEQ ID NO: 207299 - DNA, 268 bp, Homo sapiens
aaacaggggttctttgtaagttcctcttgtgtatatatagtaacttataacaatggcatgtgggcattctttcagtgaattgctttctttgtactaaaatctctagttttctaagacagttccatgtataaaaatgatttatgcatttctccaaggcggtacatatccaaagacatgacaccagggggaaaaagtgcttgtttttctgatggaagcagtggtcttttcttttctttcctctttcttttgtgcatgtgtatgtgtagct

SEQ ID NO: 207300 - DNA, 461 bp, Homo sapiens
atcaatccaacatccaattaacagaaattcaaggagaaaaaaacggggaattaaccatgaaataatacaagaaaataatcctaaaacaatcttcaaatggaaacaggtctgtgagaacccaatgaaatgaacaaattttaaaacgtattcatattcggtgcaatttcataataacaataaacgatcctagaaagctctctgacaggaaataaaaatttcatctacaaaagattgagaatcatcttggaacacttctcattggcaatactggattctagaaaaagaaaaattaaaagtcactgaagtattgaaggaaaattaattgcatactctgccaaatcagcaggcaagcataggatataacattttcacacatgcaacaataaagaaaattaactctcacatatgaaattacataatgttatccagcaaaattaaaatatgaaccaaaacagaggaag

SEQ ID NO: 207301 - DNA, 526 bp, Homo sapiens
accacgcctgttgcctctgtctagagtagttcacacatggatgctgtctctctggtacttgggtgtttctcaggttccagaacatccgttcatcttaccagtccttcaaggttcagcttaaagatcagctccaccaggaagccttcctggatttcccctcttagtttccaacagaatccgtctcttccgttctctgcccaccttgagtagcagtagcttcagctgtagactctcctgtttttcccttacagtctttgttgctgcatcctctttcactgaattgttgatgtgagaccctagactctcttgttttttcgttacagtctttgttgctgcatcctctctcactgaattgttgaattgtgagaccctgtgagggtcggcaccctgtgatactggccaggaaagggttgttgcaaggggatcatgggattgttgaatgggttttgatctggattttgatgttggaaatcaagttcccaaatgttttcaaccttgggtaaaggaacatgtaatggtgttttaa

SEQ ID NO: 207302 - DNA, 2289 bp, Homo sapiens
caggaggccgcggctcgctgatactgcgagctggcaaagccgaagctgggcgggggtccgggcggtgggagccaagtcggatcagggagtggcttgtaactcggcggccgattggacacgaagaagagagcggggtggggctgggagggttgggggtccggagcgggggcgcggacccaagaccacctggagctccgcccgggcagcgcggggtcacggcgggaattttcgggtcgccgagtgactcagccccgcaggctcgaaactgcgggcgcatgaggtgtgcaggtaccggggtgggggtcccgcgccggaaataggggcgactgaggggccgcgaggcggggaggaaacaggggggctgcggttccgggcgacaccgcccccgacgcggccgtggaggcggggctcccccaggtggcggggcggggcagggctcccccaggtggtgggggcggggcgcctggggagaccccgcctcccgcgccctctcagcaacccgcacagggcgcacccggacgctctaccgctcccgccgcagtcgccgggccatgggcctcgagcccgccccgaacccccgcgagcccgccttgtctgcggcgtgactggaggcccagatggtcatcatgggccagtgctactacaacgagaccatcggcttcttctataacaacagtggcaaagagctcagctcccactggcggcccaaggatgtggtcgtggtggcactggggctgaccgtcagcgtgctggtgctgctgaccaatctgctggtcatagcagccatcgcctccaaccgccgcttccaccagcccatctactacctgctcggcaatctggccgcggctgacctcttcgcgggcgtggcctacctcttcctcatgttccacactggtccccgcacagcccgactttcacttgagggctggttcctgcggcagggcttgctggacacaagcctcactgcgtcggtggccacactgctggccatcgccgtggagcggcaccgcagtgtgatggccgtgcagctgcacagccgcctgccccgtggccgcgtggtcatgctcattgtgggcgtgtgggtggctgccctgggcctggggctgctgcctgcccactcctggcactgcctctgtgccctggaccgctgctcacgcatggcacccctgctcagccgctcctatttggccgtctgggctctgtcgagcctgcttgtcttcctgctcatggtggctgtgtacacccgcattttcttctacgtgcggcggcgagtgcagcgcatggcagagcatgtcagctgccacccccgctaccgagagaccacgctcagcctggtcaagactgttgtcatcatcctgggggcgttcgtggtctgctggacaccaggccaggtggtactgctcctggatggtttaggctgtgagtcctgcaatgtcctggctgtagaaaagtacttcctactgttggccgaggccaactcactggtcaatgctgctgtgtactcttgccgagatgctgagatgcgccgcaccttccgccgccttctctgctgcgcgtgcctccgccagtccacccgcgagtctgtccactatacatcctctgcccagggaggtgccagcactcgcatcatgcttcccgagaacggccacccactgatggactccaccctttagctaccttgaacttcagcggtacgcggcaagcaacaaatccacagcccctgatgacttgtgggtgctcctggctcaacccaaccaacaggactgactgactggcaggacaaggtctggcatggcacagcaccactgccaggcctccccaggcacaccactctgcccagggaatgggggctttgggtcatctcccactgcctgggggagtcagatggggtgcaggaatctggctcttcagccatctcaggtttagggggtttgtaacagacattattctgttttcactgcgtatccttggtaagccctgtggactggttcctgctgtgtgatgctgagggttttaaggtggggagagataagggctctctcgggccatgctacccggtatgactgggtaatgaggacagactgtggacaccccatctacctgagtctgattctttagcagcagagactgaggggtgcagagtgtgagctgggaaaggtttgtggctccttgcagcctccagggactggcctgtccccaatagaattgaagcagtccacggggaggggatgatacaaggagtaaacctttctttacactctgaggtctccaaaacatttgttgttatca

SEQ ID NO: 207303 - DNA, 2351 bp, Homo sapiens
caggaggccgcggctcgctgatactgcgagctggcaaagccgaagctgggcgggggtccgggcggtgggagccaagtcggatcagggagtggcttgtaactcggcggccgattggacacgaagaagagagcggggtggggctgggagggttgggggtccggagcgggggcgcggacccaagaccacctggagctccgcccgggcagcgcggggtcacggcgggaattttcgggtcgccgagtgactcagccccgcaggctcgaaactgcgggcgcatgaggtgtgcaggtaccggggtgggggtcccgcgccggaaataggggcgactgaggggccgcgaggcggggaggaaacaggggggctgcggttccgggcgacaccgcccccgacgcggccgtggaggcggggctcccccaggtggcggggcggggcagggctcccccaggtggtgggggcggggcgcctggggagaccccgcctcccgcgccctctcagcaacccgcacagggcgcacccggacgctctaccgctcccgccgcagtcgccgggccatgggcctcgagcccgccccgaacccccgcgagcccgccttgtctgcggcgtgactggaggcccagctgccgcccctccctgtgtccttccaagaagtgccacatgcactggtctcttgtgtccccagatggtcatcatgggccagtgctactacaacgagaccatcggcttcttctataacaacagtggcaaagagctcagctcccactggcggcccaaggatgtggtcgtggtggcactggggctgaccgtcagcgtgctggtgctgctgaccaatctgctggtcatagcagccatcgcctccaaccgccgcttccaccagcccatctactacctgctcggcaatctggccgcggctgacctcttcgcgggcgtggcctacctcttcctcatgttccacactggtccccgcacagcccgactttcacttgagggctggttcctgcggcagggcttgctggacacaagcctcactgcgtcggtggccacactgctggccatcgccgtggagcggcaccgcagtgtgatggccgtgcagctgcacagccgcctgccccgtggccgcgtggtcatgctcattgtgggcgtgtgggtggctgccctgggcctggggctgctgcctgcccactcctggcactgcctctgtgccctggaccgctgctcacgcatggcacccctgctcagccgctcctatttggccgtctgggctctgtcgagcctgcttgtcttcctgctcatggtggctgtgtacacccgcattttcttctacgtgcggcggcgagtgcagcgcatggcagagcatgtcagctgccacccccgctaccgagagaccacgctcagcctggtcaagactgttgtcatcatcctgggggcgttcgtggtctgctggacaccaggccaggtggtactgctcctggatggtttaggctgtgagtcctgcaatgtcctggctgtagaaaagtacttcctactgttggccgaggccaactcactggtcaatgctgctgtgtactcttgccgagatgctgagatgcgccgcaccttccgccgccttctctgctgcgcgtgcctccgccagtccacccgcgagtctgtccactatacatcctctgcccagggaggtgccagcactcgcatcatgcttcccgagaacggccacccactgatggactccaccctttagctaccttgaacttcagcggtacgcggcaagcaacaaatccacagcccctgatgacttgtgggtgctcctggctcaacccaaccaacaggactgactgactggcaggacaaggtctggcatggcacagcaccactgccaggcctccccaggcacaccactctgcccagggaatgggggctttgggtcatctcccactgcctgggggagtcagatggggtgcaggaatctggctcttcagccatctcaggtttagggggtttgtaacagacattattctgttttcactgcgtatccttggtaagccctgtggactggttcctgctgtgtgatgctgagggttttaaggtggggagagataagggctctctcgggccatgctacccggtatgactgggtaatgaggacagactgtggacaccccatctacctgagtctgattctttagcagcagagactgaggggtgcagagtgtgagctgggaaaggtttgtggctccttgcagcctccagggactggcctgtccccaatagaattgaagcagtccacggggaggggatgatacaaggagtaaacctttctttacactctgaggtctccaaaacatttgttgttatca

SEQ ID NO: 207304 - DNA, 2060 bp, Homo sapiens
caggaggccgcggctcgctgatactgcgagctggcaaagccgaagctgggcgggggtccgggcggtgggagccaagtcggatcagggagtggcttgtaactcggcggccgattggacacgaagaagagagcggggtggggctgggagggttgggggtccggagcgggggcgcggacccaagaccacctggagctccgcccgggcagcgcggggtcacggcgggaattttcgggtcgccgagtgactcagccccgcaggctcgaaactgcgggcgcatgaggtcttattagtaggtaagaaacagctgctcctccacctccaccccagccccatggagcttgctttttccaggccaccgtagtcctcaccactgccactttgcttcgagatggtcatcatgggccagtgctactacaacgagaccatcggcttcttctataacaacagtggcaaagagctcagctcccactggcggcccaaggatgtggtcgtggtggcactggggctgaccgtcagcgtgctggtgctgctgaccaatctgctggtcatagcagccatcgcctccaaccgccgcttccaccagcccatctactacctgctcggcaatctggccgcggctgacctcttcgcgggcgtggcctacctcttcctcatgttccacactggtccccgcacagcccgactttcacttgagggctggttcctgcggcagggcttgctggacacaagcctcactgcgtcggtggccacactgctggccatcgccgtggagcggcaccgcagtgtgatggccgtgcagctgcacagccgcctgccccgtggccgcgtggtcatgctcattgtgggcgtgtgggtggctgccctgggcctggggctgctgcctgcccactcctggcactgcctctgtgccctggaccgctgctcacgcatggcacccctgctcagccgctcctatttggccgtctgggctctgtcgagcctgcttgtcttcctgctcatggtggctgtgtacacccgcattttcttctacgtgcggcggcgagtgcagcgcatggcagagcatgtcagctgccacccccgctaccgagagaccacgctcagcctggtcaagactgttgtcatcatcctgggggcgttcgtggtctgctggacaccaggccaggtggtactgctcctggatggtttaggctgtgagtcctgcaatgtcctggctgtagaaaagtacttcctactgttggccgaggccaactcactggtcaatgctgctgtgtactcttgccgagatgctgagatgcgccgcaccttccgccgccttctctgctgcgcgtgcctccgccagtccacccgcgagtctgtccactatacatcctctgcccagggaggtgccagcactcgcatcatgcttcccgagaacggccacccactgatggactccaccctttagctaccttgaacttcagcggtacgcggcaagcaacaaatccacagcccctgatgacttgtgggtgctcctggctcaacccaaccaacaggactgactgactggcaggacaaggtctggcatggcacagcaccactgccaggcctccccaggcacaccactctgcccagggaatgggggctttgggtcatctcccactgcctgggggagtcagatggggtgcaggaatctggctcttcagccatctcaggtttagggggtttgtaacagacattattctgttttcactgcgtatccttggtaagccctgtggactggttcctgctgtgtgatgctgagggttttaaggtggggagagataagggctctctcgggccatgctacccggtatgactgggtaatgaggacagactgtggacaccccatctacctgagtctgattctttagcagcagagactgaggggtgcagagtgtgagctgggaaaggtttgtggctccttgcagcctccagggactggcctgtccccaatagaattgaagcagtccacggggaggggatgatacaaggagtaaacctttctttacactctgaggtctccaaaacatttgttgttatca

SEQ ID NO: 207305 - DNA, 1738 bp, Homo sapiens
gctcggtaccccccgggcgtggcctacctcttcctcatgttccacactggtctcttgtgtccccagatggtcatcatgggccagtgctactacaacgagaccatcggcttcttctataacaacagtggcaaagagctcagctcccactggcggcccaaggatgtggtcgtggtggcactggggctgaccgtcagcgtgctggtgctgctgaccaatctgctggtcatagcagccatcgcctccaaccgccgcttccaccagcccatctactacctgctcggcaatctggccgcggctgacctcttcgcgggcgtggcctacctcttcctcatgttccacactggtccccgcacagcccgactttcacttgagggctggttcctgcggcagggcttgctggacacaagcctcactgcgtcggtggccacactgctggccatcgccgtggagcggcaccgcagtgtgatggccgtgcagctgcacagccgcctgccccgtggccgcgtggtcatgctcattgtgggcgtgtgggtggctgccctgggcctggggctgctgcctgcccactcctggcactgcctctgtgccctggaccgctgctcacgcatggcacccctgctcagccgctcctatttggccgtctgggctctgtcgagcctgcttgtcttcctgctcatggtggctgtgtacacccgcattttcttctacgtgcggcggcgagtgcagcgcatggcagagcatgtcagctgccacccccgctaccgagagaccacgctcagcctggtcaagactgttgtcatcatcctgggggcgttcgtggtctgctggacaccaggccaggtggtactgctcctggatggtttaggctgtgagtcctgcaatgtcctggctgtagaaaagtacttcctactgttggccgaggccaactcactggtcaatgctgctgtgtactcttgccgagatgctgagatgcgccgcaccttccgccgccttctctgctgcgcgtgcctccgccagtccacccgcgagtctgtccactatacatcctctgcccagggaggtgccagcactcgcatcatgcttcccgagaacggccacccactgatggactccaccctttagctaccttgaacttcagcggtacgcggcaagcaacaaatccacagcccctgatgacttgtgggtgctcctggctcaacccaaccaacaggactgactgactggcaggacaaggtctggcatggcacagcaccactgccaggcctccccaggcacaccactctgcccagggaatgggggctttgggtcatctcccactgcctgggggagtcagatggggtgcaggaatctggctcttcagccatctcaggtttagggggtttgtaacagacattattctgttttcactgcgtatccttggtaagccctgtggactggttcctgctgtgtgatgctgagggttttaaggtggggagagataagggctctctcgggccatgctacccggtatgactgggtaatgaggacagactgtggacaccccatctacctgagtctgattctttagcagcagagactgaggggtgcagagtgtgagctgggaaaggtttgtggctccttgcagcctccagggactggcctgtccccaatagaattgaagcagtccacggggaggggatgatacaaggagtaaacctttctttacactctgaggtctccaaaacatttgttgttatca

SEQ ID NO: 207306 - DNA, 351 bp, Homo sapiens
tggagaccactccaaccccaaactgagagctgtaggtgccgggcctctgacagcttgccctgctcacttccgcctctgtcccacaggggcgttcgtggtctgctggacaccaggccaggtggtactgctcctggatggtttaggctgtgagtcctgcaatgtcctggctgtagaaaagtacttcctactgttggccgaggccaactcactggtcaatgctgctgtgtactcttgccgagatgctgagatgcgccgcaccttccgccgccttctctgctgcgcgtgcctccgccagtccacccgcgagtctgtccactatacatcctctgcccagggaggtgccagcactcg

SEQ ID NO: 207307 - DNA, 1799 bp, Homo sapiens
caggaggccgcggctcgctgatactgcgagctggcaaagccgaagctgggcgggggtccgggcggtgggagccaagtcggatcagggagtggcttgtaactcggcggccgattggacacgaagaagagagcggggtggggctgggagggttgggggtccggagcgggggcgcggacccaagaccacctggagctccgcccgggcagcgcggggtcacggcgggaattttcgggtcgccgagtgactcagccccgcaggctcgaaactgcgggcgcatgaggtgtgcaggtaccggggtgggggtcccgcgccggaaataggggcgactgaggggccgcgaggcggggaggaaacaggggggctgcggttccgggcgacaccgcccccgacgcggccgtggaggcggggctcccccaggtggcggggcggggcagggctcccccaggtggtgggggcggggcgcctggggagaccccgcctcccgcgccctctcagcaacccgcacagggcgcacccggacgctctaccgctcccgccgcagtcgccgggccatgggcctcgagcccgccccgaacccccgcgagcccgccttgtctgcggcgtgactggaggcccagatggtcatcatgggccagtgctactacaacgagaccatcggcttcttctataacaacagtggcaaagagctcagctcccactggcggcccaaggatgtggtcgtggtggcactggggctgaccgtcagcgtgctggtgctgctgaccaatctgctggtcatagcagccatcgcctccaaccgccgcttccaccagcccatctactacctgctcggcaatctggccgcggctgacctcttcgcgggcgtggcctacctcttcctcatgttccacactggtccccgcacagcccgactttcacttgagggctggttcctgcggcagggcttgctggacacaagcctcactgcgtcggtggccacactgctggccatcgccgtggagcggcaccgcagtgtgatggccgtgcagctgcacagccgcctgccccgtggccgcgtggtcatgctcattgtgggcgtgtgggtggctgccctgggcctggggctgctgcctgcccactcctggcactgcctctgtgccctggaccgctgctcacgcatggcacccctgctcagccgctcctatttggccgtctgggctctgtcgagcctgcttgtcttcctgctcatggtggctgtgtacacccgcattttcttctacgtgcggcggcgagtgcagcgcatggcagagcatgtcagctgccacccccgctaccgagagaccacgctcagcctggtcaagactgttgtcatcatcctgggggcgttcgtggtctgctggacaccaggccaggtggtactgctcctggatggtttaggctgtgagtcctgcaatgtcctggctgtagaaaagtacttcctactgttggccgaggccaactcactggtcaatgctgctgtgtactcttgccgagatgtgagggttttaaggtggggagagataagggctctctcgggccatgctacccggtatgactgggtaatgaggacagactgtggacaccccatctacctgagtctgattctttagcagcagagactgaggggtgcagagtgtgagctgggaaaggtttgtggctccttgcagcctccagggactggcctgtccccaatagaattgaagcagtccacggggaggggatgatacaaggagtaaacctttctttacactctgaggtctccaaaacatttgttgttatca

SEQ ID NO: 207308 - DNA, 549 bp, Homo sapiens
tgaatccaggtctattgactcaagtctacatgtaaaaaactgcaagcccatactcccaaatttacttcctgcttccacttcctgctttatttttcccttctcaccattgaatatacctatacatttatttattgctttattgccctatctgagtggaaagcaagcaccatggaggcaggaacttcactcattttggacacagctgtttccctagggtctaacaccgtgtctggtagtgcctgatccagagtaagtgctcaataaacatttattaaatgagtaagttgatgaatgatggttaaataaaattataagggcattctgggaaacagttacgagaaagaaaataaatgaactatttttccacaagacttctctcatttctgttggtttatcctgtggactgaagccaggtcctgaaaatgtctgtttgtaaaaaatagtaggatgatttgcacatgcattaaaactgatgaatatagaagtggaaaggcttatccacatgactgctatgagcggaagtgagactgttttaagatctttctcaaa

SEQ ID NO: 207309 - DNA, 651 bp, Homo sapiens
gaaattaatatattggaaagtgctcagtgctacggagaaaacaaagatgaagtggggataggaaatgccgggaggtagggtcaatcgcagattgaggcaaaggggtcagggaggtcccaagatgggggacatttgtacagatccctgaaggaggtgagggtggtgactacgaggaatgtcaggcagagggaatagcaaggggagaggcccggagtggaggttcccgagtgtttgagaacctgtggaagctggtgtggccgagtaagttagggggagagtgatggtgatgcacccagacaaggagcaggaccaaggtcacataaagtcaatgcattaattcacctttcaattcattcattcacttactcaacgaatcttttgaggctctactgtgagccaggacctgctattttagatcctgaaaatccaacattagacgtgacaggcaaggtcccagctctcacggggctgtgtaatggtggctgatccgggagcaggagggaagttactttgttgaggtgagtggggaagcccaatcgccactcgcctctaggtccacaatcccagcagaattccctcttttgtttgctcttaggtgattcttgtcttccccataagcccatttagcagatgagaaaactaaggttcctt

SEQ ID NO: 207310 - DNA, 629 bp, Homo sapiens
agacgggcaggcaatatataagatctgagtagctgggcatggtgtcgcatgcctgtaatcccagctacttgggaggctgaggcatgagaaccgctagaacctgggaggcagaggttgcagtgagccgagaccacgccactgcattccagcctggatgacagagctagaccccgtctcaaaaaaaatctaagaacaactgactcagttctgcagtagagctcaatctcctcaggtagatgtcaagttctcttcctaagatctatatggagataatctagtccagtgctgtccagtacaactttctgcaatgatggtaatgttctatttctaaccatgctagcccaatagacacttcaaacacagataatatgactaagggactcaattttaaaatgtatttaattttaactaacttgaatttaaatagccacatgtagctaatggctactgtactggatggcaaagttctggtctacaccttcatggcagacctaaaatcaaagtagcgtcgaaatgctaaaacaatgcatagtcagtaatttccctatctgatatgctacagaaaaatttaaaaaacaacaaaacactttttaaagagtaatctatattgcctcccggggtcctcttct

SEQ ID NO: 207311 - DNA, 806 bp, Homo sapiens
gatattaataagcccccattctcagtgactctgtccttcccacaaagcccaggcagcctctctgaactgaatgacactctccacaaccctgccatagctgatgggactaaagtgaatacccaactttagctgaactattccagttctttctcttgaatttaaaagacagagactggctgggcgtggtggctcatgtctataatcgcagcactttgggaggccaaggtgggtggatcgcctgaggtcaggagtttgagaccaccctggccaacatggcaaaaccccgtctctagtaaaaatacaaaaagtagccaggcatgatggtgggcgcctgtaatcccaactactcgggagactgaggcagggaggacagcttgaacccaggaggcggaggtttcagtgagcacagattgcaccattacgctccagcctgggcgacggaatgagactccatcataaataaatacacacatacatacatacaaacaaataaaagacacagactaagggaactgggtgataatgaccctggagaagtaagatcatagtaagcttcagagcgaataccatggcaagccaaagatccgtacgagccaaagatatggagaataaaaaaccaagagcctttcagaggaagtgattctgcaggaggaatccataaatatctaaatgaactgaggccagaaatcagaaagagatggaaaagccattacctgctaactttccagattatgtggctattacttcctatgctcggggtacctgaaagtccactgtatcctgccaataaaactcctataaattaa

SEQ ID NO: 207312 - DNA, 298 bp, Homo sapiens
ccaatgacccactctgtccagatgaacagcatgggctcagtgctagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagtactcggaaagacagcaaccctgcagaacaacagcaaccctacagcttcccagcctaccactcgtccccctgctgcttctccagcctctg

SEQ ID NO: 207313 - DNA, 314 bp, Homo sapiens
catgacaatctcctgcaccttactccccctgtttccccatcctccaatcctaggtttcctctcttcaatctttaaacatagattagattgagtcacctgctcacctccggacaaattatgggaacacaacaaactcgctggcttattccaaacacaacattccccagagctgatatagggctgatgtatgcgtgtacatgtaagtacaggactccagaaggaaaaacgaaagaatggctgataagcaaacctccttctctataaagttatttggttagagcacttcataattatctgctttccagggaactcct

SEQ ID NO: 207314 - DNA, 765 bp, Homo sapiens
atgatggtgaggcatgacgaggggacaagctattcaaagaagagaaccatagctcagtttcaggcccagcctgagagctgccattttgcataggatgctgaaacgcctgggagtcctgaccatttgcatagatatttgcaatcctgctttccacaccagcttgaggaatgaaaactctggagtggtacccatagagacagcctttccttccccacactgagccaataagcaatgtcattctacccaagatgagaagtcaatggcttaacatgacataagctgctatacaaaacaaaataaatatcggttcaccaagtttgggtcacttaaaattgcacgggcctaaccaatgcagggaaaatggccttcaatgcattctatgaaccagagaattggagtccccagtagtctgtgttctttttctccagagaggcgtatatttatagaaggaacaaaaccccatgcaggatgagggggctggctaataatatgtgtgaatacactgatctgtctgaacagttcttggctgcctgcgctcaatggtaataaatatccactgaaagccgtctgctgtatgtgtttttggtaacgtctcacacttccctgcatgaatacattcagaatgtaagcagcacacactcaacgatagagactctgttgtattccgaattcttaagttatgcagcttagcagctgtgataatgtaatggtttgcaaaataatagactggcaagacgtcaacctggaataacacatcatataatg

SEQ ID NO: 207315 - DNA, 382 bp, Homo sapiens
ccttctataccatccttgtagaggtttaccatgaggctctgtctgttggaaaagcttcgcctggaaacccaggattttccatacatactctggagtctagaagatgaagactccaaagtttctagtcttgtgctctgtgcacctgctgacttaacactatgtggaagccaccaaggcttggagcttgcacccctgaagcagtgacccaagctgtacctgtgcatctttcagccatggctgcagcaggagctacagggatgtaggcagcagtgtcctgaggctacacacagcaggggaccatggggctgggccaggaaaccattctgtcctagaaaaccattcttctgtcctaggcttcagggcctgtacagcaagggctgct

SEQ ID NO: 207316 - DNA, 241 bp, Homo sapiens
atatagaggataccccattgaggtaaggttaccatgaggcttgcagagactatctttaacccattattttaacctgataacaagcttcacactgcctgcataacaatataaacgaaaacaagacttaaaaaaactctacactttaaccttgtccctctgctttttaactttttattgtttcatatctttttgtgctatgtcttgaaaagttatagtcatttttgactggttcatcttttag

SEQ ID NO: 207317 - DNA, 243 bp, Homo sapiens
acaatagtggtggcaagctctcagataaatagacacacaaaaaattaatttagtaaacacaacagagttgctctgattgggaataggctacatattacactatgaggaggtgtttacataaagatatgtattttatcatgtagatgtctagaactcccagcctcaagcattcctcccacctaagcctcccaaagcactgggattacagacatgagccattgcacccagcctattatgcagatg

SEQ ID NO: 207318 - DNA, 834 bp, Homo sapiens
aaaaatggaatgcagtgattacatttaaggagatagatgttaaaactgtaagaataatttgaaaatgttgcgatcataggttatcaagaaaaaagtcatttaaattaaatatctcaaaggtatttggtaaagtttaatacccattcataataaaacattttaaaataagaaaacaatgcttctttagcacgataaaagaatattggccgggcgcggtggctcatgcctgtaatcctaggactttgggaggccgaggcggttggatcacctgaggtggagagttcgaaaccagccatgaccaacatggagaaacctcgtctctactaaaaaacaaaattagctgggcgtgttgccgcatacctgtaatcccagctactcgggagactgaggcaggagaattgcttgaacctgggaggcggaggttgcagtgagctgtgatcgcaccattgcactctagcctgggcaaagagagccaaactctgcttcaaacaaacaaacaaacaaaaaagaaaaagaaacatctctttcacgtgggaacttaggatataagaagattgggagaataatgggctagcaataaaaggtgttgagacaattagctatgcacttgtgaagataaagtcaagtccctactttatactctgcactaaaagaagtgcacttagatccttttgcggttcataatgtgatgactaggttttcatgtccatgtgtgaagtgcgccttcctccaatcctgttaagatgtcagcacatttgccttctgacaggaaagaaaaaaaaagtgaaataaatgagcttatttttgtggcttaaggggccaaatgggaacaca

SEQ ID NO: 207319 - DNA, 358 bp, Homo sapiens
ggggagcagaaaggacatcagtgtgtctggacctctaggatcaaggccagaggctgtgctgtgagttggagataggtaaaacctagagggccatggtaaggaatttggattttatttattttaaaatttttttcccataggttattgggatacaggtagtatctggttacataagttctttagtggtttgtgaggttttggtgcacccatcacccaggcagtatagactgtaccatatttgtagtattcttttttctttcttctttcttctttcttccttcttccttcttccttcttcttccttcctcttcttccttcctcttcttccgtccccttctgccttcctcttcccctcctt

SEQ ID NO: 207320 - DNA, 672 bp, Homo sapiens
aattttcatgctgcagtatcctctgacttctttgtagtttagaaaattaactgtccaaagcgctaactgacaatcaatctggaactgaaatagaatctctcatatgaatcccatccaactggttcctctggttttgttgctgagcaaaaaaagaaaaaaaaaagctctgccctgcggagggatggcacctgctgttttgagctgcgagctccatgggggttccctcacactccccactgttctcctacttgcttcatttcgtctatagtttgtctccattgatataatctcagagacaggacacagagtgcctgcctaagattcctcagaaagatgagtccagaaaaaagatttacagcaaaagaaatcaactcatacttggaatcttagcatatcgcttcatcccgatagaccaatcttttatttttttaattaattaattattttttgggacagggtcttgctctgtcgcccaagctggagtgcaatggcgcgatcttggcttaccacaacctcggctgatccttctgtctcagcctcccaagtagctgagactacaggcatgcaccaccaggcccagctaacttttgtactttttgtagagatggagtttcgccttgttgcccagactgatctcaaattcctgggctccagcaatccacccacctcagc

SEQ ID NO: 207321 - DNA, 359 bp, Homo sapiens
ggtgccgtaagtagatgcggagaagtgtggccgctttttaatgcgaaatctctggggagttctcaccaaatctgtctagaaagtaaagaagttcctcaggtgggtaaagacaagggctattaaagaaggttcagaggtgtagggagacaggagaggtagctcagtcagcctgtagagcggggacggctgcataagagcaggaagaaagggaaatgcatagccaacaattttttactagagaaggattggaggcagtgaggagagagtgggtgaggttgatactatgctggaggtaactagggagaggtagagagtgactggagaataggggcaaggataagagtgagtagaaaagtaaa

SEQ ID NO: 207322 - DNA, 361 bp, Homo sapiens
gtctgcagcattcattccttctgggtatggaacaggaccctctggaatgggggctgtggcctacaacagttaaacaagtgaactaaagggctcccaaaatctctcctgcagcattttccttgagaaggaggaaggtttgcatctctgtgagaagaaacatcagaagcagttgaaagaccaggatgtgggtcctctggggctgaggaggcattctgaatcaactgtgtgttctacacctgtgttttaactgtgacctgtcacatgaggacaagtgtggaatttcccacttttgtgccatgtcagtgctaaaaaagttttggattttggagcatttttaatttcagatttttcagactaggaa

SEQ ID NO: 207323 - DNA, 483 bp, Homo sapiens
cttcaatgtagaatctctaaatttcatcccccatcacctcacctatcaaatcgagaccttattctgattcccctcatctctttatggaaagctttgtttctaacatgtagggtttggggtattggcatgatctcctggtttgagatctcctggtttgagatcaaagtgagactcagagaaaactgggacaaagagcaacactgaggtactgccccaaaagagagtacagaaagaaaggcatgatggtaggcggcgaacactgttcccagtgctgaatcctcaaggctagtaacagccaagtgagtaatcagttacccacccctgccaagctggttgcctgaaaaggcttctaagtttatcattcttttaaactatcatttactgactatttaccacagacctgtgctaagcatatcatatctgatatggcttggctctgtgttctcatccaaattataatccccacatgtcaggggagaagga

SEQ ID NO: 207324 - DNA, 403 bp, Homo sapiens
gggtgaaattaaattatgaatgtcatgcaaataaaagtgttagttgaaattttaagaggaggagaatggttcccgctgaggggaagggggaagtgatgtttgaaatatgctttgaaagacacatagcatttgaacactgacgactcaaagaacaaacaagaatatgtaagaacattgttaaaataaagaccaggaactacatggggacactcaattatttggtgaagggaatgtcataggtgtgagaagagcattgataaaggaatttgaaaaaaagaaaacaaaaaccatcactgggacagactgaggagggattgaatgtaaggctaaggattctaagaagttccatgaggtttttcagaagttctgccctgttattgctattactttgcgtattctgcca

SEQ ID NO: 207325 - DNA, 348 bp, Homo sapiens
tatgtagtttatgccttgagagtacacaggatgtactgtatagctgtcccacacaggttaccacaagctttgttagtttggtggcagatattaaagaaaaatgataacattcagggttcaagtatgagagagaacaatgggaattatcaggcaagactgggactgaattgttaaatgttactggggcagttggcaagattcactgaaacctatatacgtgcagcccaggatgctgcatttagagtcctacagggttacttacaaggagactcagtaagtgcacaaagtaaacctacaggaggtcttttccatcactgcacttctggtggagctcaggaaaatccatca

SEQ ID NO: 207326 - DNA, 289 bp, Homo sapiens
tagttttcatatgtgtttagcccttttggagggaggatagagtaaataaatagaaggcactaagctttatggatgaatatgggaaatatggctttgcctgctgaaagcactcaggccacagggcctgcctacctatgctttcctcatcccggcaacagcagtaatttgtttcttgatacgtttttggatgttcataattatagaaaataaatttgcctttatgatgaaatttagtacctttttttttgaaagttcatccagttgtttatgtaaaaagaattgagtgagg

SEQ ID NO: 207327 - DNA, 456 bp, Homo sapiens
ggaaagctgggtggaggaagagctcccaaatccaacatggaattctcttggcgacaactccccattgaagaatgttcctttcttctggagaaaggagggcacctttcacgtgggagtttttgtctcctgttttccgggaaagaaggaagatcagagtgccctcgttgcatctgctgttttcaagttgccttagcttgagcctgctcatcagaattagccacatgtccctgagccaactacaatggagcctggaatatgcaatcttccccagcatctgggagaggaaagtgaacatggagcattgtcttggctgtggtggccaacaaacattgggacagaacttgattgtaggggcaccagtgggaggcgagtgttatgatccgatggcttcacttgtgatctattcttcatgataatataggctaaacctgagccctgggctccaggacaggcagt

SEQ ID NO: 207328 - DNA, 352 bp, Homo sapiens
tcagggtctcccccatggagaagaaagccaggtgacctcacacctactttgctgtgcttcagccaagaagtaacccacttgattttaacttacagcctgctcatcagaattagccacatgtccctgagccaactacaatggagcctggaatatgcaatcttccccagcatctgggagaggaaagtgaacatggagcattgtcttggctgtggtggccaacaaacattgggacagaacttgattgtaggggcaccagtgggaggcgagtgttatgatccgatggcttcacttgtgatctattcttcatgataatataggctaaacctgagccctgggctccaggacaggcagt

SEQ ID NO: 207329 - DNA, 841 bp, Homo sapiens
cagttttttgccctagcaggtatatagctgatttttcaataacttgtaattttgacataatttcagacacgattgtatttgctttataattctagctacatgttatttttttcatgtactaaagtgcagacataatgccccctaacctctaaatagttattaacaacaagtacattctctttcataaccacattgcaattatcaatgtcagaaaattaatgttgatatggtactgcttgctgtctaatgtgcatactttgagctgggcttggtggtatacacctatagtcttagctactcaggaggctgaggtgggaggatcgcttgagcctaggagttgaaggctgcagtatgccatgatcaaccctgtgaatagccactgtactccagcctgggcaacaatagtgagatccctatctttaaaaaaaaaactgcatattttactgaaattttacctattcttttctaatgccaattataaagcaaaattctggttgaggatctcatccttgatcacatggtacatttgtttgtcaaatctcattttctttaatctgaaaaagttctcacaaacattgtcttttatgacttaattttttttaaagtacagaccatttattttgtattaatagtaagttctccaatatggatttgtcttgatgcttttcattattaaagtaatgtttttgacaggaatacctcagcatgtcctcctcagtacattttatcaggagacacgatacctgtttgtctgatttctgataacgataacttcaaacacttggttaaggtggtgtctgccttatttctctcctataaatagtaccttgtagagagatac

SEQ ID NO: 207330 - DNA, 263 bp, Homo sapiens
  misc_feature (2)..(2): n is a, c, g, or t
  misc_feature (20)..(20): n is a, c, g, or t
  misc_feature (31)..(31): n is a, c, g, or t
  misc_feature (33)..(33): n is a, c, g, or t
  misc_feature (36)..(36): n is a, c, g, or t
cncttgctgcctgcagtttntaggggggggngnggnctttcctcccccttggggtttcaccatgttggccaggctggtctcaaactcctgacctcaggtgatccgcccgcctcggcctcccaaagtgctgggattacagtcgtgagccaccacgcccagcctgatcattcttttcagactccaacataaagtcatttttctggttcctcttatttcaaatttaaaatgctaatgcctgaggaaaactgtttgaatcttgcatg

SEQ ID NO: 207331 - DNA, 489 bp, Homo sapiens
tgagctccctagacctccatccacccagataggtttagctgtcccgtggggactggccccgtggacctctccctccgagcccagatggtggccaggacagccaggcggtgggaggcgccccacaggcccctagaagatgagagaccccaatggggaggagatacctacccccctgggggcacggggagtgctgcagacaggatttcctaggacgagagcttttccaccggctccctctgggcctggggagccttcatcctcagtcctgaaatgaggtggtcacccctgaccagggggctttggctcctggtatttcccggtctgtcacgaaggtccttttcctttaagtgccggccagagcctgagcgctccgagggagccccgtctggccgccttgccttcagcaaaccgagtggttttatctggatacacacgtgcatcttgtatccaagtatgtagaattgtaaaaatgaaagaacgatctgtaaa

SEQ ID NO: 207332 - DNA, 410 bp, Homo sapiens
aagggccccccccaaaaagggggccgcggtgggaggcgccccacaggcccctagaagatgagagaccccaatggggaggagatacctacccccctgggggcacggggagtgctgcagacaggatttcctaggacgagagcttttccaccggctccctctgggcctggggagccttcatcctcagtcctgaaatgaggtggtcacccctgaccagggggctttggctcctggtatttcccggtctgtcacgaaggtccttttcctttaagtgccggccagagcctgagcgctccgagggagccccgtctggccgccttgccttcagcaaaccgagtggttttatctggatacacacgtgcatcttgtatccaagtatgtagaattgtaaaaatgaaagaacgatctgtaaa

SEQ ID NO: 207333 - DNA, 530 bp, Homo sapiens
atattataaaccaatggagcccttcttggaagctaatacaggaggtaaagaatgaaagtaattttatgtgctagtaataagcccatctgtattgctggcaagcacttctaggggccaaattggacgtgactcatttctatgaagttaacttgtggcattgggcctcaaacagtagagtcacttcatcattgaatgggagtgaataaagacactctcaacaatgagacacatttacaaaatgaaaatcaggctattgtgaaatctataaaagattttctttcataaatggagtctagatagtgatcccagattatcatgacaatttggttacttgttagatatggaacatcagcgtctatttgggggggatatttatttacctcagtttgtattgaaataaaagttcaaatattctgaaaatgatgcaatgtgatggaactttgatccaaatataaaatctaaggctgcaatctaagtgtacagcaagtggaaacttctcaataaatggatgttagatcaaaatagtggtt

SEQ ID NO: 207334 - DNA, 298 bp, Homo sapiens
ttgtcagtgacgaagttctagggcctcagccactcatatcgccagagtagcacatgctagggcgtaggatagtggctcggaagggccaagccccgcgcatcgtgcgtacgaagatctgtgtcttcttggactagatggtgaagcccagtagctgggtttcggaggagagaggacttgtcccggcgctgcgagtcgatgtgggtgccctgccttcccacaggctgtttctggggcagcggcgcactgaccttcgacaggcgggcgtcggccaggtcacagccactgacaaggtggcggg

SEQ ID NO: 207335 - DNA, 270 bp, Homo sapiens
ttagttcagctctgatattggttatttcttgttttctgctaagctttggggtttgtttgcccttggttttctagttactttagttgggatattaggttgttgagatctttccagctttttgatattgtcatttagtgctataaatttccctcttaacactgctttagctgtgtcccagagatgctggtatgttgtatttgaaatttctttatataatttaccatgttaaatataacttatagctaataacttcggaatttgaacctcata

SEQ ID NO: 207336 - DNA, 424 bp, Homo sapiens
ctgggctgtaatttacggtgctatcacaaaggggtcctttttccgcatggtgctctgcggtgatgagccagaagctgaagctgaggggtgtgtgactctcccgcacactctctggagtgagcagaatggacgcttaaatggctaagtatagcttgaaactgattacaggccagatcccactattgtgcatcatcagttgtcattgttgagactgaaattgcactgggatgtttctctttgtcaccggctccaagctcatttctaggacaggagtgaaaccgtatggtgagcctcgggcccaagcacagggagaattgttcttctggtgtgtcccccaaggaagagcttggcaggtctttggcagtggaagatgggctggcttcagtcatgatacctataacattggtattgctagggcttccag

SEQ ID NO: 207337 - DNA, 355 bp, Homo sapiens
tagatgaggcacttaggtcagcagtcataaagtgacttgcactagggccacaaaaaggatttacatgtcttaacagtcaaattttttagtagcttcaaaaaaactggcttttttgtttcttaaggaaaaaactgaacaatttgtaaattggtgatttaaattggtatagaaatcagaaatttggattatggtagtcatgtttttgaacaaatgtccaaacattcctagaaggcactcttgaggtaaatcagttaatttaaaaaaagaaacgagagatttttattaacaaatattaatatttggaaactctagtacaaattattggaatagttaaataaagttataggtcttgcct

SEQ ID NO: 207338 - DNA, 825 bp, Homo sapiens
gaggcagctgttattagtcctaggtttaagacaagcctcaaagatactctacaggggcctgaatttaactggattaaactgcggcgacttgtgccccagagcattgtcagaaacaaaagagtggccaggtgtggtggctcatgcctgtaataccagtactttgggatgcggaggcgggaggaccacttgaagccaggagtacaagaccagcctcggcaacatagtgagaccctgtctctataaaaaatgaaaaaaaaaatgagtggttagctagtaaattagtgggtgctaatagtaggatgtgataacaaaagaggttctaactaactagaacctttcccgaaagatcaggaaaaggtaaaagagagccctatcaaaaccactgtccttggggctagagggagtagtcatggtgactgcacacgcccagactgtactctgaggagggacatcagagcctgcatacttcagggtaagtggacttaactgaaatcatccagccaagaaactaaacaagaagaaatgcgctggagggcagagggtaggggttggagggaaattactatccagagctgctgtgacacagtgtctaaaatatccagtcctcaacaacaaactacaagacatacagaagaacaggaaactaatccatacaaggagcgaaaaagcaatcaaaggaaactgagagggtcaataggttggaagcagataaaaacttcaaagcattattataagtgtgttccaaaaaaaactaaaggaaactgctggaagtaaaggaaggtatgcttacaatattccatcaaacagaatatcaacaaagaaagg

SEQ ID NO: 207339 - DNA, 814 bp, Homo sapiens
gactccagctaaagccgagagaagccaagtgcaggatgagcaagttccaggcagtgggaacagcctgtgcaagctctgaggtggccacgggctggcacatggaacggagggcagagggactggtgcagcaggaggggggacggcgggaaaacaggagcctggagggagagggaggagacggtccgcagcgcctgctggctgggagggatgcagattctgcccaagggcagcaaagtaccccacgcaatacacaggctcttcatgctggtgctggtttttcattttttctgacacagagtctcgctctgttgcccaggctggagtgcaatggccagatcttggctcactgcagcctccgcctcctgggttcaagcgattctcctgcctcagcctcctgagtagctgggactataggcgtgcaccgccatgcccagctaatttttttatttttagtagagatgggtttttgccatgttggctaggctggtcttgaactcctgaccttaggtgatccgtccacctcagcctcccaaagacctgggattacaggtgtgagccagtgcacccagccttgtgctgggttttaaagcagctctccctatatctcatgcttcaccacctaccagagtgaggctcagggtgaaactcagagcaaggtgcaagacaacttcaggtatctccatgctcgaagccctgacctactgtattgccccgaaagtcttccctgctgtggctgcatcttttccacgtggataatcttggttcacctctagcacaggaattcttttccggggctcctaggatgggctgggtg

SEQ ID NO: 207340 - DNA, 384 bp, Homo sapiens
tgaaaaccggtgatgctagagccatgacctgtgtcttcttgctgtcatgtcaggtgttgacatgacattgatggctttttggagaccctcttgaaacggtttgcagcaagaccatattgacatccactagaatcccagaagcgagtggaagactgtgttcttgcacctcaccggaacagactcttcctagttcccggcggagcgtggtgggggttgttcctctgccagtggctcagcacacatgcgcatgtttctaaatatagactgttgatttcaggaaatagaattttctgatttgagtgaagttgaaaggtttaaatcaaaatagtgaccagaatatgtattaatgtcatgaagactgattacatgcaaaaataagaattc

SEQ ID NO: 207341 - DNA, 366 bp, Homo sapiens
catgaatagagatgctcaataccattatttcattagggaaatacaaaataaaagtgattagtgagctatcactatacatttatttaaatggctctgattttcaaaagactgaccatattaaatagtggcaaagatgtagaacaaatggaactttcatatgctgctggtgaaaatgcagaatggttcaactactttgggtggggtgggggaggaactaacaaatacgaaaaatttatataaagaaaaccttagaagatgcctgaccaaaattttgattcattaaaaaaatagagtggactttgtcaaaattaagaacttctgctcttcaaaagatactggtaagagaacaaaaatacaggtcacaga

SEQ ID NO: 207342 - DNA, 615 bp, Homo sapiens
ggtcatttcttttacccactttttatgctgaaaacttcaaacctactaaaaggccgtaaaaaaatacaatgaagtacattcttccttcttcatctaaattattcagtctctgaccaattgttaacattttgccacatttcctttctctctttacacatacttgcacagacacaatttttctttggttaacaatttgaatgttacttgcagcatcatgacatttcactcctaaatatgtcaacatgtaccccattaagaagaagagtattttcctatgtaatcagaataaattatcactcagaaaatttaatattcatattacaccattcaaatccattctacaatttctccagtcaccctaataatgtcctttagatctgttttgtcctccagtccaagacccaatgcaggatccactgcacaacacagttaatttccatgtctcgcctttaactttctgtctgtctgtctgtctatctacctacctacctacctacctatctatctacccatgtatctatctagtctttcatgataccaactactagcatttttgaaggcagacaagcttccctaaggaatgcagacaggtgcagcgtagaatggggacctcta

SEQ ID NO: 207343 - DNA, 920 bp, Homo sapiens
ccctgtttctacagaaaaaaaaagaaggaaaaggaattgcttggtcaaaggctatgcatgttttacattttagtacatgttgttgaactgtgctccagagaccatattaataaacaattccttggttgattgtgaatattcttatgtactggggcaagtgactgaaattctctaagtctcatttaatttttctgttcaaaataggaataatagtatctaccatttaccttactaggtagctgtgagatacaaattaaataatacatgtaaatacttttaaaaaatgaaagtgctactgtcacgtatagtattcatactatgaagccatccgttgttggaaggatgaaagtcagagaccctgaatcctctgtgatcttagtttaacactcaaaataaggaatggtggtaacatgagctttaaagacttcctcatgggaaagagaatcctagcttcagaaacataatttattattgtagacataagcacaccaatatgaatgtaggattttccattcaaggacatttagagaagtgggataatttttgttttaatctgagaattgggtaacatatcatccagctccactcctcattctacagatgagaaagcagaggccccgagaagttgaattctcatgttcaaactgctgacatgtggcagaatctaggttagacctcagccctctgaccctctatccagcgtcctttcctctatatcccacagctctaatgatatagtcacgaggtggcgggattttttctctatccctcagatgaaaattaagccagtgttgtaatctagtttgataactattagttatctagaagtgtattcttaaaatcaatgcctgtataggcttactgggctatttgaaagtcaggctactaaattcttattagccacttgaaattcctgtgga

SEQ ID NO: 207344 - DNA, 203 bp, Homo sapiens
agagagctaaagagctcccaccacacagaggcaaatatgttaaattctgtcacccactaagacagccattttgactaagagtgatcttggttctaggggctgtgcttcccactctgcgacttctggtaaggcccacatacatcttcttgccaggaaagtcaaccataacaaagccctagtgccagtcctgtcaggggctgggt

SEQ ID NO: 207345 - DNA, 425 bp, Homo sapiens
cgatgaccttcatctaaagggacagtgcccatgtacacacatggttggcaagcagtagggaatatctgacgttactgagctcgttttctgaatccggcatattttccaaatggatgaataaatgaacaaatgggaaaccccagcaccaacaaagaacacgcaagaaaatgatcagccagtcccacgtggatgtaaaaatcctaaatacagcattagtgagtcaagcacagtaggctattgcaagaccaagaagagtttatctccaaggttgcaaagacattccaaaaattaatatctatcaaaaattccaaagcatttggtacaaaaattctcaggcaaccaggactagcagggactctcccactaccaccttcatggcgaggcaggagaggacacaacctgcccatcatcacagcacacgtcac

SEQ ID NO: 207346 - DNA, 247 bp, Homo sapiens
gattacaggtgtgagccaccgcgcccggccaaaaaattttctaaaaggggggtgtgcactggagtcagaatgtttgcattcaaatacttagatatcatctctctaaatctttcccttattttgtctggaaaatgagtgagataacattatatttcttgagatggctgatgtgatgtagattaaatgagatatttactgtggataatacaataaggtatttcacaaaatgcctggcacacggcacccg

SEQ ID NO: 207347 - DNA, 389 bp, Homo sapiens
tgccagatcagaggtctcactaaaagtaagcaccagaggcatccataaagaaaacaatgttcaccaagaaacaactggaagatttagagatgttattcattaagaacccatacccaaactccagtctttagaaagaatggcctcaaaaactggcatctctccaacagtactacagatttaattcaagaacctcagagcaaaactcaagaaatgaaaatacaaccatattcaataaaaacaacagaagactcaacaataacaattactttagggaagagtggagagaaatattggcacaccacctggatccactaccggtgccagccctgcctctccaatttctataaatcatctggcaccttcagtccaagttagcatgtcccagtttt

SEQ ID NO: 207348 - DNA, 338 bp, Homo sapiens
gggaacactctttcaccctgcttgtgctgtgacatccttgggccctgggagctattcctactctggcatgggtgcctacttgttctgccaaaaaggaaggagtgtacccattccactctctgcagtttaacattagagaaggtaaactaggaagtacagattttctttttcattcaccccaaatcccaggattgtgggggagcattagaggctgtttaattaaaaagaaaaaagaatcatagaatatcaaataacctggagaaagaaatgattgatggacaaaatttcattatatttgagcacttagtttattgttactcagaaaagccacctctgat

SEQ ID NO: 207349 - DNA, 222 bp, Homo sapiens
tcttaacttttatgtgatcaacgttttacatgagtgagatcttgtggtattcgtctttctgtgcctggttcatttcacttaatgtaacatcccccagatgaatccacgttgttgttgcaaatggcaggatttccttttgtaaggctccatcatattccactgtggatctacacattttcttcatccattcatctgaagctgggcacataggtcacttcctca

SEQ ID NO: 207350 - DNA, 394 bp, Homo sapiens
agaagttagctaaagagaaaaaaaatgcaaaaagaaggagtcatggaacatcaggaaggaaaaagaacacagtggatccaatattatcacaagggtccttataagaaggactcaggagaatcagccacagaaagagaaaatatataaggatggaagcacaggatagagccaagagaaggtgctgtgcactgctggctttgaagatggaggaaggggctacaaaccaaggcacgcagtcagcctctagaagctggaaaaagcaaggaaatggattttcccctacagctccagaaggaatacaagccagccgacaccttgatttcagctcagggaaactgattttggatttctgactttcagaactgtatgataaattcatgttgttttaagctgc

SEQ ID NO: 207351 - DNA, 956 bp, Homo sapiens
taaaattttttttcaaaagaaaacttaaaagcattcattaattaaaaaatttatttagcacctgcaatgtgctggcattcttctagatacttgggaggcatttagtaagcaaaacaaagatccatgccctcatggagctttaattccagtggaaagagatagataataggcataacacattgttaaattagttgtctgtgttattgtgtgaataaaaagaatcaagtagtggccagtgaagtcttagatattataccatgtgagtatttatgcggatatggttttccccacaaccttgaggaaataatctattttggttgcttttgtagtaaacaatggtgataaatggctaagggtctaggataaagtagattgtggcattaatgtatgtgttatgatgtggcatatattgagcatttgtaagtttatagaaataaactgattgttctctcaaaaactggttttgacacaggtttgtatataactggttattcagtaatgataattttcaaagttgtcttagtctatttgcactactacagcaaaataccatagagtaggtagcttataaagaacagatgtttatttctttctttttttttttttttttttgagacaaagtctcactctgttgcacaggctggagtgcaatggtgtgatcttggctcactgtaacccctgcctcccaggttcaagtgattcttctgcctcagcctcctgagtagcttggattacaagtactcaccaccacacccggctaatttttgtatttatagtagagttcgggtttctccatcttggccaggctggttttgaactcctgacctcaagtgatccaccttcctcggcctcccaaagtgctaggattataggcatgagccaccgtacccggccagatgtttatttctaacagttctggtggctggaaagtttaagatcaagatgctggcagattc

SEQ ID NO: 207352 - DNA, 372 bp, Homo sapiens
tgagatgatggtagcttggagcagggtggtggtgggagaaaaggaaagaagtaaacctaccaaaatataatttagagataaaactgataggcttggatatgcaggatgagagagaacaggtatcaaggattcctaggtttctggcttaggcactgggtggatggtggttgtggagatgtggagagaggccacattacagagggctctactgtaggccaaattaaggaattttttttttttttttttttttggaaagggagtctaactctgtccccgggctggggttgcaaactctccgggtgaaatgatggtagcttgggagcagggggggggggggagaaagggaaagaggtaacccttcaccaaaatata

SEQ ID NO: 207353 - DNA, 404 bp, Homo sapiens
tgagatgatggtagcttggagcagggtggtggtgggagaaaaggaaagaagtaaacctaccaaaatataatttagagataaaactgataggcttggatatgcaggatgagagagaacaggtatcaaggattcctaggtttctggcttaggcactgggtggatggtggtgcctctcaatgacatacatgtttcagtggaagaggagccagttttagggggaagagtgaaagtccagcaaagtctagagaagagagtctgaagtgcctggaagacattcaaatggacaagccaggttgatagtacaacatatgggtctagaactcagtggaaaggtttaggctggagatactgattttagggtcatcagtgtgtggaggacaatggaaggaagtcatgagtgtgtg

SEQ ID NO: 207354 - DNA, 540 bp, Homo sapiens
ttgcttgatacccatcctgagctgtttatgtccttgtgcctctcttcacaaacctgctggtctccctctgccacctgggatgcagtgcagtggcctgaccacaggttcaaggaaaagttagtggaagccgttatccatgtcaacattgaaccagaaggttctgggatacatgtgcagaatgtgcagagcatgatttgcaagaggaactgctacacattttacacttatttactccaacctttcctgctaattccaggtttattgtaaaaccactgatcccttcatttgagctcgacttccctgcacttttttttttttttttcccctgtccaatagtaagacacacacacagagaagaacaacaagaacaagaagagaattgcaatgatgtgaagtaatgtatatgttaattagcttgaattagcttgattgtggtgattatttcacaatgtacatgtatatcagatcataaacttgtatatcttaaatgaatacaacttttatttgtcaattatacctcattcgagctggaaaagtaat

SEQ ID NO: 207355 - DNA, 456 bp, Homo sapiens
agaaaatgttctttgttttactgtgttgcaaatgggctgctagagttatgggatgctggatcaaggagcagatcattttgagttttgatatcttcgtccatagaaattgtgcttaactatactctcatagcaatgtatgagaatgcgttcccctacacattctgatcttgttaaaccagactgggactctggaccagaagggaaagaccatccctgtatagcaaatatctggatggggagaaagctgctgtcactcattgacttctttaggttaagtcttagtgatcaaaacatagtgaaagatatgaagcttactttggaaactcagaactatttccacagtttgggcaaaagctgtcatcagatccccatcacgttttggagagaatggaagcatgaccgcattcttggctttaaagagcttaaaatcaggccgggctccatggctcacgcctg

SEQ ID NO: 207356 - DNA, 652 bp, Homo sapiens
gcatcaacggcccctggttgagaccatctgactctccaccctctgtctcaaagcatcagacacacaaccacagacaccgtccccagcattcctgtctgcttcaggagtcatgtaggtttggggagacaggctgggtcccggaaggtctgagggaggagacggcagggctgagtcctggaggccttgaaggtataactggacccatctttggggtagggctcacggagcctcagggacatctggctggacgctgccatccactggtgcaagacaggggtggggatggggggtcaggggtaggaggagaattcattcctggactgaggttgaggacacccacttttcaaggttttctgtctcccttatcatgccctgggcaggatctttgttcactgactgttcccactggctccaaacgtctggttagggctatagtcctagcaagcgcatagcacatagtaggtgcttattaaagatttgttatgagtctcttcaatcagacctttagttccttcaaggccttatccctgtcagcaccccacaacaccttgaatgcaggaggtgcccaattaaccctcagtggctgatggaaagatgaatactcactgctctcaagcccaagggtgcatggaaaactgaggcccggctaccc

SEQ ID NO: 207357 - DNA, 134 bp, Homo sapiens
tgaaatggtctaatcttgaccatctaattctgcagtgtcttattctcattctaaaagagaatggttatattcgctgttctagcataaaaagtaatgataaaaataaaagatcccgtattaccagacaataatcc

SEQ ID NO: 207358 - DNA, 473 bp, Homo sapiens
tcagtgctgctctaaaatcagctccatttttatgtttcattgtgctagagaccctagaagcagattgtgagataaaaagaaatctgttattgggtctaggaaggaaaaaaactaagctattactatgtgcagaacatttttgaagaggaaattaaagataatctagagacagctgttagaattaactagggagttcaatgaattgcaggatataaattcagcataaaaattactagcaaaaattagataagtatataagattccattaacagtgaagaaccccacaaggttcctagagatacatgtaataataatgtgcaagacgtttctaataggaggaaatgggtaaactttgttggaaggcatgaaagaagacctaagtgaatggagaaatatgccatattcatgaatagagagactcgttaatgatggaaactatcattacattgatctaaagataaaatgtatttcca

SEQ ID NO: 207359 - DNA, 362 bp, Homo sapiens
gtctaagtggctctacccacccagagcagtgctccatcatacagaacagtgggtgcagtggggagaaaaggggatgaattgtagctcaagtgctacagtctcttgttcttactgagatttagtagatgtgatggttaatattgagtgtcaacttgatcgaaggatacaaagtattgttcctgtgtgtatctgtgagggtgttgccaaaggagataaacatttgagtcagtggactgggagaggcagacctaccctcaatctggtgtcctctaatcagctgccagcatggctagaatacagcaggaagaagttgaagggatttgaattgctgagtcttctggctttcatctctctcccatgct

SEQ ID NO: 207360 - DNA, 974 bp, Homo sapiens
ccccatctccataaaaaatacaaaaattagccaggtatggtggcactcacttgtagtccctgctacttgtgaggcagatgttagaggaccacctgagcccagaaggctgcagtgagccatgatcatgccactgtactccagcctggatgacagagccataccctgtctcaaaaaaaaaaagaagaccttacttccaaataaggtaacattctgaggtaaggacttcatgtctttttttggatgagggagacgggggacataattcaacccataacaggccctaaagtataataaacatggagattattttaatacttctgatattaatggactagcttgttgcagaccactgctccctctgagaactattagaaaagctagacataatatccaaaacagccgcttgaaggcattggaagctagtgaggtagtaaggacttgagaggcttagaatccatagaggagggaagcatagagataagcctgacatttggcattgcttttaccctcaaagcatttgctgatttgcaagtagtggcaaagaaactgagcacaaaagaatggctgagcagcgaagacactgagttgagattgcagcaatcttaacaggtctaaaggaacaaaaactgaaatctggggacaaccaaagaggaggggccttgataaacacctcaggctttcagttgggactcactctctgagagtttcaacctagtaggaagagtgtaatacacacagatcagccttacaaagacaaacccagcctccagtccgctcaatcccttcttggatgaaggtgatctgcctcttccttactacttgccaaaagcaaatgtatgccttctcctatatcacatcactctgaacctcaaattatttcttcaagttttcatacccagttatcaagcatacgaagagacatgactacatgaccaaaaatcaaaaggaaaaatatgataagaagagacccatgg

SEQ ID NO: 207361 - DNA, 119 bp, Homo sapiens
tttttttttttcccccaaatgattaggtaaatccatgtccttatgtattagtccatactgtcaaaaaattcttgtatctttgtatttaaaattaaaattctttgaatattctctgcttt

SEQ ID NO: 207362 - DNA, 343 bp, Homo sapiens
attgtatacctttgacctaaattcccctaatgttaacagcttgcaaatagtacaatgatcagtactaagaaattaacactggcacatgctattcactaaattatggactttactcagattttaccgtttttccactgatatcatttttccgttatttctttcatttcaccaaccccagattcaacattacatgtgttttgtctctctagtttcttccaatatgagagttccttagtctttccttatttttcatgatgatgccatttttgaggaatatcagttattttctagattgttcctcaatttgggtttgtctgatacttatgattagaatgaggttaca

SEQ ID NO: 207363 - DNA, 433 bp, Homo sapiens
cagagaaactcttttaaggactttccaggagacttagcagaaagctaataatatttaaaaagctgcaaatacattctcagagtcactgtaaatagaagaaagtcaacagcaagtatctaaaactctggtgcaaaatttcacgtagccaggcgtggtggctcatgcctctaatctcagcactttgggaggctgaggcaggcagatcgcctgaggtcaggagttcgagattagcctggccaacatggtgaaaccccatctctactaaaaatacaaaaattagccgggcatagtggcaggcgcctgtaattccagctactcacgaggctgaggcaggagaatcacttgaaccggggaggtggaggttgcagtgagccgagattgtgccattgcactccagcctgggtgacaagagcaaaactctgtctcaaaaaaa

SEQ ID NO: 207364 - DNA, 628 bp, Homo sapiens
aaatctgcttgtctatggtaggatacttttactttcatgagtaaaaataagggatgggaacatagcaggctgtttttaaaccacaacatagggtaagattttctagtgttctcatcagcagtaatgttgccaggatacaagacagcaatggcttccactgtctatggagttatgattttgctcctaaattgtcaattcaaactaaataccagtcaagtatgaggccaaactgatgacatatacagacaagcagacaaattcaccagcagacttagttatgtgcactgcaaataaatggagaaaccagatcagatgattcacaggttcacataaaatatagcagaattgctgccttgtgctgaagatctggaagagggcatcgggaagaaagggcaatcgcaagagggctgagaaatgcccttcccaccagggtggtacatggcacctgaagtccaaactcagagtaaggccaaccacacactggaaggcagtcttctgagaaagaggagcagctgacctagacagcagggtctataacatagtcacaagcaagaaaaacactgcagtatcatggggccaaagacgtatttttatatgaacactgtcaagggtgacgctcaaaaagagc

SEQ ID NO: 207365 - DNA, 638 bp, Homo sapiens
ccagatatcccagtaaaggaagtctttactgttggactcaaacacctatgccaggaatcctctctagacacattgaatttccttaaagtattgttttcagtttttagtctgacaaaatctttctagaagacttctacccagagagtgcatgatttctcagaaaaggcttccttctagtatgtataagctctgaatggcagatatgttttgccattttgttcactgatgcatcccaagtacccaggacagtgcttgccatatagggactgatttttaattcctgcccttttttggggctacagagtattgctttcttgggacccacatatcagataaatatttaaaatatttatcagatatcagacaaatatttaaaaggattattgttcaattttatttagcatttctaggtattttgaataggaaacttttttagtcagctgatctctcttagaagtcttttaaaataattcctcaaggaagatgttgatatttcacatttattgtttagggaaaagatagaatttccaggcttctaaagttaataaagtttcttatttatatcattattaaggaaacttattttttcattaatataagttattgtgtgtgacctaatttggaggtctttaattaga

SEQ ID NO: 207366 - DNA, 659 bp, Homo sapiens
gaatgaccactgtgtgctgagaaatactgaaatcaaagactggccttccttgcatactcacaggttgagaggagatcagacatacttgcacaactaatgtcgttctgtgacaagtgctctgataagggagaacagagttgtagccaggcaaacatgtgtgtagatctaaacctgttatcttacaaaagcaggagacaagactcccacttctagaagatggagtagacattctttcttgtagtcctcctgctaagtacagctacaatctctggtcattatatacaaagcaaacacaagaagactgaagagagagaagacagacgggagaggaactttagcacctgagggaggacctgggtttcctttttgcttcacacatcccaaactagataatggggaaggtggcaagctggaagtgccgatcagtgcagaccaaaaagaccctgagaagagctgctctctttaacaaagaatctaagaaggaaaggggcaacctagcaagacagaacatttttagacaataacctctctactccagggaaccaccacataaaagccttcagcctcacatcagcaaacgccaagtgtgaagagcctgaatttccatgctcagcaggccaaatagcaaggcactgccgggccttcagaacaccgtcaaa

SEQ ID NO: 207367 - DNA, 601 bp, Homo sapiens
cagttttcgtgggccctatcccttctgaaaaagcaaagccatttatctttagaagcaggcaacaatgaagctgtaacaggctcaaggaggggtggaggacagcctcgcgtgactcttaccccacactctagtccctctctttctgcaagaaaaacaaatgaatttcttttctgattatatatgtactccttgtagaaatattatatatgtatctgtcttcatatatatgtaaaacagtcacccacagtatctgtgggggattggttccaggacctacaaagatggcagaatccagggatgccctagtcccttggcatggtatttgcatataacctatggacttcctccatgaactataaatcacttctggattacttataatacctaatacaatgtaacactatgcaaatagtagttatactgtattgctttttatttgtataatttttattctttcattattggggagagggagtttggaatgttttctatcaattcaaccaaccacggatatggaacctgtggctatggagggctggctgtatgtttatctctctctatgtatataaatgctaacctcaagcactaagcaatgttcata

SEQ ID NO: 207368 - DNA, 353 bp, Homo sapiens
cacaatttagagaacttataacgtccttggccagatatgcccaaagccaggatgtccccctaacagaagaaacatagcactccttttgcaggctgttcacgcaatcactaaggacctcctagagaagatttgaaatgtgttgggggcaggaatttatcccaaagataactcagggacttctgggaaagttttaatgcctgtaatgcagagaactcccaagccccttgagtatagcagggttggtaaaagcctaagattgactttggtaagatagacatcaaaatagcaaaaacaagaaccattgtagaatttaagagaagcaaaataatgtcttttcttggggctaacactcc

SEQ ID NO: 207369 - DNA, 292 bp, Homo sapiens
agtattacccacatccccatttcacagatggacaaatggaggctgagaggtgatgtcattgtctaagatcccatagctagtaagaggcagagccaaaattagaattcaggactatttgatgacagcatctgcatacataggagtcatctgggacaagttagagatgtaggtttcactcatttccctttttgccttgactgctaggaagctcagctctaactggaatgttaaataatacggctagccttgcctgaacacccaacaaggtcaaaaataaaaaaattttagggtc

SEQ ID NO: 207370 - DNA, 393 bp, Homo sapiens
cagtcagggcccaggcctgagggggaaagccctaggtaaagaatattcctccaaatcccactccagctcccgcagacaacctgatcggggtcaggaggacacactcctaccccaggctgagagcagcctctgataacacaaaaggaccctgagggtggagacctcccacctccacttcaaaacagtgtgttatttatcaatatcttatccccggaagttgaatctatctcccagtgccaactccgagataaatgacttgaccaggcgtgtggcatggattaaggcatgagataggtgttcccaccaccagaacgagccagtggctgcctctcttccctttgagccctccctccacagagacctgtgaataggtgtttctgatccctaggctgg

SEQ ID NO: 207371 - DNA, 299 bp, Homo sapiens
cccaaataccgttgcatcagatatttgcatggctcaattgttcattctcttcaagtctttcctcagatgtcccttttctcagggaggactttgatgggcacctcattgctttccctgatactctccgtcctcctgccttgcttccgttttctccaggcacttactaccattcaacattccctctgccttatttattcattgtctctctcctccatgctagaacataacctggcgaaggcagagatttctgtctcttttgttcgttgcttcatctccagtgtccaggactgtgcctgcta

SEQ ID NO: 207372 - DNA, 235 bp, Homo sapiens
gccagccaggcgggggcagttgagcagttttgacgcggctggtgggagtgtgagctgccacaatcttttgggacactaatctgtattggagtttaaaatgtgtatgacctttggtccagcacttccactttggagaattttttgtacaaaaccatatagacacataaggtgatatgtacaaggatgtttgttgcaaaaacaaaagaatgcgctaaatattgatcgttaaggcaat

SEQ ID NO: 207373 - DNA, 592 bp, Homo sapiens
ctaagattgccagataaaatacaggatgctctattaaatatgaattcggatataccaccaatttttttaagtataaatttctcccaaagtattacatgggatggctacaacattatatgaaataaattgtcacgaaatccttaaaaaatttgtttcacaattaatgctgaccacttccaaatctcagtatccagcctcatcatgtgttttaaactgaaaatctccattgtgaagtcttgcaggcaacatgttgaaaatttaactcataatttgccccgcctgtcttctcactttcagtgatgttgcctccatccatccagttcttgaaactgcccttgaccattccctttgccccacatccattaggtgggcccttttgcttctctccctagttagtctcagcagccagcaatacctttactaaagttacagcacagtctctactgctttcctcttctgtaggtccttccttctaaccgaagtgacttcaaacttcagacatatgtgcatatacagaatcaagttccctgcaaactatacttaccctcacaacttgcaggatattctgatgttgtctaatgtttcttttaaa

SEQ ID NO: 207374 - DNA, 375 bp, Homo sapiens
gaactccaaacccaagatgctagcagggagcagggacatgtacattgaaggctctgggagagaatctgttccgtgcccttctccttagcttctggtgtggctggaatccatggtgttcctggtttgcagctgagtcactccagtctctgcctccattggcacgtagagtttcccggtgtgtctgtctttacatggccgtctcctctgtgtctctctcttttttttttaccaggacactagttatattggattaaaggctctgtactctttgtatgaactccattatatctgtaacaacctgtttccagttaagaccacattcttagttactgggagttaggacttaagcatatcttttggggggttattcagcat

SEQ ID NO: 207375 - DNA, 463 bp, Homo sapiens
ctagagagatcccccacaccacctgagcaccccacctgagtctgttactcaacagctatgtgaccttgggcaaatcaatattggatcctctgttatctgctctgcaaaatggggaccaaacacctacccctatttgctgggctgtggtgagggctcaaagcaaaggtatatatataccttgattgataaatgtaccagttcttactattagtactattaatacttatttataataatagtgctagcactattagtaactgttagtgacattcatcactattaatattagtaatcatagcactagtactattattatagaatatatctgctggctccctaaagaaccaaggttcaccctccagggcaccaaaagccacagtcccgtgatgatgatagtgatagtgaccatggcgatggaggtgatggcaatgatggcagtgatgcttgactcaggtggtgtgcg

SEQ ID NO: 207376 - DNA, 516 bp, Homo sapiens
tctgattggtagcttttgctgatttctgtggtataaatactcctacctttgaccaatttcaaactactaatatgacatcactgaacacagagttatgaaaatttgggccagctccaccataatttggctgtagccaatcttgattatctagattgactcggggggaaaaagtatcattttgtcagaaagcatttttccagtacaattgtgaccctgttacccaatcacttgagtttattttccaaaaatacaagacaactcatttagattttttatatttccagaaaatgtgtgtgagccttatatcaccagcctaatgggcattggtgtaaggaaccaaatatctatatatagcatttaaatttgaaaagtcaaaattggaaaaaaaaaacttgaatttttgctgcattaaatacttacagtgttattatggttggtatgattttggaagttgtagataatcactagaaatcataacatttattgaatctgtccaaagatcagaaaagagaaaaa

SEQ ID NO: 207377 - DNA, 294 bp, Homo sapiens
agagaaggaggaaagagggaagggaagggaagaaggaagggcagaatgaagggaagaaggaagctattgaatgttacctcttaagaataactgaaacttaacctgaagtcatttgaacggtcagtaatgaatctgaccacataatctatctgaaattctgacctcctgcactatttctgtttattgcatgagatcccccctcaaaagaaaaattaagcctttcctggaaagtgctatattcttgcattaatttgggggcagtccccagctgactgattaaccttagggcacagc

SEQ ID NO: 207378 - DNA, 470 bp, Homo sapiens
gagagagaaaccagcaagcagaggcagaatgaggtaacaaatctttccttacaaccccaaattagtcctttactaatcattaatattttatgccattccagattaaacttactgtttagccagtaagcagtattcttacttagaatttaaattatcatttgccatctattcaaagaacatttaaagatacagagttaaaattaaacaaatggcatataatcaaagtattaagcaatgggagtgtggtaaaagagaaaaagcccacatacaatccatttactcaggattctagaatgacactgtcttctttctttccctgtacaaatataacctgtaacttccaaaaatatctttagttcttgggggccactttgctcaaagtgacaagcacgtcaagtaaacctatttccagttacattcttatcttgtcagtgtcaagatggttgtttgatcatctttatcacacactg

SEQ ID NO: 207379 - DNA, 243 bp, Homo sapiens
atggaaatgggccccgtgcactgctacaggcaaagggtagacgaggtatctggaaatggctatgacatcagcatatgatgggcgtggcttttctgtcctagaagtaattgtgccaatgccctttgtatggcactaaggaggggccacaggaaaggaaaggaaaggaagagaaaggaaggaaggaaagaaagaaggaaaggaaggaaaagagagaaagagaaagaaagaagggacggaagatca

SEQ ID NO: 207380 - DNA, 668 bp, Homo sapiens
atgtgggccgggttagatctcttttcctagagacctgcacatagacacacagacacacagagacacacacataccacatggacacacaaagacacagacacacacagacacacgacacacacacaagacagacacacctacacattctctctacatttagactcactattgctgaaagacctaaacactccccgctaactcccctcagtcacatgtcaaaggtgaagaataattctctggtcaaaagaacctgagtctggaacttttgccctcagcactcctacatgcttcccccattgtttcttacatgggacaaagtgacaagggtgaagctcatgccatacttcctcctccaaggacagctcagaatctggccctgaactcttttagatatcttggtaactaggctgacatgtagcattcctggggaatgtataggaaggaggtgaatggcacctatcatttattgagagccttttatgagccaagcactatgtgaagtggtttctatacattatatgatgtaatcatcatgacaacccagtgagatatgtactatcatcatctcctttttacagatggagaaactgaggctcagagaggttaagtaacttgcccgaggccacaaagccagtaggtggcataaaatgtccaggactattaaagaa

SEQ ID NO: 207381 - DNA, 758 bp, Homo sapiens
tatttagtaccaggttttcctaagaggaaatgggggctacttggggtcaaaacaaaggagagtctttctagatagggaaggactagcagtgggtcaaaacttgccaagaaggactatgaagggagctttgcttggggtttaaaagctctgatcacagacttggaggggctcaaacccctcgctttagaaggcagaaaccaagaaccactaaggacctaggacttgctgacggtgtctttggagttaaaggtggaactgaagttagagctgattttcttcctgtcacatccagtaagactgggaatggttgggtgccagaggcaggttccagaaggtgggaagagtcctgtctgcatccccagggtcctaaccttgaggaaagcttgctgtccttttgtcctgcttcacactccctttggttaaaggtttcactcagagcccgatggaaaccttcaggaaaaaagggccccaaaccgaggcgaggacactggggaagccttgggtggtttctgtgtggggcggcccctgctctgtgaagcacaggggaataggactccatcgctgtcatcgtcactcatgccctggtgcagacctgcaggaacattgcctgctgtatacagggcaaatgggcactgtgccgggagaagcctgtaggaagagagacctggagggatgaggagggaactccgaccatgagcatgcacggagctccgtgaaggagggccttgacagacagaggcatggtgggtggagacggg

SEQ ID NO: 207382 - DNA, 434 bp, Homo sapiens
tagacgatcccattctacgctcctgtctgcatccccagggtcctaaccttgaggaaagcttgctgtccttttgtcctgcttcacactccctttggttaaaggtttcactcagagcccgatggaaaccttcaggaaaaaagggccccaaaccgaggcgaggacactggggaagccttgggtggtttctgtgtggggcggcccctgctctgtgaagcacaggggaataggactccatcgctgtcatcgtcactcatgccctggtgcagacctgcaggaacattgcctgctgtatacagggcaaatgggcactgtgccgggagaagcctgtaggaagagagacctggagggatgaggagggaactccgaccatgagcatgcacggagctccgtgaaggagggccttgacagacagaggcatggtgggtggagacggg

SEQ ID NO: 207383 - DNA, 282 bp, Homo sapiens
atgatccagtcacctcccaccaggcccctcctccaacattgaggattacaatttgacatgagatttgggtggggacacagaaccaaaccatattgcatggattgaccccatttgtaaatgacgtatgtgtttggtatcccatattcttgaatgctttcatgttagaatttctcagagtcactgcagaacttgttgttaacattcattttattgtttgtcctgattcttggccccatagaaggcattactgattttctaaaagtctgcacattattacttttt

SEQ ID NO: 207384 - DNA, 612 bp, Homo sapiens
ctctactaaaaatacaaaaaaattagcctggcatggtggtggatgcctgtaatcccagctacccaagaggcagaggtttcagtgagccgagaccacaccactgcactccagcctgggcaacagagtgagactccgtctcaaaaaacaaacagacaggagacaggatctcattatattgaccaggatgcacctcctggcctcaagcaatccatcctcacaccttgacctcccaaaattctggaattacaggcgtgagccactacacctgtcccattgtttatctttgttttttgctgttgttgtttgtttttttgagatggagtctcgctctgtcaccaggctcaagtgcagtggcgcgatcttggctcactgcaaccttcgactccctggttcaggcgattctcctgcttcagcctcccaagtagctgggattacaggcacacaccaccatgcccagctgatttttgtatttttaatagagatggggtttcaccatgttggccaggctggtcttgatcttctgaccttgtgatccacctgcttcggccttccaaagcgctgggattacaggtatgagccaccgcgcctggcccgtttatcttttaaaactta

SEQ ID NO: 207385 - DNA, 205 bp, Homo sapiens
ccagaatgaatatttataaaaattctctattcttcaaaaaatatatgtgtttataatgtcaaactttgccagaatccttaactttaaggcttattagttgaacattttctcacaactttgcttgggagaaaaagattggcttataaaaaatgcttgagggttatttataactattttagaaaagctagttaataaagatattaag

SEQ ID NO: 207386 - DNA, 409 bp, Homo sapiens
tctggtggctatatttgagtattggtagtataggttaattttctatttttatgggcaattctcgtttttgaaaataaatatttattgtacttataataaaatatttctaaataaaaatattaatatataactaaatatacaccaatgacaaaattttaaagctgttttacaataaaagataaaaacaaaattaaaaatatgtactttatctctttccctcacatatctgatgggcaaatgttttttaaaacattagaaaaaaccttttaaaagaaatgttggcagggaaaaagttaataacacctacttttattggaatatattttttatttaataatttcaataaagaaaaaaattctgagtatttactattaagctatgtaaacaaaaaccgatgctattttgtccc

SEQ ID NO: 207387 - DNA, 413 bp, Homo sapiens
gaataagatacgtagaaaatgttgagacttcatttacatgctatccccatgacgatgtgctagaattcttaccagtgtcataacagccagccctaccatctgcttaactacaccagggaatagatcagtaatccagctgactccattagactttctatcactactccctccatccagagataaaaaatgcacatgctctgtaggaggtctgtttactcccagaccagattctatctttttttcttccctttctccttaccagataattttctatggtctctcaatgataaaactgtttgtctcttcattgaaaaagatctttgaacataaatgtttcactgaaaattaaaataatgcctcagttggatggagagaatgttgaaaacatcttggaatccattgttgtcagcaga

SEQ ID NO: 207388 - DNA, 345 bp, Homo sapiens
ctcagtcctcttagccaactgagttagagagaaatggtcgttcattcaccttgtcttcttcaggctgagtcccatggtgggacgagaacaccggcctcggtgttccctgctagatccagatcctgattggccccaggcttcctccacctcccatcccccatggcaccttctccagacacaagccctttcctcctctcaggtctgaaaactgtccagatggccttctggggctgtgccagactcccaaagacaggcctgccaaggtctcctggatctcagcccaagagccagaccctggagaatcacgggtgactccttgtgcttgcggcaccctgaccctgtggc

SEQ ID NO: 207389 - DNA, 335 bp, Homo sapiens
ctagtgagtattatggttttctggtgtgggtagtagaggagtgtaaggaggaagggaactttgaatgatcagggtaacccatcccatatctgtcactcagttccactgttctctttggatccttgaacaaagaattaaattaatctaagggagttctttacctgaataatttacattatagcttgcataagtctgtttaaaattcttgtgcttataaacaatgcttataaacaaagtaaaaaatgtttatattgcaaaatgccagaggtgacacttctgctagtccaaatggcaggaacaatatggggatgagtttctaaatgtattagccatta

SEQ ID NO: 207390 - DNA, 275 bp, Homo sapiens
gattaatagacaccatcatagcaaatctgtactgttataaatattctcattccatttcccatgcagatttttaatataaaaagaacaataaaagataactcataattggtcttttttaaaggtatcatgcatctagtggcttatttgtagcaagtttaattccttgcataggtgttttgatcaattgtgatctgaaagtgtcaaggaaaaaaaaaaagttacttttccagttgaaaccagggtctcaggaatatactcaaaatctcaatattatg

SEQ ID NO: 207391 - DNA, 705 bp, Homo sapiens
ctattggcatcgacatttaatttatcttttccaagacaaaattaatgaagctttggatgacttgaattatatacataaatataataaaaataatacaggtgggttgtctgtagagacagttatattacctacattttgacctcagcctttgtcatttattggtactataaggatacataaatcagtagatatatgtcctgaaaatgactttcctcagttaaatttttttactcttgttattgtaaatccggggctcgtacaatcctatagtgtttttaaaataccatggtttgaaaggttattgtccttgatatatattgcagtaagttggttccttactgctcatctcacaacgaaagaatatgaatttaaaatagttagttatagaagtaatttacaaatcactctttgatttgtgtgatttgatcacatctctctgagttagagttattgtgcgcctaggattacttggttgtatgaaatctatatctttgctcttatgtactatcctccaaccaacttgaagcactagacatggaactttctaggaatgtgaaaatgtgatattcacctttgtatccccagcacctacaacatacccataaaataaaacatgagcttaataaatgatttttgacctgtgttgatctctgctaaaagtccattaagttttgtgtcatcacaacctaaccttttactatgatg

SEQ ID NO: 207392 - DNA, 170 bp, Homo sapiens
ggaggcactgtgagacagggcagacatgtgcttacctgtctaatctgattcttatcatctatttttaacatattccaaagttcacataagaaaagaaatgtgtatattaaagattttaattaatgttaatctacttgcaaatgcactaataaaaatattattttgagtgg

SEQ ID NO: 207393 - DNA, 731 bp, Homo sapiens
gtgaacacctggatacacacctcctcctttctcccatccacaggttcctgtacttgctttagcaatgtctgtccatcccccaccaatttcatcttattttttggatacattcaaagtaaactgcaggtatccatacttttgttttccctaaatactttagatgaatgtatctttatcatgaggtaaacatagattttaactgaaaacataggaaaggactttcattcacccgccattttttggagggccaaggccttctcgttaagtatggtttgctgatgcgctttctagtcgtgtcttaccatctagaatttctagtttcagttatttccaatgggatgtgatttacagactctagcaaggcatacagtatagctttccagattttttgttgttttcctcctagttttttattcatgtcatcctcacttactttgactattgtttgtttcactggattgctgttaattgttctttctaaaacattaccttagttttctttcacagaaacagtgctattctttttgtgttcattttttattggtatatataatacttaacgtgttcactcagcaaacacacgagtgctttactatatgccaagcatgattctaaatgctggggatatactagtgaagaaagcaaagtgcctgccctcccggagctgggaagacagacagaaataaatatacaatatcaaactagttagcgatgactgtgagaacgaagag

SEQ ID NO: 207394 - DNA, 294 bp, Homo sapiens
agcccagaaaatgaaaaatgctgacattgttttagttaaacttccctgttgctgtgagagaagtgacctgcaaccgttatctgagatgtatggcctttgccgtaagcacattctctgtcttacacttgaacttgcctagtgagacaaccatgcgtatcctgactttttctggattgattggttttcctatattccatttgatatttccctatgaaatattaatagaaattttaatgttttaacatccataacagagagccctttattatatctctcttgattttcagtttgggt

SEQ ID NO: 207395 - DNA, 417 bp, Homo sapiens
ccccccagacctccacagagaggagaggggctgaaagttaagttgatcaccagtgaccaatgatgtaatcaatcagacatatgcaatgaagcctgtataaaagcccaaaggatagggtttgttgagttctggagagcagaacatcaggttcctagagggtggcgtgctcagagaggatatggaagcgccacagcccttcccacatttcttgccctgtgcatctcttccatctcactgttcatctatatgctttgtaatatccttcctcataaatgagcaaacagaagtaaagtgtttcactgagttctgtgatccactctagcagattagtccaaacaaggagtgggttgggggaactccagtttatagctgggcaggcagaggtacaggagacaacctactacctgggattggcat

SEQ ID NO: 207396 - DNA, 633 bp, Homo sapiens
ggaggcctccctaggccccctggctaccaacccatccccttcagtcagtcgggcaaccctgttatgagcactgtgccttcctggcctctgtcgtcgatccccgagtcgcctctgctgctgcaaagtcagccctagaggagttctccaaaatgaaggaagaggtacccacggccttggtggaggcccatgttcgaaaagtggaagaagcagccaaagtaacaggcaaggcggaccctgccttcggtctggaaagcagggcatgcaggaaccacctctgatgagcctgagcggatgaggagagcgggaatgacgaggctcgggtggaaggccaggccacagatgagaagaaggagcccaaggaaccccgagaaggagggggtgctatagaggaggaagcaaaagagaaaaccagcgaggctcccaagaaggatgaggagaaagggaaagaaggcgacagtgagaaggagtccgagaagagtgatggagacccaatagtcgatcctaaagaagatgaaggtgccatgtattgaaagtgtgcgtcaaagaacataaatatcagtggattttctctgtgtatatgtgcagtatttatttttgatcctttaaaataaaacttttgcaaataaaaaaaaa

SEQ ID NO: 207397 - DNA, 608 bp, Homo sapiens
ggaggcctccctaggccccctggctaccaacccatccccttcagtcagtcgggcaaccctgttatgagcactgtgccttcctggcctctgtcgtcgatccccgagtcgcctctgctgctgcaaagtcagccctagaggagttctccaaaatgaaggaagaggtacccacggccttggtggaggcccatgttcgaaaagtggaagaagcagccaaagtaacaggcaaggcggaccctgccttcggtctggaaagcagggcatgcaggaaccacctctgatgagcctgagcggatgaggagagcgggaatgacgaggctcgggtggaaggccaggccacagatgagaagaaggagcccaaggaaccccgagaaggagggggtgctatagaggaggaagcaaaagagaaaaccagcgaggctcccaagaaggatgaggagaaagggaaagaaggcgacagtgagaaggagtccgagaagagtgatggagacccaatagtcgatcctgagaaggagaaggagccaaaggaagggcaggaggaagtgctgaaggaagtggtggagtctgagggggaaaggaagacaaaggtggagcgggacattggcgagggc

SEQ ID NO: 207398 - DNA, 577 bp, Homo sapiens
gatagggaactgtgtgtgttctgatggttcaatggggaaatgaggatcgatcatgagtgattttcccgaaatgcaacctgtgcaggtcttgccttcctcaagcacctgcgaggagaagtcgtcactagtggggaattccagcaggtgacccaatcgagacagctgggcaggctcctggagctgatggcttgggaaggagggagtcagaagtggcaggcccatggaggtatgcctgtccgcggatgaccgggatcacaaaacaatgacactgacttgtcgtggggatggtatgaacagacatgaggaaggattggagaagatctctgttgctgacagaggacagggaccagtcagctaggaaacccagaggccagatatgtctgagcgtaggagcaggagcagtgaggtatctctggaagcagcaggcaggacctgggctggaatggctttgtgagattctattctgcagcctcggcagcctgagtcttacagccccaattcttaaagttgaaacatgtgcaaggtactaaatctctgtatcagtcagggtcctccagagaatcagaactaatagtag

SEQ ID NO: 207399 - DNA, 899 bp, Homo sapiens
gagatggagtctctctctctctgtctcccaggctggagtgcaatggcgcgatcttggctcactgcaacctccgcctcccgggttcaagcgattctcctacctcagccttccgagtagctgggattaaaggcgcccaccaccacattcagctaatttttgtatttttagtagagacagggttggccgggctggtctcgaacttctgactcaggcgatccgccgcttcggcctcccaaagtgctgggattacagatgtgagccactgcgcctggccaaatgtttgattgaatgaaggaacaagtgaaagaacatttatatgacagaagaccaggcctttgttactgctcctaggatgcatctccccttagctttgaccttttagggaactgaagtgacatggaaaagattaagcctggtctgtgccacagaacttaagggattttactgaagacactggttcctccatcgtcatgggaaaatgccatatgtcatataattctaacagtgatactaatatctattgagcacttaccgggtttgaatgaactcatttaatcttcacaaatatatggggtagatactaatattatttacaatgtacaggttggaaaactgaggctcagagaagttaagcctagtttagaggagaacatctcaatgttatattgctttctccaatcttctccctattctatttcttccccagtcactgcatcccatgcttcaagtacaaaggtatccagtcattctctgcccatttcattattgaatttccctacctctagagagttattttaagatgttggtctttatattatctaaccgaattccatttatacctttttaaaaaagtatacatgtatactgttgcaaaaaaataaaatagaagttaaaaaaag

SEQ ID NO: 207400 - DNA, 764 bp, Homo sapiens
acatatatttcgtgatgtctccgttgttataattttttttactactagtcagattaagcctctgcagtcactaaactttgttcattaccagcgacgtcatcatttgcgagcatgtggtgttcacccttatataccaccgtctctaaaacgttctaaaagtttgcctcgtttcgagtcgtcttctgtagtatttctgtcttattgattgatctgtcttgttcccctgattattttttcctacatccacccttcaatatgataggtttgctctcttcttacctcacgaattttcctcaatcgtttgttcgacgttttttttctccactgttctcgatgctctcggttgtataataaataaactcgcgaccgccaggctcggatgtccttcttttttattctcttctccctttatgggtggctcctccgtttttctacaacaaacattctgtgggtgatctcctctatttcttttgtcctcctcctttgtgtggtatttttcttttgtttctccccccccctcttttttttttttttttttttttttttttttttttttttttttattacttatcaagtgggtttttattaggtggaaagttggtacctcaaagctttggaaacttgctctatcaacaatcagatgcttgctgcaggtgagtcagtatatttcaatgttttcctttaataattaaactaaataattatacatatcattttcaaaatctcaaaatgtggctctacttgaagtcaatcttccaaaatta

SEQ ID NO: 207401 - DNA, 591 bp, Homo sapiens
tcaatacggtgatcctcccatatatgtgatggaaaatggagcatctcaaaaattccactgtactcaattatgtgatgagtggagaattcaataccttaaaggatacataaatgaaatgctaaaaggtggaaagttggtacctcaaagctttggaaacttgctctatcaacaatcagatgcttgctgcagagcccttgctaagtcacatgcaaatggttacggagatcggggcacccactgtctgctccctctgtgccctcatcactggtgttctactaatgctcctcctgaggaggcagagctgacacaggattatcaattttggagcttcataagagaatcttcaggatcttcctcccttttctgctttgagggtttccatacattgctgttttcaggttctacaataatcacctttttttctctttctctttttggcttgcgctgggatttaagaattagaaaataaaaatacgcagagattaaaaaaaaaacacttgtaatctcacccctcctaaagttaatgttaagattttgctgtatataatgaatgtatattatgaattattcacaaaagtggcctcatagtac

SEQ ID NO: 207402 - DNA, 782 bp, Homo sapiens
tggatggttgtttacatctgttgtttatacatctaaattgcatgattcatttgtaattgttaacatgttggaataatgttacaggtactccatggcattttatatttggcttagcagagttagcacttaactgtatatattggtcaggcactgttgtataacaaaccatcctaaaactaaatggcttaagacaacaattctttatttagcctgcaattctgtgggtcagcagtttcagccaaactcatctgcatggttcacctggacttggctaggctccaccatgtatctctgggcagttgtaggttagctagttggctctgcttctaggggtgctgactgtgggctggggagactcagctctcctccatgtgatccctcattcccatcaggctggccctggcttgttcgcagaggcagggttccagaagacagaacaaaagcacataaggtctccagaggcttaggctaagaagcatctcattactacttctgccacactattggccaaagcaagttataaggtcagcctagactcagtaggtaggaacatcaactcaacttttgttcttcttttaaataaaataaaacgaatctgtcaacttgaaaaagcttttttgtagagatgggggtctcacgtatgttgcccaggctgacctcgaattcctgggctcaagtgatcctcccaccttggcctcccaaagtgctgggaatacaggtgtgagccaccacgcccagccccactcaatttcttaatgggcagagcttcaaagtaataagtg

SEQ ID NO: 207403 - DNA, 644 bp, Homo sapiens
atctagaggatcccaagcagctaatacagtactcactgcacccaatcagcatcacctgcacccattcagccagcatcacctgcacccaatcagaatcacctgcacccaatcagccagcaacacctgcacccagccagcatcacctgcacccaatcaatcagcatcacctgcacccaatcagccagcatcacctccacttggaagctgccccaacttcccttctccaccaagccaaataatcgcccacctctacttctgtggcatcctttgcatgctactaatcagtgtcttcattgtcctgaactgccccccaacacacacccagtccatgagctgacagttctctaaaactcctgagccactatagtctctagcacagtatagtgtaggcttccaaaactggcagcaaacacttgttaattaattgcatgaagggtttcaagtctatagatttcccacatcgtgtgttatagatatcccacttcattttatctaacagatacttaggcagagtcactatgtgctgggctctgttccaaataagtactactatccccattgtccaaggagaatctaaagcatacagaggtcaatgcacctctgctcagccagacagataatagaggcgggatccaaacccaaaa

SEQ ID NO: 207404 - DNA, 237 bp, Homo sapiens
tgtgttaaggaaaagcagaaaacagagttgcctttggttaagagttccactatttttataagcaactgacttttttggggaaagttgctttaagcatttttttttctgtgtgtatgtgtgagatggggtctcactctgtcacccaggctagaatgcaggagcacaatcatggctcactgcagcctcaaccttctgggctcaagcaatcctcccacctcagcctcccaagtagctggt

SEQ ID NO: 207405 - DNA, 447 bp, Homo sapiens
cttatgatccagtcatctcccaccaggccccaccttcaacattgtggattacaattgaatgtgagatttgggtggggacacagatccaaaccatatccaaaagcatttgtttctgggagtcaaagctataagccaagaaaaagactatataagagaaagctgtgttccaagcaccaaggcagagggagtgaagagcacatataatcactaagtttgaaggggccagagctgggatttgagaccaagaatagaaagccaaggattcaaggccaagaggaaatgaaaagagacagaaagctgatcaagaacaagttggagttagaagcaagatgctaaccagtgtcctcaaatcactcaagagttctttgtgactttgaattttgttttagcaaattagtggtgcagggggcagtgggactaggttaaaaggtctaaatggggtgagca

SEQ ID NO: 207406 - DNA, 1015 bp, Homo sapiens
acagtgaacaagatctcttgctgtctcagtgcattctagtggaggacgcaagagacttaacattgtaattacttctgttttggggtgcacacccagtatatgagagcacatagccatgggaccaaagcagccattggtcaattgaagtataaagaacaagtaggagttagcttgagaaggaaagggaggtggtaaagtgattcccaggcaaaggaaatagcatatgcaaagggctgaggctggctgggggagagagagcacggtaggtggaaaactgcagtggctggttcgttgcgccttaagggtaaaattcacccagtgggtggtgtaagctggggctagatgttgaagggtcatatgataaattatttgacctttatcctgaaaatagtaggaagctattggatgctttaaataggggaataacatctgctcttcagaaataaaccctggccgctttgtaaaatgtttggagaagagtaagactagaaataggagacaaggagggtgctgcggtagttccaagtgagatatgaaaaagacttgaaccaagaaatggctttggaggtgggaagaagtgaacagacacaagtcatattattacagtagaatccaaaagacttggttgaacgtggggagctcagggagaagaaagagtcaaggtcctggtgtggtggctcccatctgtaatcccagcactttgggaggccaaggcaggaggttcgctggagcctaggaattcagtaccagcctggtcaacaaaacgaggcttctgtctctgtaaaaaaattttcaaaattggctgggcatggtgatgcgggcctctagttctagctactcaggagtctgaggcaggaggattgcttgagtccaggagttcaaggatgtcatgagctatgatccagcgtaggtgccagagcaagaccctgtctcaaaaaagtcaagaatgagcccaagagcgtcaaggctgcaccactgcactgcagcctgagtgatgagtgagactctgccttcc

SEQ ID NO: 207407 - DNA, 540 bp, Homo sapiens
actttaaattcttgtaggtagactacaacgtggtaatttgttttctaaactattgatgaaactatatatttttagtttgtacatcatccttgggtaactattacccttaattttctttaaatttaaatctttgagtttgagcttttcattttaggctaccagccctcgaagaaatctgcagtttctggtcctggtgtggtggctcccatctgtaatcccagcactttgggaggccaaggcaggaggttcgctggagcctaggaattcagtaccagcctggtcaacaaaacgaggcttctgtctctgtaaaaaaattttcaaaattggctgggcatggtgatgcgggcctctagttctagctactcaggagtctgaggcaggaggattgcttgagtccaggagttcaaggatgtcatgagctatgatccagcgtaggtgccagagcaagaccctgtctcaaaaaagtcaagaatgagcccaagagcgtcaaggctgcaccactgcactgcagcctgagtgatgagtgagactctgccttcc

SEQ ID NO: 207408 - DNA, 237 bp, Homo sapiens
aaactgatctgagttaagaagaggtaaaggtttcctttacaaaggcttaagccctgtcagcacaaggtgggactctggtctcctactctcttgtccatgcctttactgagcatggaaaacagcagttcttgctaaagtgccagtttctaactttttatctaacctataaatgctcacaagacagtttggctatataactgttgaaatccacatcttattcaagccttgacctatata

SEQ ID NO: 207409 - DNA, 126 bp, Homo sapiens
tgcatttatctcgtgggttaaaatcattcattgatcgctaatcacctgtggttgtttacacacaacaggttccctggacagcacaaaaccacaaggaggattatacataccacaggaaacaatcaa

SEQ ID NO: 207410 - DNA, 486 bp, Homo sapiens
aggtaacaggaaatgaccaaaggtgagctcaggtaaattgtttttgtcgtttcagctgtagttaaaatgactcagagatctaagcttctgtgccagacctgagtgaaatatttttttctttgtacattaaaaataacacatcaagaacatttatttttaccttggagaatacaaaacacctataagctttacccaattatacttcatttcccagtcttctaatgtaatgtataacaacgtggtaagctaggcgggtggatcacctgaggtcaggagttagagaccagcctgaccaacatggtgaaaccccgtctctactaaaagtacaaaattagctaggcgtggtggtgcatgcctgtaatcccagctacttgggaggctgaggcaggagaattggttgaacccaggagccagaggttgcagtgacctggaatgcgccattgcagtctagcctgggcaccaagagtgaaactccatctcaaaaaa

SEQ ID NO: 207411 - DNA, 265 bp, Homo sapiens
attcataatagctccacactggaaacaactaaaatttcttcagtagtggaatggaatacactgtggtgtattcacacaaaggaacgctgcacagcattaaaaaataacaacacgtacaacaacaaatgaatctcaaaaacataatgctgagctaaagaaccagatgcaaatattatacactgtttaattacatatgaagtttaaaagcaggcacaattggtatatggtgaaaaaagttataaaagtggttacctgtgggagtgag

SEQ ID NO: 207412 - DNA, 489 bp, Homo sapiens
aggctccaaaagttcatatttatatcagggagattcatcattcttttcgaagagcagtcccaggtcgcttgcctccattgttatgacatttgtcctcagaatcgctcatcaagacagacacggtaatggtcatttcaaacacagcacaaatgatgccagtggcagaggggggccaagccttcagagcctggagttgaagtaagaagccaggctaggggcttgtcacaccctggagggaaaataaataaagctgcaaggtctcagcacacattccggtctttgactgatttgtaagctctccaccagaggcttggctggtgtgtgagtactcatcttaccagctacatcaatgtcactaggtattgacggtgatgattcccaaaaataaattacctgcaagagaaggaaatagcaaaagactcgcaaatgaacctatcactcatttcttgtcatatatattaaaatagatataatctattctactttaaa

SEQ ID NO: 207413 - DNA, 246 bp, Homo sapiens
aaccagccagctacacagaaaatagtgaggtagaaggaaaagcaaagagagggctccacatcattccttgtcctttccatcctcccttactcatcagtaagccaaaggcagagagtgtcatagaatgtgcatacatcaggaggaaataaaaacaggtgagttagtgctgtacggtgtttccacctttctggtaggaacaaaatactcctgtacgatctgcaaattatgcattgtgtcattatcagt

SEQ ID NO: 207414 - DNA, 313 bp, Homo sapiens
tgaaatgcctcccttcccccacatcatcatgggctaaatgcttttactgtttagcaacttctctagcagtggttttccaacagaaacgtacagaaccatatgggagattttcaaaagaacaaggagctcaggttttctctagatctgcaaaattaggatttctggaagtagaacacagacatgctccttttgtttaaaatctccacagagtgtaaaacaccatttccttttaacaaatgcaaatagtattcctttgaacaaaaaagaatggtctttcgtagtgcttggtaaaaacaataaataaaaataacaa

SEQ ID NO: 207415 - DNA, 292 bp, Homo sapiens
cagaaaaaatgaagagagcttcagagaccctttgggacacaaagaaatgcatgcacttgtgcgctctctctctttttcatttttatttttctaatttatatggctaacttgtcaggcatactgatacaaagtgacccatggatgccagccatataagtgaaaagaataaaaatagaaggaaagaaggaagggaggaaggaaggaaggaaaaaaacaggagggagggaggaaggacagaaggaaggatggaaggaagaaaggaaagaaggagaaaggaaaggaagaaaagaaa

SEQ ID NO: 207416 - DNA, 482 bp, Homo sapiens
cttgacagaaataatagaactgctgtcttcttccaagttaaacaaaactttggagctaaaagctagctaggtcaagagaaacaaaatctaatcctcacccaattgagagactgaatatacaaagaatggccaaacctaaccatgacctcctacccataacctcttcagtaatcggccagaagggtcaggacttaatctttaaccggcagcttccctatttcttgcccctgcttccagctctgggccaatcagagaaagccaaatgtgctcctcacaccaatcgcgtaagaagccctgcttctagtatagccctcctccaacttcccgatgccaacatcctccaatcagagccaacctgaagtttctcccttttttcagtatatgtaaagcttttccactcccctgcctgcctatgagtctgttaaatcaagtgatgggtcgcggctgactcttgccagctctgagtaaatagcctattctca

SEQ ID NO: 207417 - DNA, 175 bp, Homo sapiens
tgatagtgcccttaatgctcctttgaatttctgagatattggttgtaatatctccttttccatctgatattacctatttggatctttatcttcttagttaaatctacctaaaggtctgtcaattttatcttttcaaaataccaatttatcatttcactgatctataggagtggtg

SEQ ID NO: 207418 - DNA, 1117 bp, Homo sapiens
gttttataatactttatcatgcgtacttgctttaaggtgatattggttatagaatttaccatcaatttaacaatagcctttccaaaaagaagcactacattaactatacacagtttttagaaattaacaatattacatacttattcatgcaatcacctaccactttcttcttcagcatcgtaattaaagttttagtctaagcgttcttcatattcagagcaaaaatattcttctgagtcactctcagcctttcagagctatgaatagagttacagtgacaaactgcattcataacaccttcacctgtaggacaggcagtataatttcaaggcataataaagtgctgagcttaggcgacttctactttaattacattgcttagtatgtcagacaaacttcagactaaatattacctgtttttttttcaaaactacatcacaaagtaatttatcccaagaaatttcaagcaacaaactaaatttatttaagagtcaaccttgtgggatgcaaccaatgcaaataattcagctgaggtcacaggagtatatatacctttatgtattgctaagttcccatattacaacttattcctgggccttgtggctgacaagtttcttttgacatcaattataaaaggcatctcgatttcagaaacataacactgtgaaaaacacaaccatgtaggatcaagaaaattacatataaatgttatacaaaatcactgtagcctttactttagagcactaggttaactgtttctttgtatttatgggagagttattatcttttattgtcactgctatttgtatacactgcggtcccatggaaaattttatttgaaaattgattacagtattgttttttaaaaaaattgtgaaaaacattgccctgggaaaatgcaagacacaagatagataagatagagcctttgccttgaaggacacattaaaagatgcatattccaaaaaaagaggcaatgaaatggtcaacagagacttataagtcaaaaattattctggacaataatctaataactgttaagctaccattttcttcttctgaaaagtccattttgcatgtctaaatgtttcacttacttttaaaattattcagttac

SEQ ID NO: 207419 - DNA, 295 bp, Homo sapiens
accctgatttcaaccagttcaggttttatctgtaaagtataatcagttccccaatatacaatttccctacaggaagaaaaaatcaatttgcagctttaaaaataaaaagtttgattcaaagccagcctgggcaacaaagtaagacctgtctcaaaaaataaaaacaagttttgaacaccactgatagagatttgggtttggagtttgaatctccccaccctacctctgtgcgtcccttctcttaagtgtaatgagaataatgctgtttgaacatgccagacaggtgctcaaaaaa

SEQ ID NO: 207420 - DNA, 292 bp, Homo sapiens
atttctattttcaatgaataaatgagaaacctagaatttttgttttggacacactttgatcatatctaatgtgttctacttcctctaattatttttatgttattaggatttttaaaaaatctcttagattaaaatttctcagtgtatctttgtttgcgtgtctttttttctctctccacttatgtaattgaagcatttctgacatatcctcagaacacacagattcttatcaggacttaactacccagggcagggccctccttggatttactgaaaataaacactttgggta

SEQ ID NO: 207421 - DNA, 289 bp, Homo sapiens
tggagttctttaaagtagtgtttttatataatctgcctgacaggcaagacaggatggttgaaatttatactcccaaatatgacagagttcaacccagttctgctgtttcataacagtgtggtcttgaggaaatctgaagagattggcaacttggaacttcagttttctcatctgtaaaatggggtcatagaaggactaccacatagggttgtgtttgggaatgagaagagatagaatagcaatttcgtatggagctgcgcatatattcagtaagtggtcgaagtacaat

SEQ ID NO: 207422 - DNA, 739 bp, Homo sapiens
  misc_feature (730)..(730): n is a, c, g, or t
catctcaaaatatatatatatatatatatatatatatatatgccatacgcagtggctcacacatataatgggaggtcaaggcaagacgatcatttgagcccagcagttcaagaccagtctgggccacatagcaagaccccaactctacaaaaaactttaaaaattagccgggcatggtggcatgctcctgtagtcccaactactcaagaggctggggtgagaggatcacttgagcccaggaattcgaggctatagtgagctatgatcgtgccactgccctccagcctgggtgacagcaagaccctgtctctaaaaaattaaaaattaagaaataaacttaatacctaaatatctttattcagtcaaattgttattcaaatgtgagaccataaaaaaatatattctcatacaaacacagcttcagaggcttagcagttaagggagagttatcagatttcatggtaagacttgtcactatccaaaaggagaaaaaagtaatcagaagaacatggcaaatattaagattggaaagaatttgaagcaccactacactatgaagactactccccaggaagatgcgatgtggtaacagctcaccttgactccaactagacaccagaagcggcggcacagttcacaacgggggcgaccacggaaagagatcccaacgagccccgcggacaacaacgctggacacgtgataggacgacgacaacaccacactcactcnggcgcccgc

SEQ ID NO: 207423 - DNA, 110 bp, Homo sapiens
ggggtacccccatttcagttctgggaagaattatttgtagtctgtagaaataagaacttgagaaatatccatgaagagtagaaccaaagagtcagcaccaaaaaaggatt

SEQ ID NO: 207424 - DNA, 367 bp, Homo sapiens
tgttttcttttgagacagagtctcactgtgtagactagcctcgagtgcagcagtgtgatcaatagctcatcgtggtctcaaacttccaggctcaagcagtcctcccacctcagcctcctgagtagctggaattacaggcacatgctaccatgcccagataacttgttttttatttttatttttagaagagacgaggtcttgccctgctggtcttgaatgcctggactcaagcaattctcccaccttggcctcccaaagttattgggaagggattacagcataagttatcacacccagcctctgctgatttaattatctgtgctttataatcccttttggggtgcatagcataagaaagaatggccat

SEQ ID NO: 207425 - DNA, 313 bp, Homo sapiens
gtgttaagattattatttaaatccagtgggaagccataggtgcattatatataaagcagtgacatgaactgatttagacctttaaaagatcactctggtagctgtatagacaatgaattaaaagtataaaacatagatacatgaagtttagagaccgcagtaatacaagagaaaggatagaatgtcctgaactagagaatagcagtggcagagaaatggataaatttaggacacattttgaaggcagaaacagaacaacttggtaatggattagatgtgagaaagtacatgaaaggaatgaaagcaagataat

SEQ ID NO: 207426 - DNA, 542 bp, Homo sapiens
taggtactattttttactattcagagccaagacagcaattccggttttctttctcttacatccgttgaaaagtacagctacttatttccttatcttcccccaaaaagttctccctatagaagagtgcacagggccttctctcatcagaaagaccttttggtgtgattagctatcactgcactggcattcatgaaggaggatgtatggtcagggtatacttttattgatcctggttgggatagataatgaaatatgtgttaggcagctgatcgttttggataaggaaatgacttatgaagggtaaagagaggctcttagtttcattaagtcattgacatgaatacatgtcctcactcttactacctggactgtgaattttccagtccatgttctcattctttccacaaaaaaatactctcgctgggtgcagtggctcatgcctgtaatccttgcactttgggaggctgaggagggaggattgcttgagcctaggagttcgagaccaacctgggcaacacagtgagaccccatctctacaaaaa

SEQ ID NO: 207427 - DNA, 353 bp, Homo sapiens
  misc_feature (89)..(89): n is a, c, g, or t
gttcttgagaggtgatttgctttacatgtcattggctgcttgtgagatgcttaagaacatgtgtgcagcaccgtggaggccctggaggngggtctgttgttttagggaattccctttatagctctatacatgcggggccacagggaggatctgcttggaaactttttaagcagaactttatgaaagctcacagaacatgttcattcaccttccacacatgaaaatgcccatttgtcgggtcagtgttcagtgtgaaaccattgaactaaacatgtcaaaccacaggactaaaggagacctgacacttcatctggatacccctgtctagatcctactcccaccaggcacatggc

SEQ ID NO: 207428 - DNA, 171 bp, Homo sapiens
tctgaggtgatctagaggatcccgtctttgttttctttaaggaaagcaattttacatttttaaaaacattcacagttttaatgtagtttactatgtaacatgaaaaaatgatccagaaaggccatctcaggtcatatcctaataaaacaattatattgtgagcagcgttgg

SEQ ID NO: 207429 - DNA, 609 bp, Homo sapiens
gattttttgtgatctaacatgtcaacagtctgactgtatgtgaatttatttcaggtcatttagaaccttgatttgtattaaatactgttcagctcctttctcatagaatcccagatcgatttcaggaaggagtacctagcagtttttaatagctgctgtgtggcggacactattctctgaacttttcatccatctcatttaaccccaatggtatctatccttcataggtaggaggtggggttcccatttacaaccacatgaactgtgggtcaagtgaagtaatttacgcaagactgcctttaaaaaaataaaataaaataacactttggtgttgccagcactttgagaggccaaggcgggtggatcacctgaggttaggagttcaagaccagcctgaccaacatggagaaaccctgtctctactaaaagtacaaaattagccgggcatggtggcacatgcctgtaatcccagctactcgggaggctgaggcaggagaatcccttgaacccgagaagcagaggttgcgatgagccaagatagcgccattgcactccagcctgggcagcaagagcgaaactccatctcaaaaaacaaacaaaaacagtaag

SEQ ID NO: 207430 - DNA, 405 bp, Homo sapiens
acagtgtacccacaaaaacacctacaaagtacccacaaaaattaaaaattaaaaagttagagaacacaaagaaaattactactgtgatgttatgcatatcccaaaaacctatatatacgatattttccctgaagtatatatatttgtacataaattcatggggggaaaaaaactcttgagaggatcacatcatactgacagaagtagtttgctaggaagggcagaagtttacgcaggggagggtgagtggtcaaccagatgcactttggattctgctttaatctagagtttcatgcagctaagcatctgactgaataaaggaaggaaaaggagtcatcttagcggaagatgatatacagttgacaaaattctagtcaaagatgcaatctccagatacaaaaagag

SEQ ID NO: 207431 - DNA, 119 bp, Homo sapiens
aacttttccaaagtagctataccatattatgttctcactggcaatgtgtgagaattccagtttgtccacatccttgccaacaatggttactgtcttttatgttagccatcctagtgggt

SEQ ID NO: 207432 - DNA, 599 bp, Homo sapiens
tggcccttctgaagaatgtcacaggaaagcaaagctgagagggcctcgtgaactcatccatgcctgtctcccacactgacctgcacctttggtcccagaggtgcttatgaaagacagatgctcagatccctccttagagagtcagattcaggaggtctgatgtgaatcccagagacctggaattttactgatggcccagataatttttatggtcagatactgacctaattccacccagtttcccactaaattttgtaagtgaggaaagcaatgcagaagagttacaggaaggcccagtgttacatgcccaggtcatggcccagggccaagccagccccaaaggtgggaccctggttctcttagccttccctgacacctgtcaccctggctgctgctccagggaaccctctctcgggagaagcttgagcaaatgttgatcttcccagaacaggggtctacagaatccagaggtgtggaaacagtgggatgctaatagctgttagaattttggttcatccatagatccaaactttgaagcattgagacaaaagatagctgtgctttgatagagaaaatagataagaaaagggtgtgaaatc

SEQ ID NO: 207433 - DNA, 361 bp, Homo sapiens
agcaattacagactctgctgtccctaagactgtaaaacacagctttcacctttagccaaatccccctgccatttaaaatcaattctgtctcatgagaggcagtacagcttaatagtctgggctcaggaggctgaggcaggtggatcacctgaggtcaggagttcgagaccaggttggccaatatggtgaaaccccatctctgctaaaaatacaaaaattagctgggcatagtggcatgtgcctataatcccagctacttgggaggttgaggcagaagaatcgcttgaacccgagaggcggaggctgcagtgagacgagatcctgccactgcactccagcctgggcaacagaaagagactat

SEQ ID NO: 207434 - DNA, 727 bp, Homo sapiens
  misc_feature (1)..(1): n is a, c, g, or t
  misc_feature (7)..(7): n is a, c, g, or t
  misc_feature (18)..(18): n is a, c, g, or t
  misc_feature (24)..(24): n is a, c, g, or t
naatggnaaatggggggnctttcncttccccttggtggccatggagagtaggtctaatctgtctaccaccaaaggttgtgaggattaaatggggtaatgggcgtagcacacctctcatggtgcctggcacatagtggcctgcaggtggcctcttcccctctggctcattcctgaattggcccacaggagccttggagcacagatgtgggcagggttccttgttgccgcaggcctctcattcggtactggcccctaagtgccttttacctttaataacttttaattgttttttaaagacaagagtctcactccgtcacccaggctgcagtgtagtgcgatcctggctcactgcaacctctgcttcccaggttcaagcaattctcctgcctcagcctcccgagtagctgggattacaggcatgtgtcaccacgcctggctaatttttgtatttttagtagagacaaggtttctccatgttggccaggctgatctcaacctcctgacctcaagtgatctgcctgcctcagcttccaaagtgctgggattacaggagtgagccaccgcgcctggcctgcctttaatgacttttttaaagggaatggctcagtcaaagcacctgtgtgtgcagtgaagaacgatgggccacctttcgcttcctggtgagaagttcttctcataaaccttggaactgcaggtctgggaaaagccttatcattaatcccactgg

SEQ ID NO: 207435 - DNA, 890 bp, Homo sapiens
tcagtgctacccatatgagaacaagctgatttgttcactgattgataaattgattgctcagtgcattcattctgtcagccaagatttttggagtactctcaatttgaagcatgctgtcacagacagaccatgggttttcagtcactgtaaacactggacaagccacacacatactatctctgaaccttgggtttgttctctgtaaaatgggagtgatgctacttacctcacggggaggttgtgaggattaaatggggtaatgggcgtagcacacctctcatggtgcctggcacatagtggcctgcaggtggcctcttcccctctggctcattcctgaattggcccacaggagccttggagcacagatgtgggcagggttccttgttgccgcaggcctctcattcggtactggcccctaagtgccttttacctttaataacttttaattgttttttaaagacaagagtctcactccgtcacccaggctgcagtgtagtgcgatcctggctcactgcaacctctgcttcccaggttcaagcaattctcctgcctcagcctcccgagtagctgggattacaggcatgtgtcaccacgcctggctaatttttgtatttttagtagagacaaggtttctccatgttggccaggctgatctcaacctcctgacctcaagtgatctgcctgcctcagcttccaaagtgctgggattacaggagtgagccaccgcgcctggcctgcctttaatgacttttttaaagggaatggctcagtcaaagcacctgtgtgtgcagtgaagaacgatgggccacctttcgcttcctggtgagaagttcttctcataaaccttggaactgcaggtctgggaaaagccttatcattaatcccactgg

SEQ ID NO: 207436 - DNA, 476 bp, Homo sapiens
agagtttcatcattcaaagcgaattgtattaagcaccatacttggacttggtaaagttttgcttctagtcatggctttactaccagatgcttacatgtcacagctatttaacatgaaccttgacaagaaaagtcactcaacatttctgagcttcagtttcttggtctgtaaaatacaacatcatagataatcttttacttaaagaagatggcttaaaaaatcagaaatgtgttctcccaccattctggaggccagaagtctgaaataatggtgttaacagggccatgctctctctggaggctctagggaagaatccttccttgtctttttccagcttctggtgttgtgccagtccttggtgttccttggcttgtagctacatcactccagttgctgcctccatcttcatatgaccatctttctctttgcatctgtgtccagatttccatgttagaagaacatcagtcatattgaat

SEQ ID NO: 207437 - DNA, 372 bp, Homo sapiens
ctaaaaaaaacaaacaacatatcttactgactaaacctgaatggaactcataattagtctttctgtatttttccacaaaatagcgaattggtacttgggagacttctgtttttttgttgttgttgttgttgaaaaaactgcctttgttctgaaattatatcacctgtgttctgaactaagatgatgggagttcattttgtatttactttgcagtaagtatcatgtaaatacgcaaacgttgaatgtaatatagattgtgatcgcagtggttttttgggtgatacagtttataaatataccaattatacaccctcatacatttgtctgattttgaatttgtaaaatgaggactactgtttacacatttaatac

SEQ ID NO: 207438 - DNA, 305 bp, Homo sapiens
tgagctagggtctcgctgttatatccaggctagagagcagtggcccaatcacagccacttcagcctcaacctcccaggctcaagcaaacctctcaccacttcaacctctcgaggagctgagactacaggtatatcccaccatgcctggctaattttttctattttttgtagagatgctgacccactatgttgcccaggctggtcttaagctcacaacctcaagcgaccctccttccaaggaaattataactttgtatgcagttaaaactaggctcttttcctttgagactcctcccatttctttt

SEQ ID NO: 207439 - DNA, 243 bp, Homo sapiens
ccttttttcaatatttactatgcctcttctacgtaactcaatgtcctaggtagtgactagattcaacattgaataaaacaaatccctcttactctctaaagacgtgaaggatgaaacacgatagattaaaaataaatatcatgtcatatagtaataatgtagggttggggagggaaacagcaacagtttttgaagaggagtactattatagaggagtcaagaaaggcctctttcaggacattt

SEQ ID NO: 207440 - DNA, 329 bp, Homo sapiens
gtggaatatagttttagctataaatatgtttcacctaatgtgattctggaaaatgttgcttgaaaatttgactgtaaagtaactttgaaaaggttattcttttttttcaattggcttccaaaatgaaaatagatttaatcccagtttaggtcaaagattcagtaaaacctgtgtttaagaagcagtaacattttcttttaagagaagtagtttttgcttataaaatactttatcatctccgatttttagatggtctttataacaaatttatcttaaaaattcttacctatatactaatgcttaatcatcgagaaatgggtcttgatata

SEQ ID NO: 207441 - DNA, 651 bp, Homo sapiens
tgcatgacagttgacaatcactgtgacaatgaacggaagagaccaagaaaggacagaaatgaggtgactccttgattctaggaaaatctccatcccttactaagaaaagcatgaatattcctcaccttgctcattcccttcattaaagatcctctatatttgtaacttcctggttctcagtagctgagaaggtgatttgcaagctatactacttctccaattccatgctatgctcctacttctccaatgccattgaatagagcctgcactgcttgacgctcactcttggtttcatacattggctttgcaataataaacaggaaagagtccctttttggggtgagacccctcagtaacatctgcagcccctctaaatagccatctcaaattataccaaaggagtgtattttggggtggcatattttgggcttcccacatggctaagccaacatatagcattcttgctgaacgcagggtgatcagacatcacctagcagatggtgaaggatgaggagccctattagatattatgagtgatcagctattgaagatggggaattctggctaaattgactgagaaggattcttgctgagattgaacaatgcagagaggaacacagaagctcaatagttgaggcctagtgagaagag

SEQ ID NO: 207442 - DNA, 513 bp, Homo sapiens
tgagccacaggtgaaagcatggggccccaatctagtgccctgcatgcccaatgcccaggcctcaaggcccacgtctgcagagcccaggggaaaggtgccttgaggacgaagctgggtcctggggagccagctccagtactgggggtggctcactgtttcctgtccaggaatgctcaggacaaccagcttcttgcaatcttcccagctcaggctccccagcctgagtcacaccatcaccatactgtggaccctggacaagcctccggacttttctgggcctcaccttccccacctgggagtgcaggtgctaatgcccacctgtgggctgtgtcacaccataggccaagagcttcttcagtgcctggcactcagtaggcctgcaataaatggagacagctgctaggatgcaggcgaaccccctggtgcacagtagggtctcaacccaatcccgctgaccccatagcatggacaaggcgaggttctcaaaggcctctgagagccagaggtgcctag

SEQ ID NO: 207443 - DNA, 572 bp, Homo sapiens
tgttgcagactcctcaaccctgttactatcgttcagagtagccacagacagtatgtaaatgagtgggtgtgaatgtgttcccaaaatattttattggcgaaaacaggcaacaggttaattttaaactgcaagccacaatttgctcacccttggactaggctaattcccaaggctatgaacagcaaacggccaggcacaaataaatcggctaccaatcaatcacattgaccagggattttgaggataaactagagaatatgacataagattccttcaaaatcaaggatgaagtaacaacagttaatttaatattatctttctgtctatccatccatccgtgtgttcattcagctattcctttctttcatatttcattgtgtttgacttctcttctatttagccagaaatatttgtttatattaaggatactaagattaatatagtaagaatacagagaaagaaagaacgggagaaaaagaaagaggggaaggaaggaagagagaaaataagaggtgggagagaaaataaaagaaggaagggggaaagaatgaaagagaaagaagaaagaggaa

SEQ ID NO: 207444 - DNA, 298 bp, Homo sapiens
caataagaactacggtcctgaggacacgcctcccagcctcccttaggtattggggttggttccccttccggatgtaggcaggggattggtggcgcagggtcggaaagatcagtagatacgtcagtaacgcgtcccagagggaagaggggcggtgcctgtctccgaagcgaggagcggattggcttcacggaggccgcgcccccgaagtcacggccggcgggcatttggaaatagcttgtcatttccctccttcaacctgtaccattcttcaagaaacggtttgaatcagactgccttt

SEQ ID NO: 207445 - DNA, 343 bp, Homo sapiens
agtttcttcaaggcacttgctaataggaagacggcacctacttgattagacagtgaacagttattcacatgacaattctaatacatcctaatttccacctaggatttacatactggagaatattttctagaagattctagcttttaaatggtttaatttgaaaaccaccaatcacaggggtagatgggaaaagaattaaacaaaaaggaattactaaatataagatgttctttaaaagtaaataacaagaaagaaaaacaaatatttcaaaatacatcttcaactattttgattatgtatcttactagcaagaatacccattactgcaaacaatcacattgtg

SEQ ID NO: 207446 - DNA, 489 bp, Homo sapiens
ttttaataatttaaaatataaaagagttaggttctgctttgttgagctgtgttgcaaagtgttaatgaagtagaaactttgctttttatagtctattatactatatcttcagtaggttttgagaacatctaaaaacaataagcaaatcatcttatttagaagaaaaggtgacttatcaactcacagtaataagattgagaacagtctttattagacaaatttagaagaagctataaattatggtttatagatcaataaattgattaaacttttatcaaactttaaaaattactactttttaaattttaggatatcttttctaaacagcaaaagaaaagaaaaaacatatttaagaatataggggctgggtgcggtggctctcgcctgtaatcccagcactttgtgaggctgaggcggacggatcacaagatcaagagatcgagaccatcctggctaacatggtgaaacctcgtctctactaaaaataca

SEQ ID NO: 207447 - DNA, 444 bp, Homo sapiens
ctttagaccaaatggaagtaacacatttacaatatatttcatccaacagctgcaaaacacacattgttttcatcaccagtagaatattcttcaagattggccacatgttaagccacaaaacaagatttgatatcagctaggcacagttttgcttgcatgtagtcccagctacttgggaaggtgaggcagaaaggatctcatgagtccaagagttcaagaccagcctgggcaatatagtgagatggcgtttcttagttttaagaactttttaaaaattaaaatcatacaaaggatcttttctgaccacaaatgaaataaagatagaaatcagtaacaatagaaacttttggaattgtacaaatacatggaaatttacaaacgtgctcctaaacaaccagtgggtcaatgagtaaattaggaaggagactttaaaatttcttcagt

SEQ ID NO: 207448 - DNA, 160 bp, Homo sapiens
atgacacatacactcctctaacataagtggtcctgacaactacaaaatcagctgtttacttcttcaaccaaaacgtcaacttttaaacaacactcaggccatccccgacctacaagagcccaactagggacagggttgtaggggtgaggaggcctggtgt

SEQ ID NO: 207449 - DNA, 385 bp, Homo sapiens
ctgtagtttgtcttttcaccccagtactatggaataattagcttttacttaagattaacaccattaagtcttcagtagaaggaagatagtaaagaaaaccgtctcatgtttctcttcttcctgttctgtatgattacgtactgcttttatcccaaatccttcagaataattttggtacattttatggattaaattatcttctataaattatgtctgggtaaattttactctgctattttggctgaaacagtatctagaactagaaaaaatgtttgaaagtttcttgatgtagttggattgacctgtaaattgagcatagtagtttgttacaaataatgctttataaataatagcataatagtttgtaacaactgtagaatagaaa

SEQ ID NO: 207450 - DNA, 701 bp, Homo sapiens
gaaatgtatcttacatggtacagataggaaatcatatacacactgtggcacatacgaaagctattccctaagttcttgccgaaatatatttttatattattttttaattaaaaatttactgaaactcgtactcctgaaataaaatagctattgtctttatagaaaaggatggaccataacatttaatgagagaactcaagctgtaggttatagtttccagaccattggtcacttactcaccatgcttcctactttctgtcttttcttctatttccccccactattaaggattatttggtggctccgtaattgagcaattttttggtctgttctttaataagtgtttacttccccctaccattttattagtgaaatgagttttttataacgctattatatctatgttgttttaaaaagctacatacttcttctcattatttaatcttgtgagagatttgctattatctggagtttcatattatccataataattttgtttgttacataatcaacagaatggctaaaaattaaaaaggtggaaaataacaagggttcacaaaaatgtagcaaactggaactctcattcactgctaaaggagttttatagctgctttggaaaactatttggttatatttactaaagctgaacatatgtatgttctatgacccaacagttctagtgtatactcagcagaaattaa

SEQ ID NO: 207451 - DNA, 171 bp, Homo sapiens
ctaagcccaggtaatggtgttaaacagatagcaattttgaacttggaggcttgtttcattcccagtattttcagtaattctgtctttctttcagcaaatatttactgagtgccacctatttgcctgattctgtcgtagctaagcactggagaaaacaatgctgagcaagac

SEQ ID NO: 207452 - DNA, 597 bp, Homo sapiens
agccggcccacagttatagatcagtaactatgtccctggaatgtttctgatatcttcaaataacaagttccttctgcagacaagattacactgtccattaaattgaataatgggctatttggaaagccagaaactggctcaatcaccacagcaaaatgaagaagaaagtaaactggaatggacttgtacaatgccttaatttcttaaatcatttagtggaactgaaagccacaggacaaggaaagacaaaacatgtgtccagtcaacattatgtaaatgtgaaggggatgctaaaggaaataaagtcagctcctaagaagggaaaatataacagttcaacctaaactgttctgcttatttactgatggtaaatggctacttttagagaaaaaaaatagaaatttaggctgactttaatcaaggttcattctttggttgagcacatgcgtgtgtgtgtgtggaaggggagtgtgaaggggagagtattaatattaccttacacctctcatagctttctttctgtattttcctatctctgatggtatgactcagtcacctaagccaaaaacttaatcagctgaattatatataaagata

SEQ ID NO: 207453 - DNA, 1145 bp, Homo sapiens
aaaattaaaaaaaaaaaagctagggagaagagagagatctcattccaaacaattattggtcaacaatagttttagaccattgaaagaatataagagaatgttgacttgataataaatattgccatttagatgtcaggtgataaagtttattttgttgttaagctctctccattttgccccattcagtttaaaaggaaagtttttgtgtttaggaaactaaaggatgggtgatatgtagcagacccataaggttattttcatgaaaaacctagcttgggctaatctgaaagattcctcaataacagtctttggtgtcttatcctttcttctccatttgcctaagaatataattgtataagctggatgtttattccttggctatcgtttttacctaggaatcaatttctgcaagagctctgtaagccttacaaagcagaaagtcatccatttcttttttctttgttctcatttagtgcctcatttgatttcactttgtgtatctatttattgctccatgttaagtcaggtatgcatacatcatagaagtctgcctctcatttccatcttctttgccttatgtatcacttctcttgtgtcctattagagggagatgatctatgcttaaagctgttgggttatttttgataattatataacaccaacatgctgtgtctatagttcccatttattgattcaactaatatttctgagtatctacagcatgccgggactgggcaaggcatgggggatacaagagattgaggtggctgcaatccctccagtgaaatgctgcaaaataagcaaggggctgagagagaaagtaatgagactgaaacgattgtcagtacagcccactagtccctctgcctagaacgtgctcctgaatgtgctcctgctctgtgtggtgggctgcctttgtctctcccacgggacccagcccagtcatcacctctgcactcagacatctctgaccctcccaagtggctgcatcccacacactccagttatcgcactcatcaccttgcctcattcttggactttgctgccagactacgatttatctcgagcacctatcctagtaactgacactaataggcattcattgtttgtttattgaatggtgactatacaaaataaattatcta

SEQ ID NO: 207454 - DNA, 324 bp, Homo sapiens
aaagaaaggggatggtcatgggacgcgctctagcagggtggcaatctttagatggttattaagaaatgggatgaaaaaagtagaaactgatgggtgtgaagacaacagtgactccatcttgcatgctaatctaccatgttcacttttgattaacctcagtcccacgaatgcctgctgatttctactttacttgctgtccttagtgtaggaacatgtacccactataaatcctgcctttagagcaaagcaaccttgatgttatcacaaaaattacaggctatgacacgcatagcattcttgcctgttctggagcttgcctttgtc

SEQ ID NO: 207455 - DNA, 262 bp, Homo sapiens
aggttgaggctgcagtgagctgtgattgcaccactgcactccagcctgggcaacagagaatgactgtctcaaaaaattaattaagaagtataaaagaaaaaatagaaatttaaactacactgtttacctcataaaggataggcaaaaccccaaaatttgtccacacagtatctctagtgaggctgtggaataaataggtatcttaacctatttatctggtggggctgaagaatataactggagcaactcctacaaatggcaa

SEQ ID NO: 207456 - DNA, 331 bp, Homo sapiens
actttactatgggctagaacttggaatgccagaaggtctctcgtgtccccagtcttctgttcttacagttctttacataacccaatggtcccctaggctggtaactgtccttaacagaagctaggttgtaaatcgtctttctggaatgtggctcctagagccagacacagccgctggtgtggcccacctagtgcagaggagaacagaccacccctttccttgctcttgaatgaggctgggacatcacactctcaacttctgtggaatttctgtttgtgcttctgataagccacatatgccacataatatatcttatataaaccacgttaag

SEQ ID NO: 207457 - DNA, 221 bp, Homo sapiens
gccctcagatattttgtcaggacagtgtaaaatgtgggccaagatagtggttttgggtccaaacagaagggggttagagattttggaggttgaagcctgctgctagaaggagtatagaaagaagaacggggattctgtttgcccaaatacatggttaggctcatcttggacttgtttttgttttatatcttctgttacttctatgcacatattaatagata

SEQ ID NO: 207458 - DNA, 397 bp, Homo sapiens
ctcccaaccccaccccacctcaggtccaggatgaacattccagcagtgtggtctgcccacaggggagacccagggaagaggcctgcacagtccttagaaaaaggcttagggtttgagggtgaggaatcccaggatcccagacacctggtgtgggcttcaggtgggctcgtgcccttggccctcccagctaagtggttctgctggaggaggcagaccagagtgggaccctcaaagtcacagagccctgggccgagacccccaaatgctcaactttaagggtgatactatcctcaggaatccttgcaaagtaggaaaattgaacccagtgattgttttcaagatagctttatgttaatactcaatttaaccaattaaagaaatcgacataaaatcaaaa

SEQ ID NO: 207459 - DNA, 293 bp, Homo sapiens
gaaatactgagttctatttcacgtaagtcactgtacatctaacaagagatttgcaaaaaagaatttataattattcctattttatagctgtataatagaaatgtcacttaaatgtttttaaatttaggacatatttatttgataaactgttactagaataaaaatttctgtactaatatttataagctcaaaacacaatttaattcaaactttagttaatacattaaaaatctcagaagtgtggaatgaaaagttactaaaaagaataaattatattcaaacaatacacaata

SEQ ID NO: 207460 - DNA, 129 bp, Homo sapiens
ccttgcagacattctgacatctcaatagccagctgactgaaggcctgtggggtcaggtttgagaggtagatggggagcaggcaagagagcatttgaagctgaatgtatcaagactgccaagactaagag

SEQ ID NO: 207461 - DNA, 565 bp, Homo sapiens
cccaaaccttcagaaaaaccctgtccacgcactcacaggctcacatataaatgccgtgtgtgtgtggttgtttgcgtggaaattagagaaaaggactgaattagtccatacatgctaagtggggaaacagacaggaagtggatcccccaaattgaatgtctctctagctgaagcaaagactcaggggtggagaatgtgaagctccggagaattagcagaaacgtggggaggacattcatcatcccaccgttggagaatggggtttgaattaattttatatagatcctaacagggagttcccatatgacatctggaatataagtataggcgagaaaaataccaccactgcctgcaggcacttctgccttgtaggcaaactgtaatttttccctacgtttctctttgtttaggaagatgcccttgggggtgaaaggtgaagtgctattgatgtttaagtgggaagaatgtggagtttctagagttagggatagaagggctgggactgggataagatgggaggagtgtctccaggggtcctcagaggacaagcgggagtggaaggaga

SEQ ID NO: 207462 - DNA, 579 bp, Homo sapiens
aaatgaaaacatatattcatgcaaacacttgtatagaaatgttcatagcaacatcattcataatagccaaaaactggagacaacccaaatgttcatcaactgatgaatgaataaacaaaatgtagtttatctatatacaatggactattattcagccataaaaaggaatgaagtactgacacatgctacaacatgggtgaactttgaaaacattatgctaagtgaaagaagccagtcacaaaaaactgtatagtgtatgatttcatttatatgaaatgaccaggaaaggaaaatttttagagacagaaagcagatcagtagttgtctgaaactgaaggtaacaagtgaggattgactgcaaattctctttttgtttgtttgttttgtttcttttttttttgactgcacattctcacaagtaattttctgggtgttagaaatgttctaaaactggattgtgacagtggttgcacaaagctatcaatttactaaaaattattcactgtacacttataatgggtgaagtcttatggtacataaaatatatttcaataaaactaagaaaaagtctcatgaatt

SEQ ID NO: 207463 - DNA, 464 bp, Homo sapiens
tctctatgtggataacatgtagcattaatttgtcatattacatgtacatttattaaaaatcctagcagcaatgttaccaagtaacagtgttactgatattatttcatcaattagaaatgctgaattatttttaaagaaaaatctcgctagtgacctttcatctgacgtaaataagaggcttaacctatatctcaaaaaaaaaatcaagtcaaatttaccacttgtaattttgtttgcattactgaatcatttgacttgtttttgtctctgtgtttgttagtcagctcatacaaacagtttatcctcagtcattccaccaagctctttgcagtcatctagaaagaatcagacattattactaccattcttgtttacccttcctgaaagattttccaaagaaaaggagaaacaggcttgaattatacatgaagaatttcaccataaaatctgaacaaaaaacatcc

SEQ ID NO: 207464 - DNA, 377 bp, Homo sapiens
gttattttgaaatcatctactcatagcaatctagtatctagctgcaagactgtgcagacactgcacagggacagagtagcagcagacaattgaaagttgactgtgaggccgggcacagtggctcaagccggtaatcccagcactttgggagcctgaggctgacggatcacctgaggtcgggagtttgatactagcctgaccaacatggagaaaccccatctctactaaaaatacacaattagccaggcatggtggtgcatgcctgtaatcccagctactcagaggctgaggcagggaaacccgagaggcagaggttgcagtgagccgagatggtgccatcgcactccagcgtgggcaacaagagcgaaactctgtct

SEQ ID NO: 207465 - DNA, 811 bp, Homo sapiens
ggactcttttctcttgcctggaccctacaaatattttgcattgtgacgtgtagctgggtctgccacccaggtaatgtgagtcttccacataagccctggccacaagagtattatgaaataactttttattcatcacctaggtagtgatgtgactcttcatcagcctgtaccctgccacaagggaattgtgttgtgtcagtgggtccagcacctagatgatgtaactcatcttttggctggacctttcatattttacatattagttacatatcactgcatctgacattaggggatgagaggcttctgcctgggccctgcccacagatggcctcgtgacatattttggcatccatcacctaagaaacgtggctctcctcacctacatgcaccatgcacaaagaaaatattgtggcatatcactgggatcagccaccaggtatgtgtctatcctctcagggtgttgctcacagagagcgttgtaacatatcactgggcccagcacacaggtgatgtgacttgtggcctgtgcctatctagcctttttttttttgaggcagagtctcactctgttgcccaggttggagtgcaccgatgtatgatctgggctcactgcaaaatctgcctcctgggttcaagcagttctcctgccttagcctcccaagtagctgggattacaggcatgcattaccacaccgttctaattttggctatcggagtaaaggtgaagttacccatgttggccaggctggttctaactcctgacctcaggtatccacttgccttggccccaaagtgtggactccgaattaca

SEQ ID NO: 207466 - DNA, 782 bp, Homo sapiens
agcctggtgttctgctcagtaccaagtgcagcactttcacatgcttgatgctcaatgaatgttgaaggagagagtgaatggatacagagctgaatgagtaggttcacccttgtgactctctcagaggactgccccattgtctgcaagcctgaaaaccagaagtgcctaaggggttgcatcctccctgcacagccattagccaatgactggcaaaggagagggaaagctcggatccattgcctcgtttgggaaaaactcggagacatgattcgcactctggagttttcctgcaggatcaggcctacatcccctttctgaaatttctcataaaccacggtcccctgcttggctttttccccttccctgcccatcatccatcttcctctacttctctccttcatttcagaatctgcatctgagaaaactgccctaagataaggaatatgcttatcttccaatttgagttctgtaaacaacagccaagagagcaggggtgacgatacagctgagccacaatcaagtttcttattattttccaggcacagaagattccagtccacatcctttcttcctttcattcccaagatatagcaatagaagtctgaagacggtaaactctaataactgttccctgaatagaaaataacaagccttcccctccatacctaacagtccccaatacaattggtgttcataatatgcagtttgaagacaatgatgaccaatgaccaaaggcataatctgaatcacagccctatatcagtgctctggacccacatatc

SEQ ID NO: 207467 - DNA, 323 bp, Homo sapiens
catgcttcgtccttttagttcacaggtctctggatcaacagatgctgtacccaaggagctggacctgtggaattatcccccaggaattttgactgcacctggattggatttagtgtaagaagagtaactgtcatgagcctcaaatgagttctgcagtagagaaaccatataatgaagtaaagaaaaaaacaaacaacaacaaaaaaaaaacctttatactgatcactacatgggcaaaaaagaagacagttgtagaggtatgatggaataaaaaaattgatcagtcagatggcaaaactgtcatcttcatcaaaatgccaaga

SEQ ID NO: 207468 - DNA, 533 bp, Homo sapiens
atctccccaaggcagggagtgaatgcacagaagacgcatgaactgagaatatactctgccagttttcctggacatgcaattgcctttgaacttgctataatatattatgtctgcagaattcagaacattataatggccttcatccttgacccaaaaatcagggcagaagactctccacaagtaaatgtatttatggggaaaacaatgtgttatttgaaatgagctctaccttggacactccaagctatcagcttaccttcctgaagaagaaaaggataggtgtatcctcaccttcagtagcaggtccttccagcaagatgagactcctccaaggaaattgcagaagacttcctgagaaggaacaacagaaaatagaagacaattttgcttatcctggaaaatgtggctcttccatctgatgttaaatatgtattttgagcgtggaacaaagagtataatacagatcctcgtgttcttataattatgttagggtttcagaaaaacaatatatactttaatatccatcaatcaaa

SEQ ID NO: 207469 - DNA, 487 bp, Homo sapiens
tgaaactgcagaaagcaaatccatggataaggggagactactgcatatccaagagaaataaaaacatctgtacacacaaaaacatgcaattcttcacagcatcattattcataacaattcaaacgtccatctactaacaagtgaataaacaaaatgtgacacatccatacaatggaatattatttggccataaaaaggaatgaagtggccaggcatggtggcccatgcctgtaatcccagcactttgggaggccgaggcaggcagatcacaaggtcaccagttcaagatcagcctggccaatatggtgaaaccccatctctattataaatgtaaaaattagccaggcatactggcggatgcctgtaatcccagctactcaggaggctgaggcaggagaatcgcttgaacctgggaggtagaggttgcagtgagccgagaccaagccattgcactccagcctgggcgacagagcgagattccatctca

SEQ ID NO: 207470 - DNA, 571 bp, Homo sapiens
cacagactctcttgcatctctcgacccttgatccttttttaaatttaacccacatacttttgccacctcccccttaggattcttcttatctcgattttaggtctttcatccatgttctcagaaatcatctttcttaagcttcaagagcctactttttcgtttattcaaagattgcctatataaaatatttttcttaatactttgtattgtgaagaagtctcaatacaaagcagtgaacattacattatatttaactttctgatatgatataaaatttgccatgtgtaaaataagtgctcaaaatgtatttgttaataatgacttaaaagtcaagttatcactcagtgacttacttagctgatctgaacagaaatactcttctgttgtactctttgaatcttttactcagaaaagtatattgaatttaggaagcttttagactgaattgtacatttagagaaacttaactatgccacattgattaataaatagcaaatctgtggtagtttgagttttctacaaatctatggtagtgttttgagtttaggtgaactctgcctatttaagagat

SEQ ID NO: 207471 - DNA, 591 bp, Homo sapiens
aagttattagagcaggtgttttatatcattgtattttatataacttaattgtcatgaataggtatacactccctttatcttttatttgtaccaaattgtttagtaagccttgttaaaggtaaatcaagtccagattccagattagtgaagccagaattttattttgattctttttctttatagtccaaaaatgagcacatctcaaataaatataagtgattagggtgaggggtggaatttatacgattattgtcatgtgtaagcctgaccagactgtctatatcttcaaagttacattgtggataacttagagcttaaaaaatttgtgaatttgtgaaataggaagttgattatacattcagtattcagataatttatattggaggttggcatactttctccataaaggggcagctagtaaatacttttggtttttcaggccatatgttctctgtcataactatgcagttctgcaattgtaatgtgaaagcagatacagacaatatgtaaaagaatgtgtggttgtgttgcaaaaaaacttcatttacagacaggcagcatgctgaatttggcatatggaccataagttta

SEQ ID NO: 207472 - DNA, 357 bp, Homo sapiens
cgtggcgtgtcactctgttgcacaggccggagtgcagtggtgcagtcttggctcgctgcagcctccacctcccaggttcaagcaattctcctgcttcagcctcctgagtagctgggattacaggcgcttgccaccacacctggctaatttttgtatttttagtagagacgggatttcaccacgttagcgagactggtcttgaactcctgacctcaagtgatccacctgcctcagcctcccgaagtgctgggattgcaggcgtgagccaccgcgcctggcccatagcaacttttaagaaactcatttgtcgagctttagtgtaatatcaatgaagaatagacagttttctgaaaaagt

SEQ ID NO: 207473 - DNA, 415 bp, Homo sapiens
aagagtctgaaatgtattttaacgctgcacccgggtacaggaacattctaccaaaagatgagtgtattacagttctaatgtaaagaatacataccaaagacatatttaaaaaataacaagatttagaaaaacaactgaaggttgtatgttatcaaatacaatatcaaatctttccaaataaaatttcatttggttcataagagtacgcgttttacaaaaaatatctttcaaaattatgcagaccagtctgccctgccatcctccttgacatgatgcagaaatgttcctttaatccactgagctttttctgacatttttcttaacattgctgagccttatttagagcaccaaaggaggcgtgtgcagttttctttgacactgatgggtatttcaaaatgttacagagagagggggg

SEQ ID NO: 207474 - DNA, 372 bp, Homo sapiens
ccctcttcagctgtgtagagtgatagccccagttcaacagggtatggtattattaaaacacaattcttcggctgggcgaggtggctcacgcctgtaatctcagcactttaggaggccgaggcaggcggattatgaggtcaggaattcgggaccagcctgggtgacagagcaagactccatctaaaaaacaaaacaaaacaacaaaacacatggttgtgattattttgtacgtaaaagtgtatatcctgttcttttcatttaacattgtatcaaatatgtttccaagtaattatgctgctactaaaatgtttataaggcaagaccgtaaagtacatggctttccttatttcttgtgagtctagacctctagac

SEQ ID NO: 207475 - DNA, 226 bp, Homo sapiens
tgctgggattacaggtgtgagccactgtgcctggcctaaaagacttgttttgaaagagactgagattcccttctggctctgtttctatctggttgtgcaaacttagaacctctctaagctttgtttccttaactatgaaggataatgatttaaataattttaagcatttctaaagccccagttctttatagtataagagaaggtaggtgaaggtcatcttccctct

SEQ ID NO: 207476 - DNA, 356 bp, Homo sapiens
cagagcttgcagtgagccaagatcccaccactgcactccagcctgggcaacagagtgagactccgtctcaaaaaaaaaaagataaaatcaaccagctcaagtgctttacgaggctgatataggggaaaaaagaatagtacgatcatacatgaatagtccacagaactgcccactgctcaactccataagcatgtatttgtattggtatacagatctaaatctcacttctaaccttatcagcagataagatcttttccatcctaacttgataacgtaatattgcaaaactagaaataacatgatcatgaacaataccaacacatgtgggctatctttttaactgatataggtgtgtg

SEQ ID NO: 207477 - DNA, 436 bp, Homo sapiens
tgttttgatccatgcctatttttaccagatattcctaattaagctctggattttatacaaaatttacaagaatttttaaacaagacctcacctcatttaggatttgggatagaggagtgattgtgtctttaaaatcgtgtgtttgtgaccaggcatggtggctgacacctgtaatcccagcactttgggaggcgaaggtgggcagatcacgaggtcaggagttcaagaccagcctggtcaacatagtgaaaccccgtctctattaaaaacacaaaaaattagctgggcgtggtggcaggcacctataatcccagctactcaggaggctgaggcaggagaatcacttgaacccgggaggcggaggttgcagtgagctgagatcgcgccattgcactccagcctggcaacaatgtgagactccgtctcaaaaaaaaaa

SEQ ID NO: 207478 - DNA, 468 bp, Homo sapiens
ctagtttttgctcagtcctctcaatattctaaagtttgtctcaaatctacccttattcatgagatagtgctaccctgaagtaactttccatttctcaatcttctaaaacatctattatgacagatactttggtatttttaaaatattatgtatttagtctaaacatttcaccagtataaatcttatttttctaagtaatggaaattgcatttgattcaagtttctatcttgaaacatatatgcattttgaagtagattatttaatgattacagcatgatgtttcaaagaggcattttgaaaggtgaatggagcagcaaatgtttataacagtggtttttgtttcaattcccttgtaagtatttgacgaaaagtagatccacgttgattgatagaatggagtatatcaatacaattagagaaagttgtgtaaaaagaaaaacgctgaaaaattctcagaacatttttct

SEQ ID NO: 207479 - DNA, 391 bp, Homo sapiens
aaagcaaaacagttaaaacatcaggccacgctcctcaaactgcaggattgcaagcagctcacaaacttccagtccccaccccaaggactccaagctgctgtcccctctctgccgcatctgaggctgggaaaacttcctaggagaaggcaagagaaagccaccagaccagagccgaggactaaactttaaggtcgaagacggcagaggggcaggttctcccctgcacaccccaaggcctctcctgcacccgcgaggccttccttgagcgcccaggcccccgaaatgcctgccctccttctgacaaaaggagggggtaggatgtgaaggggtagtgcaaccaacaatgtttttgtaaacacaacaacagggaaatacatggaggaaatctatt

SEQ ID NO: 207480 - DNA, 439 bp, Homo sapiens
cttagtttccagagctgtgaggaatataaatttctattgtttaagccacctgtcatggtattttgttatagcagttcaagcagactaatacaacaatgttctccaaagccatccacagattcagtgcaattcctatccaatcccaatggcattttttttgcagaagtaggcaaactggtcctaaaatttgtatggaatttcaagagaccccaaataaccaaaataaccgaaaaagaagaacaaagttggaggtctcatacttcctgatttcaaaacttactacaaagctacagtaatcaaaatactatgaagccaggcagatggctcatgcctgtaatcccaacacattgggaagccaaggcaggtagatcacttgaggtcaggaattcgaggccagcctggccaacatggtgaaaccctgtctgtactaaaactacag

SEQ ID NO: 207481 - DNA, 370 bp, Homo sapiens
atctatacattggtaagtggcattagtattattatatcaccatatagctgtatcacaaatttaattgctaaattgttaaaaagaaggaggagttttaactgggcatagtggctcatgcctgtaatctgagcactttgggaagcgaggcaagtggatcacttgaggtcaggagttcgagaccagcctagccaacatggcgaaaccctgtctctactaaaaatacaaaaattagtcaggtgtggtggcgagcacctgtgatcccagctactcaggaggctgaggcacgagaatcacttgaacccaggagacagaggttgcggtgagtgagactgcgccactgcactccagcctgggcgatggagcgagattt

SEQ ID NO: 207482 - DNA, 444 bp, Homo sapiens
ccagtgagatgcaggtgaatggggttctagaggctttccttccacagcaggggacaaagcctcagaaagaaaagaatgttgctatttccctctgctttctcctaattcctgccttgtgagtggtcctgatgctgacagatgcagtaggtatcttgcagccacgaggaagaaaacagcatgactaaggacaggaggagctgaaagggggatgacacgtgatttctgatgaaagccttgagccatgacattttttaaatgaaactagatacctcttactgaaatgcagagatttccagttaaatttccagcaaaagaatgaaaaatggaaattaactataaatcacttatttatgtaaaataatacgaacataatttctatttggggttctgtttttgttattgtattttagtaaaccttaaaatataagagatttaaagcttact

SEQ ID NO: 207483 - DNA, 352 bp, Homo sapiens
  misc_feature (56)..(56): n is a, c, g, or t
  misc_feature (122)..(122): n is a, c, g, or t
gattttttcttttctttgggatgaactcttcattctcatggtaaactccggtatanacaaggaccaatttcacacatctgtgacactttttacttgctttcttattgacaggcagaatccanagttctttttatatattttcatttgggcaacaatgggatacattttcattcacttttagttcagtagtttctctcaaacaggcagtgtagcctccatcgcttagatgatctcttttgacaatcagctaaagatacagcatgttagtgatacactttcagggaaagatcatttaataaatattgatacctatattgttagcctgaatctccctcctcccttcacctcccta

SEQ ID NO: 207484 - DNA, 572 bp, Homo sapiens
gacattttaatttcactttaatttttttcatgtgatctattaccaagtatttttccactgagtaaaattattttataatctgaggccggtaagagattcactgatgctcatattttatccatttttgttctcttgtttaaagtaaaaaggatttggaaggtaaatatttaggtgactgtgtattggaatcacagtggtgcaacaaaagctaaatactcttctggtagaaataaaaaataaaacttgatggggcattgacttatgctgaacttcggtggatcttaatatggttctgtgtcttattttaaaatttcaacttttattttagattcagggggtacatgtgcaggtctgtcacatgggaacactgtgttatgctgaggtttggggtacagatgagcctatcacacaagcagtgagcacagtacccaataggcagtctttcagtcttcattcctcttccctcccccaccccactccagcagtcaccagtgtccattgctcccatctttatgtccatgtgtactcaacgagtgagaacatatggtatttggttttctgttcctatgcta

SEQ ID NO: 207485 - DNA, 584 bp, Homo sapiens
tagtgggtgctcagtagatatttgttgattgactaggtctgtttccaccagtctagtgaacgattacttcaaaagtcaccaacaaactccataatacccaatccgggggccttttcctacccttagcctgtattacttatctctaatatttgatcatttcttttcaataaattaatctctttctctgtctgtttccctccctctctttttcttggacttctttttctacatgtttgagaacttagtttctccttattttttcatcctcaaatggtgaccttccacaatattctgtcctctgctcttttcttttttgtgtatatttttgctgtactgttccattcagtatcatacattcacatatccccttttagtaggggtcaagtctcttgagtttgtcttctagttccagctcgtgattagctacccccataggatggtcctgttgcatgttgaaatcaaacccagttttgtggttttgtctctttcctcaaaccagtttgttgtccatttcctgtttaaattttactaccaattttaaagatggtgaagctggagttttctttcccttttccctgccccac

SEQ ID NO: 207486 - DNA, 417 bp, Homo sapiens
gacatagattaagggaagaactgttaaacaaaaaggaactaggacttgataatttaggaaattctcagtctattcagctttcaaaaactgctaaagttagaagatttgattacaagagagtatgctctggagagaatgccaaaggtttggctgagcagtcttttgcttgtgccttggaacgattttagataaggtcagtattttaatcacacagaaaagtgtttgaaaagattaagtatatggctcatggatcccctcacagatctcaataggagccaggaataaaaatgggattatcctgcatatatttgtggaagagcctcttgtttgatggatttactccctgtaacatgtgtgggagacccacaaagtttttgagaatgttgtatcagcagaaacactgccaggggtaccgaa

SEQ ID NO: 207487 - DNA, 373 bp, Homo sapiens
taaagttgatgtcgaccttgcccgctcaggcaaaggtgcatgtgtgcacatacgtttgcgcccagcattttagaatttgagactgtctccattcccttgtctctggtggataccacagatacacctagaccttgggcctgtaggtgttccttccagccctatggtgtgtggttgggtctttccttcctgggagaagcactctgaaaccccacgctctttcatcctggtgtcaaatctcctgttcataggaaccatggaagcatgtggaaactctgtgggaggagccatttatgctaatgtggatggccatggcatttggcttatgctttcaagcttgtccaacccatggcctgtgtgcacttgcagcccaaga

SEQ ID NO: 207488 - DNA, 712 bp, Homo sapiens
agaacttttacccaggggaaggtgagtctttaagagacttggtagatgctgcaatcaagcagctttaaagagctaaaccagatagagtgaatgtgtcatagtgttacccacacccaaaatctttctaaagaaaaacttccttagccaggcaaacaagcctgctaagaaagcattcttatgaccaactacccctcctccaaatccaaagttgatcagaccaagggaaagtaaagctcagactcaaaggcatatgtctacacgctgatcaacagcctatgacttgtaacatgaaagccctccccaaacaaggatgacgtgagaaaattagattaaatttgcaattgggaaaaacagaagaacagaaactcagctgaagtgaatggatacatggtaaaagaacataccacagctacgtaagaagcatgaaagatttaaataagatcaacttgtgaggaataggcacaggagtcagaagctataaataagcaaaaactggccaggcatggtggctcatgcctgtaatcttagcactttgggaggttaaggcaggaagatcacttgaggccaggagttcaataataacctgggcaacacagcgtgaccctgtctctattagttaaaaaataaataaataactgggcatggtagcacacgcctgtattcccagctacttgggaggctgaggtgagagaatcacttgagccgggaggcg

SEQ ID NO: 207489 - DNA, 376 bp, Homo sapiens
tggggcaccccatcccacgttctgattctggatggacttttaagtgaactctgatgatgagtaggctcttaaaactctttctcaacgttctctgctgggtttgtgtgtcacctcccatgccctctctggtgtgtggtgattctcagatctagagcaatgcttcctgccttgtccccccatgcctttgcgtgtgggaagctaaaattcacatgtgcgatgccctcccatgtgccatttttacctggtcccttctgctcactctttattcatatttaaatgcaggtgagttggaatgtcatcttacaggcataatcctgaatctgctctatcgcagacattttaaaactaaattaaatgttagtactaagtagtaaaa

SEQ ID NO: 207490 - DNA, 491 bp, Homo sapiens
tctgcatatatacctggctggtatggttagcaggtagggacctcctctttcggctttgtatcccccctccctctgcctctgtatagggggagcttcttccttctgtcttctcccttccttcttgcctattaaactctcagctccttaaaaccaaaaacaacaacaacaaaaaaacaggaactcatacttttcaattacaaatagtgcatgcaatccacctacttggatgactacaagaagtttagaatctttccgtggcccatcgtagctaactgcatagacttgacctccagcaaccatgcctcaggaccaagataaagcatatgctgctatctctaaaatgacaaagttggctgggtgcggtggctcagacctctaaccccagcactttgggaggctcaggcgggtgatctgttttagcccaggagtttgagaccagcctagtttgagatcggcctgtgatacatggcagaaaccccgtctctacaaaa

SEQ ID NO: 207491 - DNA, 361 bp, Homo sapiens
tctagaggatcccttctatggcaaggccaaggtagattaaggtaaaggtcaaaaagatcatggatgatgaagggccctggaggattttattcaggaaggggacatgaaacgtggagaaaatcatggggcagcagtggggacaagggaggagggaggctactgaggggctaccacagcactctgggcaccacaggctcagcacggacaggacctgggatggatcagatgaggcgagagtcaagggagaggatgactcaggtcacagggaggaaagaggagccctctgtagagagaggccatgaagaggagaaaatgccatggagacactaagttcagcttggccttgccatatgcaaacgcc

SEQ ID NO: 207492 - DNA, 318 bp, Homo sapiens
tcctgggaactccctcagcaaatcaggagtcaagttgggttagcaaggccaaggtagattaaggtaaaggtcaaaaagatcatggatgatgaagggccctggaggattttattcaggaaggggacatgaaacgtggagaaaatcatggggcagcagtggggacaagggaggagggaggctactgaggggctaccacagcactctgggcaccacaggctcagcacggacaggacctgggatggatcagatgaggcgagagtcaagggagaggatgactcaggtcacagggaggaaagaggagccctctgtagagagagg

SEQ ID NO: 207493 - DNA, 481 bp, Homo sapiens
gctcggtaccccacaccacctgagtccatcatttttatatgtcatattcccagtgagactgtgagacattggcatttcacaacttagaagagctttcaaagcatcatccataaacttagagatttagtgagtaactgtatatgatctttctcttctcttttgtttaagggagaaaggaggaaggaacaccatgacgtagtgatatatttaaattctgttttagaaaccaggaaaatagttttcctaccagaaatatgattacattaaatatatgcggtataaagatcacagcaaggagaccatgaatctgtccatctacccctccccgaaataaaattactctacactattcagataaaaagtgacttggttggctgtttctgaaactttctgtttattggcttttggcaagataaatagtaacaaacaccagtgtcttaaaatctaaaaattggtaatccatgtacctactgtttatttc

SEQ ID NO: 207494 - DNA, 304 bp, Homo sapiens
agaagtaggtgaaattcacttgcagagcttcttaaactgcatttcccaagttattccccacctcaaaacccttcaataggttctccccactgcccttaggtataaagatcacagcaaggagaccatgaatctgtccatctacccctccccgaaataaaattactctacactattcagataaaaagtgacttggttggctgtttctgaaactttctgtttattggcttttggcaagataaatagtaacaaacaccagtgtcttaaaatctaaaaattggtaatccatgtacctactgtttatttc

SEQ ID NO: 207495 - DNA, 1178 bp, Homo sapiens
ggccgaggtaggcggatcacaaggtcaggagattgagaccatcctggctaacacggtgaaaccccgcctctactaaaaatacaaaaaattagccggtggtggtggcaggtgcctgtagtcccagctactcaggaggctgaggcaggagaatggcgtgaacccgggaggcggaggttgcagggagccgagatcgcgccactgcactccagcctgggcggcagagtaagactccatctcaaaaaaaaacaaaaaacaaaaacaaaaaaagtcagtatccactctgtaatgttttagacctgtgctgtccagtctggtagccgctagctacatatgggtatcagaacatgagaagaatattttctaagagtagattattttctaaaaacctggataccagtatttagccagccctgtttgggtgtagcatgaaatggtatccctgtttgcaggactgtgcttcctcactttttgcatgtcatggcattcctaaaaagcagcgatgtttgtatggcacactgggatacacagccgaggatgcttacaactagggcttaccgatctgagtgctctgcagcaccaggcaagaccataccccattcttggcatgccggtatgcagtggcacatacggtacaaagctgcttcagcgtgctccctataactcattcctggatgtttttcttggtctatgagcggaatttgaattcattctcccttcttatttcatcatttttatatgtcatattcccagtgagactgtgagacattggcatttcacaacttagaagagctttcaaagcatcatccataaacttagagatttagtgagtaactgtatatgatctttctcttctcttttgtttaagggagaaaggaggaaggaacaccatgacgtagtgatatatttaaattctgttttagaaaccaggaaaatagttttcctaccagaaatatgattacattaaatatatgcggtataaagatcacagcaaggagaccatgaatctgtccatctacccctccccgaaataaaattactctacactattcagataaaaagtgacttggttggctgtttctgaaactttctgtttattggcttttggcaagataaatagtaacaaacaccagtgtcttaaaatctaaaaattggtaatccatgtacctactgtttatttc

SEQ ID NO: 207496 - DNA, 349 bp, Homo sapiens
aggggatattactatagacccttctaagaagaaagggaagcaccataaacaactctacacacatgcattcaacaacttagatgtaggggccaaatctcagaaaagcacaggtgaccacaaccccccaataccaaacaggttctttaaagaacttcataactgttaaagaaattgaatccgtagtttgcaaactcccctcaaaagaggtctctagcccagaggtgtcactcggtaatttaccatatgtttaaagaagaattaatgctagttctacattctcttccagaaaatacaagaagatagaccattccccagtgaggccagtattaccctgacacccaaaccagac

SEQ ID NO: 207497 - DNA, 247 bp, Homo sapiens
tagtctgtgtctgtgtatgatttcaaccaaagtaacaaggccaacaaagtaacaaggccaaataaatttacaccaaagacttcctactccagtgttaacattgttgtggatacagtttgtaaaatataaaaaataaaaactggatgcggtggctcgaacctgtaatcccaatgctttggaaggctaagctgggaggattgcttcaggccagaagtttgagaccagcgtgggcatcatagcaagaccc

SEQ ID NO: 207498 - DNA, 465 bp, Homo sapiens
ggggctctaaaaaacaggtgttaccacctggtattccaaccagaagtgacaaaaattcttggggtcatttagagatgattcgcaatggtgtttcagtgtggcccagagacccatagctggagcagtggtgtcttaaatagactgttcctaagacatgctgtaagcagtgttctctgctgcccctacactccttttttgggggaatggttttccaagcttcccgtaaatcctatgagctttccaattatctgctccctccaaaatatcttttcttataagttagcaatttatctgacttgcacccgagatcccaattgtgatgcatattggtacccactctttatctgatcagctgtggccagcttggttaaccatgtgatcaactttcctcagaaatagctgtatgagtgaggcaggaaaccagaggatattagagaacattaatccgaaactacaaaaagatta

SEQ ID NO: 207499 - DNA, 672 bp, Homo sapiens
ttatgatggcaaggccaagagcatgacctcatgtctaagctcagaaaaaacagttctgcaaggaacctgagagtgtagtttcctgattattcaccaagctccattcagttctagagccaggatatctataaagcaaagttggaaaactggtttcatctcatgagctactctgatgagtaggtctggagtcttgtggggttttgtttttgtttttattttttgtttttgtttttagagacaaggtcttgctttgttgcccaggctgaagtgcagtggcacggtcagagctcactgaaaccacaagcccctgggctcaagcgatcttcccacctaaggcttccgagtagctaggactacaggcgcgttccatcacatctggctaattttagtttttatagagatgggggctcactatgttgcccaggcaggtctcaaactcatggcctcaagtgatcctccagccttggccagggactgtcattgccttagtttattttttctgttttgtttttttttgtcgtttttgtttttttttgagacagcgtcttagtctgtcgccaaggctggagtgcagtggcgcaatcaaagcttgctgcagccttgaaatcctgggctcaagcaatcctcttaactcagcaactaggaccacaggcacatgccaccacgcttggc

SEQ ID NO: 207500 - DNA, 502 bp, Homo sapiens
aggcttttatcctcacattggttccattttgaattctagccttatttgtcagtatcagtctgtagttcagatcttccatgattatttctccacaggatgactggtctcatccatttaatattgattcttcttagcgttctactcatttgacattttctgaccttgccttaaaattctggatatatcctgttttacttccttaggccattctaaagtcctacagtatccagatgagaaacgagagaaagcataagctttggagtccaaagatcaggattttagcgtcagcactccacaccttagctatacaatctcaaagcaggtaagcttaaatccctgtttgttgttttgttttttaatctataaaatgaaggttataataatgctagcccaacctgccaaactatcattgtgaggatcaaacattatactttcaccctttgaaaaatataaaattaccctctcagtcagaattcagacaaggcatagcaaagatggctta

SEQ ID NO: 207501 - DNA, 237 bp, Homo sapiens
tagaggacccccgtatgtctgcaaaaacgttacctggctatgaaggaagggctatcacattatacagatcgggtgcttaaacaacaaacatttatttctcacagttctggaggctgggaatttcaagatcaaggggccagaagattcagtttctagtcacggtcctcttcctggtttatagagagtcaccttcaggctttatcttcacatgacagaaagagatcatctttcttatgt

SEQ ID NO: 207502 - DNA, 732 bp, Homo sapiens
acaccttcattgtgggtgggcaccatccagtcagctgccagtactgctggaacaaagcaggcggaagaagggggataaaagcagcttgtttactgagtctgcttgttctttcttcacatgctatgcccgatgcttggcttcctttccttctgccctgggacatcagactccaggttctttggcctttagactctagaacttgcaccagcagcttcccaggggctcttggccctttggcctcaggctgagggctgcattgtcagcttccctggttttgaggctttcagacttagactgagccatgctactggcttctctctttccccaccttgcagatggcctattgtggggcttcaccttgtaactgtgtgagccaattttccctaacgtgctcccccgtgtatgtggggagcatatatacacacatgagggagcacatgtgtgtgtgtatacgcatacacacatatacacaggggagtacctgtgtatatgtgtgtgtatctcctgttgtttctgtccctctggagaaccttgactaatacaactattaaagtaataagtgagagatgatggtgacttggcttgggttagaatggtaccagaggaagtgatgagaaatggtaggattcttgctaagtttctaatgtcaggccaacagggtttcttaatgaagtgtgtaggagaaagaggaatcagataacttcaaagtttttggcttgagcaactggatta

SEQ ID NO: 207503 - DNA, 375 bp, Homo sapiens
atattcatgctccagatttcttatgattaagagaagagtaggaaggaaagaaagaaggaaaaatattgtggcaatccctgaaatatcaaaggttttcttgggttcccctgtagtggaaaacttagtcacaatttgctagttagcagtacacatttttaaccctataaaaggtttgaagtctccagcatctttgagcaaaacttttagactgagaaaaatggatccatagctttctcagtggaaatccattagtaaatagagcctaagataattagggacagttggattggtacatccttacctgtgttcccaaaaagcctagctatatcaagcacatggcctattagttcatgagtgttctcctcattatttaaa

SEQ ID NO: 207504 - DNA, 722 bp, Homo sapiens
ggtagctcgatcaaccttgtggtgatgacttaaagatccaaatgaactatttcttatgaatgaaagtccaagagcaattaacatgggaaagttactttaagcactttacaatgtggatgaggtttttattctgttgctgaagtactgcaaaaattagaagtatgtatatatatcttcagagataatcaaggaaacaacagatatttaagataaaacatagaataggcattatttgtgagtgtactgagttttgtaactgtggtttaggcagcagtcattttcaataggtccttgggaaattctctaggctgtaggcaacaactttctcctttctggctatgccctaattgtttcattcaggattgctgggaactcctagctccagggaatttgtagtgttgatcgagcatcacttagtagacagaaatcttatcttccccttaaagtagttgtcatgccatacagactttttaatattaacaaaaataaagaaaaacatccttgaaaatatattatcagaggaattgtagagtactgaacaggtaagtcacccggcagccagaaatcagtacacttgttacaaggcgtgacgtgtcctagatttccatgcacagcggtgtgcatctctagaggatacccgctagcacacaggattatcaacggcactacactgtactatatgcatcacccttgcctcactacatgcatcatacggtaccgac

SEQ ID NO: 207505 - DNA, 350 bp, Homo sapiens
cttcctgtagatatctgcatcctaccgtggtttttctagacctaaaggacaaaaattgtattcctgtgttggattaaataggcataataaaaaaagaatgaatgggcgtacaagttattcagggagagttaaaaacatgtttgactgtctatcaaacaagaaagaattgaagatgtttaatgtcataatgagagaattcttgaaaggtacaagcctgatggggcatttgaggtcaggatctttgaggacaatatttcccctgattcattctgggaggctaacatgggaggatcacttgagcctaggagtttgaaaccaacctaggtaacatggcgaaaccctgtctctac

SEQ ID NO: 207506 - DNA, 359 bp, Homo sapiens
gaaatattgcttaagaataattgacctaatttaaaatgatacagatcaagtaacctaaaggccattaggagtttccattttttcatgaaatttggctctaacccttcgccccctggtgataaatacatttggtttattttgtgctcacaggcactttaatgttttgttatgtgtgtgatgcccagatcctttaccctgatgtgacccgcaccagagttcaaggaatactttgcatttatgatactcagaggatcctttaaaaacctaagtgtgttacagtttgaagagcttagaatcacttgatgaagagttgaggaaaaactatacaaaactgatttttgtgagctgaatagttgatt

SEQ ID NO: 207507 - DNA, 607 bp, Homo sapiens
ttgagtctagaacctgttcgacatataaacaagttatttttttgcagttttaatatacactaatattacaaaaatgtgactactgtataaattgatggaagaccactgctactcatggtatctgagtccccagatcggtctcagccttgggactgttggatttgtggtgcctttacataggtatacaaacgtattaatactccattgttttctagtgtagtcagccttaggcattatacataactgaacatatatcttttctatattatgcaccttctatttctcctatgcatcacagagtgctatactgtctgctacttttttaaattataaaagtaggtaggttatatttatattcattttaatagagggaatgttacacaaatatttgtaataaaatgaagatgctgcatctgatttgttgcaaagatcgggcctacatgtttaactgtctgaagacagaagacagtatccgatgatctctttgggacagtctggtcctagatgatggaagggaacatttggaacaacttcacttgagaactgctttactctatgcatatataaatatctaacctctgcatattataaggctcttccctttatc

SEQ ID NO: 207508 - DNA, 144 bp, Homo sapiens
gagcttactgaaagagtggatatgtgtgtgggtgggagagtgagagagagagaaagagatgaagatacatgggaacctatagacagacaaacagatacagatcaatgtaatatacaacaggtaagaatctgtcaaagtgtgact

SEQ ID NO: 207509 - DNA, 181 bp, Homo sapiens
atcatttgaaataggagtagacagatcattttttttcccctggagctagaactcatttaaatatactgaacatttaaaagtattgtgccatctggctagcacccagtcctcctgatttcaggccaataatctttctgctacactactttaatgtgtatgttggggctgtgggggtcaagga

SEQ ID NO: 207510 - DNA, 140 bp, Homo sapiens
taaaaggaaatcgtttctatttaataccaagagtagggcagggagaggaaggggtgaaagggaactttctggtttttcttattgcccacaggtgattaaatcatttattaatatttaggaaggaaattccaagatgaaaa

SEQ ID NO: 207511 - DNA, 342 bp, Homo sapiens
agttacttctaagagagtgagatcatgggaaactttcaacattaaatagtctaccatgttagaatactatatttaattctgttacattctgatattcataaaaagaagtaacattttcatatgcatctgtatctatataaacaagtttagctgtttccagaggggagcaaaaccagttaatataattagtgtggtaacaattggatagaagacaatgcctgctcagtgagacagtaatctgagagagtgaactacaactaccttttttttttttttttttttttttttttgaaaaaccctcggttaccgaccccaattccgaaaccggggccatagctgttc

SEQ ID NO: 207512 - DNA, 235 bp, Homo sapiens
aaagagccaggcaagcaaagagctgggggaagagcacagagatgagaggttaagggacctaacaaaaggccaggtggtcactggagagttttgagttgggaggggtaggggtggctaacctgatcatgttttgcctttaaaagatcgctctgttgggaagctgaggcgggcagattgcttgagcccaggagttcgagacaaggctaggcaacatggctcaaccctgtctctacca

SEQ ID NO: 207513 - DNA, 497 bp, Homo sapiens
ggttgaaatatgagaaagtgatttcattattatcgtcagttgttattttattctttctattactgaagaaacttcggaaccccttctaaagagaataaggagtccaattgttttgctctacctgtaccttcaaatctatatttttaaataggaaatttcttatatatccactgtttactcatactaagtacttggcaatgtgatacgttctgggactgagttgatatgataagaattgatatgtccccatttccttatgggacactactctctggcaggaggtgttagacaaataattatacaattatatacaacagttgtggtaagctctacaaaaacagattaggtagtacgatattgcttataatacagtgggtaggataggggagaggtcaaggacgccttccttgagtaagtgaatttgagctgagatggattttctagggagagggaaaggccctgaggtgagatgaagtttgcagctgattaaaccaatg

SEQ ID NO: 207514 - DNA, 383 bp, Homo sapiens
cgaggatccctatgctcatccctccttacagtagttagatagtatttctggagtttaagaatgagttaattatcaaatctataatcaaacttttggttccatactaaatctgcggcctcttgcaattaatcccatttatcctccttaaaattagaaaaggctcctgagctgagattctgccactgcactgcagcctgggtgacagagtgagactccatctcaaaaaaaaaaaaaaaaaaaaaaaaccccttggaaaaaaaatttggctttcctttggggccctggtaaaaattaatagggggttttttagggcccttaatggaaataaatttccccaataccatttttttttttttattggggggaatttttgggaaaagggg

SEQ ID NO: 207515 - DNA, 515 bp, Homo sapiens
caacaaacagcctaatgacctctgtatgatccctaataaattgtcaaagtaaggagatgaaagttctctttttttcttgatgctcacagtgtttaaatattgtatttaggataatttacatgccataaaatttgcatatttaaagtgattttataaatttattgggtggtgcaaccatcactacaatctaattttaaaacatttgcatcacgtcagtgacatcttccttgcccatctgcagtcagtcttcattactactcccagcatcagacaaccactaatctactttctgtgcctatggatttgcctatcctgaaaatttcatctaaataatgtctccaaagtttattaatgttgtggcatatataaatacttcattcctttttatagctgagtaatattccattgcatcagtatactacattttgtctatctagtcatcagttgatgaacacttggattgtttctatcttttggctattatgaataaagctgctatgaacgtttgtgtgcaa

SEQ ID NO: 207516 - DNA, 407 bp, Homo sapiens
cagcacttcgggaggccaaggcgggcagatcacttgaggtcaggagttcaacatcagcctggccaacatggtgaaaccccgtctctgctaaaaatacaaaaaaattagcatggtggcatgtgtctgtaattccagttattcgggaggctgaggcaggagaatcccttgaacctggaggtggaggttgcagggagccaagatcacaccactgcactccagcctgtatgacagagcgagactccatctcaaaacaaacaaaaaaaaccacacacacacacacacacacacacacacacacacacacacacacacacactagtgagagatcctatatggttcccataaaatccatccaaatgacttaaaagaggaagtagaaatggaataaacttatcagtcttgaagaa

SEQ ID NO: 207517 - DNA, 337 bp, Homo sapiens
ggcttaggcaatcctctcaccatagctgggaatacaggtgtgtaccaccatccccagctaaatttttttatttttagcagagatgaggtcttgctgtgtttccaggctggttttgaactcctgtgctcaactgatcctcctgccttggcctcccaaagtgctggttttttttaagagacagagtctcactctgtcacctaggctggagtgtagtggcacaatcatagcacactgactttgaacccctgggctcaagtgtttcttctgcctcaatttccctagtatttgggactacaggcatgtgccactgtgcctggctattttttgtgtgtgtgta

SEQ ID NO: 207518 - DNA, 429 bp, Homo sapiens
aaaataatttgtaatattaagatgtcattgacttttttttgcgtgtgaccatctgcactgatggtgcaaaagcaatgggaggtaaagccactagcacttggcacagccccatctgtagcaacaggctggaccagtggtcactggattcttcactgccatacattttaaataattaatcgttttaaaataaataaggtccttgaaagagcagcagaagttactaattttatgaagcctcaatctttaaatgcccatctttttaatattctgtgatttgaaatgggaagtaagcatcgcctggctgcatactagagtgtgcaggctttctcatggaaaggacttgtgtgattgagttgccagctgaactagcagcttcttttggagcaccacgtttacttgaaaaacaactgataggcaaaactgtggtca

SEQ ID NO: 207519 - DNA, 204 bp, Homo sapiens
gtctctaaaaacaaataataagtaaataaaaaataaaataaaaataaaactgtgtcttataccaacttccacctgagatcatgatagaaatctatttattcatgataaatagctactggctaagcctttggccctaaacctcagtatagtgcctgaggagctagaccaaaccaaatgtaggactctgttctgattcccttaagt

SEQ ID NO: 207520 - DNA, 594 bp, Homo sapiens
ttttctcttctttttatttatttatttatttatttttgagatggaggcctgctctgtcgcccaggctggagtgcagtggcatgatctcagctcactgcaacctcctcctcccgggttcaagctattctcctgcctcagcctctggagtagctgggtttacaggcacacagtaacacgcccagctaatttttgtatttttagtagatatgggatctcaccatgttggccaggttggtctcgaactcctgacttcaagtgatctgcccgccttggcctcacaaagtgctgggattataggcgtaagccaccgcacccagccttgacaggcttttccaatacaccatgtcatatttcatttttgccaattatgttacatgctttagctttattttatttttttctttttcttatggaaaatggaaacagaactgcttttacttttaaacttatattggcttgttttaactcctcttatgttttatcataaaacactcaaaatatatatgcttttaattccaatccgctcattgtcttaaattgtattttcaaggaaagaatggaatgcacacaactgctttgattgtcatttctatt

SEQ ID NO: 207521 - DNA, 604 bp, Homo sapiens
caagttgtaaacgtaaaacaagttcttgaaaggaaattaaaagtgctacttccagtgaacacacgaatcagaatgaaatagccttatttcatttagtggtctggatagaagtttggagaaagttttagtggtctgaagaacaaaccagtaacaacattcccttagccaaaccctaatccagagcaaggccctaattcccttcaattctatgaaggctgagggaagtgacaaagccgtagaagaaaagtttaaagctaaaagaccggttcatgagatttaaggagagaagacatctccatatcataaaattgcaaggtaaagcagcgacatgatttggctctgtccccacctcaaatctcatcttgaattgtagttcccacaatccccatgtgttgtgggaaggacccaatgggaggtaactgaatcatgggcgcagttacccccatgctgctgttcttgtgatagtgagtgaattctcatgagatctgatggttttataatgggcttttctcccttttgctgggcacttctttctgccatcatgtgaagaaggatgtgtttacatccccttccaccatgattataagtttcctgaggccttcct

SEQ ID NO: 207522 - DNA, 777 bp, Homo sapiens
ttaacaaaagattctccttaaaaatgttagataataaactgcattttatgggtctggtttaaaaaggttatttgtggggaaaggaccaacaagctgtattgtggttttctagattgtttcctcaagccttgtaacctcctagctccttacattcctagtgggaaatacttgctgcaaatgccttgggctgcactgtaagcccaagtgtgctgcaccagtgtgatgccctatactaaaacatccagaaatcatcatacatatgaggaagaagaaataaagcctcaaaccctttggaataataggatataaaattgccttttgtaactgaatcttaaaaatggaaggttaccatgacttgtcctattgcaacctggttatcagaataacttattttttttaagatagctattctcaaatactgaacatatttgcatctttaaagacactttattctattcaattataggtaaagtagcctatttctaggtggttaggcttgaaaagatagactgaaaagataggaaattttgtatgcctttttgcaaattgtatttacttctaagaccgatgctgttttagcttaacttttaaaaaagtgttcttcaaataattgtaatattttacacgatcttgaagttcttcaaataaacagagtttagaaactaaaaattatagtgggattttctggttttgaaggcttggaatgtatgattcttactaatagatgttttattcttgtgattgaaaataaaccaaattatgacatggaatataata

SEQ ID NO: 207523 - DNA, 782 bp, Homo sapiens
gtctttctccctgatgtctttttacccagcttgcacccatctcaggtagaagaagagagctgatcctgatggcctggtttcagcatttggaagggattactttttccagggtggaactgtctaaggcatttacacatccagcaattacagtgtcttgctgtgttgtccggctggagtgctgtggtgcgatctcagctcactgcaacctcctcctcctgggttcaaaggattctcatgcttccgttctggagtagctgggatttacaggttaaaaaagaaaagaaatgcaagactggtaattcaaatgcttttgggtggcatttatggacacaactatacatatgtaccggaatttctactaggtgttcattgccattgcttcttactcagctgagaaacgaaagaattactcacccctcacaaaaaaaattgtctcctttattttccttttttctgcggaatttgtcaatagcacttgatttgacatcttcataaactcccttcgacttcatatccatgacccatttattgctaaattctattccttctctcttatcatattgacacaaagggcttaactttttaaattattcttctttctctccttggccacctgaaaagccaaagctattttctccattgttaaagctatttaatattcttccagataaaatatcaatctacacatttaccattcctcatcttgattaatgtaaacttctcctgttggccttacttataaatcactttcactgccaaaaatttcaatttcattgccaaaa

SEQ ID NO: 207524 - DNA, 716 bp, Homo sapiens
agaaatgggaggcgatgaatctcccagccatcgctggcagactatggtgttgggcagcttcggtctggtctcgtctgggtggtacctaccgttttgccccagttaggaggactggggagggaggacaggagaggtgagagtaattgttactgggaagactagtgaggagggcgggaagagggagggaagagctgctatcttgcctgagcagatcaggagggggacgcagtgggcggggggagacatcacccaaagtccagtttagcaagttgttgattcttctggtgtgccagcccgttactcctcctgctgaagctgaaggttggtggagtgatggagcgtggggatggtaaaggaggagtaagtagctttccacagactcccaggtctctggccccttcccagcttcttgggaaattgagagccctccaggcagacagagaacagaactagaaggaggggtggtgcttagtcttaaatagctcaaggaggcaggttggagtgtgaaactgctgttcttggcaacccagaaggctactctgcctgggggaaggctggaaactcacctgcttgtttttatttttccgagaagatctgtgctgtctccttgagcttataaaaacagaggaagcacagggtggcctcctcgcaaagtcaaggctagaagactcccttctcctgttctcttttccactcatgccctcccttatttaaaa

SEQ ID NO: 207525 - DNA, 518 bp, Homo sapiens
gaactgtcttaacatacagaaacggtccagtggtggcaggctggacaggagaactgccttaatgttcagaaacggtccagtggtggcaggctggacaacatatccaccttcctacagtctggtggtggcagactgggcaagaaaaccacaactgcaaccgcctgcgaacatcatgcagtttacgcagcattttcatttagcaccctcctcctaacagccctcacctggcaaccttcatgtaacccaagcttgtccaacccaaggcctgtgggacgcatgcagcccaggatggctttgaatgcggcgcaacacaaatttgtaaactttcttaaagtgttatgagatttttttttttagctcatcaactatcattagtgttagcgtattttatgtatggcccaagacaattcttctttttctaatgtggcccaaggaagccaaaagattggacacccctgatagtaacccaaaactcagggcctcaatcccctgtacagcccgtgttccacaggacaggc

SEQ ID NO: 207526 - DNA, 608 bp, Homo sapiens
ggacatggcagccatatatgtcggtgttcctggctgactttcttagagaccctggaactggtgacccttttctctgagctctttctgagcttcttccatctctggaaatctgtccgaggatctggagcagtgttgttttggatgggaaagtaaacaatgagtgaatactgctattctcgttctgcataggttgtgtgtaaaaatagagttgcttatataaagactccaaaatggaattttatctgtgcatttctgtgtcatcccttccccttttagactataaccatccaaactgtatgacctcgagtgagttactcaacatattcaagcctcaatttctgcaaaatggggataataatagtgcttacttcctaggatggtaatgaggattaaataagataagtaaagtaatatgcgtgaagtgctcagcacagactggaccagtgtgtgcacagctaatgctgacagttcatgctattttgtcattattgctatcatcctgagctcttccacaagacaaaccatattgtatttattttttgttgaaggcattcaatagatatttgttaaattgaactgttttaagtaaaaataaataagaaaaagga

SEQ ID NO: 207527 - DNA, 536 bp, Homo sapiens
ccatcccgggagcccaccaggcgttcagcttcccttgagccccctggctgctcgaacccgggtcgcagaccggggcgtttccgggggcttctgaagcaggcgaggggcagggcgggcgaaggccattcggctgtccttctggctccagaatctcctaacgcgcaggtgtccaacgtgaccagcgcgattcaccgctctaatcgctccggttttccaaggccttgctcagtcatcctgccggacaagccctgaggctggaaggcacaggggaaatttgttgaaggcgcccttcccatagcgcacagtaaaagcagtagttcttgtctctgtggcgcaatcggttagcgcgttcggctgttaactgaaaggtctcacaaaacttcttatgaagagctccaaattaataaaggatgcctttcataatgagctgatgggagatgaaaatatcaaaaactatgcctataaactggagatgtcgcttactggaaacaacatcaaataaaatactccctccaagtccactggagggcaccacg

SEQ ID NO: 207528 - DNA, 284 bp, Homo sapiens
cagtgatggagatgaagatgtaagtttgggagttctatataattttcaaaatcaagggactgtttcaattcacatagagaaaataccttgaaagtggaaagaagggaggctcagaaagagagtcctgtgattgccagtagtcagaagccaatgagaagagaaaaggcaaacaaaaagatggagaaggaacagtcaatgaagaagtaaaataaaaacagaagtgtgctaagtcttgaataagagaaaaaaagtgaagatgcggaggttaattagtgtaaatttta

SEQ ID NO: 207529 - DNA, 459 bp, Homo sapiens
agtaccttatataatacaggttagttttatattatatgttgacaatttccccccgttccttgctttgcaaatctactcgaaattatataacttccctccctaacccctgctgaatatatgtgaattataaaaagtagaagctagccaacaacaacaacaaaaggccataaaaaagtatcaatgattccacccactcacagctactgttattgacactttggtgtaaactcctacatatatcacattttttcccacaaaaatatttttttcactctgcttttttcatttaacacattcctctgtcactacatacatatctgaatggctgcattttgttgtatgtgttcactctatttacactgttctccaacatgtatcacttaggctgtttccaattttgtttctattaaaacagaattggtataaacaaccttatagctaaatttccattcctttatt

SEQ ID NO: 207530 - DNA, 304 bp, Homo sapiens
tcaataactatcctcctaccattaatttttatccaattgctatacaccttatggtaaaacaaaaatggccttgcccattagtgacacctcagacaagtaagtataaagatcaaaattctagaagcccataacaaactcaatacttaagcaaggctgggtgtggtagctcatgtctgtaaatcccagtgctttgagaggccaacgcaggggtggaggggtaagggagggtagagatttgctggagcctaggagtttgagaccatcctgggcaatacagaaaaacctagctctaccaaaaaaaaaa

SEQ ID NO: 207531 - DNA, 306 bp, Homo sapiens
ccgagattgcgccaccgaactccagcctgggcgacagagactccgtctcaaaaaaacaacaaaaaaaattcattgtttgcatacataccgtgaatatcgacatgaagattaccttgaatttctgaaagtacatcataggagtatatcttgaaaaatgactcatagcaaaatgagaattacaaagtgttaacattaatgataattagtttaggtagtattattttgagttctgaattagtttatagatttatataataccagacatcttagtatagaggtgaattgagtaaatttttcagatgtttc

SEQ ID NO: 207532 - DNA, 445 bp, Homo sapiens
gacttttttctgaagttgtttattgccttgcagagcaagaggaacttaactctcacttaaagcaggcctatataatttaatatgataatcttcctcaattagactcaacatgcttacccgagtactgtgcatccaggaaattttagcttggacataattttctcagagaagccttctgtttctctgcactaaaacagccatgctaccaacacactctctgatcatattttaagtcctcctagcaccctaattttctttatatgactgagcacattttaaattcttactcaattcttgtcttttccaccaagtttaaaactatgtcaaagtaaactatcatctgtgctttcctagtgttgtttcctcaggaccatgcatagtgctttgcacatggctggccttagataaatgtttgctgaatgaataaaattgatgcattaactgt

SEQ ID NO: 207533 - DNA, 453 bp, Homo sapiens
aatattgtgcttgtcaattttgcttgactattgaagtgactttttaattgtttgtatttttccatagaagtaaacaatatatagtgcccttgaaaaaaatgcaaatgaatactttcttatatcaatttaaaccggaactccatacagctgaggcagatagaagcaccattttgcctttggaacagctcttttagtaaaaggattatttaacgatagtttgaaaattttattctagaaattagagtttcataattgaatctcaaaatagatccaagtctgttttaaataaaaacaaattaaaagccaagccacaaaaaaataattcagagatttggaaccaactcaagaaatgtctactaagaacacctggctacagtaggggaaggggaagaaattggacaagtgactctaacatcatttcaaaataaaaaatttaaaaatacacggaactgt

SEQ ID NO: 207534 - DNA, 1055 bp, Homo sapiens
cgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgtaccagcagaaatccaggtgtcaaaagaaccccatacaacagccaaccttcccttttgcagttgcaaagcaactcttgctggtttcttgagctggagcacttgagccacgtgcatgaaccaaacccacttcgttcaagaaaggtgtttaagcgtactttgccgagacgttaatcaaacatggggctgctgtcttctttcacttgtagtgacgagtatagcatcattgcaagataatccacaacagagctattactcacttaatgaggtctgctaacagagaagagtccgtcagggatccttgtgaggatatatctcgtatccagaaaatcaggatcaaggggaagtaggcttggaagacaaaaattcgaaggtaatttaacatggaatttggaagcaaatggcgcaccttaggcaaaaggtgagatagggagaagtatacaaggcaggagttcatcaagatgggcagtataatgcaaatagaaagatcagattaaggggtgaactaaaagagtttggatgaaagggtctagggaagtgaaggtgatgaaaggtctcagagccgaagatgaagagaaataacgagatgggtgacatgttctgtaatagccaggagaaagctgcctgagatgaacatctcgggagcgggctaccggccacggacaggggaaacagcaaggtgtgaaacaatgataaaactacggcaccaatgatgcagagaaacaggagacaaaggcgggccctcgaggcaacgcacaggcggggagcgcagtgcagagaggaacgccccgcgccaaagagaggaagcgaagaacgcccagagcaaaggagccgagaggcggaagacagcagcgaggggcgcgcacgggcggacggccgccaccacgaacaagtacgg

SEQ ID NO: 207535 - DNA, 684 bp, Homo sapiens
tgtgtcatttcttccagttactgtggatgaagagcacaagaatggtgtgttagtttcttagggctgccataacaagttaccccaaacttggtgccttaatacaacggacctttattatctcatacttctcaaggccacaagtacaaaatcaagctgtaggtagtagagaactctgctctgcaggctgtaggggagaagcactccttgcctttgacagtttatggtggctgcaagcccattctttagtttcttgttgcgtaactctcatttctgcctcggtcttcacctggccttctcctttcatctctgtctccctcctttgggtgtctcttctaaggacacttgtcactggatttagggtccacccagataatctaggatgatctcatcttgagactcttagcttaattatgtttgcaaagacccttttgtcacgtaaggtcatgttcacaagttcctgggttagatgtggatatatatatattttttaaggccacaattcaattcacaaaaaaaaaaaaagaaaagagtagaggaataacgaggcaaatatcacttgttatttactttaatgacatgtcatatttggacaaacacaaagctaagcctggaattccaatatcttgggaaatgaaagataaaagcagtcagaaaaaagtagaactatgaagacagttttataaa

SEQ ID NO: 207536 - DNA, 546 bp, Homo sapiens
cagtggtcccataagattataatacattatttttactgtacctcttctgtgtttagatacacaaataccactgtgttactgttgtctacaggcacagtaacacgctgtacagatttgtagcctaggagcaacaggctataccatatagcctaggtgtgtagtaggctataccatctaggtttgtgcaagtacactctgatgttcaaacacaatgaaatcgcctaacaatgtagttttcagaatgaatccttgtcattaagtgatgaatgactatatatttgtataggcatagaaaaaagtctagaaaactatatatttgtataggcatagaaaaaagtctggaaaagtcagatatcaaaacagagagaaatgagaagagtgagcgatgaggaagggacctttactttttctttaggtttttttagtactgcttgaattattttacagtaagcattaattattgttacataaaaacttcctttttaatattaataataaagtgttcttttacaataaatgtctcatgaaacatcaattacacctcaa

SEQ ID NO: 207537 - DNA, 313 bp, Homo sapiens
tggatgggtctcttgaggtctgtgtactattcacagtgaaaccttgtccggtattgtttggtccagtcttctccagtcctgaccggtcttatccggttcggcccagtctggtccggtcctgaccagtcttatctggttcagcccggtcttgtccagtcctgtctggtctaatctagtccggataggtcttgtcctatctggtttgggccagtcctgaccagtcttatccggtttggcctggtctggtcctgtcttatctgatgctgaccagtcttacccggtttgctgcggtttggtctggtcttgtctggtc

SEQ ID NO: 207538 - DNA, 178 bp, Homo sapiens
tgggcagcaacagcagggctatttcaagacctcactccattgtaaaggtgttatgtgtccacacagatctataaatcaccatgcaacatctttccagaagtatgtgctggtctgcagaattgctagatatgtccaggtgggctgggatcactggaaaggcctggtacatcttgcctga

SEQ ID NO: 207539 - DNA, 333 bp, Homo sapiens
gctctcccccgtctgggtcccccttgggcggggcagggccggccggggagggggcgcggggcctttgttagggagccaggccccagcccccgggacaatagagacaccctcccggactcctctccccggccggccggggctgctggcgggcggggaaggagaggggctgggacgcgtcccactctctgggggtcggtctgtcccggcccggcgccggccccggcggctcggctgtcctccccccagtcggtatgatgcagcagcagtgccgcagggacgggggaagagccgaggcccggcctcctacccttcccagtgcccccggctcattcg

SEQ ID NO: 207540 - DNA, 198 bp, Homo sapiens
tccggctattgccccatttctttgttcctttgtagcagaactcctaaaaatagtctgtgtttcatgacttcagtttgtctcttcctgttttctcttaaacccagtgaaacgagtttcacctccacattccagtggaatggctgttgttgaggttggtggtgacctccctgttgccgaatccagcatttagtcctgtgg

SEQ ID NO: 207541 - DNA, 745 bp, Homo sapiens
aattgtgagtcaattaagcctctttcctttataaattgcagaatcttgggcaggccttcatagcagcatgaaaacaggctaatacaccccaagaccatctttcctctgggtttgagtcaccctagtgaccctggggctccccattttgagccctgaggtaccagctttgagactgtattctgtatatgattgagggctgcaaggaaatcactgttcgacttgtgtttttaaataatgatagaaaaacagcctattacctttaagctgaaggaacttctggagctcttgagcaggggcaggctataaatccataacttactaggagctgcagtataatgttcattttgaaccgttattgccgcctaaggattccatgaactaaccaaggcattacccctgagctgaggggtgaaatggactgctagaggaagttgttggaagtgtctacttgaatactagagaaatccctgcctcaaataagttggtaatggtgacatgattgatacaaagccattcagattagtaaccagtaaaagtgatttattcacttcttaggatggctggaaaaccatgtcagcagcatagatgaagatatccatcttcctccttgctgtgactcaaagtcagcaacatattgaaccagtttttaaaaaataaaagctaaaatgtcagaggaacagaatacaaaggtggcatagagtattgacctagctggccgtgaaagtcaaatttgaatttttttttg

SEQ ID NO: 207542 - DNA, 498 bp, Homo sapiens
agaacataccaattttgcagtagatttattcaagtaaactatgacaagtcagcagtgaaaaattgcagaaacaagcaatgagtggtcaagaaagtgtaagatgaacctcaatgtggaaaagtatagtaatacatttagagaaacacatgccaaactatataaagagtattatcagattattacatagcactgcttgctgccacaccagagaaatgattctgtctcgatgggtcaattcttagatcatttaattatctgtcatcgaaaatgtagcaaacttgacagcagtaatatatactataaacgtgcaatagcaagagcattgagcgctgaactagaaatcacatctgaatttagactgagctcagctgcttactgtgattttgagaaaattgattagcccctctgtgtctcagttttcatatctgtttaatactttattgtcatggtgattatgaagacccaataaactatacataaatttgtttgcttaaagaa

SEQ ID NO: 207543 - DNA, 505 bp, Homo sapiens
cagttacatatgtaactacgtaaacattttggaggatatcgaaaagatctgtcaccctaccctgatacattttttttttgatatattttgtccccactgtttctgtgacttttaaaaaaaaaccgtagttctgttcctagtggttgtacagtgctctgactgacgttcagattgtcggcacatgaaagaaatgtagcacaaaatggagaagtcgttcaaccttgaccctgtcagagttcttatttgaaagccacattgctgctagtgttcttattgtgttttggattctgtttcttgccctttttcttattagccaagtagtaacttaaggaagcagataagaacaatgaattttggactaaaggaagtaagaacaatgaaccagaaatcagataggaatgtggtgataattgtgacatggtcacatagtcatagtgggagctcatgtgagtaaaaatagcttgatacatttgttaagaggcttgtatcctctctctctctctca

SEQ ID NO: 207544 - DNA, 405 bp, Homo sapiens
gggaaagagaaccaagaaaagtgagtttcccagactttgcccagtttacttcacctgcaactcccaaacagatctttgggtgggggtgtggggagctgggataaggcttttctctagagaccctcaagagccaactgggctctctttggttaaattttcaggcagaaactgctgacatcctagcagccaggagaaaaatgtcctgggagagacaggtacttgttccagcagtgaaatgggatgctctgggctcaggtacaaacaagggtgtttagaaacgcggatctccagggctcatgtgcccatttcagagtgcagacacgcagctcacccacagggaagacagagaaagctctgaccccaagagaaaccgacatcatacacacacacacacacacacacacg

SEQ ID NO: 207545 - DNA, 340 bp, Homo sapiens
tgagctgaaagattgtgtgtcatcagggctgacaccaaagatggtgaattattggcaatactgacaaggaaagctaaatttctgtgatttttctcaaggttaatgagtcaccagtcaaccacatccaaacacttcaagctgcatgtctaggtcttctgagaggaataaaaatgaaagagtttatgtttgtattctcgttaaaatttattttatcttaggcataatttcagacttatagaaaagttgcaagaataactagttattttgtagaatatcccagatttggctttctctgatgtttcatcatcattagattccgattatgcccttttagcatcac

SEQ ID NO: 207546 - DNA, 777 bp, Homo sapiens
acttgaatgtgtcagaatttaaaacgtttcccaatcaactgtagtaaaatgatagctcattttaatatatagtttcctgatcactataataagcctttcttattatgttaattggccatttacatttcttcttctgtgagtgttttgatcatattttctgttcattttcatattggatttttttttcttattgatttggaactctggatacgaatcttttctcagttacgtgtattgaaaatatattctcctactgtcttttaacctcttatgataccttttattatatcaaaaattttaacttcaatgtagcaaatgtgttcaattttaatatattgctctttcttttgaaagataatgcatacagcacatagcttaaacttcaagaggtacaaaagagcatatagtaaaaggtctattctctgcctcttcaaatcacccaattccctttagtgtcctcccagaattatgcacataaaagcaaaatacaataaatattttcacttttttaatccaaaaaagagagaaaaaaagaacgaacagaaacaatgtttgtgggcggcatgggcccgggaaaacgttcttagacccttctgttggggcgcggcgccacaatggcatagggacacgtgcccaaagaggtcacaagggaactcgggcaaaaaacaaggagggagattccccgacataaaaacgccgggggcaacagaggtcttagaaaatccaagagagcctcgaagcaaacagggacaaacacaggaccaaggaccgatatat

SEQ ID NO: 207547 - DNA, 405 bp, Homo sapiens
tcctggctgtttaaccagagccctgggtagagtctccctggtgggacagctctcaccaagggcccacatgtccccaacagacacagtccatctgtagggcagtgcaggacacaggccttttttaggccctcatgtagctccagaggtggcatcatcaatccagcacctctgttcctcaaaatacaagcttttttgtgtgtgtttttccatcgaaaaatatatttttttccttgaggcttttaaagcctgcagagcttagctgttctgaatgtaaggagagaatcttgttctagtgaagggctgtaattactgcaatgtaacatacagcatggtggtatgagaatgcgtcggcaagggaggcagacagagagagactgagaggagacaggacctgggcttaaatcc

SEQ ID NO: 207548 - DNA, 496 bp, Homo sapiens
aggcagtctggtgagccagtttgtgtaggtgtctgtttgtggagccctgctcattgatagttacttctggtattatcactgaatttctgctgtgaaagttgtcattatgttaaccttgaggctttaggaatataaacaatgcttcatagataatagagatcacatttaagaaagattcatatatatagctaaactttttaaaaaggaatactgtggccgggcacggtggctcaagcctgtaatcccagcactttgggaggccgaggtgggtggatcacgaggtcaggagattgagaccagcctggccaacatgatgaaaccctgcctctactaaaaataaaaaaattagccaggtgtggtggcatacacctgtaatcctagttacttgggaggctgaggcaggagaattgcttgaacctgggaggcggaggttgcagtgagccgagatccccccattgcactccagcctgggtgacagagcaagactcagtttcca

SEQ ID NO: 207549 - DNA, 572 bp, Homo sapiens
gagttcgagagcagccttgccagcacagcggaaccctgtctctaccaaaaatataaaaaaatagccaggcgtggtggcggacacctgtaatcccagctacttgagaggctgaggcaggagaattgcttgaacctgggaggcagaggttgcagtgagccgagatcgcgccactgcactccagcccagtgacagagcaaggactccgtctcagaaaaaaaaaaagaaaaaattatagattataaaatgcggtattaagggaataaaagaattacatgaaaattatatgtagttgctggaagtccattgtattaatagaaggaatgcacagggacactctcttatatctagtgtttctgctgagacctgaaaaatgggactaagcttgccatacagaccttgaggaagaacattcctggcagagggaagagcaagtttataggccctggagtatgttcaaggaaatggaaggctgtcatcatggttgtagaggaataaataaggaggaagtggtatgctctttaagaagccagcattggcagcagccagttgtggagggccttgtgcatcatcgt

SEQ ID NO: 207550 - DNA, 233 bp, Homo sapiens
gcttttcctgacagcccatcagtgttctcactgaccctgtagtatggcctgcagaagcctgggttctacatgattatcatcactgccatgcctcatgttcaattcaacttagtaaaccccagttgagtgccttctgtttactccttcaacaagtttcctctttatcatcaacttctctggaaaaccttgtctgactcctccaggctgagtaggaaccctcttcccactgaaga

SEQ ID NO: 207551 - DNA, 191 bp, Homo sapiens
ggagctgagggaaaatccaggggaagttagagcaactgcaggcacaagccctgctactgcttcacaccaatgaagtgagtcagcagatcagcaataatgtaggtgtgagctacaaaatggccaccgtttccctaccaccctccaaatttctcaagaatcttccttgtgacccactctaactagaagcatac

SEQ ID NO: 207552 - DNA, 534 bp, Homo sapiens
gaaacacggtggtggccttgaagtggtagaattatgagtgattttcccgactttatgtattttcttaaatggtcgtgtttttgctatttgtttttaaaactcacgctttatttaaaaataaatttgttccacattttgtggaaacttgtacatttcggctttctgtggatattttaaatttttctttcgttttctacgtggaatttgccatataagatgcagtttttccctttacagaaaatcattttaatgtaaaacttactctaggctgatcttactgaatcagttactaatagtccaaagtttgaacctagagttcattgcaccattttcgagttacataattgtgtttgtgtgttaggtttgggctttgtaacctgtattattttaatcatcttttttgccattaactctattattcagtgtcatcgtcgtgaactccatttttagcttgtggcctgagtcctgtgcatacctttaccacgtttttcgggaaaatgcctttggcacaatgtagtgagtttccataagcac

SEQ ID NO: 207553 - DNA, 577 bp, Homo sapiens
aagaatcacctaagatcttgtgactaatatagattctagacccctctactttccaaatatctaggaagtttggatggggtctgggcatctgtatgtttttagagctctccagttgactctgatttacattggtgaaccactgtattaaatctttgactgacactctgaatcttgttgtggacctgttggcttttatgttccgaggctacacattaagattttggtaataacttgctattctagttattcattttacttataaggctgcttagttgaagtttgtaggtaaaccattgcaaagtcaccatcacttctggaaaaataactcaaggcccaaatacccctcatggtggattaggcgaatcattctactatgcagaagacacatgccatttgcatgtgtttccaggtgaatgcatgtttttcattttcaatatttcctctctcttactttctgctcttcacactttgagcactatcgctacaggcctgaaattcattgtgttcatcattctagacaggtacctaatgcaggatgtgaggcaaaagcagaaagaggaagctttgttttaagaag

SEQ ID NO: 207554 - DNA, 700 bp, Homo sapiens
cagttctcctgcctcagcccaggaggtggaggttgcagtaagcaaagcagagatcgtgccactccacctcctgggttcaagcagttctcctgcctcagcctcccaagtagctgggattacaggtgcccgccaccacacccggctaatttttgtgtttttagtagagacggagtttcgccatgttggccagggtggtcttgaactcctgacctccagtgatccgcctacctcggcctcccaaagtgctgggattataagcgtgagccactgcacctggtcctaagtgctttttaaaagcataagttggagggtcttcaaagtcttttggctaatggcacatactaaaacttaagcgaaacacttttttttcttttttttttttaactgagtacgtgatagcaaataatatttatgctaaggcacatcattgcaaaagtcaacactgaaaaaagcaaataatgcccttagtattatcatgacaataatttgggcctcctggacttcctaaagggtctcaaggatctctgggggctctgttgacctcactttgagaagttcttttctaaagtatagtatgtatatatatctgatcacttattcaagaaatttcagtgctgtatggcagcacaggtctgggttccagggatatacccctgaacaaatgatgagacagcgaccgaaaaaattgctcattattccg

SEQ ID NO: 207555 - DNA, 474 bp, Homo sapiens
tctgctgagcttggcccagcttggcttagcctgatacaacctgctcagcccagttcagctcggctcagcccagcccagcccagcgtagctcagctcagctgagcccagcccaggttagctcagccccagtccaggtcagctcaactcagcccaaaccagcctggctcggcccagctcaccctagttcagcttagctcagcccagcccagccctgcccaacccagctcagctcagcccagcccaggttagcccagcccagcctcggcttagctctgctcagctcggcccagcccaggttagcccactgagaagctgaggttccagagaggcttccagagcaggagcagtgcagggacaggaggatccgggagctcattcaggaggggcacatgggcaagggcaaggggctctgttggggagacctgactggacactggggctgctccacagcatagggaacacgccaagtgctgc

SEQ ID NO: 207556 - DNA, 472 bp, Homo sapiens
gtcttgattttctgaatggagcgtggtagcatgttatagagtccaaggaatttgccaaatccgtgtgagaagatttgcctctcacatgtgagagaattttttgagaaaaaaaagatcctgaccccgtccctctgccaccacccgagtgaggaagactgacagagcacattggcttgctgtggagacaagatcagggaaagcgcccctgaaaagaaagcattttggaagtcctgaaggtggagaaggagatttagaggaagagtgataaatcagaagtcttcgtccaagaattagctttgcaccatctacagacctaagcagctgcagtcctggaactgtgtgataacttgcccagaaaatcttcttgtggaatctgtctttacatggaaaagacttggcaatatttgtacagcaactggaagaaaggtctttgctgagatatacaaagaggcagaatgtgtgtggatcaccg

SEQ ID NO: 207557 - DNA, 698 bp, Homo sapiens
tttaaaatgggggagggctgggggctggagtacctgaaccatagattcattgctgccatcatccttttggaagcttagctcggaaaaagaggagtgagatttattgcacttgtaggtctaattaggggggaaggggggcttctggcccgttcactggttccctctcttcttcacggagctggggccgcctcctccagagctgtggccttgttttcacccctctactttgaaaggaaagtttgtgactgaaccgtgctttcatagttgtgtcattttttttaaagcatgatactcgttttatttcttcatcaaactccaccctctgcttaaatactgcatacaaattacaatttacaacggcatttaccgatccttctgatttggccgtaatgcatagactgcagctagcatgagcttccacatcatttaatccctgtgttgtatgggtttgttttttttaaaaaaaaacacaacttttgatgttgtatttggatatgcttcatgttcatgtggcaagagatgcagtacttttcttataaatatatttagccgtttacagttaaagtttatctcttgacaatcattaaagatgtcttatagtcaaattagcgaaccagtcaattttgcagaatgcagattactccttcttgtaattgactttaaaattatattttatatgccacaagaaaagaaattga

SEQ ID NO: 207558 - DNA, 254 bp, Homo sapiens
tccaatacttatttcaaacaggcgtctctgggtctttttcaaactccctcccactaatgcctttcaggcatcctccccagcttagcctcccctgggaccagcttcctgccagtcctgaaatgcccacatacacggggaagattcctgcttccacatgaccagcccccagtgacatctccctcagactccagacctcgtctttttttctttttcttttttctttttttttttttgagacagggtctcactctgcc

SEQ ID NO: 207559 - DNA, 496 bp, Homo sapiens
tcaatgcctggcttcaaagcttcaaaagacaggctgactcttgttaggagataaagcagctgatgactttagttgcagccaatgttcatttatcattctggaaatccttaagattactcttataaatggaaccaacaaagtctggatgacagcacatctgtgtacagcatggtttactgaatatttaagtccactgttgagacctactgctcaggaagagtcttctttcaaaatattactgctcattgacaatacacctggttacccaagcgctctcatggagacatacatgaagattaatgttttcatgctggctcacccaacatccattctgcagttcatggatcaagaattcattgtgacttccaagttttttaattcaagaaatatatgtcgtgagaaaaagctcaatatcactgatcattagaggaatgaaaatcaaaaccacaatgagataccatctcacaccagtcagaatggctattactaacaaacc

SEQ ID NO: 207560 - DNA, 110 bp, Homo sapiens
gtcctgtcgtctgattcccttttcattaaactaatgtgcctccgtcactactgctttctttttctccctgttgccttatttctttccggctctgtcacctgcttctcttt

SEQ ID NO: 207561 - DNA, 295 bp, Homo sapiens
gatcatgcaggatgcttttcagaaacaggtgtgaataatcttctgaatacccttgacccagtgatctgattgccagcttcaattatttcaccttaaaagtcaagagctggtcaatacactgaatctggaaaggactaggcaaaattgcctaaccattactatcttcaaatatgggcattgagctggaggcataattccagtaacccccttgcaacaatatttacctgagcagcctttatctgggctaagtcaagcacttgggcagtcctacaggaatgaattccttatcactgaa

SEQ ID NO: 207562 - DNA, 159 bp, Homo sapiens
ttaagttgtgcaggaagggtgtgacatacacactaaattgtgaagacttagcacatgagaaaaaagaacatacacggtctcagtaccttactgcagcctcaaacgctgaggtttaggcgatcctaccaccacagccccctgagtagctgagactgtagt

SEQ ID NO: 207563 - DNA, 663 bp, Homo sapiens
aaggaacataggagagacagtggtgtggaatgagcagagatgatattccttacttacctgactgttgagttatcttggtatctggaactctttattcctccagtcttcaaagcagaggagatgagagagattgctttttagagccctatccccagatggccagtctgttttctgatctttgcatctcatcacctcttgtggctccaggtcctccaagtttccatgtaatctgctactgtcttcatcatattttactgttcgactacctccagaaatgtgcctgtaacagcatacttgtattctccatttccttttctgagaaatagcaagtcagaataaattactgagggaaacagcatttgtatagaattcagacctgtatcttcttaatagtaggtataagcaggaacatttgatgaaggaaagtttgcctttgttgactaaaattggcccaatggctcttttcccctacgataaccaagtgttcggagtaacacttatctggaatcctttgcttagagacagtttcccaatacacctccctcccaagggcaaatcccacatgcgattaacttcagaatttctctttcaggttcttttcttttttgtcttcataattttctgttttattatttttttttagtgaattacagtcttaataat

SEQ ID NO: 207564 - DNA, 181 bp, Homo sapiens
tatcagctgcactttctgcagtgtcctttatactgaggttgaaaccattgactacctaacatttcacccccctctcatttttattacctacctgacccctgaagggtttgccttttccacctctcggtcagggtggggacaaatcagaaaatgctgagtgccaggctgagcagggtagact

SEQ ID NO: 207565 - DNA, 536 bp, Homo sapiens
gacccttggatatctaagattttcttcttaaatccttgtaagagtcactgcacatgtgtgtgtgcgtgtcgcgcgcgcgtgcacctcaggtcatcaggcattaggttctcataaggagtgtacaacatagatccctcgcgtgtgcagttcacagtagggttcgcgcttctgtgagaatctcatgccaccgttgatctgagaggaggcagagcgcagatggtcacgctcgctttagagtgcttgggagctcctgtgtaaggacagtaccctcccccaacccaggctacctggagggagagcttctgggaatagaaagttaggaatagggaacaacaacaataacaacaacaggcaccatttattgagtgcttactttgggccaggcactgtgctcagttttgtacatgtagcaactcatttcatctttatgacttctgctggttcttgataagatgtttctaatttaattttaggatactagcctccactgagtgttgatcctaacaagctcctcgaccctcatccgctgttccaat

SEQ ID NO: 207566 - DNA, 717 bp, Homo sapiens
gacccttggatatctaagattttcttcttaaatccttgtaagagtcactgcacatgtgtgtgtgcgtgtcgcgcgcgcgtgcacctcaggtcatcaggcattaggttctcataaggagtgtacaacatagatccctcgcgtgtgcagttcacagtagggttcgcgcttctgtgagaatctcatgccaccgttgatctgagaggaggcagagcgcagatggtcacgctcgctttagagtgcttgggagctcctgtgtaaggacagtaccctcccccaacccaggctacctggagggagagcttctgggaatagaaagttaggaatagggaacaacaacaataacaacaacaggcaccatttattgagtgcttactttgggccaggcactgtgctcagttttgtacatgtagcaactcatttcatctttatgacttctgctggttcttgataagatgtttctaatttaattttaggatactagcctccactgagtgttgatcctaacaagctcctctcattttaaaaatatacacttgaattcttaagctttttgcaacgagtgggcttagttgttagttcatttggtctgcaaagctatcttcaacatgccatgctcctactatttaaagggtctttgtgtgctttttccctttgcttgtccactagtggttaagaaacaaccagtgcgtgttcgtcctttattttgtcagttgtagg

SEQ ID NO: 207567 - DNA, 545 bp, Homo sapiens
tagtagagacagggtttcaccatgttggtcagggtggtctcaaacccctgaccttctgatccacccgccttggcttcccacagtgctgggattacagataggtgtgagccaccgcgcccagcctaaattttgtatttttagtagagacggggttttgccatgttgcccaggctggtcttgaactcctaggctcaagagatccacccacctccgcctcccaaagtgttgggattacaggtgtgagccaccgcacctggccagtttattcttttggcaaagaagttactgagcttggctaacacagctttccttggttcccctcttaccactgattgcttctcttccagctgttcttcctgccccttaaatgtcaagtcttccccaccattctgtccttgggcctctcctgctctacttactcttaaactcccaaatcactctgtagcccttttctcctgaaatccagctctaattgtccactggagatttttttcccaagaaagtccccttgacaaaacaaaactcattctctccctttctttcat

SEQ ID NO: 207568 - DNA, 803 bp, Homo sapiens
ttgggtaggctggctacaggccaggttgtgggtagtgatctcattgtgggggctgcgctggtttgcatttttcaggaggctcttgtgtcctctggcaagaatccctgaacatggcttggactccagtgtgggccctctagtgctcccaggtgaggcttgatttccctttgctttcatgtgaagttcttagtgcgcctccacaacactcctggacacctttttaggcttgcaatccccccagatggacactgagacactctcaacctcacatgcccctgtgagaatccagatccaggtgtgagtcctctgctgtgccttggacttgcctttggggtgtttcctgcttttcccagacagccatactgagaaggagcagcaggaatatactgataaatactcaacatataaagttggtgagttgcaattatgtctgtgatatttccaataaccatggtgaaaggaagacactgtattttaaatgtagacaaactgatttctctggagtcggaaaaactgaaagacttcttggataacatcatttttgctcacaacataatgacatatagtaaacaaacttccatgaatagccctacattaattgtggcatattgccttaaaatgtttctcagtcagagtagaggagttcaggacctggtttaaatagtcaattatctgatggcatcaacctttgttttgatccagtcagttggaaacactatttctgtaggatctatgatgggacacttcagatcccattgaggactgtagtgaaaaaactaatatcccatgataaaaactagaaa

SEQ ID NO: 207569 - DNA, 773 bp, Homo sapiens
tggaataaggatataaggcagtaattattattcctacatttcagtagagaaagctgagattcatacaagttaaggacctacattaagtaacagaagtagttataggcaacatcaaaaaggctattcaagtctcctaatttctataatagtttgaacaatttccaaacaggcttgaatacacaaaagcaattccagtccattacaagatattactacacacctagtagaacatctaaaattaaaaaatagtggcaataaaaagtttggcaagggtgtgtaaaaactggatgtatacattgctcatggaaatttaaagtggtatagccagtacgaaaaaatagtttggcatgttcattaaataataacactaaatatacactgactatacattccagtaatctcattcttgtatatttgtcccaaaaaatgagaatttatgtcaatgcaaaagtctgcacacacatttttacagcagctttatttgtaatagctcaaactgcaagcagataaaatggcttacaacaggtgaaaagttaaacaagttgtggtacatctacaccatggcatactactcagcaataaaaaggaacaacatattgataaacacagcaacatggatgaatctaaaaacacactatgctgagcaaaaaagctggtctcataaagctacatattctatggttccatttaaataactgtctcaaaatgacaaaactgcagaggtggaaaacaaactgatgcttatcaagtgttgggacgggtaggggaaaaag

SEQ ID NO: 207570 - DNA, 573 bp, Homo sapiens
ttcatcagtcccatcttcaatgaaggtgaatatgtattatttcgtgaaatatttaataagaggccactctgtgcagcactcttcaaggcatagaagatacaacggtgaacaaagtagacaaaagattcctgcgctctggtggagctgacattctagccatggagaatgggtaatcaacaaacaaatactgtacataacgacaatatagtgcaacagatgctgatagtgaaaaataaagtaaacccaggaaaggaagaggagagctgagtctactgcttgggactgtggctcctccaggcacctttgaccattcccaataaggtaccgtgagaccctgagctgccatgcgcagccaagaaaatttttagagaagggaaagacacagtaatgaaaatgatcttcaaatacctgaaaggatgttgcttcagaggtccaaagcagattcagtttaaattactgaggtacaggtctcattcaaaatgagagataaaatacttagagccatctctaatgaaatgggctgcttttggaagtaatgtttcctatgactagtatgaagtactatgttacatg

SEQ ID NO: 207571 - DNA, 554 bp, Homo sapiens
acatgttcactgagcatttcacacacggtaaataactagggaaattagttcccttgtcatagtatgtcaaggaatttatcctacagtgcttaaaggaccccatgaggtatttaacaagcggaggggataattttgaaaagcaccagagaaaatacggaggacggatcaggcaagaacctgtaacaggaaggccaggtcaggggtgggaagtcacaggtgctaatgcccaacttaaggcaatgccaatttggagaggcaggaaagcctccattcaagggatattgagccagtcgaggcataggtcttagtatccatgcagatgtagggagtaaaggagaaaggaaccaaggatgtctttaaaatgccttgcctttcaccatgtttattgtcattgacattataagatatatctggtctttgtttgcttgtttgttttgttaactgccttcttgaggcctttggtgacttttctctctattgtatttcatgaatacatggctaaaactgtacctagctgatattaaatatgcaatcagtatttacgactgaattaa

SEQ ID NO: 207572 - DNA, 361 bp, Homo sapiens
aatgttcttcccccttctcccctgaccacttagctctaagtcctgactgtcctttttagcaaggcttgttcttttccttctgctcttagattctgcccagttcacttgacatcaaatattatattacctgtcttatactgggggagaatgcttttttccctacacatttctagcatataatacctctctttccatctcttcatttactctacccaaggggaggttgagtgacatacatgtctaatgggcaatttggggaagcatctcctggactcagctcttgccttctctctgcagggagtagggctaccatccatgaatatgaattctcctctgatcctccagcaaataatttgagttg

SEQ ID NO: 207573 - DNA, 763 bp, Homo sapiens
cctttagagtgagtgcagggtcatgtttctagcaagcttgctaaggttaagagttacaccagtggaaacctctgcttgtggcattaggcccatggtgccatattttggtaaacttaggatttttagagacattttaactcttcatgtaattttctgtaagaatatgggtagataaaacaatctatgacttgccttctttatttaccaattagtaatcaactgtgtgttttttgatcatgtattatttttccagggttgttctaggaggaatggtggggaaaaagcagtccccaaccattttggcctctgggaaccagttttgtggaagacaatttttccacagactggggaggggtggatggtttcgggatgaaactgttccacctcagattaacaggtgtgcaacctagatctggcatgcacagttcacagtagggtactcctatgagaatccattgctgccgctgatctgacaggaggcagagctcaggcggtaatgctcactcgcccgtcgcacaccttcatctgtgtggccgggttcctgacaggccacagacaggggttgggaaccccttttataaaccatgttctttactttaaagaagctttttctctcatatttagagaataattaagtgataaaccgtggcctgctaatcatatagacacctaaggggtaaacaaaggagaaaacacagtgtgggttaggagagactttgtggagtaggcatgtgtcttagtcagtttgggctgctatagcaaa

SEQ ID NO: 207574 - DNA, 392 bp, Homo sapiens
tacttcttatatcctccctattaggtcataagatccttgatggcaagaccaatgttattctcatctttgtattctacagcattcagcaataaagaagtttgcacatagcagatgctaaataaaatttttgaatgaacgaaacctcagttctatcagtagctctttcagttttgcactgtttattacaaatgggaaggagagtgagataggatgcaccctaataatcaatccatattgtctcagagtataggatcccagaagacatctactgcagtggttctcagccaattttctaacctgatacacctgatcaatgacacacacatgtgcaactaattcttcaggccatatccagatttttctttttctttttacagatgctaggactgaat

SEQ ID NO: 207575 - DNA, 227 bp, Homo sapiens
ccaagctgctcacatatttatgatgagctaaagttgatggtaaacttttttttaaagagtgggtagcagtttaaaccaaaggaagaaaggaagtgttttgcttttcagggaactgttatttgtagaagatatgttcaaatataacagataagtacaaatcagcattggcaaacccttgttatcacttctagttctttgttgcaagaatattatcccacgtatctgag

SEQ ID NO: 207576 - DNA, 476 bp, Homo sapiens
tcaaacatttgtttaatacattaatagaatacattaatggaattgataaatccttaccaagactgataagaaaacaagaaagaaaatgcaaattaccagtatcaagaatgaaacagcatatatcattataggctaaatggctaataagggaacattattaacaactttatgccagtaaatttgaagcatacatgaaatggacaaaaatccagtgtatcaaaaatagacacaagaactagaaaatatgaatagccctttatctatgaaggaatttgaatttattttgtatccacacatatacatttaaagaaaacgtttcgccaagattattttactagtaaattttgtcaaacttttaagaatacaataaaatcactcacacaagctctttcagaaagtagagaagtgtggaacagtacctaactagttttatggggctaacattaccttgataccaaatctgaaaaagacattat

SEQ ID NO: 207577 - DNA, 354 bp, Homo sapiens
ctcattgcccagccccagcccccgtcgtagtacctggattgctgtcagcaaccaagaagccatgtgcagtgaatggacatggggtcctgtcccagagcagctcccagcccacaggggagagaggcgtgtctatgaatgagctggaagaacattctggcacaaaggggccaggcacagtggctcacacctctaatcacagccctctgggaggctgaggcgagtggatcacttgaggtcaggggttcaggccaggctggccaacatggtgaaaccatgtttttactaaaaataccaaaattagtcagatgtggtcgcgggtgcctgtactcccagctacaagggaggctaaggcag

SEQ ID NO: 207578 - DNA, 217 bp, Homo sapiens
taacagcactaggtaccagttacttccctgaccctctgtttccttgttttcaaaaggacaagagcgtcaggtgccagttgtgtcgaggagagaccctgtgagagaggctgtgggaaaagcacagtgcctggcacaaagggagaggtctgagtaaaagtcaaggtggcttcctggaggaggccactgtgctctccggcggcaggagaagcaggaatag

SEQ ID NO: 207579 - DNA, 846 bp, Homo sapiens
gggctggcagaagggcagagggggtggcagcatgtggagggccttgtacccatcaccaggactttgtctttcacttgggactcctctggtcctttagcccagatccaccggctgcctcctcccgccagttctgcctcccctctccattctgggcagtggagcctgatggttagtagcatgggcactggcctgcctgctcaggttctgagctgagcacagaggtctgggcctcccctgggcttctgctccatttggcccagggtggggccatggactcccatttccaatggcgctgctggctctggcatattctgacccctccactggggacacctcccagtgttccttgcctggctcatttctctctcagggccatcttcgttgttgctacctctaggaagccttctctgatcctcatccccaaggcctgtgtcgggatacgtcctactccttccctttgccagttgggatcccctgggttcctttatgctcccccaccaggctgggtacttgggaagtattcgcagcccccagcattaagcctggcatgtagttgccactcagtgagtagtttgatgaggggctctttgctgtgggaggattaggctgcagggttaccccataacccccagtggaggtgacttatgtccatcttttggggacttttgcagtgagggagtgcattataatggagaggaggaagccagattcctaaaactttcaatcacattttgctcctctcagaaacaaaaacaaaacaaacaaaaacacaggccgggcatggtggatcacgcctgtattctcagcactttgggaggccaaggccagaggatcacctgaagtcag

SEQ ID NO: 207580 - DNA, 600 bp, Homo sapiens
actttcacttattttcaatcggtctacttagaaaaagaaaatcggcattggctacgctgtgaccaagacagcttagggaagaagggcagggtggctgctgaccgcaggctctcaacagacctgtgtacaatgggtgggcaagcaagtgtccatgagtgcagagacagacaagcagatgtctaatgaaggaggagacaaccagcatcgaacaaatgaccaagaaatagatgcctagtgggtgaattgatcagcaaatgtatacacgtgtgcataaacaaatcaatatctaatatctaaactaataaatgtatgaacaaatacatgcctaatgagtgaatagacaaatatctcatgaatgcgtggacaaatcgatatctaatgaatggacaaacaaatgcatatctatgaatggatgaacaaatacatatcgaataaataaatgaataaatacctaatagatatatgaacagatatatctctaatgagtgaataaacaaatatctcatgaatacgtggacaaagcgatatctaacgaatgaatgaacaaatgcatatctatgaatggataaagaaataaacatctcataagtgaatgaacaa

SEQ ID NO: 207581 - DNA, 130 bp, Homo sapiens
ctctacatgacaactaaaatattagaaaccataacaggaacacctctctttattgtactttgcattattgcactttgcagatattgtgataattacacattgaagatttgtggcaactctgtgtcaagta

SEQ ID NO: 207582 - DNA, 434 bp, Homo sapiens
gttttacaaaagttgccaaattaagacaggattataactgctcgagtccttgtcagggctgaaaggttgggagcctcaaatatgccccggcagtgttgatgaaaagcttaaaaagtaataaaagggagaaaagagcgaggaaagtaacatgtaaaactcttattaaagagaagagccacagagaggttgtgaacttgaatcactgtttgaactttaatttgttcattaacaggatttgccccttactgtgaatgttattacttccctttgccactcagcaacaactctgggcataataaaagagcctggcaaaaagttaaacgcctggtaattaattcatttaattgaaaaaagggggaagagagaaagagaggtcccaatgcaaaagcagaaggcagagaggttggaggagggggcaaggctgaaataacatt

SEQ ID NO: 207583 - DNA, 1285 bp, Homo sapiens
ggtaaaacattctggcataagcagttgcattgatttgtagagaggctagtaaaatggaaatggtcacttagtgggtgacaattttctctgaaaattgatcccatgccaaaagggaaggaagtaaagaagaaaaatgatgaccacagatcctgcttgggacctgccatggcatcaagttttagaactgtttctaggggttttgttaatcctgcaggaatgaacagatacaactttccagtatggcttttctgggattatatgctgagagaactaggatggatttttagaagtttactaacattctgtatttcatgtttggaggtcactttgggaaagactttttttttttttttgtattttaacctttgataagccttttgggggccttatttgttaagtgggtatcagccaacataagagattatttctatagcattttcctctcttctgtgaatggaatctaatttccaagcataatctttgtactgattggcagttgcttttgtcagatgctaatctgtttttggtttgtgttttattcaatagactagattctccactaacatttatctttcattttaccctattttaatcccatcagtgtttcttttcacattaagttgattgaatcaaactacttaactcctcttctgttcccaaaggtagtttatgacccacagacactgtcaacaatttttccctttttttatgtcttcgatggttgtgattaaagttcttaaaagcatttgatataaagagcatttgatatgaagtcggagggggaggtttctattcaatagaatttattttctgagttccggaagaaccttttcttaaggtcatttcactttactatatattagccatatactgtgggaccataattgtagtctttaatggagcttcagaacatttttatgtttagttatttaccaaaaattattggggactgtgtgctatggatatagcagcgagcagaacagttgaatgggggttatattctgggaaatgtttgttcttagagtgacatctcagtttttgaaaatgtgttgtctaaactccatccatgtatgaaactcatgaggacaaaattccctcatattactggtgctttttcggatacttacccattatttaattctctgataagctgtaatatttatctccagcaataaagcaaggtaggtgctcagggattacctctttccctcctttctattccctccacacatgtagctgcatcaattatgtgcttactcaaaatctgttttgttctgttcctttt

SEQ ID NO: 207584 - DNA, 345 bp, Homo sapiens
gatttttatagctttaagtttcacagttaagtttttaatccattttgaattacattttttatatggtgagaggtacagtttcaattttctccttctacatatgattaaccagttttcccagtaccatttgttggatagacaatttttccttgtttacttctgttgactttgtcagaaaaaagttgggtgtagaaatgtaaacttatttcagggctttctcttctttctattggtctacatgtgtatttttgtagcaagccatgtaatatggattactgtagctttgtagtacaagccaggtaatgtgaggcctccaggattgctttgttgttaatgttgctttgg

SEQ ID NO: 207585 - DNA, 562 bp, Homo sapiens
  misc_feature (219)..(219): n is a, c, g, or t
aattggggctggaatcccaggcttcctatcccagggctgagctcatccccatagtgttattctgtctcataacataggagacatatttagggaaagcagccacccaaaagtaagatagaacacaagggacctgtaagcaactccttcactgaaatgagcctgggagtgtgaagagcagaggatggagagccttgcttctgaaggccttggtcacacccntcacactgttcaaagtggaagagattcattaacttttatcattatataagatactacttatttctttaaatctcacctcaacccccaaaactgaaagttagcaggagaacacttttggccaataagaaaacagaaaataaaattaaaatggtagattcagtttcctgcaatacctcagtttcatgcaaagacagtggctctgtgaaactcataataaaacttttaaacatcccagaaatatctttaaaaacataaattttactgtttatctttccttttataaaatggtacatgttcattatggaaatttttaaaaaagacaaaattatgccaaaaaaaatga

SEQ ID NO: 207586 - DNA, 669 bp, Homo sapiens
tgagagaatgttcctaacaccaaacaaagtacaaagtataaactgcaaaggaaaatactgataaacttgaccaaaatttaaaacttgtgtatcgcaaaagaaacaataaagttaaaaacattagaaaatttgtaactcatataactgagaactttacaaaatataagaacagataaattgaaaaataggtagttctcaaaataggaaatgcatatagccagtaaacacatgaaaagattctcattcattaataatcaagaacttgcaagtgaaatcagtgttaccattttctacgcatcagatttgtaaaattaaaaagccttatgatttgcaaaaagtgcaaggtgaaaagaaaaatcttatgaaataccaaatgttggtgaggatgaagtaaaaggaactctcacacattgtttgtagtagtaccatttggtacaactaccccggagagcaattctcaactagaagagatgaagtaaagatgaaattgcataacttaaaacccataaagagatatcttgcatgtgtgcttgaaacattatatgtaatagcagaaaattggaaacagcctaaattcctgtcagtagcagaatgaataaacagcacgtaaatagttacataatattgtggtgtactacataacagttaaataaatgaaccagatctata

SEQ ID NO: 207587 - DNA, 161 bp, Homo sapiens
cctacagttgttttcttaaataatagtaaccataatgccatgatcacagctaataaaattatcagtcattctttaggatcacttactatccagtctgtgtaactaagtattcccaattgattcaaaaaggtattttaaatggttttgttcaaattggtatc

SEQ ID NO: 207588 - DNA, 385 bp, Homo sapiens
aagaaagaaagaaaactatacttgtgccccttacattgatacaaaaaaaaaaacaaaaacctttctgtgttcaaattactatgtggtttctctcttctgactagactgatgaaaacaatcagttttaaaacttttggaggagcaattgattctggggctggtcttgaatgggttcaggggtatagtcttcctatacaattattgccacgtttcaactgtatagcaaatcaaatttctgttataaagataatttctggatgggtgcagtgcctcacacctgtaatcccaacactttgggaggctaagatgggaggatcacttgaggccaggagttagaggccagcctgggcaacatagtgagatcccatctctaaaaaaaatttaa

SEQ ID NO: 207589 - DNA, 402 bp, Homo sapiens
gatcgtcacaacttggcagtttatgtgcaatattcagagcaagttcctggttacagaagtatctgagtatctgcattaggagggtccttgttttaaaatttcttaaagaagccaaataggccagtcgtggtggctcacgcctgtgatcactttgggagtcccaggcaggctgattgcttgagctcaggagtttgagaccagcctgggcaacatggcaaaaccctgtccctacaagaaattttaaacaaaattagctgggcatggtggctcacgcctgtcatctcaactactcaggaggctgagaggtgaaaggatagtttgagccagtgatgttgacactgcagttagccaagatcgtgccactgcattccagcctaggaaacagctagaccctgtctcgag

SEQ ID NO: 207590 - DNA, 401 bp, Homo sapiens
aaatgagcagatgagattcacagaaacaggaacagactaggctcctacagatataacactcaacctagcgtactactataaaaggaatagagtatcaaagtatacgaagacaggctaggcatggtggtacacgcctataatcccaacactttgggagtcccaggcaggctgattgcttgagctcaggagtttgagaccagcctgggcaacatggcaaaaccctgtccctacaagaaattttaaacaaaattagctgggcatggtggctcacgcctgtcatctcaactactcaggaggctgagaggtgaaaggatagtttgagccagtgatgttgacactgcagttagccaagatcgtgccactgcattccagcctaggaaacagctagaccctgtctcgag

SEQ ID NO: 207591 - DNA, 727 bp, Homo sapiens
ctgaataaatatgagaggtaagacataaaattcaatataaaatgtttctggaaattttatctaaaatggttctgacctgacagtgaccagcctggccaacatggtgaaactctgtctctactaaaaatacaaaaattaggcaggcatggtggtgcatgcctgtagtcccagctactcaggaggttgaggcaggagaataacttgaacccaggaggtgaaggttgcaatgagctgaaatcgcgccactgcactccagcctgggcaatagagtgagactctgtcttaaaaaaaaaaaaaaagaaaagaaaagagcagggtcctgtgatacagtacactctgaacctgatgggaaccagtccttctaataaactagagatggcttttacagtaaagcaaagacatctcttatcaatcacctatatccatgaatcaaaagagaaaaccaggtcaggcatgatggctcacacctataatcacagcattttggtaggttgaggtgggcagatcacctgaggtcaggaatttgagactagcctggccaacatggcaaaaccccatctctaataaaaatacaaaaattagccgggtgtgatggcacacgcctgtaatcccaggtactcaggaggctgaggcaggagaatcgcttgaacccgggaggcagaggctacaatgaactgagatcaccactgtgctccagcctgggcaacagagcaagactccttctcaa

SEQ ID NO: 207592 - DNA, 832 bp, Homo sapiens
tggttagtaatattcagggctgtctccatgcgagactgtaaatacaaagtacactgtattcccgccaaggtctggcacagtgtctcttatatggtacatacttagaaaaaaattttggactgaacctgattaccaagaagcagcagtatttcaagttcatcaacctaaagaggttaggtcaagtggcaggttagggagctctcctaaaattagaagagcttcccacttgcaaaactgaaggcaagccaatcctcctcagctggaaaaaaaccattattttaataggatttcaataggaatctattcaacaaagttgctcctacaaagggaacttttcaaaggaaacagctatgcacacaggatagccttctgtgtaaatcccgtttacagaaatatactttcaaacctgcacctttaagattttgctctttttatggaggatgacaacgaggcttttctgtcttatcttaccctaggcatacattaactgcttaaaaaggcatagcctattgagtttttattactcaaataatgtatgttcaatcatctcagctcaaatatgtcattattaaacaatcgcacccattatagagaacataatgacaccatttggagtggaaagcttttctcaaccctgcggtaccccttgagtaaagggcttttgtgtcatagaacactttccacttcatctcatcatgaaacgttaatacactgcaaggagttgtttgtaaattagtctggtgggtgtaaatcagagaacagatagcacaaaaagttgttgttcagaagcgtgaaagacatgaaactagaacttctctctgtttttaataat

SEQ ID NO: 207593 - DNA, 395 bp, Homo sapiens
ttcaaaccctaagctccagtatgactgtttggatataggccctttatgaaggttgtcttagtccatctggggtgctacaccaaaatatcttaggctggaaaatgtataaacaacagaaatttactgctcacaattctggaggctggaaagtccaagatgaaggccccaggggattcagaatctggtgagggttcactttctgcttcaaagatggtgccttcttgctgtcttcacatggtggaagttgagcaaacaagctctctcaagcctcctttataatggtgctaatcccattcatgagaaaaaacctttatggccgaatcacctctccaaggccccacctcttcataccaacgcaatggggattaggtttcaacatataaattttgggaggg

SEQ ID NO: 207594 - DNA, 248 bp, Homo sapiens
agaacctgctacaaaggataattgtgaaatatcactggacccagcacctaggtgatgtgactctcctttttgcctgggtctcacataatttgggtattgtgatatattgctgagaccaacatctagggggtgggaagctcctttcttgaccctaaccacaggagctttgtgacatatctctgcatccatgatctaaatatgtgattctgtgtttctgcctgcaccctgctaacagagaagattacgac

SEQ ID NO: 207595 - DNA, 616 bp, Homo sapiens
acctcaggtgatccacccacctcggcctcccaaagtgctgggattacaggtgtgagccactgcgcccggccgattttggggttttaagcgatgaataccaaatgtcagtttaggaaaatattaagtggtcacggggttagtttaggtttgatattttatgctatgactccggttttgctcaactatgtgactccccttaaactaagtccacctataagtacttctgaaagcctggctttacactgtgcttgttatgtcaaactgatgaggaggataggggaataggaaaacacgaaatttgctgctttaatttatcagctgtaataatgcttctgtgtatcccaagatattattcttaagtgttcttattaccatgggttcagtgtgtaccatagaggccaatgtagtgcctctgactcccagtctatgtatgacttgtagaaagatacttttttttcaatctggttatctagtagatcagtaaaaccctttgcctgcactctctgttgacacccagccaggagggaggatgatatgctgggcccaactagtaattgtaaatgaagcaggataatgaatcacaggacttcgagctgctcaaatttaattcccatta

SEQ ID NO: 207596 - DNA, 595 bp, Homo sapiens
cagcttcctgcatttcctgtgcatggcacggagctcgggtctccagagactctgcatctggggtgcagcgaccgatgagcccgtaaaccagtcgcacactcggagcgtggatgctgcgtggggtgcgctgtcagcgcggacaggctgggagaacgggggacgctggggacagggagagccggtgaacttcccagaacgtccgcctagccagacccagctgcgggtactgggttttgagacgtggtccagtacccaggaactcagtctgacagggagacagcgcctacacagtgagcccagtactgagggaagacccgctgggaggggcggcctggatagcccctccacagagaggtcagatgtgaggtggccttgagggaggtatgatgtaaatcctgatcattcgttgtatttgaggctgtccgttctcctgtgcctcctcggtcgccttacttggatctgttcccattgccttggtgtgattttatccaccggaaactgtcttcagctatttccccagtaacctctaactaaaaacctgggtcttgcctggtctaccctccctgctgaactccagagccacatcccaactgct

SEQ ID NO: 207597 - DNA, 638 bp, Homo sapiens
cccttccctaaacagaattctctacctgttaccatatctagagtgtagggctcagggaagacagtaaaggacacagactctgagaaatgaacatgaactagggcttagatgaataaatggagctacaacaatagttatattttagtgcaacttctgaaaattaaactaaaggatccacgggtgtggaagacacaataccagggtgtgagtcaggggatgagtgctcaagaatgttctgtgtttcccaaatccactatatgaatggcacgaccactttcccaggcaactcagtctaaaacactagttagttctaacttctcacctccacgcagtcacttcctaatcccacctctacggcctcttttattatgcctctcttttcccctcgccttccccttgtcaagctttcctccctgccacactctagttcctcctcagcacctccaagccagctgattgcaacaggctcctaacagagcttctgacctccagaatgagcaacacaagccaaaagatctaggtccaattctcgtcccaacactcactaatttgatcaatttgtataaaaaaatcatttatctctctgagcctattttatttctctgtgaaacaggaaaataaaagatacttcaaccagg

SEQ ID NO: 207598 - DNA, 236 bp, Homo sapiens
atttaaattttgataggtattgcattgaatttgtagatctgctttgtagtataaatgttttagaaatattaattcttctaatccattaacatgaaatatcttcctacatatttgtgtctttaatttctgtattagtccattctcatgctgctaataaagacatacaaaagcctgggtaatttataaagtaaagatgtttaattgattcacaattccacatgactggggaggcctca

SEQ ID NO: 207599 - DNA, 239 bp, Homo sapiens
tctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcacta

SEQ ID NO: 207600 - DNA, 572 bp, Homo sapiens
cataccacattgaatttctatgatctctcatatgttgtgtcccgtgatgtgaaaagcactgcctaaaggagtgaagttatcaggaggttcagacatcagttagcaggttatataggagagttctaagtataatttctaagtagaatttaaccagtactgtccctagaactcagctgcttcttcctaacactctcaggtcacactatgccacaataaggccaaacaagtgggcactctacatatttataaaactgtcacctcagacatcttatatctcttacctaagactaagctctaaatcactttaatacattttcaaataaccatattacctaaccctgagccatatacatcatttccgtttctggttttgagagaagtagagtcacataggtctgcactcctgctccatgccttcttctccgattaaattttctcattcaataagcagcaccactgtcccctctattatccaaatcaacaaatatagatgttatccttaactcttctctttccttcaccttcaactactaattgattaccaaaccagttgattttacctcctaaatgtc

SEQ ID NO: 207601 - DNA, 586 bp, Homo sapiens
tttcactataagaaaaaaaagcatttttgtttcagcatataaaagaccatgtcaagtatctcactctagtttggagtgactgaaatagtatggggaatctccccaatgaagtcaatcagtaaacacgctgatctttctaataactattactttagaattcaattttctgttacaagttattcattatattaaagtaccttaacacttctaacacttcgagctggataattttttgttatgggagattatcctgtgcactgtaagatatttagcagcatctctaatttctacctactaggtgccagtagcacaccccaaggtgataaccaaaaatgtctctacacattggcaaatgttacctggggatggggctggagggatataaaattgccccagttgagaaatactacacagaacaataattccaggaaaaggatagaatcatccagatgattatttttaaaagcaaacttttaacctaccaactatagaacaatttatattccataaatgcttcttagttaacatagcagctaagcctttgatggttcaccttctggatatttaccttatcatctaatctatt

SEQ ID NO: 207602 - DNA, 565 bp, Homo sapiens
caccatgtttgtcagactggtctcgaactcctgacctcgtgatccaccggcctcggcctcccacagtgctggatgacaggcgtgagcccccgcgcccggtccgtgcatttacagcacaagttcacgcttatctacaaagcatccacctctcaccgcaccttccgggaccacgggatttaacgcctcaccgcccgatgacagcacgaggtggaaagggcagcgacaatgctcgcgcgtcccctcccggcgatccggagcacggcagccccggagcgcgcggccactcctcgctcccctcaggagctcgtaagagccccgcgcggggccgaggcgcgagagcacgcgcaacgcttcctgggaaatgtagttgggtgtcggattagaactacaaatcccggtactcaccgcgctgcagccccgaccgtgagggcgctttctggtgaatctgaatctcgtttgtctgtgacatggggaaagctgtccaagcccaattccattttcacaagaggctttctttttggaaacatgatagcggtctcgctggtgtgcgcaccaggagcgttgc

SEQ ID NO: 207603 - DNA, 468 bp, Homo sapiens
tgtatccctgccacactggctgccaagattggagatcataaaatttcctgaccacttctcagcctaacacagggctctcaaccttgaaatcccatggaaactttgcaaagctgtggaagcccaggtcccatgcccagagattcacaggttcacatctaattcatctggggtgaggcctgagctttcagaaaattccccaggtgattttttttttttaagacgtagtctccagcctgggcaacagagcgagactccatctcaaaaaaaaaaaaaatgttggaagagggtgtgcttgtttatgtacaaaatgtcgctagatttaaacacaataaactggcaaagatggttgtctctggggagaattggggacttgggaacaggagctgaagaacaacttttcagtgttgtgtttggaaccatgtgaatgtattatgtattcaaaatgtaaataaaaatgaagttaaagag

SEQ ID NO: 207604 - DNA, 482 bp, Homo sapiens
gggagaaccacttgagcctgagaggtcaaagttgcagtgagccatgatcacgccactgcactccagcctgggtgacagagtgagaccctgtctccaaaaacaaaacaaaacaaaaatatgtctataggtcagtcctcctaaggcggggggtgaatacatacatacggcatccttgtgcgcacaaacacagggtgcacatgcaggcccctccctcccacgcatgtgcccacaggttcataggcatcagcatctctagagccagccccctccactccctcccgaccctgctctgtagaattcctatacaaggttcttgtggatttgtatcatcccttgcacctctcacgtgtcgcaggacagaacactcggcatcctgggggcttccttatcccacagccccaaattccgggaacagcatggatgtgggagggggcatggaatccagacctggattcttgtcccggacctacccctcacccttg

SEQ ID NO: 207605 - DNA, 1350 bp, Homo sapiens
atgttttttattttttgagacgtagtctcgttctctcgcccaggctggagtgaagtggcgcgatcttggctcactgcaagttccgcctcccgggttcacgccattttcctgcctcagcctcccaagtagctggggctacaggcgcctgccaccatgcccggctaattttttgtatttttagtagagacggggtttcaccgtgttagccaggatggtctggatctcccgacctcgtgatccgcccgcctcggcctcctaaagtgctgggattacaggcgtgaaccaccacgcccggccaaggtctaactcagtttgaaggcctttgttctgccatttggaaattctctatttcttaggtaataccatctcctaaaaaattctttttaaaacttccatgattcagatggtgctctgttttctcaggggattctcaactttcttgaattctgaatttttctttctcatgttttaaaaacattctcaactgattttttttaaaaataacattccgttgtttgatgttctgtgattttatttttctctagaattactttattttggtcttgttctttactcggattcttcttgtcgtatttctggttgttttttgtttttttgtttttgagatggagtcttgctctcttgtccaggctggagtgcagtggcgctatctcggctcactgcaacctccgcctcccaggtccaagcagcccttctgcctcagcctccagaggaactgggactataggcacgtgccaccacgcctgtctgattttttgtatttttagcagagacggggtttcaccttgttagccaggatggtcttgatctcctgacctcgtgatctgcctgccttgacctcccaaagtgctgggattacaggcatgagccaccgtgcctggcttatggcttagtttttaaattatcctccaaaaatttgggcctttttctgtggggaaacaagtgaagctgctcttcagcatagacactacctttatcccatcattttagtaaaaactaggttggtttcacttctgaggtgtcttattaaatgtacttcatctgagaatttggtgatctttaatgttcgagctaatattagaactggccattagacaaacatgggatactacatgattctatccagtattccctgtgcaatattgtacacactggatctaatggattttttgaactggaccggggggtttggagtacccattaaatatctcgcggattcgcttattgtaactccgaccgcttaagggcatccagcccgtttgtcggaggagcaacaaccgtcaccctccctcagagcctgcacccaggaccccaactgctcgtcaaaac

SEQ ID NO: 207606 - DNA, 491 bp, Homo sapiens
cagtatcatgaacctctacatatccatcacatgcaacttctttttaattcgcttaaatttaaaaatagatacgtgaaataaagcatttggggcagaagttcattgcaaaatcaaatgatagaatttcacagctcctaggcaatcaaatactccccttgtgccataaggagatttaggccttttatttccttttcttttacaatttgttttctttgctatcattcatatgtagagttctcctgcagtatgtagaaggtggacattgtcattttcaaaaatggagtaattatggcctatctacctgactgtgcagctatcaataataattattattataaaggccatataacagggaaaagcattattgattagtgttaataaacggtataaattgtacataaacagtgatgtctactgtgtgaacatatactagatatgcatgtaaacaaaaactagaggtaaattgaaaaaataaaatcagtttttgcatc

SEQ ID NO: 207607 - DNA, 410 bp, Homo sapiens
gcatatctctagacctgtggttatcaaaagagcgtgtgttagaatcaccggacagacttatgaacaaacgaaatgctgggccccatctccagtgttctgactctgtaggtctggagtggggctgaagatttgcctttccaacgagttccaagtgatgctgaggctgcttctctggggactatattttgagaactactgaactaccattctaggagggtgggaaaatgggttttcatcttggagcacaaattatttgcatgaatttaagcaagtcatgaatattctattcttcagtttcttcatctgataaataagatcaataataccagttcagcctactttgttgagttcttgggaggagccagtagaataatgtataagaaagtgcttttgaaaattaaaagaaacac

SEQ ID NO: 207608 - DNA, 368 bp, Homo sapiens
tgcactgaaataataactgcattagtaacaataactggattgaaagacatcaaattaatttgatgtctcatatgttatgtgatatatctttcacagtgatacttttaaaacatcattggccacctttggaagatgctagggagccaactcattgttttgaaactggtaaatttaaaaaaagaatcaaacatttgtcctgcctttcctatatgaattcaagataaccaaatggttgatgagaaatttctctgtataggaatattctggctaataaaatgaagaaggaatgagagaattggacaatcaacgttttgcaacctctaatgcaatcaagaacctgagcaatggtcactagcagctgtggatat

SEQ ID NO: 207609 - DNA, 348 bp, Homo sapiens
aagccatgccatggaatgctggcagccaccagagggagaagcaaggaatgaatccccctgagatcctccagagggagcgtggacctgccaacactttgattttggacctctggcctccagaacggctagagaataaatatctgtttatttaagccaccaaagtttgtgactgctcatcaagttggcctcaggaatctaagacaccctgctgcttactgtgtgtcattttttctgggagtcccagctcatgtggatctaggctttggagattatgcctgtctgaactcctgcagcaggtttgtgtgaatctcccatttgacaatttacaaattttcaaccttgtggtat

SEQ ID NO: 207610 - DNA, 280 bp, Homo sapiens
gtgattctgaatttaggaatcgctgtgtaaacagacttcatgagggctaggactttgtcctattcaccactgtagtcgaagtgcccatcaccaactgaattttgataatgtattgttaattgggggatatctgtgtactcctacctgaatgaccaagtaaataatatgaaacaaacctgcacacaatataattcagcatgctcatgaagctgtgaatattcttgtttattccgatttgagtatgaaacaaagtcatcaactcccataaaggaagtagaaa

SEQ ID NO: 207611 - DNA, 308 bp, Homo sapiens
tacaaagtaattacttataactatcttgtattaggcacacttctaagtgctgtgaacaatacaagttgattaagactttagaagtgtgcctaatacaaagtaattacttataactatcttgtgattttaactatatgtctactgatattagaaaatcccaagcagtgttctttctcatgtggaagagaaacaaaagtgaacttctcagcctcagaatacaaatattgacatagttaaccaactaacctagtttatctacctaagttacaatacacatgctgttccaagctcatatttcttatgaacta

SEQ ID NO: 207612 - DNA, 355 bp, Homo sapiens
ctttgggcatttacattaagctgcagcatcacaaaaatgaagctgaaaatgatctgcctttttttctaacagaacacaaatcatatattgaaattttgcctaatagttttcaacctcaagagtatgggatgcatttctagaaaattatttgccatatagtttgttccatgcaggaaaatagaggggacttgaagtcacagccatttttcactgccacctgtgattatactacatgatttacatttcctatttttgttggaaataaaatagtttcctattaggactggaggtagatggatttaagtagcccagtttcctggcaaaggccaggatattgggagtgtttgacttaggc

SEQ ID NO: 207613 - DNA, 344 bp, Homo sapiens
ctgcctttccccttttcccaagctattttttagcatgagtgaagtattttataaggatgctcatttccaagactctcccttatgatctgacagaacacctcctgttcctgacataaacctctagggtagcactgtgtaatagaatttctgtgatgatgaaaatgttctgtacttgtgcttttcactgctgtagctctactagctatatacatggctatagagcactttaaatgtggctaatgcagctaaagaactgaattttttctttttttttttttatgagacagagtctcactctgtcacctaggctggagtgcagtggcacgatctcagctctctgcaac

SEQ ID NO: 207614 - DNA, 449 bp, Homo sapiens
agtgccccttaacagagaaggtcttactcaagaatattgtgtttttccctgcccctattatagactggtatgtctgcaattcaactgctgaatatttgatttttttctttgtccatgaaatgaaaacacaatacccttgacaagaacaatagtacattacattgttttgataaaatatcattgttttctctatattcaagagtggaaaatatatgtaattttttataaagggtattatacagtggcacaagcactaaactaagcaactctgggttctagtctctacttggccacttttaaactagtgttaatttaactctaaagttgtacatgcacacaacccgcatattccaagagcttgttaggtacaaggcttgttacaaagaccagcagtctccccgctgtcactcctgccccatcccttgctctctgagctcaactcttagagc

SEQ ID NO: 207615 - DNA, 871 bp, Homo sapiens
tcttgattggtatcttctagttttcatagaaagatcctcaatcaagatcattctggaatgtgcagaaataaaaagaaatgggatggcaaaacgcagagaaagcaaggcaaatgaaagctacaaacctctcccttagataatgtacattccagaatgatcttgattgaggatctttctatgaaaactagaagtattcccaagaatgctttaattttgttaaatatcagggcgtaggttataatattgtatcactctgggacggacagggttaggctttggagtagaaagaccctagcctcaatcctgcacttactctgccacttactgttctgaaccttgagaaaatgacttaatctctcagagattcagtttacactgaaactcagttttacacatctgaaaaaagaggactattaatatctgcaacagatttaaggactaacaaatatgaagtatataaagcacctatgttatctactttactggatacataagtgttcagtgaatgggaaccatttaaaagcttacaaaaagcaggaacagtaattgaagatatcagtctatagagtaaccactatgtttattcattatttgttactctaatacttgcataagaacgtatatgtgcattcatgcgtgtatacatattggccatcattaccttttgtctgttgtgtataatacagattcttgttcttctgtgtcatcaccaacatgtaatattgtcagaatttttattttttgtcagtttattggttttaaaactcttatcttgtgttcactttgcattccttgcaggttgaggatgttttgttttctggtcttagtctcattcttccttctttttcctgttggtcttgttcttttcttt

SEQ ID NO: 207616 - DNA, 897 bp, Homo sapiens
tgagaggccatggatcctgagcctaaccaggaccacagaaatagggtgcgagagaggtgacagctgccagaaatacacaagaggcaaaagtggcaagatctggtgattggttggatgttggggggacaatgcagtgggagaaacttaggtggatggtgattttgcagcaaaaatgaggaataaaagccagtttggggaataaagggagtttatgaattcagtttttgacatactgatttggggaagcttatggaatatacaaatgtgttcagcagacagttgagtctataaagctcagggagatgcaatacacaaatgtttgggagtcaacagcatggaggccgttaagatcacagagagtaggtaaagacgaaaaagcaagtgtcaaggggagaaccgtgagcaacatcatcatgaatgtggtgggcagaggagccaaggcaagagatgggaaagtcactcttcagcatcttccccccactcccactgagtgttccaactcaatagagatggaaagggctataaatatgtcagtcacatattctgaatcaaggatccacaatctggctccaaggtatgagaaagtataacagtggggccaaatatttaaaatcaagaccatctcagaaaatgtggccatgtcaactgtaaaggcatatgcaaattgctaccagaagctgcccagaacagaggacatgtgactcaggacttgcatgggaggaggaggaggagggaaccacaattcttgtgagagaaacacgtgcacaaagacacaggacaggaaagctccatatggcacaccatttagaattaatcagtgatttcagattgatgtgaccattggaagatttcaagtatgcatcactaaacttgaaaaattagtaaaacaggaataat

SEQ ID NO: 207617 - DNA, 1026 bp, Homo sapiens
tgagtctttcctaaagagtatgataaatgtttctttcagcggacttgagagatcaagagattttttttctttttttgctttatttatttatttatttatttattttttgagacggagtctcactcactctgtcacccaggctagagtgcagtggcacaatcttggcttactgcaacctccacctcgggttcaagtgattctcctgcctcaacttcccaagtagctgggactacagacacacaccatcacacccagctaatttttgtatttctagtagggatgggctttcactgtgttggccaggctggtctcgaactcacgacctcaggtgatccacctgtcttggcctcccaaagtgctgggtttacaggtgtgagccactgcgcctggcggagatcaagagattaacatgaacatttttaaatgagcattacaggtgtatattcaagtttactacattgtaaatagacttcctttaatttgatctctctgttgtcgtgagccaaaagaaggttgtctagtccaaaagaaggtctcgccccaatttgtgatttagatttactaggtctgcagtgtatatgttacaggggattattaatggaaaagaattgggccagcacaagacagttaaaaccacccatttgtgagtcaaagaggaaaaaggtcatcttaggctattaatggtgaaaccactagatttgtatggatgatacaaaaatattcacatagaaatagctagtatagtcatttattcctcatcatttcaagtattattctgtatggaaacagacaaaaggcactgatttctgtctcccagtactgaattttggtttagttccagtggttttcatatttctaatatcttataagaaatcccagtttaggccgggcgctgtgactcacgcctgtaatcccaacactttgggaggctgaggtgagtggatcgcctgaggttgggagtttgagaccagcctggccagcatggtgaaaccctgtctatactaaaaatacaaaaaaattacatgg

SEQ ID NO: 207618 - DNA, 360 bp, Homo sapiens
taacatccatgcacccaccatccagcttaagacaaatcctcacccaaagacttggagctccatgtggtctttgccccagagctaactattgcaccaaattttggatttatcacttccatgtactttgtggttataacagtcacgatcacaagcaatatgtatttcttttgcctcttttagctttatacagtggaagcattctatattaatacttctgtgacttgcttcttttgctcaaattacgttagtgagatgcatcaatgtcgcgccatgtaaactgagttcattcatttcactgatgcatgtgaataagtcacattagattgatctattcttttgtcataggacatttggatgttt

SEQ ID NO: 207619 - DNA, 458 bp, Homo sapiens
tccttaaagaatcctgcaaagtagatactattttacagaaaaggagactgaggtaaaaagagttaagtcacttgtttaaaatacaaggctagtaagtgatggggacacaatttcaaccacctggttctaaacaaagtccattcaatgaactaacactctactgcctccttttacctgtgagagatcctatccactatcctgtttgccctgacatcctgaagtcattgatttacctttcttcctttatgaccttatttacagcagctggttctggattttacccaaatctggatgcagtaactgctttctataaaaagtgagaagcagaaaatctctatagatttatacataattacaggggtctatatacgggacattgtcacaggggatgtgacaaccaaagtgaagagagatgtgaagatgtgaggctgctggctttaaagagaccatgagtaaag

SEQ ID NO: 207620 - DNA, 346 bp, Homo sapiens
cacctgacagtctacagaacctccatccaccatcatatccactgatgcaggccagacagatgtctactctacataggaaacagaggcaaatcaggcctttcagtttagtctctgagctgccagttgtccctgtaactcaccagggagtcataaagcagaaaatgctccaaccaccaggtgggctgttcagcctgaggccaggtccctgtaagctgaccctccctcgtctaggtgatgagaaaagtcctaagatgcaggaacctggctgtcctggagacaaacttttgattccagaaatgtcccagaacttaaagcaatgcctaggcctgcctcaccagcccaagtt

SEQ ID NO: 207621 - DNA, 339 bp, Homo sapiens
tatgatgttcacacaatgaccaatctgcctaacgatccatttctcagaatgtatccctctcgttaaaggacacatgtctgtatggacatcattgtccttagactttggaaaactacacataatggaccttggaatacaggtatgatattggccaaacgcggtggctcaagcctgtaatcccagcactttgggaggctaaggtaggtggatcacttgaggtataggagctggagaccagcctgaccaacatggtgaaaccctatctcaactaaaaatacaaaaaaattagccaggcatggtggcgtgtgcctgtaatcccagctacttgggaggctgagg

SEQ ID NO: 207622 - DNA, 291 bp, Homo sapiens
attctaaggaaatgaccagggattcagacaaagatttaatgcatgaggttgatcatttacagcattgttgatgggagggaaaaaaaaaaagggaaatgctcgtttttttttttttttttattttgagtcagagtctccctctgttgtccaggctggagtgcagtggcgcgatctcagcccactgcaacctccgcctcccgggctcaagtgattctcctgcctcagcttcccaagtagctcgaccggggattacaggcttgcgccaccgcgctgggccctgccttcagggtg

SEQ ID NO: 207623 - DNA, 295 bp, Homo sapiens
ccagatgcccttctctctacatctgcctggcaagcccatctcggacccagcgtggctttctcatccactctgaggccttctttgctccctgcagacacagctgagctccctttcctccaggcccccaccgtgcacactcctgaaaacatagctgcaaatttgattgtgccaaagcggaaggaaagatgggcgtgctatgagggaggcacgaaggtaaaatccttagtgccagctctctgttgagcacagccttagacgatggagctctggtatttcgcacaaggttttgctttat

SEQ ID NO: 207624 - DNA, 317 bp, Homo sapiens
ggcaggtctactggtgatgaattcctgcagcttttatttacctgggaaaatcttaatttctccttttttttgcagtggcgggggctcagctggagtttcactcttgtgacccacgctggagtgcaatggcatgattttggctcaccgcaacctccacctttcaggttcaagcaattctcctgcctcagcctcctgagtagctgggattacaggtgtgcaccaccacacccagctaatttttgtatttttagtagagatagggtttcaccatgttggccaggctggtctcaaactcctgacctcaagtgatccgccca

SEQ ID NO: 207625 - DNA, 155 bp, Homo sapiens
tcagttttcacagttcaccggctgccatctgcacccaggtcgtgtttagaaacccttgactttatgctttattgactccactgggacaaaaactaaagtatcaaacaccagtgggagcatttttcagaggtaaacagtggtaacattttacacat

SEQ ID NO: 207626 - DNA, 476 bp, Homo sapiens
ttatggggctggtgagtccaagtggacatttcatagatacatctccagaatatcagggcttggaagtgaccttagaccctgccagctgttcccaccttgtctctctactgaagatccctgttacaggttctcctcactttcacagcctggacatttcccagagttcttcatggaagcaccttaatgagtgttccatggataaagaataccaacgcctgtaatcccagcactttaggaggccaaggcaggcagatcacctgaggttaggagttcgagaccagcctggccaacatggcgaaatcccatctctactaaaaacacgaaaattagcggggcgtggtggcaggcacctgtaatcccagcaacttgggaggctgaggcaggagaattgcttgaacccaggaggcagaggttgcagtgagccgagattacaccattgcattccacctgggtgacagagtgagactccatctcaa

SEQ ID NO: 207627 - DNA, 219 bp, Homo sapiens
tagaagcattgcaatttgtgcttgatatgtttccaaatgactaagatgagtatgtttgatcaactactatttttgaggtgatattttctttaaaaatatgctcattcctaacctggaaaataggtaccttttttagaaaagtgtcgatattttggctgcatttcaaaactgggcaggagattaccagtgttcaatctaccagtcatctttcttcaaact

SEQ ID NO: 207628 - DNA, 169 bp, Homo sapiens
agttttaaaaagatgcatgttctagtcacctcccttttgtctcttcggattcatttgtttattgaatgtgtattatgtgctgccctctgtgctcgttttgtgtaaatctcacagccagccccaatagggatgaggaaacggaggctcaagatgtggcagttgattaccc

SEQ ID NO: 207629 - DNA, 321 bp, Homo sapiens
tttgtctttattcacaaaggtaatttcaagagctcttgtgggttccacttctggcatcccgctcctcagatacctactattaggcaagagcagagaagtaaagtgcatttggcagcagtctctgcctttcaaagcagagctaaatcatgtaaaataggttattttccatccaggcattctcttgagaaagaaaaccctgtgtgtgtcttcccccatactctcacttcttgccagttcagttgaaaagtgttcccttaatgttattaaataggtattttcactcactgaagtggattatttgatttctgcacggtcttaaga

SEQ ID NO: 207630 - DNA, 353 bp, Homo sapiens
acagaacctgggtagtggatcttgctctactagctttatgagctttgatctgttttcacctgtctgggccttggtttcctcgtctgtaaaatgggtataatcaaaccattcgggatcattcaagataagtatgataaggcaactagagcacctaggacgttccctgtacctgagcacctgccaccaaatggaggtattaaatgagttcaagtgacatgctgtgtgcagcacagactcaggacctggcttttgcctctcaagacagaagcttcctccctctcctcctgcccagttaaagacttcgcccagcagggcaatgaaacggggaggggagtcagacagggatgaggtgt

SEQ ID NO: 207631 - DNA, 615 bp, Homo sapiens
aataaaaggaagatagaagatatgatctctcttctcaagaagcttataatcaatccatttaaagatataaaacaagtatttagctagattccaattcagctaaatttacagaatgcctacttcatgacaggaactacgactgatgttctcacatacaccactcatttaattaatcttaaaataacagtgcaaaaacatggagcctggaaagaagtaaaagagagaataaaaagatcttactagaaaagtcctgtgagaagcagtaatacaaaagtcacaaaagtgctaatcttttttccctcttacattttagcagttaatatctgtagtttcataggtataacacaatagcattaaaaagcaaattggtgaatatatttcttttttcaaaagctataattggggatatttcattggagaaaagaatgaaaaaagtagtcaatatgaggtctgtgaattatatgtggatgcccttgttactacagacaaatgaaaagtgggaatgcattgctttatgcttctctcaagtctcacatttctggcttacatctaaaataggtaaactgtatccttttaataataaaattaatatatcatttatcaatatgtgtctta

SEQ ID NO: 207632 - DNA, 369 bp, Homo sapiens
tgctgagattacaggtgtgatcaccgcacccagtctgcttttgggagtttaaattgaagcaaagttttggcaaatagttgccattctctactaaggttaaagattcacacaccctattcacaagtggagaaattctgatgtgggaaaatgccatcaaggcaggtgtacatgcatatgctgtggaccaggatgtatacaagaatgtgtagagaagcagtgtttgtaatagccccaagctggaaccaaaccaaatgctggcctgtcatagaaagcataagaattagagccacttaacaacagcatggttggagttaataaatataatgttgaagaaaagaagcaagacacaaatactcagagtcagggtcc

SEQ ID NO: 207633 - DNA, 338 bp, Homo sapiens
tgagcccttgagcttcagtttcttctgaaaggtgggcagtacttagcacttaggtttaaaggattcagctggttaatgtgaaacattcagctccagtattatgtctcaaagtcactgtgtcagtgaaccggcatccctcatcgtggaaagactgtcttaaacgagtgctttattctgtccgtacgtcttccacttgtgaattacaactgcaaaaatgtatctttctatagtaaggttgaagtgaagtgaagctatttccccgcttcggattctttggtctttccggagctgccaggggtctgtgaccccatttggtaaggactcagtgccgcacactg

SEQ ID NO: 207634 - DNA, 388 bp, Homo sapiens
gccaacgtgatgcaggcagaggtgtgaaaagagcattcaccttaggacttgccccttcctcctgctctttggacccccaagaccaccaaaaaagaggcttgggctagcccctgggagaatgagagatgacatatcatgaagataccagtcccagctcaggtccttggaccaaccaacctgccaaagctagaaatgtgagtgctgccacaacacgagggcatcctgagtcggcctagctgtaggctgacctcaagacctaccacctggtctagaccgaaggatcagacccaaggtcccttagaattacgagaaatagcaagtgtttcttgtttcaagccattaaattttagagtaatctgttatacagccaaggctaacaaatatattt

SEQ ID NO: 207635 - DNA, 517 bp, Homo sapiens
gtatgaggggatagatgccagtgagctcttctaagagggatatttcttcgacttctgggcattcctcatgcttctcttaaaatgcctgtaacagaagaaagaatgcttggagctgctttggagatttctgttgtctatccctcagccaaccagactgaatagtcctgccgtacagcatcctgtgtatttgaaacttgtcacccttaataaatactgatttctgaagtatctgagactatagtttgtttacttcaggtagttcctcagaagggcaaccctcagtgagagattatacaaacgccgagtcagaattttttggggggcaagaagaagactctttctattaacctccagcctttgcaaaaattgttagtgtcctaacacaagtaattgtagtagcgagaggactcttggcctaataattcaagtcaaatgagaaaataaaatggaagtcttcaggaaaatagaggacttgttattttatagaatttcaataaaatatctagaagtcttcact

SEQ ID NO: 207636 - DNA, 1043 bp, Homo sapiens
gaagaaaagagtttcccatacgtggaaaatttctgaacagagacaagttaaaagtgtggttcagtggagagaagggggaaagatttcccggctgacaatgatagaacactgctttctagcccttacctaggattagagaataaagtacctatcaggtaacaaatctcttagagatgtgtgtctctacctttaatgtataatacctatgcctggagatctggataaaatacagattatgattcaagggtctgggtgaggcttggattctgcatttctaacaagctcccaggaatgctgctggtccatgaaccacactttgagtagcaattctagaggttagggaagactcctgtgtagcaaagatgtttaggctgagagctgaaggatgagaaaaatgtgactaagaagctttttaggtgcaggaaccagcttgttcaaaggcctcgtggcgctgggaaccctagaagaaggtctgtggctggagtgcagagagtttggggaaagaagtgagatggaactacagacagcatgtgaccaggcatgtagaaccatgtatgaggtatctagatttttaatattcactttgacagtgaggagacaccactgaaggctggttagcaggaaagatacatgatcagatctgtattttgaaaagatcattctatctgactataaatgacatatgggtgataaggaggtataaacaaagcggacgctgaacaccagttaggaattagggagctaaagtggtctttgcaacaggtagcttgactaataatggtagagatggagagatgtgggatgtctgagaatatataggaagtaaaatgggcagaattttgtaaagaattcaacatggataaggaagagaaagctctaaaggctgttgcctgagcatttggccacaatgcgatgttgagggtgccattcgctgcagaaaaaagcagtggaagccaaccaagttatgggggaaaagcaaaaatttcgtcttgaacatattgagtttgaggtccctgtgagtcatccaaggtgaaggtcaaata

SEQ ID NO: 207637 - DNA, 414 bp, Homo sapiens
aacagccggaccgctcgcgttagttgtgcagaaatgtaagagccgctattcataacagccaaaaggtggaaacgactcaaatgcccatcagctgatgaatggataagcaaaatgtgatctaaccatacagtgaaatattcttcagccatgaaaaagaatgaagcactgatacctattgctacatggataaaacctgaaaacatcaagctaagtaaaagaagccaatcaaaaaaggccacatttatatgagtccagttatgcaaactgttcagaataggcaaactcatagagacagaaaccggtgagaggttaccagaggctgggggaagggaggactggggaatgactgcttaatgggtacagtttccttttctatgtaatgaaaatactctgaaattagatagcagtaatggt

SEQ ID NO: 207638 - DNA, 621 bp, Homo sapiens
  misc_feature (1)..(1): n is a, c, g, or t
  misc_feature (54)..(54): n is a, c, g, or t
  misc_feature (178)..(178): n is a, c, g, or t
naaggcatgtgcagcctgtccctcaatacccagttttgcacaggaagatgctgntgctgccctgactgggatgagggtaaagggtgacgggtgtggccctggatgtggtggttttcccttggccattagcccatcttcaatgaccccttaatctgcagcagctcacaggctgggggtnaggagtccctggcttctcttagcctgagcctttctcccaagttccagagcctctccgggcctcagtgctgccatctgtacaatggtggagtgagtacgctgtaaaggaccttccattcattttgctgaattccagagtccttttggaaaactgactttagtctgctgggctgtattgacctctggcaggctcgaagcctcactgggtatgcagtcaacaggatgggcctggagatccgtgaactgcaggccacgtacccatgacgtaaacggcggcactggagcaagctggggcggggggtgggtaaaccctcactgccagcaggccccaagtggcttgtaaatcattctcctgtgatgtctgtgggcctgcgtggggacaacaggggcacatgacatctgcctgggccctgaccaataaaccctcagacccaggacccagga

SEQ ID NO: 207639 - DNA, 632 bp, Homo sapiens
agaaatcttagtcatcatcatctctaacattacctatattgcttagccacagcactcatagaataaatatttactgaattcttgacaatgtttattttctctacatctatatgtgccaggaacaagtaaatcaaccagaattttaaattatacttcagtcttaattagcctccagtaaaatgagaaagtatatttataaataggacattcctcaatagtgctacacttctgtggaactttcttcctgtacacttgagctgttttaagtactactccgttttcagttaacagtttccattttaaaatcactgggggtttttttgaaaatagaatgaacacagttctcttttggtgaggacccaagaacaagtgtcaacacaaaccagcagctaggcactagaagaaaaaaacttaaccagtcccaccgcacatttaaatcccttggtctccagagacattaagaagctgctctatcctaggcaagacagaacagttttactgaatcagaattttagtacatctgcctcaatgaggtctttgatagaaagtaatttaaaacaaagtttcatcttgtatgtttcattgacttgttcatctccccgatatatatcgctaatgttagagaacaatgc

SEQ ID NO: 207640 - DNA, 571 bp, Homo sapiens
cacccatccctgtattctcttagctccaaaccacagaaggtaaaatcctcgtgagtgcaaccaggggatcataggttcccatcctccacccaccgcctattcatatagtagagactctactccaggtgccacaagttgagaatattagagccttgattgcccttatcccagctcattcatacggcagagattccacaccaagctcccacttccactcagtgtctgactcataaagtaggggtgtcattctgagataaatgggccgctttccctgcctacctctctacaacaggagctcagatattttgcccagcggggagagataatccaaaagaacagagttctaaagctgtccccacaggaacgaactttatttgaaatagagtgtgtgaaaggacagcctaagattgctctcaagaacaatggagaatttagtggtaagcaactaaaaggattctggtaactccattagagcaacaaatgaacccataatgcagctagtttaccaggaaaaaacagaaaacaaacaaacaaacaaaacaagaaagagacagctaagagcagcccttct

SEQ ID NO: 207641 - DNA, 505 bp, Homo sapiens
catttaataaatctggattaattttaataaagtagacaaattacctaaaggttagaccattagagaatcagtgtaacaatcaaaaaggataaagacagaggagaagccttacaactacattttaatcttttggttttcctgaattttgaattttaacaaatgtctctcaaatgtctgggtattcttctacatacactgtagcaacaaaagaagccatcttcaactatgaaaagttgaacaggatgtcacagaatttcatagtttaaaagtctgaggtctagattcagatccttgctctaatacttaagctacttagctacttagtaagctatgcgacacctcaagtcactttacttctgcgattcagattcttcattgatacctaaaccttattaagtttactacaagaattaaacaattcaatacaagtgtagttgcttgaaatgtactcaaatccatccattaattttgttcagggcactaggcctatttttgcttggttgca

SEQ ID NO: 207642 - DNA, 295 bp, Homo sapiens
tacctcctttcatccttccatattctcccttttggaatggcactgtctatagccattatcctatggctgtcctgccattgcatttggggtgcagagtacttgttttctagtttcacagatccaaaaatggagaagaattttgtcccaggattgatcacacccaaagtctcacccataactgattagatgatgacattgggacatgtgagttgctgatcttcagctctgattttggacttgaattgttttgcagggttgagacttttggggatgggggaatgaggtgaatgtattt

SEQ ID NO: 207643 - DNA, 566 bp, Homo sapiens
caggcattcatatcaagaacagaaagtgatttcttcttgcatcatcctctaccacccaaatgcccacattgtttccatattttttctaacatatatcattctcccagtttcaaaacaaaacaaaatgagaaatataacttctgatgtctagagctataccatccaaaatggtagccttagccatatgtggccatttaaatttaaggtgattaaaaaaattaaaaattagccaggcatggtggcatactcctgtaatcctagctactgggcaggctgaggtgggagggttgcttgagcctgggaagtcaaggttgtagtgagctgtgattgtaccaccgtactccagcctgggcaaaagagcgagaccctataaaataaaaaatcaggtctttcaaatcagaggttgaaaacggctctgcatttatatctttctttagaaatattttattaatctgaaatattactgacaaaactaggaggaatttagaaaactatacctctactaatcttttttctcttcttttgattttttttttttttcccttaagacagggtctctctctgtc

SEQ ID NO: 207644 - DNA, 228 bp, Homo sapiens
taacatttcgacctgttaaataaaatgggaagccacacttcataccaataaaagtagatactgaataaattaaaagtttgatgagaaacaggatatttacacagtttcaaagtactctcccacaaaatacatattattaattaccattattacatacatgtgatacaggttcattctgcccgcatgccataaatccatcactgtgacaggttttgtaaaagagaaaag

SEQ ID NO: 207645 - DNA, 428 bp, Homo sapiens
gctggttaccctgtggaaaacttcacaaccccttctcttccaggtaggtgccttccttttctatgtgcagccactggctgtctctgagacatattttctgggttttcccacaccagcttgctgcttttgctgtgtctacagacccctctactccctacccactcctaatctaccctcccttgcagtgtaatctgggagtggctgcagatgtgacgtgggatgcagtcctcacatgccatataaagagaagacccaacagtaacacccttgagccaaaatttcagtctctcactcaagaaaagaattttcaatgtgtctcctggttaatgtgaaaattggagtaatggactcagcttctggttcattcttggtgccctggccaaaactttccctctatgtgatttaggatttctggaagatggggccaa

SEQ ID NO: 207646 - DNA, 441 bp, Homo sapiens
tgattcttgcctcataaaattcttgtgaccaataaatgaaattctacacatttttatgtgtctaaaatcccaagactagtatctgacacatggttagctctcaatatattttagctactgctattatcattattggtagtactattaaacattttgaaacagaaaatcacttggggctggtcacggtggcacacgcctgtaatcctagcatgtggagaggccgaggcaggtggatcactggagctcaggagttcaagaccagcctgaccaaatggtaaaatcctgtctctaccaaaaaaatacaaaacttagatgggcgtgatggcatgcccctgtagtcccagctactcaacagggtggggtaaaaggattgcttgaacctgggaagttgctgcagtgagctgagatcacactactgcactccagcctggatgacagagc

SEQ ID NO: 207647 - DNA, 375 bp, Homo sapiens
gccagtagcatccccactacccccttgtcacaatttaaaaagtctccagacattgccaaatatctcctgggcaaaattatcactgctctaaactttttgaagtgcacatattaccatgtcatgcctcctcctttcccccattgagagtgactgaatgatagtgtcaaccattttaatgtgtcacacaagactgaccttttcccacttttcctgccatgtcctcacctgcactttgtgctctagcttagtacaactctttggcagttcttagaatcagccatgttggttttcatccttttgtctcctcacatgttttatttctccctggaatgcccctctgttttctgtacgttgtacaaatatctgtttatcctt

SEQ ID NO: 207648 - DNA, 329 bp, Homo sapiens
ttttaaaaatcggttcttattatgctgcctagaccagtctcacctcctggccttaagcgatcctcctgcctcagctttccaaaatgttaggattatgggaatgagctactgtgcccagccttcagtgcttgtttacagtatgacggatcaggctggagggaaccctgtcgcactaattgcaagtaagcatcattacccgctacttttgtctcaagaacactgtgcactgaggaaggacatcgcaagtgctaaaagtcgaatgcgatgccaggctgcagattgtaaaggtgcatgcaagaggtggcagggctcagtggtgaaaagttctg

SEQ ID NO: 207649 - DNA, 1203 bp, Homo sapiens
ccttcggcctttttaagcacatcaggagcttaacactggcccagtgactgtgccctgactccacccggcattcagacttgggttcaaattcccaccatgccccgccccctatgtggacaaattgagaaagcaagtgtgggcaccccaccagggactgcgaggaccagggctgtcccctctccaaggtgctgaactcccgccttccaggacccaacggtggtgggaggacaggaaaggaaccctctttgcatgggcctgagttgccaacccctttccccaccctgggcaggggctgggctagcggacgcatcagggagggaggccccactcccagccgaggcagccaccttggagccctaactcacccgggtatgttttctgggacaccagagtaagggggattcagtttcgccatcaactctggcttcaggccagtcatagccctccagtctccacctgccccccactccccacccctgtgaattcaccagactgagcaccttcagacctttggcccatcagcagatctgacctcaggctaacttctccaggccaccctgacctttcaaatcagtctggggagctggcgtctgcccccgggccttcatagtctcagggaaggcccgagaggagcagctggcgttcaggtgggttggcaggggctatttctggagcctgacaggccaggctgcagctgggtgggccaggcactttcatttaaccttcacaaccacctgcccgccaggcattgttcctgctgcacagaggcaaggcgatgtgcctaaggacacacagccaatcagcagccaccgtccgacgccactccaccctgctcaccccagggtctcctgcatctcaggccaggcactctggaggtcccggcatggatggtctctctgacatctactccctggccaagatccaggcagggaatgctgcccccttagagggacgatcccgtgaccccctaagtgtgagggcctttccccaagggctctggaatcggtccagatctcaatctcaactctgcctccctcagctctgtgacctgcagccacgcaggccctctgccggttaccccgatgtcagagggggagcacaccgtccctgttaggaagctttggtgagaagcacgtgcgacgcagccctcaaccagtgccggcccgagagaagggagggtggaccaggttgtggaaacagccg

SEQ ID NO: 207650 - DNA, 252 bp, Homo sapiens
gaaaaagactgaagattgggagaccagttagggaactataaaaacaacaaaggtaagaattaataaggggtggagttaagaaagtagagtgggcaagggcaacatatcttggatgtttaggaagcagttctcaaagtatagtccatggatcctgggggtcatcaagaccctttttaaggtgtccattggtgaggtcaaaactattttcataataatatcaaagtgttatttaaatgttatttgacctctttc

SEQ ID NO: 207651 - DNA, 696 bp, Homo sapiens
gtcttggcctcccaaagtgctggagttataggagtgagccaccatgcctggccccataagagttctttatggggataaggaatctgtcacttgaaattaacctgaatcaattaaaataggcacaaataacaatgtcttgatagtcagatttcttccttcttccttccacctgctttcctcttagctgccttcttaatttcaagtaatagaaatggagcttctattaatataatgtatctcaaagttggaaaagcgacagatactcttttggtctaacaaagtatctactaaaaagaattgagaaaatcagtcattttgtattgcaaaaattactctccttctggcatacagtagataccttatcagattctcccaacattcaggagcatctttctccatttcattctatttctgcccccattgataagcagatatgaatgaaacagaaaaagcctgataatccaagctagaggccaggcattagaggaggcagaaacttggtggggaatatgaacaaaagagataagaggaccaaggaaaaatactgggagtgggccaatagtaaggtttaacaggaatgctctctcttgagcatagtgctatccacacagtatcttctgagggccttggaataaggcctctgtatcagcagactaagcccaggaacaaacagagcaagttatgtctcatcaacat

SEQ ID NO: 207652 - DNA, 449 bp, Homo sapiens
acttttttttaagcaaattccagctcaaaaaatgggttctgatatattcgagcttaagaaagaatgcccatttgtgaaattccagaaattggtaagctgctaaggacatttgttcctttgtctcctctcctcccccttccccttccccgactccattttctgtggggatgttgtcaaggcccaggaaaccaaaaatcaaattgtctaaggaggaacccattcctggattagaagattttagaaccattttgtcacagggtcctgattctagctctctttcttggcctctcttttccatgaaccctcatggcctgattcctggtttctgttataactcaatgtaggttctaggtttaactcctgcctgtatctatagggctgggcccattgtcttgggttaattgaatatttgttaaataaacaaccacccaaaaaagtgattagactaa

SEQ ID NO: 207653 - DNA, 271 bp, Homo sapiens
tatgtttagtgggaatacttgccaataagcctgattttctatgataagcctcttcttccttcaattggttaggccattttgttcttctctatactacaaatctgttacgaaatgaaatttcagagctatattttctgaaaaggataaatgtcctttgctccaaattcattttatttttattcctatccacttcagtttgtataaaatacagaattctaatcttcaccagcaagaatttgtggtttttcctaatacaaactggtaactgtaa

SEQ ID NO: 207654 - DNA, 513 bp, Homo sapiens
aagggtcttggaggtaagtgatcattcagcttccaacatcctgatttttacagatgtagaaactgagggacagaacgtttcaggggtttgcttaaggcaagaaaattgtttagtgacaagggtagcaccagaatgcaggcccccttaattttgccttgatctgcagtctttcatttctattctcaggcacccttgaaaattcaccagccacaaggagatccttattaatggtgtttgttatgggatttctcttagaattcttcagtaatctgatgaaaacttggaggacaacctttgcaaaaataaatgataagtaaataaataaaagcatgtacacaatttgttatatggtttcaggggctgacacacacctcccgctaagggcatcctcagacttacaaactcttgctctgggagtttacattttgcctgtttgtttagttgggtaggtctgtggagctgtttagtctaagtaggagttttttgaacctttcaatttggccctaaggggtt

SEQ ID NO: 207655 - DNA, 431 bp, Homo sapiens
agcagggctcagatcaacacccaggggtcttagcaccatcttagcgctaggccagggtgtgtgtctgcgtggagaggctcctctgacctctccccaggaggcacattaaattgaacctcggaggatgagtaggattcagacacaggaagacaaggaggtacagggagggcatttctgatggcaggaacagcacgggccaaggcacagagctgagagttcagctgagggcatggatctgtagaaaaccgtttaccaaacggagagaggccacatgctaacgggcatactacaaatcaaatgcctctcgttcataagttcagggaacactggagtaaatgtgacccagctcgggattctacattgcagggcttctcagggtctttggggtgctcgtgtggctgagtagccagcaaagctctggtctgcaggga

SEQ ID NO: 207656 - DNA, 454 bp, Homo sapiens
tgacctgtcagttcttgtcagtctggctccatggaactggagaagcttgtgtaacaaaatggagatatttggcttgtgtaacaaaattctgacattctgtcagaattccaaggtttgtgaaaaacaaagcaatgtggtggggctacagagtcatatatcagatcacaggcttcagagagctacatgacagagccgctctagagaaggagaggggaaatggttggagaaaaggaagctggcaggtggccacaccctccttggaaattgtcatcggtctcccccgccgtattggaagctccagaaagacagggattatgtatgtcttgttcactaccatatctattgcaattagaatagtaattaaaacatagtgggtactcaataaatgaatggatgtgaccaacccctgccctttgaccccacaaatattcaataaaactgcaaaagttataaa

SEQ ID NO: 207657 - DNA, 154 bp, Homo sapiens
caagaaactgaaatgtaagtgaagatcttggactgtagggaaagggtgagacgattcaagaagtgaacctagcaacaatcaagtctccgatgttagaggtgcagatgaacaagatggctaagtggtttctccctcccttggtcccgagtgtgtc

SEQ ID NO: 207658 - DNA, 445 bp, Homo sapiens
catgtcagagaactgctctggtgactgatcattcccggagatattcattcagcttaaccaatgcacactttggttaaaactccacctcatttatcactaaacccccataagtaccctcttgaccagtggaccatgtgactttctgattctccagttaagattattagctcagagccagtgtcccacagtcctctaaagtcttcatatttctgtttcactatttcctagcagctttggtaagtagcctcccatcccttcggggaaggccgaaaggaaggtacttgtggtattattgcaggatccttcctcaacaataccaagcttatgcttgtttcaagtggtacaaaatcaatgctgtgcttcatgctttgcctattatcatgatggttctggtcaggtatccaccagacttgggttttggttaggctaatgaagtagcccctta

SEQ ID NO: 207659 - DNA, 625 bp, Homo sapiens
gtgagtaattcaagagctgcttctgctaaagaagccagaataccttttttgatgcagtcttagaagtcatacactgtcacttctgccatactctgctcactagaagcgaatcacttaagtgaagccatgctaaaggtgaaggggattaagctccacttctttaagggaggaatatcaaagaaattgtggacatagtttaatatgaggaaacttaggaagggaaaggttaagtgatttgtccaagtgcataccttgtgagttgcagaacctggatttgaatcccagcagactccatgtgtttttggttgttctgtgaaccacatgctttgagcacttaacctcttgaatgcatattcgaactcacaaggtttggtggcccaagcctgtaatcccaggacttggggaggtggaggtgggtggatcacttgatcccaacagttcaagaccagtctaggcaacatagggagacctcatttctacaaatacagaaaacaaaaaaattagccaggcccgctgtaaactgccctgacgctaccctgacgctgtactgccctgacgctgtaaactgccctgacgctgtaaactgaccctgacgctgtaaactgaccctgacgctgtaaactga

SEQ ID NO: 207660 - DNA, 1019 bp, Homo sapiens
aatgtgccagactttccagagaagaacagtccaggagaccctcagcataaagtctcctgaaaacaacacagtctgacagtcctgaaggccagccctgtctttgcagggacttgtagagaacaccattcccagctccccattttacagaagggaaaactgaggcccagagatcggatgaagcttagcaacacaagcaaaatctgtattgtccatggctgttcagaagcattgcggttacctcaccaggcagtgttgaagaggctatcacagaagcctcagggtagtggttttcaataggtgcccccaaaccactggtgttcctttaaatggtccttgcaagattgtccccagctcactgaatcagcgtgcgaactcggattcacttacagctggcattcaaaaggagacacagggctgtgacttgttcacaagatcaggcaaggcacaaaccagcttgtagtggcagcttgaggatggcatcaggtggtgattgtaattatttttagagttacaagatcctgggtaaagtgttaaaatgccaatagccacaacacagagtatcttcttagagaaccaagtgagagtctgttgagtcaagtcctaggctgtggatggggactaggagatcacatgtgatagtccccttcagagcacagtctgaacagtctgaacaggaaggaggacttcggaggcatggtagccacggaaacgtgagcctcacctcttcagtgctgcccccagaaatccgccaccactgcacgtgcttcccagtgcaccatggacagcaccgctaagctcccagtgcaggactgttcctgggagacacggggccctccgagtatgcatctgacagcctggctgagcgcacctagaaatgcagtgcagtcttagatgtaccccaccttcgctgcccccctcccctgtgccctaactgtgttgatgtcctccagtgctcccagctccctcctgccctccctgtcttccctcacaggcttagtccctaatcaatctcttaccta

SEQ ID NO: 207661 - DNA, 310 bp, Homo sapiens
cagttgagaaaggttgaaaaggcagagagagagagctgcttctgcaagtgtattgaacaatcaaaggcaaataattcgttacagctgggcattctgtacatgtagattagtgagagatgactgcagaggtcagcagacctcgtgccataaagacaacatggaagcagggagtcaagttctcatacctttgggcattcattctgaaattgctaaagaagcaaataaatgtctgtctgggctttcccgccatacatgactgagaatatccagacatttctctatattaaagaaaaaggagagagcagtcatt

SEQ ID NO: 207662 - DNA, 841 bp, Homo sapiens
aatatatttgttatgaagtcttattgaaggcttgactaatcaagtatctgggcccatacagatttagttttcactgaatgctttttttcctttagtatatttcactttcatatgtttttacatgtctaataatttttggttgacagctggacattttaggtagcatattgtagcaactcaattttgttttatatctaagggatttgtattgttttaaatttagcattttgactggactcaaattgtggaatctatcttatatatgatgtgaagttattgctgtctgtgctcagtttttaagttctttatttcaatatttattcttgcttgctaggggtagttcctgtgtctgcatagcttagcagtcagccaatcatttggacaaaggttaagatcaaacacttgagtctataagccttccacccactgttggttgttctgtgtgggatgggggatgcattcattgtaggaggcagttcccaaattccccttggtttttacatttgccatgctctcttgagtctcccctgtgcatgcatcatttcagtttgccaaagatgtttggagagctcatgttacccttttctgcccttctgtttccaggaccttgttaaatgtctggctgctctgttgctcttcaagaactaggactgtaacctttggttagcaactacagatactccttgtccattcctaagtgatttttttacttttgacttacaaagttgtaggtttatacctctgctgtaaatcaagactcctcttacggcaaagttgctagtttttcagttagctacagccagacaaaactgtagtttttaccaatcaacctaggggtggg

SEQ ID NO: 207663 - DNA, 403 bp, Homo sapiens
atattctcagtgaagtttgtgacagcaactcccacgctcccactactctccctaaacccccagctcaaaagcaaaacagcccagatcaaagtgacttggcttgtttggaagaattgtttaaccatctgaccaggtatgtgggagcttttgaaacatggccgtcattgaatcaagctggggagggactgcaaaagctgctgaggagaaggcaagaccagtcctgttgtatcaacccttctgcaccctggcctagcaccatccttagaaaactcagttaaaatgtacatctcaagaagatttaaggggaaataggtcaactgcactgcatttaatttaaaagaaacctgttatgttttaaaggatcccatcgagaagatgaaaaagaaaacccacagaatgggag

SEQ ID NO: 207664 - DNA, 416 bp, Homo sapiens
agctataccaaaatgttactaatgtatcttatatttcaggcatgtctaaatcaacttttagtatgcctcaggcatttgtcaccaaccttttatattaacatgaaacttagaaaatttttgatagaatcccagagttcaaaaggtattaggatttttgccactgaagtaaaaaagagaaaaaaagatatttatgagaaaactattgaacagtgactgtgttgtacccgagcaagttagaggaacgccacactttgagacgaatttaaaagtcctttatttagctggcagccaagaggtggctcacacttggaattctctcagctccgaggaaggggcttgattttcctttatactttggtttaggaaggggacgggagctcagttgcaacaattctacagaagtaaaaacatgcaaa

SEQ ID NO: 207665 - DNA, 448 bp, Homo sapiens
actcatctgttaattttggagtagaatttaacctttttattgtcagtttgctcattttaaaaatacaggtaatatatctacttacttttattcttgaggactgaattcaataatgtatgtggaaatgctttggaaagtattgttattacagggaattttatctttataagaaataatgtcgccggacacagtggctcatgcctgtaatcccagcactttgagaggccgaggcagatggaccatgaggtcaggagttcaagaccagcttggccaatatagtgaaaccccatctctactaaaaatacaaaaattagccatggcgggtgcctgtaatcccagatacttgggaggctgaggcttgacctgggaggcggaggtagcagtgacctgagatcacgccactgcactccagcctggaagacaaagcaagactctgtctcaaaaaaaa

SEQ ID NO: 207666 - DNA, 318 bp, Homo sapiens
aacaaaaaataaagcaccaagaaccctaatgaaaaactggcaaaagacatgaatatttcacaggaaacacatatgccaataaacataagaggagatattcagcagcagggctcagggacctagaaaccaagttcccaaagattccattttctacccattcacttggccaacagcaaatgttggtaagactgtggagctgcaagacacaggacactgctggtaaagtggatactggtataagcactacattcaggaaatggtctagcaatagctacgaaagatgaacactgccgagcatggtggctcatgtctatcatc

SEQ ID NO: 207667 - DNA, 521 bp, Homo sapiens
cagttgtagcccatgaatttttttaagaagcagttttttaagtttatatttgatgtttgccttttaaaaggtcaaagttggacagtaaaagatggtacttagttcaacaaaataccaatgtagctactgtattttgatacaaattttaacatgagacctcaagaataattcatatgtacaagtttcggtttaatatctataattatattatttgtaattatagtgcaaaaattaaattggtattacattcatgaaatattgaaaaaagttgataataatattgaaagttttaataaacatttacagtgttgtccccttctaggtacttttcatgtactaatttcatccttgtaacaatagatactattatgctgtccatatttttaggagaacaataagacagaactgtttttaaatgttttgagcaggggttctcaactttggcattattaacatttcaggttagatcattctttgttgtcttcaagctgtcatgtgtattttataatatttaggcattg

SEQ ID NO: 207668 - DNA, 375 bp, Homo sapiens
tcagaaatgggcctggaggtgtggtagtctggaatgcccatgcaagggtaatatgatcttggaagcctgcagagcctgacttctatttgacacaaaaaaaggcaggttatctccggagtgggttaagcctcaatttgcaggcttggctagtgttttcggcaagccacaagccagagtctctaatgaccagtcttactgtagcaagtagacttgaggatggttgcagcttctcacctccccttgtgagatcactgtggtgtagagatgtctttttcttggtatgtaaggaacattaagaggaggtttgtctggggacggggaaaagagaagtgacttgcttcctaataaacttgtgttctctgctttctgttggca

SEQ ID NO: 207669 - DNA, 719 bp, Homo sapiens
gcaaaatatataagttatgactgtatgatcagatgaagtatgagttcttttggtttgcatccttaaatagttagagatctctgataaaaactttggaatctttgcaaaacaatacaaaaatgccaaaatgtgagcatgtcaatgaaaactaaagacaaatacttcactctttttcatactattataagttattctggtattaaatatgttaataaaagtgtttttgttttgacatatttcagttaaatgaatgaatgctggttgtattttatttgaatgagtcatgattcatgtttgccatctttttaaaaaaatcagcaaatttcttctatgttataaattatagatgacaaggcaatataggacaactattcacatgattttttttaataccaaaggttggaagattttataattaacatgtcaagaagactttatagtaagcacatccttggtaatatctccaattgcaatgactttttaatttattttttcttttgctgctttaacattttctggatattaaaatccccccagtcctttaaaagaatcttgaacaatgctgagccggcagctgaaaatctaactcataatttatgttgtagagaaatagaattacctctattctttgttttgccatatgtaatcattttaataaaattaataactgccaggagttcttgacagatttaaaataaaagttaatttctagacctcga

SEQ ID NO: 207670 - DNA, 400 bp, Homo sapiens
caaaactgtttctaattatttttaaataactagagttcaatctaatgtaaactatatacaaaagccagatagcaatcactaactttgttacatcataggcatagataattttaatgaaacatatccaccaagtatgtccaatttctctgatgacagtgctaacttacatgcgcatcaaacatttgataaatgaatatgttaatgactgtaatgtcttttctgggaatgcctttgttggggctcaacacattgttaaggagaagaaagcagatgactgagaggaggtttgtaaagtggggatggggagagtagctggaagccatgaacaaattcattctcagaggcacagatccccctacatgagctaggacctatgctaggagctagattcacagatatg

SEQ ID NO: 207671 - DNA, 763 bp, Homo sapiens
cacagatgagaggtccagatgtcaaagagaaagtcagttcttgacatgggatttgggaagctatgttccagagaaaatagtttttgggaagctcagtttcttttctcttgctctcacataggggcatcttctttatgctcttaaattctctaaaaattctactttcccatcagtgatcttccttcaagtttactgtaagccaaagtcctctttatggcttataagagactgcacaatctgactgatgttccattgttttagggacacacaaatatctgcaaaattttgagaaactgttattttttaagttctctttctacatcacgtctgaaatgtgtgtgattagtggtttcttttccatttttttggttcatttttctgcacatttcatatttttattattatagtcttttttgatagtcgaaatatagttcgaaattataaagtataatgtccttctttgttctttttcctccagattgctttgactattcaaagtttattgtagtttcatataaattttaggattttatttttcattgctgtaaaaaaatgccactggaatttcgatagggagttcattgaatccatagattattttggataatatggcactttaacaatatttatgctttcaatccatagacataaaatactttaaaatttatttgcgttggccaggcacagtagctcacacttgtaatcccagcactttgggaggccaaggcagggagatcacttgaggtcaggagtttgagaccag

SEQ ID NO: 207672 - DNA, 639 bp, Homo sapiens
atatcttatattttctactttcattctggtggtttggggcccaaaaaaacttcaattcagtcacttgaattccagatattttattttctaggaaccaaggcctattctctttgatcatgaattttataagattggttgtctattgccacctgccttcccatagtgtttttgtttttgttgtttgtttgtttgtttgtttctggtaactagcatagcatttagtaactagcatttgataactagcatagcaggtaggctctcaattaggcattgtctgtggtattcagttcttcagcagccttgtctaaccaaggagttaaggaagaattcaaggaaacacacacatccattttaagtagtaaagagaaaacatcccataggagttcagagaaggagagtgtgatttggaggattttatgaaggggtggaattttggtgtgcactgagatatggttgcaattttgtcaaaggagaactgagggattttaagggaagaaaatataagacaaaacttagaggtagaagagaccgtgtcttctatgggcaatgggtagtagccatatattgaaaattttaagggtgaaatttgctgtgctaagtaggactaagggtttgactttgttgtagagctgattgtga

SEQ ID NO: 207673 - DNA, 492 bp, Homo sapiens
ctcagtatgattgatgcaaaaattgaaatacatagagtgactaagtgtgagaaaccaaagaaagcttcaagagagaataatatttgaacatagtattcatacaattataaggagattaccatgtgaaaaaggtagagctatttatagattctcattacaattgttaaaatgccaaatttgtttctagatggtagttaacttgaactatcagaaatcagtagttccctgtgtttagtgcttagagctttccgttttcctgtattttgtgtattttgtttgcttgtttgttttttcgaactgattttttttctgagtagacaaactatcattgcttatcctgaaaccttcttaaggtttctcatcatttttgttctttagcctttcaatgaaagattatttctttgctgaaattttgtgattcagatgccatgtacatttgttgtatttgtctgtacatctacatcttatgaataaatccatgttttcttacca

SEQ ID NO: 207674 - DNA, 377 bp, Homo sapiens
aaggacagtgcccccgtgcagttccaattcagagacagggtctcaatctgttacccaggctggagtgcaatggcaccatcaaattacctatgataacctatttaataaaccagtgttatgtacctgaattggagaagcataaattggtacttatggtattaaaatttgtatttaagaggctgtaattccagtgtgaagcatgcactcatggagacactggatggccgcctgatccttcctgagttcttaaaatttccattactaaaagctctgcattccacgactcatcatagaagagataaaatgatccaaattatgaaaaaatattgatgaggtgactgttctaatggtttataactaatatttgatttatcaaa

SEQ ID NO: 207675 - DNA, 409 bp, Homo sapiens
tttaaatgttcgccttcaatttatttcataggtcactgttataccatctagtaagataattaaaaacatgcaagcagctggtactacagctaaacagattaatgtaatagtctgtagtcatatgtgctggcaaggggcttgcctcttttggcgaggagaaggtcagctgcccttgggaagaggaggagaggagtggcctgtgctacagtcactaagttaaacatcttcagcaaactgataatcaggaaatgactttccttctttcacacccattcatgttcttctctcagttttaatggttaaataaggaacagagaaagctcatataatttggcagacaacattaacgttggtctttaaaaagtacaagatatatttcacaaaaccaacaatgtcttctcaagtctta

SEQ ID NO: 207676 - DNA, 556 bp, Homo sapiens
tgaataattccaacagagaccatgaggcctgtaaaacctaccatatttactaccaggacttttacaaaaaacatgtgccaacccctagaatattcaggtggtagaattctacctggccacaaaagccatcattaaataaaggatatttaatgacatataactttgcagtgtattagtgaaaaaagaaagttataaaatagtatgtaggaatgattcccattaaaaaattaaatgtgattttaaaaggcatatattcaagttcatgcacacacacatgcacacacacagaaagagagaaaaagacaaagatgtatgccaagatatgaatagtggcttccccttggtagcagaatttctaagtagtttttatttttcttcatacacattctaattttctacaattaatacacattactgtcaatctcgaaaacaagtggggtataaatattatcttttagaaaacaggaagtacaatgtgtttacctgataagatataacacaaatatatacataaaatttagaaaaaagctaggtggggacaagaatctaaggcaac

SEQ ID NO: 207677 - DNA, 511 bp, Homo sapiens
tagagataggatctcgctctgtcacctaggctggagtacagtgctgcaatcatagcccactgcagccttgacctcctgggctcaagcggtcttccccttcagccttccaactaactgggaccacaggtaagtgccaccaggctcagctattttattttttgtagagacaggtctccccatgctgcccaggctggtctcagtctcctgggctcaagtgatcctcctgcctcagcttcccaaagtgctgagattatgggaatgagctgtcgcaccggcccacaacaaaaatttattttctcctgattctggaaggtgggagtccaagatcaaggtgtcggcaggactgggtcctttgaggctgcgggaaggagctatccaggtgtctgtccttgacctgtagtcagctgtcttcactccctcttctcatcaccttctctctgcatgtgcctgtctccaaatttcccttttttataaggacatcagccatactggattaaggcccatcctaatg

SEQ ID NO: 207678 - DNA, 150 bp, Homo sapiens
tgaagttactcatttctcatgaactttctcttgttagaaggctttcctaattactgtagataattaggaaataattatcagatagttatatccatttatgcatgtacctaatatattttgagcacatgaataatccaggcactgtgctag

SEQ ID NO: 207679 - DNA, 455 bp, Homo sapiens
gagatcccccagccgttttcagggtggttgacatgaaatactatgaatttcatttttaaatggtatatgccctatactcaaattttaaagactctccattgttctttttcattggtctataatacatatgaaaaccaaggctttgggctttatgcttctctccactcagacaatattatcgagaaatttatgtaccccaacacaggtactattatttaagggattccagagtaagtatttccataaaaatattattcactatttattctatatgtttttttccaataatatacacatcatgcttcaatttcacaggccttgaatgcacttggaagaatgcgcaagagcaaaatatcaagtctccacttgtggcttgtagaccacgggcagaactgaaggacagtggctcagacaggcacagcctcagggccaccttaaccttgggagtcggcagg

SEQ ID NO: 207680 - DNA, 203 bp, Homo sapiens
ctggctactgcaagagagacatacacgctacctatatatctctgcagcacatcaatttaaatctgttggaacaactttttaaccctcatttcagctcaaggtctttgaagttgaccaaatgatgaatctagcctgatttcttgtttgtatgaaccaggtttcttcttttgctgtctgtagctcaggttttcattctctatagt

SEQ ID NO: 207681 - DNA, 611 bp, Homo sapiens
ccactgagaatccctgacagaaataacaatagcaactatgtaacacttcctacatgccagagtctcagctaatattaataatcacagcagcatttcctgaggttcaagagcccccaggaatcaacagatgaatttacagactaagtttcagaatttaaaaacctgttttctaacggtgatgtgagcctctagttccagctactcaggaggactgtctgaacccaagagttccagtccagcctgggcagcatagtgagacactgtctctaaaaatttttttaaattaaaaacaattttgattttagtcaatgaaaagcatatagagatgtattatctatacatatcaatatatgtatgatatggatgtgtagctatatatatctatatgtgcttttcattgaactaaaagcaaaattatatgtgtcaccacatattttatatatgtcactgtgtgtgtgtgggggggtgtatgagataaagatacagatataggcccctcctcactcctcatcttccatgttccccattttccacccacctggggagccctgagccactgcctagaggagaaatacccaagagagtcacctggcctacatcagacaaatgtg

SEQ ID NO: 207682 - DNA, 420 bp, Homo sapiens
agttggggtctagacccactgcccatctccccagcacctgctgctctgtgattccccagacccccgtcaggacagtcagtgtccttagcaatgggcagggaggtaccgctcagcccagaatggatgtaggtttggtcctgagcttcctgaccctcaggctgtgtagtgatgaaggggccatggggtggtgcaaccattgctggttttaaatgtttgtgctcaatttatcaaagtttaaaaatcatatcttacaccgacaattaaagttatatctattaacatataagtgtgcatattatacttattcctaatatagatgcacagtatatccaaatgtataaatataatttatatctaaaatattatatgtatatttaatatgtaagggttacattacaaatatatacctatgcatgtaat

SEQ ID NO: 207683 - DNA, 118 bp, Homo sapiens
ctgctgaggcttgagtagcagttttactcacagtataaacaaagccgcccagaagttcgaactagatggagcgcaccacagctcagcaaggctgctgtggccagactgcctcttttag

SEQ ID NO: 207684 - DNA, 327 bp, Homo sapiens
gtaaggcgttggacaggagaaatgttctataaccttacaactaaatttcatttttttaagtgggcctgactttgtatgctgtgatcccttgaactacttcttagcctgtttcctccccttaagtaagataggaagctgagatttactaattgccttctcccttaggtcagataaggctctgtaaaatattttcccttggagagtaggctgttgttatgaagaatccttcgtgtgtatttcaaaattgttactttttcattagacaagtattacaaaatggttacttttcttccctctcccacgcctactccctaccttcacttaaac

SEQ ID NO: 207685 - DNA, 959 bp, Homo sapiens
catacccccttctatgtgaaataggtaggtaatcataatggatacagacatatcttcatacaaatacattgaagcatattgagataaatgggtagcagaacactggggagaagagacacaagatatcttgtccaagataaaaacttaaaccatgggctgcctggaggaaggaagtcaagcatcttctcactcgatccaaatttgtgctcacagagtgagttattacagggtttcccacattttataggacattttaggataaaggcagcagtgaagcatgagtttctgtgcctttttgtgagagtatactcatacctaagcttcagtttctctgtcaatttttctaaattgtggtaaactacatataaaattgaccatttaaccatctttaagagtacacttgagtggcattaagtacattcacactattatgcaaccatcaccactgtctgtcttcagaacttttcatattcccaaactgaaacaatggccccattaaacactacctgcccattctctctctcccagcccctggcgcccatcattctttctgtctctatgaatctgactactccagggacctcagctaagtggaatcagacagtatccgtcctcttacgactgggttctttcacttagtagaatgttcccaagcttcatccatgttgtagcatgtgtcagaatgtctttcctttctaaggctgaaagtattccatgtttttgtacagaccacattgctttctgcatccatccatcaatggacactgaatcatctcatcttctggcaattgtgaatgtgcagaacaggatgtaagtttccatttgatattcctggaattctgagtaatggctctctgtaggcttctgggagaactgaatgcaagaatgtttacaactctacatagtctcatcattttaaatcttatcaatttgtcagtcttttccttttaaaaaatgtc

SEQ ID NO: 207686 - DNA, 121 bp, Homo sapiens
ctgagtcttcctacccctcagcatgctccacctgccattatactttcacagggatgtttttgtttttatgtagggttgaaagttttacctatttcttaagtttggggttttggtgtgtgtg

SEQ ID NO: 207687 - DNA, 245 bp, Homo sapiens
gattttttaaaggatattatgcttatgtttttaaaaattatcttttagcaatacatactaatattatttacaaatgaaatgttatgatgcctgggaggtgctttataataatttgtgaagggagaatggctagaggagcgaaggccaccagttaatggttggggctgggtaagggctcattatgccatcctgtcttcttttgtgtattcaaaattcttcataataaaaagttaaggtgtatgaga

SEQ ID NO: 207688 - DNA, 217 bp, Homo sapiens
aattatctgccctccaaaagtcctttagaagagccagtgcgagggtgaagaccaaagcgtcaagaacacgccagactctcagcttcctctggggagaatggctagaggagcgaaggccaccagttaatggttggggctgggtaagggctcattatgccatcctgtcttcttttgtgtattcaaaattcttcataataaaaagttaaggtgtatgaga

SEQ ID NO: 207689 - DNA, 749 bp, Homo sapiens
atctcaggccatgaggcaactgtaaagaccaaagtcacaagctgaaaccagaagagtagaaggaagaaggagcccgagtccctgatgactgtggggctgccacaccatcggtttactcagtgacatgctaggaagctggctgtctgagaaaaactttttttttttaaatccccaacagtgccaatttccatggtgtaaatgttcccactcaagtggatttcaagctatcagtgtgaagtagtagttggacttggcattgggatgagatgcacacaatcagctctcaggagccagtgcaacctgccgcagcacacccacctggagtcctttcctagagacttgtcttacatgagagagaaacgcaccccatctgactgcagctacttcagccagggctctgttactaacagctgaaagtcattcctaacattcgtgtgcagcttgagcggatacagtcctcggagcagaggaatcttgtttgcctaagagagtagaaagaccgctcctcaggtgcctctgacagccttgggctatccagcctgggacacagtgtggctgagaggcagatgttgaggagatgggccaagtgctacaattctccccctggtggcccccatgggtccacagaagacccagccacccaggcagctcttcaggatttctgagaaactgccttggagtctgccttcctcacattgctcagggcacttgagaaacctggacatttcctccctgattttgcagtcagg

SEQ ID NO: 207690 - DNA, 340 bp, Homo sapiens
attaaaattcaatcttctaaatattttttaaagccaagttgtaatatagtaatataaggccgggcgcggtggctcatgcctgtaatcccagcactttgggacgccaaggtgggcggatcacctgaggtcaggagttcaaaaccagcctgaccaacattgagaaaccccatctctactaaaaatacaaaattagccgggtatagtggtgcgtgcctgtaatcccagctagttgggaggctgaggcaggagaatcgcttgaatctggaaggcagaggttgcggtgagccgagattgtgccattgcactccagcctgggtaacaagagtgagactccatgtca

SEQ ID NO: 207691 - DNA, 875 bp, Homo sapiens
ggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaa

SEQ ID NO: 207692 - DNA, 331 bp, Homo sapiens
ggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgtaagttcttttgattggttgcagctttatttagatatgattcatgtaccacacaatttactcattgtaagttcataaccaattgatttctgg

SEQ ID NO: 207693 - DNA, 350 bp, Homo sapiens
tccccactgtgttatagctactgtatggcagagccggaatttgaaaccagatctatttgaccctagaagatgtgaccatgagatgttaattttgaggataacttttttagtattatggaattttcaacatatattttttaggaccaaagataaactaggcacagagtctactctttgcataaattatttaaaagagcttcgcgctccattttgtcatctaagcactgtaaaattctcacaagactaattcttctttttaggaacgatatagttgtaaactttctattttttttctttttttttttctccctccaccatccaagtagttgtgaattttctagagccaaaat

SEQ ID NO: 207694 - DNA, 582 bp, Homo sapiens
tacaagttggtgtatgttggacagctgtgaggagtctgacaaaaaaatctgatgctaataataaagtgttaggaaggccaggttttctagttttgtttgtttgtttaagcaccatattctctattagagcaggggccagcaaactttttctgtaaagggccaggtagtaaatattttaggctttgcctgccataggttctcttgcaattcttatctctgtcattgtagcgtgaaagtagcgacagaaaatgagtaatgaatggatgggttttgttccgataaaactttatttccaaaaggcaagatttgggccatagtttgttgatgccagcattagagtgacaattcttgttctttgtgtattcatttatacagccctgctccatggactactcatgttataataaagggatagagaagggcatgatgacgatgtgcgttcccagtgtgctagctgtggctctacccctttttctctcacttaagaaaacttcccagaaacccgagaagtgagagcattttcccccagggaaaaccttgaattgtgtaacatgtaaatccatgggaatcttcagcacttta

SEQ ID NO: 207695 - DNA, 268 bp, Homo sapiens
aaataaattaccttacagtgccaacaaaacctgaagggttttaatttatggaggtgactgagtgacaacacaaagaggctaatgccattgaaagaatttattactcagttcccaaggaagggagtatgctggggcgtgccacaccatgccacacagggcaacaagaaaccttatcacacacagggaccgagaagctgagaaagagagagggaggaactaggagtgtacctttatgactacagtagtcggggagtaaaggggtggggat

SEQ ID NO: 207696 - DNA, 303 bp, Homo sapiens
agctcacttttgcttagaaatgtaaaaggtaatctctgaatatattcagaaaaagaattcctatgatgtaggataaagtctttattccattcatgggttctattgtgttaaatgtccaacaaacatgtgaatgatcactatgtattaaggtattatatattacgatattgtacttctaagaagcctttttgtaggtccaatctaaaacccctttccccactgttgactttcacattgcctgttaactgtcctcctctacatttatttacccctccttctaccattagtattatatctggtggt

SEQ ID NO: 207697 - DNA, 600 bp, Homo sapiens
tctcgttccacccaactttttggtttcaactaatacttatagctcctggaaacactcatccttttcttgctcccattactgcactcttctaattttccttcaccctctctcttaacctacatcctctttttccttccattctctatctgaatataacccaagacatcccctcatctgcttcctgttcttcctctgtttaatacttcagtaggcagctttagtcaaccatgctgataatcccacatgaacatttcccaactaagcccttcaggtgctacagaagcaacaccattttttttttcaatcacatccacaatcaagtccacatcttcactgactgcctaattcctctggtccattcttcctaacctgtatcttgtaattggcataatttcttctttaggaaaaaccatctaagcccttatcacctcacatacagattaaagcctacaattacctaagcaatctcacctgcattcatttattccccaacatcccttcctcacaaatccttcttgtacaaagatgccagtgtcaagtctccctaaaacaagacaggaaacccaagagaaaaagctatacgagtcctctctaggtgat

SEQ ID NO: 207698 - DNA, 137 bp, Homo sapiens
tgaacaacttctaatttttaaagataccatgctaatcatttcacgtggattatctcaatgtaacctcacaaatgcccaattagttaggtacattttccatttaagggaacttagagaggtgacatccctggcctggg

SEQ ID NO: 207699 - DNA, 554 bp, Homo sapiens
gctgaggtaagaggatcacttaagcccagaagggtgagacttgaggctgtagtgagcagtgattgtgctgctgactccagtctggatgacagagcaagaccctgtctcaaaaaataataaaaataaaaataaataatatataattaataatatataattatatatgatatataataatatatcatatatataaaataattttaaaagaaagattaaaaaaacttcagtgactgagtgacataccagttactgtgataaaagcatggggaattgccgggcgcagtggcttatgcctgtaatctcagcactttgggaggccgaggtgggcggatcacaaggtcaggagatcaagaccatcctggctaacacggtgaaaccccgtctctactaaaaatacaaaaaattagtagggcgtggtggcgggcgcctgtagacccagctacttgggaggcagaggcaggagaatggcgtgaaacccgcgaggtggagcttgcagtgagctgagattgtgccactacactccagcctaggggacacagagagactccgtctca

SEQ ID NO: 207700 - DNA, 463 bp, Homo sapiens
cccaggtggtcgaggctgcagtgagccaggatcacaccattgcattccagcctggatgacagtgtgaggccctgtcttaaaaaagacaaaaacaaaccaaaaaaacccacaccctagtgggtaaggggcagcagaggtcccacccaagagtgaaatcatttttggtgtcagtaatcagggagagtaatataccctcaggccagaaactagaggtgagtgatggctcacgcctataatcccaagtgctgggattataggcatgagctaccgtgcccagccaccctggaaaaattttacaaaatgaagtataaaaagaagaaaagaggggcgggcatggtgccttgtgcgtgtaatcctagaactctgcaaagccgaggcaggagatcctttgggtttaggagtttgagaccaacctgcacaacatagcaagaccctatttctacaaaaaatacagacactaggc

SEQ ID NO: 207701 - DNA, 324 bp, Homo sapiens
tccatgggacctaaagacctaggagcctgtgatatgatacctgtcagtgtgaaagggctggagtttgctatctgagccagacctacactccaagacaggtctagtgctgggattataggcatgagctaccgtgcccagccaccctggaaaaattttacaaaatgaagtataaaaagaagaaaagaggggcgggcatggtgccttgtgcgtgtaatcctagaactctgcaaagccgaggcaggagatcctttgggtttaggagtttgagaccaacctgcacaacatagcaagaccctatttctacaaaaaatacagacactaggc

SEQ ID NO: 207702 - DNA, 765 bp, Homo sapiens
aactacgaggtcacctggtacacatcttggagcccttgcccagagtgtgcaggggaggtggccgagttcctggccaggcacagcaacgtgaatctcaccatcttcaccgcccgcctctactacttctgggatacagattaccaggaggggctccgcagcctgagtcaggaaggggcctccgtggagatcatgggctacaaagattttaaatattgttgggaaaactttgtgtacaatgatgatgagccattcaagccttggaaaggactaaaatacaactttctattcctggacagcaagctgcaggagattctcgagtgaggggtctccccgggcctcatggtctgtctcctctagcctcctgctcatgttgtgcaggcctcccctccatcctggaccagctgtgcttttgcctggtcatcctgagcccctcctggcctcagggccattccatagtgctcccctgcctcaccacctcctctccgctctcccaggctcttcctgcagaggcctctttctgcctccatggctatccatccacccaccaagaccctgttccctgagcctgcatgcccctaacctgccttttcccatctccccagcataacctaatattttttttttttttttgagacggaatttcgctctgtcacccagactggagtgcaatggcttgatcttggctcactgcaaactctgcctaccaggttcaagcgattctcctgcctccgcctcccgagtagctggaattacagacgcctgcca

SEQ ID NO: 207703 - DNA, 239 bp, Homo sapiens
catgatcgagctcggtaccaccacttctatagataagtaggtgtggtaaatagtgagagggagtatagggctgtgactagtatgttgagtcctgtgagtaggagagtgatatttcatcaggataagaggaggatggaggccaagtctgatccatcgggtctgtgtcacctcacaggcatacatccttgctgtgagcagttcactacacagttctgcaccctacaaatgtgaaagtcaag

SEQ ID NO: 207704 - DNA, 469 bp, Homo sapiens
ggggtccatagctcatgaagtccaaacatatctatacattcccagcaagcacctctggcttcccacatcgggggccaccttgatccaaagcagggctggcgagggtctcaacttgcaggacctgctcagacatgaccatcatctgaggggctttggtaagaaactgatggctgggcgcggtggctcacgcctgtaatcccagcactttgggaggccaaggagggcggatcacgaggtcaagagatcgagaccatcctggctaacatggtgaaaccccatctctactaaaaatacaaaaaattagccaggtgtagtcccagctactcaggaggctgaggcaggagaatggcgtgaacccgggaggcagagctggcagtgagctgagaccgcatcactgcactccagcctgggtgacagagagagaccccgtctcaaaaaataaaaaaatacaaaataaaggctgggcgca

SEQ ID NO: 207705 - DNA, 188 bp, Homo sapiens
ataaaactgcaccccttaagtagcacagttgacttaaaatacttttggaaagcaaaacatgtatacaaataaacatgtgacaactgactgttgaactgctcacactcacacacctctggcaggtaagataatgatggcttcaaccccctcacccactactgccccacatccagtccacgcaattcacc

SEQ ID NO: 207706 - DNA, 276 bp, Homo sapiens
ctcctggattcaagcgattctcctgcctcagcctcctgagtagctgggattacaggcatgtgccaccccacgcctggctaatttttgtacttttagtagaggtggggtttttccgtgttggtcaggctggtctcgagctcccaacctcaggtgatccgccctcctcggcttcccaaagtgctgggactacaggagtgagccactgcgccgggccttggaatttcctacctgccttttctccttaattgttgccttctttgaactgttgctcccttg

SEQ ID NO: 207707 - DNA, 339 bp, Homo sapiens
agtacataaaaattacatcacttccttgttgatgagattaatcaaatttgagtatcaagagaccttgaatctcaattaagttttgctaaggtgctccgtatttttgtggagtattttgttttgttttgttttttaatcattataaaatgcttgctcccatcatagggattcaatcagcaaaaaatagcctatcaatcatagtaggttagacaacatcataacaaacatttccaacttacctgacaatgctgaaactagattaaaatgtaccaaaaacaatcccattgatttttagggccttaactgaaaacagttacagagatatagctgtcattttgg

SEQ ID NO: 207708 - DNA, 113 bp, Homo sapiens
gtgacgatgtgttttcttttatgagttcatatgttcaggaggctggaaaatacctagctgaatgtgtgatacacatgataagcatgctaaggcatatgggcagaagaagagat

SEQ ID NO: 207709 - DNA, 576 bp, Homo sapiens
gggttttttgcatacaagtattaggtctgatagggttcagaaagttagacagtgagcagcttccattggagacagctataaagtaacaaacagaaatttttcaagtgtgtagaatatggagaatatttagcacagggctttatatataacagatatacaggagctgttgtttatcaaataaatggaaaagacctgtcagataccctaagcaaggtaggaatgaattgttggaagggacagtcagaagtccagggtgttggggccaatgacccggtttgggtaacaaggacaaataaggatacttactagaactagttagttgttattgtattctcaacctgggagttgatacataactggcaggtaatatttattgaaatgtattttgtgacactgagagtggaatgagatgtcgtcattgtaggccccaactcctgaaccttggaagggaaattggatttgtgacaattgtttgagtcagtcccatgaattacacagattttggcagatgaggtctttttattatttgaataatgtcttctaagttgggaaccttgctgaaaacttgaaggattg

SEQ ID NO: 207710 - DNA, 900 bp, Homo sapiens
caggctctcactctgtatcccaggctggagtgcagtggtgtgatcgcagctcactgcagcttcaaactcctgggtccaagcaatcctctcgtctctgcctcccaggtagctgggactgcaggcacatgctcagctaatttttgtatttttttgtacatgtagggttttggggtttcgccatgttgtccaggctgatctggaactcctgagctcaggtgatctgcttgcctcagccttccaaagtgttggcaccatagacgtgagccaccatgcctggcctctttcttcttttccttccccttccctttcctttttgtcttgctctgtcacccaggctggagtgcagtggcaggatctgggcttactgcaccctcaaccttctgaggtcacatgatcctcccacctcagcttcctgagtagctgggaccataaacatgcaccaccatgtccagttaatctttgaattttttgtggagacagaatctcaatatgttgcccagactggtcgtaaactcctgggctcaagcgatcttcctgcctccttcccagagtgctgggattataggcgttagccattgcacctgacttttatttctttagtgtatgtttttaatgttttaaacttttttattgaaatatgactaacatatgtgctttctgggttgaaattcttcatttgttgcatttgccaaatttaatgatgtaaatgctgtcctcaggactatttgtaatctactgacagtttgacaagactcacaaaattactgttaaacagttgtctgtcataaaccaatatgaaccagcttcaacacaccaatgcaacatgcttacagaaaggtatacaaatcattactgtacagctcattgtatgtcagtgaagtgaatacaccttagaccctt

SEQ ID NO: 207711 - DNA, 430 bp, Homo sapiens
tgattggtgagagaggggttaagttttgaaaaacaaaatactctcctttgttgtcatgatcctttatgtcatgtcctttcaacctattaccttccaaacacgttgttgagaaggcgctacttttgcaaacttgcttaagtggggaaggtacaaggtaagctaggctactgctggagaattccaggcaggattcaactctgtgagtacgtgtggtttgctagggtgctttgaggattcagagaagggaaagttcttcgttaaacattacacaggatatatgtgacgcagctagccttgcattaagaaaatttgatttgtgaagtaggatttggaaaagatttgtgaactggcttgagagtcacagctttccatttgtcaccagagggctggttttcaatatataaaacaggaaatcacacttcttttgata

SEQ ID NO: 207712 - DNA, 583 bp, Homo sapiens
catcaagccagctcacacagggctgttcagtagttgttaagtgttgggctagcttctttctacccccatctgtgggaggagccataggtctttcctcttccctgaagggtttgccactttctcgagcttcgtttacctagacatctttataactgatctggctttttgtagcaaactttttgcttgttagggtgggagtgatgatcttttgctactttctgtatctaaaccaaaagtcctgttcaaatatgtattaaaactgatgattgtggttatcaaatcatttggcatttagattccattagtttcacctaaaaatgacattttgatttgattttaaaatatttatataaacactatgtcaagaattatatccttcagaactgtttaagcttatgatgaaaaattttagatgtcaacttaaaaatatgtaagggaatatatatagttcttcattattctattgggagtacatgagtgaactcaggaataatagcaaaggtaatctttttattctttcttgattagggcagtgtgggtgactggctttgctttgcttcacactgtgggtcttctgggctca

SEQ ID NO: 207713 - DNA, 476 bp, Homo sapiens
gaattttgcccttgttgcccaggcaggagtgcaatggcgccatctcggctcactgcaacctctgcctcccaggttcaagtgattctcctgcctcagcctcccgagtagctgggattacaggcatgcaccatcacaccaggctaattttgtatttttagtagagacagggtttctccaagttggtcaggctggtctcgaactccgacctcaggtgatctgcccacctccacctcccaaagtgctgggattacaggcatgagccaccgcacccagcccataggcagtttttattcacatttttattagaaattcaatacagatgcattatacaaattgttctttaatttcaaggcagaagtgttgcttagggaaattttaattgagactattttgaaatgtgaagagcatatgaaacagataatacagagcacagagaaacagaatatgaaagataggaactgagaggagcgtgctga

SEQ ID NO: 207714 - DNA, 678 bp, Homo sapiens
tcccagctctacttgggaggctgaggctgaaggattgcttgagtccaggagtttggcgttacagtgagctatgatggcaccactgcactccatcctgggcaacagagtgagactccatctcaaaacaaaacaaagacaagactctgagaccagaaacaatttctaggacaacagttttgcctttaagttacttaaacatcacagaaagccattaaagggtgagtactaaaaattcttaactttgtaaaccctgaaatacttcagttgttattagcaaagaagtaatgcataaactatgcatggtgaagtgctcttcagttttcaagtgcttatttctaaatgttccaaacagctgggtgaggtagatggaaactgtggatccttccaacagattaagaagctaaggtacagggaggctgtgatttacctacatggagactggacgacagcccagccttgtggctccccaaattcttgtctatcatgttccttcctcaaagaaatatttaaggttcctgaattgaaacttcagtatctacccaggggttacaacttcaaatatttatttaatgtcattttttgaaacttttttcttttatggtagaacattttgacgatgttggctccttaatttggctgttagcttttttttttttctaaatgaatacttaaaagaat

SEQ ID NO: 207715 - DNA, 408 bp, Homo sapiens
tgttacagatgaggaaactgaggcacaaagaggttatgggatatgcccaacatcacacagctggcgagtggcacagcaggcattggattgcagccctgtgggaccccaggtcccatatgtccagagattgtccctccaatgggaatgtgaggaaggtggattcagggtggggaaacatgggtggcaggaaatgacctccctgcacaccagcagaaaaatagggggactcagccacccactgtggacggcccctgccattactgacctgatagtttcctgtaaatcctctcgccctttttaaagatgtcaatacatgtacttaagaaggaactccactggccaggtgcggtggctcacacctgtaatcccagcactttgggaggccaaggcgagtggatcatctgaggt

SEQ ID NO: 207716 - DNA, 247 bp, Homo sapiens
ggagtgacgtgcccagagatagaggaagatcagcagggagtggatatgagaaggaaaagcatgattctggtttcacacattgggtttaggtttggcctggaaatccagaggcagatgtctgccagcagttggagtttctgggctggcttgggcataaaaaccaggcctgcaggttagtgaattatgtgtctagaggtgagggctgaagccaaggatgccagtgaacatgaagaagggaggagggcca

SEQ ID NO: 207717 - DNA, 758 bp, Homo sapiens
tatcagaaggttggaacacaaggcctgtgacctgcccagggatgatttgaaactagagatgagtgtctctgccacacagatagaaacagccaaatcagagaagaacaaggacatgagaatgacaggaactaaaacaaagcctagagtccctgtctggggatggagaggagagcagaacagttcccctcctccagtcaatgcttttgcccagagttgactctgaagggtgctccctaagggtgggctttcaggcagaaatacatctatagagtgtgcaggtacaagacccacttcaatcctgggcttccaagtctgagtcccctgaatccctgcgcctatctaaattctctgtttccctcactggatgatctgatcaatacagaatgagtcagcactcatgatggttcctggcttctgggaatgccttggtacttgtcccatgcctttttgccactgaggcctggctcacaattgcatccttggggaagtcttagtaataactcctgtctattcctgggcatgtgctgggggtgagggatcagggagaccctttactcctattggaatctttcaaggactcttggtaggcagtcgtgaatgttggacctatgtagagcaagaaagcctgagacttggtggtagtcagagagcctgcaggaaccggaattctgttacataccttggtcatgctgacaccacagaactaggacatgactccgttgaagactctgacagatgctttaccaagtagagttgtg

SEQ ID NO: 207718 - DNA, 472 bp, Homo sapiens
gcttcactgttctttctcttcctcttaggcagcctctgtccctacccccaggctcctgccaatggaaatatctcctcctcatcagcggcaggtcccattcctggcccatgggcctctctaaaggacaactctgtgtccctgccatgttgggatgaaacaaaatttcagcagctcctatatagctaacatgaatggttacctatataggagctactctcagtcagtagaggggagtccctcagtaaatgaaatttacagtggacttacataattggtgaacataggaggcttcaatgagagtcctcccaggggaggtcagcactgcttgtcccacatagaaatgattaacacaggctgggtgcagtggctgtcatctgtaatccctgcattttgggaggctgaagcaggaggatcgcatgggccctggagtttgagacgaacctgggcaacataaggagaccttgtctctaca

SEQ ID NO: 207719 - DNA, 439 bp, Homo sapiens
gatgcttttcttagattgaatattcctgtgacttaaaataagtagcttaaaaatgttgggggttggggggaagagtggtgctagccaggaagaagccagtaaacatgtaaatatagtgcaacccagtcgggcttttttttttctccaggtatcacaaagaaacccagaatgcattgttatgtagtagccatccatcttggagtctgatcctttgtattgtggatgcacacagctttacctactgtactggtagtcttcacttctatcttttaagttacaaactgttttatatatttgaatcgctagtcacttttccagtcttttggaaaaaaatttcagtccgcacaagatgatataattggagtattttaaacactagaccccaggagcttggctgaactggaaagagaacatacaaagctctgagaaatgtgttcaa

SEQ ID NO: 207720 - DNA, 141 bp, Homo sapiens
caataaaatcttaaagtagataatatgttgtacgggctattacggcttttaaaataatatgtgcatacacctatatgtatatttatatttattataatacaattctctcagggatatatttaaagatattagtaaattata

SEQ ID NO: 207721 - DNA, 424 bp, Homo sapiens
agttatttcatgcattttccccaaggttctagcagtttacagtggaaaggcaactgtcatattagtttctccatgatcagaagcaaaaaatttgtcctgtgtaatttgaaaaattctaaactagagaaattgtgtagatgtttcagacttacttttatacttgagtcattaatttccaataattaattgagagaatgataattaattcataagagtttaaaaaattataagtctctaagttaaattggtatttagtatccaggagacaaatagtatgcaaatcatttgagaaggaagaagcttaaattaagtagaatattttaaatacagttgaatcaagacacaatgagtaatattatattgtgtttaatttagcaaaaattcttacttggctattaaagaaatggtccgtacctagttcctc

SEQ ID NO: 207722 - DNA, 562 bp, Homo sapiens
tctctaaaaagaaaagtcaaacaaaaaaatttaaggacaggcacaaggactcacacctgtaatctcagcactttgggaggctgaagtgggacaatcacttgagcccaggagacaaaatgagacccatgtatagaaaaaaaagagaaaaaattagccacgtgtggtggtatgcacctgtggtcccaaccactcaggaggctgaagtgggaggattgcttgggcccaggaggttgaggctgcagtaaggctgtcacaaacctgggtgacagagtgaaaccctgtctccaaagaaaaaattaaggaatagacaagaaaaaactaccagaaattaaaaatatgacagctgaaaaccttcaatataaaggtaaaaagataaagtcaaaggaatctcccaggcagtagaacaaattaacaaagttggaaggacctggaaaggcccacccagtacccagaacaacagatttataaaaaagacccacctaccaaggtacgtaattatgaaattttttattaagaacttaaaaaattagaaatcttccaaagataaactaggctactataa

SEQ ID NO: 207723 - DNA, 465 bp, Homo sapiens
taccatggctaagcctaacagtgtcaacagagactgtctggagcacaaagcctaaaatatttactatctggtcctttacagaaagagtttgcctacctctgttctagagcgaagcctgagccttgggtgctcactatgccacaggtatctgttactgtggtttgcagaagcttcaggtgagagggagagcttctaggagaatgcctaccacgaaaagtgaaaatcccttccttcttggcatcactgtttcccaaacccacctcccactcttcccaaggtagcttcatggtttgcttcgtcacttccttcctgggctcaagtgaacctcccaacttggtctaccagagcactgggattacagacatgagccactatacccagctctgatttttctctatagcacttatcagatatattccatgcttatttatttatttatttttaatttgtttgagacagagtctc

SEQ ID NO: 207724 - DNA, 151 bp, Homo sapiens
aattctgttttcatttttaagagaggattctttttatcctaaatgttttatttttaaatctttttatctgttattacatgtgctgctgaagggagcactgttatgacctagagtagttacataatatatctattctatttatagctaggtg

SEQ ID NO: 207725 - DNA, 531 bp, Homo sapiens
ctttactgggtgatgaaaatgttctaaaattgatagtggtgatggttgtacaactctgagaacatactaaaaaccactagacagtctattttaaatggttgaattgtgtgatatgtgaattatatctcaatacagctgttttaaaaagttctgaattgttatttcttcaaaacgatggatgctttgctaaattggcaacatacactaagaacatgaatgtcattaaatacctttgcctagtggctgaaccagaatcccaaccccaggactactgttgaggccacattctaggtccccaagagtgggctccttcacaccaggcacagtacctcactataaactcagcctacagacctgatggccaagcagttccctgctgggccaaggaagggctggaggaggatggcagggccacttggatgctagccaggagcaactggaatgggaaattcttaagtgtctctgatatggcacagaatgacctcaaaactcaggtgataaaattcttggataaaaagaattgctgggtgt

SEQ ID NO: 207726 - DNA, 405 bp, Homo sapiens
ctccaggagaacgaagctgcacctgaggctgcttccgccagcatatgtgatttctcttgccagtcagcatcctcttctcaaggcctaacaggatcctggcctatcgcaggattttgctcttgtagggcaaagtttctttatatgtgccagctcattctatctcatgcatattctgtgaattctgtatgtgtgtagtggcagctaatagtatttccacctggacagagggaggccagagtccctgacattccctgcactgatttgtctactgagactaggtcaattatcttcaaaaaggtatttgaggccaggtgcagtggctcatgcctataatcccagcactttgggaggccagggcaggaggatgccctgagcgcaggactttgagaccaccctgggcaacac

SEQ ID NO: 207727 - DNA, 366 bp, Homo sapiens
taggaggttgcagcaattatctaggcaagagataatggtaacttggaccaagataatggtgtggagatgttgagaagtagtcagataccagttatatttcagaaggtaagccaatagcctatcttgatggattggatgtagattgtagaggaaaaagcagttaaggatgaatccaaggtttttgttctgatcaactgaaccagaatgatggttttgtcatttacagagatggaaaagaccataaggaggagtggttattggaggaagaagaccaagagttcagtgtagaatataataaaaatgagatgcctattggacgtgcaagtgggaaatttgagtaggaagttggctatatggatctggagt

SEQ ID NO: 207728 - DNA, 648 bp, Homo sapiens
gtggggccttggagaacctgggtgtggaaactctgtatctaactaatctgatggggatgtggagaacctttgtatctagctcagggattgtaaacgcaccaatcagcgccctgacgaaacaggccactcggtcctaccaatcagcaggatgtgggtggggccagataagagaataaaagcaggctgcccgagccagcattggcaacctgctcaggtccccttccacactgtgggagctttgttctttggctctttgcgataaatcttgctgctgctcactctttgggtccatgctgcttttatgagctgtaacactcaccgcgaagatctgcagcttcactcctgagcccagcaagaccacgagcccactgggaggaacgaacaactccagatgccccgccttaaaagctgtaacactcaccgcaagggtccgtggcttcattcttgaagtcagtgagaccaagaacccaccaattccgaacacattttaactcagatatagtattacgtcgcatgaatatactttaaatttacttatccatattctcccagctaacagtaaagattttaaaaattaataatctagtatagattaatggtaaagggcagagaggatatatattgatatgttttggaaggtcgttttcg

SEQ ID NO: 207729 - DNA, 1432 bp, Homo sapiens
acacctcagttgctgggactacaggtgcatgccaccataccaatctaatttttgtatttttttgtagagttggagtttcactatattgtccgggctggtctcgaactcctggcctcgagtgatccacctaccctggccttggcctgccaaagtgctgggattacaggcatgagccactatacccggccccggttagttcattgtttcaagctgggacctggctcagcacatttttgaggtgtgggcacaacagcacctcagaaatcctggagtccctagattctgagcatgcaactcttctgtgttctcttcattattgatggtagccagctgtagtctttccagtgcttttattcatcacatttcccacaccacactcctgccttctctgtcctagttttcttcagtcagtatgatgaacatttcttcacctagtagctgagaacagcaaatgtggacatttatgagcctgccaccggaggggaaatgtgggaaaaccctggacttgagcccagcaccagcgagaccaaggtcgaggattttgttcccttttcctccccccatttgctttgctttgttctatggccacagatggccacacaagccccagccgtttgttttaactgaatgctggcggtcatacaggacagagcaaaggactgtggttagatcagcatagatccatcactgtttactggaaaaaccacttaggagagcatgctctaccaactgtgggtcgagaagcatagtcacatagtaatagctactgttgttaatgctcaccgtgggccaggaatggagctggatgttttatgtgtgtcatctttaactgtcacattaaatgacattaaatagcagcaagcaattagtatttgctattttcctatctccaagttttcttgccaccgtctcattatattgaactagattttgttaaaaggagaaaaagatatggtccttgtccttgaggagttgacagcatagttgggaagaagagatttaaggacacttgagtgtaaatgattacagtacagattgatgacataagtgctgaggagactctagagaggagttttgggagttgggtggagatgattaggaagcttctagtctgagacaactctggcagaggacagaaaaaccgcagaatgaaagcccagaccaatatagactttgacagtaaatcatttgcatcgaagtttggttacgggttcagtgcagttacgggcggaggctggaagactggggagaggtagagtgattgtgaaatttctaattccagggaagctgctggcacttactagaatggggaaggcaggggttttagccagaggtgattgatgggagcgagcttgataagcagtaggtgggagacaggctagacatctggcttgactggggagagggggacagagatgaagagagtttgaag

SEQ ID NO: 207730 - DNA, 326 bp, Homo sapiens
tatttctggatatttcaacaaaaagttaaacaaagcttacagaacaattaagaatccattgttacaaaaaaaaaaaaaaaaaaaaagcctattggtggccgggcatagtggctcacacctgtaatcctagcgcttcaggaggccaaggcaggtagatcatgagatcaggagtttgaaccagactggccaacatagtgaaaccccgtctctactgaaaaagcaaaaaattagcgaggcatggtggcaggtggctgtaatcccagctatcgggaggctgaggcaggagcatagcttgaacgtgggaggtagaggttgtgctgaaccaa

SEQ ID NO: 207731 - DNA, 338 bp, Homo sapiens
aataatgcatgtaactaccacccaaaacaaaaggtagaacattatcaccccagaacattcttccgtgtgtttccagtcaatctcctccttccctgccctcctcacaaataggcaatcactcttctaatttctatcagtatagattactttgtctattcctaaactttaagtaagtgaaatcatacagtatctggctaatttcactcaatgcagttttaaaaaattgatacataatatatggacatatgggttaaacgtgcaattttgttacatggatagcaacaaaataatgatcatataatgatcaaatcagggtatttaggatatccctcaccttg

SEQ ID NO: 207732 - DNA, 525 bp, Homo sapiens
agtttattacaatctgagagaatagcagaccagtgccaaattacaggagttcaggaagaagcttggatgaaagaggtatgtacgtatctgtttgggtgtgtgtttaagggatgaggcataaagccaaaaatatatcatggagttgatcctggaagctgtggctgggaagacagtatggaagcagatggtaaaatatactaactgttgcgaagattctgaccagcaggaatctgtgatttgggccatgaggatcattcctcagattttctaattttcttgagggttgagctcatgctagcattttcatcattgtctcatcaacacctagtttaatttaatgtactaaattaaagaagaaatatatcaaaatgtaactccatgtccttacaggtattcatcaacaccacagataccagtggctgtgataaagagacctccgtctttccccattaaagcctttgccctatgtggcccactcatctttggcagaagttctgatcataaagaccgagacctggcatgctt

SEQ ID NO: 207733 - DNA, 710 bp, Homo sapiens
taatcagcaggtcaggtgcccagcagtggcagtgcacaggtcagctctggagggggaggtccatgctgccgtccatgcccagcctccacccttcccccactccacacttggagcccatcaaacatgcacgggagagctgggaaaagaggctgatgatgcctgcagagggggcagctgtggagatctgagcaccgagagcccctctgaagcgaacagacctcagagacacccgcccggcacagctatccccacagctgtccatctggtacttggtcccagaactcccagacaccttgctcccaatccattcatttccaagtccttaaccatcctaaccatccagccagacattcacaactgctcaggagtcagtgtggatgcatgtgtgcaatactatccagggattaggaagaagtgaagggctggaacatggcggtaaacctgagaacagtgtacacaaagtacacggattatatgactccctttctgtgaactgtctggagcaggcacattcggagagacagccagtggatttgcggttgccagaggctggggttgggtggggtgggctggagagtcatggctaataggaacggggtttcttttagagagatgaaaattttctaaacttcagttgggtgatggttgcacaggtctgtgaatatactaggaagctttgaattatacactttaaataaaggaatcttatg

SEQ ID NO: 207734 - DNA, 302 bp, Homo sapiens
agtgatccccggctatcacattatcttacacatatctagtgaaagatgtgaaaacataaacattcatagtgaagggtatacttatgctttgttaattcatcatgtttcatagctttaaaaaaatcgcaagaagatctgtgtatccctttttttctggccctacacttttcttctgccacccctatagactatcagcctgcacactgaaactgttctcacaaaacaaaggcattatcaacttctcaaggtttaggtagtgatttaaggctaacagaccccacactcatgtgataatgtgatag

SEQ ID NO: 207735 - DNA, 277 bp, Homo sapiens
caacacctggagagacttctagtgcccgtggttgagtatccacagaaccattccaagccatcctacaagttagcattcaggcacccttgatcagatgtggtgagcctccgagcagctttccttaagaccacagacacacagaagaaaaagcatgcgacgtggagtacagaagactcaagtctaacctcaactctcaaagcaaattacttcagctcttctacatgccatctgctccctcatttgccagcaggaacagcaggaacaatctaagaattgc

SEQ ID NO: 207736 - DNA, 891 bp, Homo sapiens
cctcccgcctcagcctcccaaagtgctgggattacaggcatgagccactgcgcccggcccaggcattgtttcttgaccttgccacaggaatgccttggtatgcaggagtcaaacatcagtcattatggcagttttgcttcaaggtggtgccattcttgcaacagggtcttttcctacagaggaacatcgacaaactgcaatgctccctagaggaggggtccagggtgagcaggctcagatcgagttatttgaagacaggacaagacaataagattgttttccatagaaaagagatttaagagagacccggttggctttaaaatatttgaaggagtattgggtagaaagctgagacacactgaagtacaaaggacaaactaggaccaatggcagggagtttcaggaagaccaattaccattcagtgttaagaactttctaatagctgttcaacaatagggtggccttgtagaagatagtaattccctgtcactggaggtgtgtcagcagatgtcagaaaggttgtaaaggggattcctgcattgtgtagaaagttggatcaggtcacccctaaggtcctttccaattatgaaaatctgtggttggctactggagacctatgggggcttgctgctgttaagtcagccctggtctccccagcatttgggagggagagctggtgagttcttctttctcctccctagataataatgacaaacacctgatcacctaccagtcagtggtcagaggcagagccctccaacagttcttatcttagctcaaccctgagggacagactcttgggttggaagatcacaaaaaggtcgctcttgtgctgttttatgttctctgaacgtgtaccttgagacaaggacctgtatgtaggtggctga

SEQ ID NO: 207737 - DNA, 438 bp, Homo sapiens
tttctgcatacttatcagttttcaagcttagagcaaggactgatagatttctctccttagctgtgcttatactagtaacacgatctctttcaagaaaaaaacatttaaataccattaatgagtgttatcattttaaagttttaggaaacttgaactaagttacatactcgtgaagggcttacaacaaccatacctactttgaacactgtgcaactgtcagaaatgtttatctcatgagtgagttttaaagtttaaggaggttttgaagtcacagagttttgtatattctaaattgtaaagttatattttacacatccaaattactttttcatttctttttctttcttgtttttttttttttttgagataaggtcttgcttgctctgtcacccaagctggagtgcagtggcatctggctcgttgcagccttgacttcat

SEQ ID NO: 207738 - DNA, 173 bp, Homo sapiens
tttttttggtagctattctaaatggtattgagtttgtgacttggttttcggcttgatctttattagtgtatagaaatgctactggtttttgtatggtgattttgtatcctgaaattttactgagtcatttattaaatctaggagtctttggaagagtcttttggatcttttag

SEQ ID NO: 207739 - DNA, 713 bp, Homo sapiens
tgacagagtgagactctgtccttaaaaaacaaacaaaaaaaatagctgggcattgtggcagacacctgtaatcccagctactcaggaggctgaggcaggagaatcgcttcaacccaggaagtggaggctgaggtgagcagaggtcatgccactgcactctagcctgggtgacagagtgagactttgtctccaaaaaaaaaaaaaaaaaaaaaaaaaaaaatgggaatgaaggaaacagaaaattagaacaccacagtaataattgctgcagataaagtccactgatgaagctaatattagtgggcaaaactctaaggaggaccaggatatttacatagcatctaagtataaacctccaaatatgcattaattatcttgtttttaacatatgtccccaaatgttttgatacccctccctccacaatggaaagcttaattctccttcccttaagtgtgggctgatttagtggtgcacttctaacaaatcatgcaggggtcagcgtagacccaaataggaaatatattaggctgtttaagccatatgatctcttttgcaacaactcacccctactgatgtagcatgaaagcagccataaaaaatatgtgaatgaatgaatgtggctgtatgccaataaaactttatttataaaaacaggcagtgggctggatttgggcctccagccatggtttgctgacctctagaatagcatatg

SEQ ID NO: 207740 - DNA, 271 bp, Homo sapiens
atgcagccacgaaaaggggtgaggtagatttatacacggtaatgcagtaagattttcacaactaagtggaaatacgagttgcagaataagaatgcatagtctgattaccatttatgtaaaaatgaaaattataattttaaaatagtaagtgcataggaaaaaaccgggaagatatacacaaaatttaatggtgattatctctaagagaggaagaggctttcctgtgagcatggggtgtgtgtgtgtgtgtgtgtgtgtgtgtgtgtgtgtg

SEQ ID NO: 207741 - DNA, 424 bp, Homo sapiens
aatgatgtgcaagaacaaaatggaaactggtcatggtgggaaaggaaatgaagcagaagacacctgacaaaaggaatcataacttagaaaaacggtgggtgttacaatttacaatttaagatttcagaacaagaacaaccatagagcacacagtcacaataatgttgccaaatcagagaaaagagtattgcagactaaacgaacttttatccatggaacatttacagtggctacagggtcacaaacctcctggatgcagtttataatcaatgtgaacgccccactgcacacccccatgcactcagctcaaaatatgcctatttatatttaccctcagtttcttatagctctgcacacacacacacaatatatatatatacacatatcccacctgaaatactttcaataaagtttctgaccaaat

SEQ ID NO: 207742 - DNA, 336 bp, Homo sapiens
ctagataacttttcagagtagagaatccagacaggttttgctgtgactgaaggagtgtctgcgcagtagaagaggtggtcatgcctgcagctgtgaccctgggtctgtgggcacacaaactggctaggtttaggaagtggccctctcaagggtcaggacaaagacgcatgatggtcaagaacccaggaatctctggttcaaatcctacttccaaggaacacttgtagatatgtgtgcaagacacacaacccttgccgaatcttaagattcctgtggttggctgggcacgggggctcacgcctgtaatcccagcactttgggaggccaaggcgggcg

SEQ ID NO: 207743 - DNA, 228 bp, Homo sapiens
tagagacgggagccataattgcaatgagaaggggagctgtggctggctctgactgccctgcttcccacattttcttttaacgagtgtccccacgtccccaccgcccctcccccccgacactcagatcccttcagttcccactggctgccattttcccttgctctgcagcctccaactccactccacttaagagaacagactggagactgctggaggccctgaagtgat

SEQ ID NO: 207744 - DNA, 413 bp, Homo sapiens
aggggtgtcaggcagctaggaagaccttagcacactgcctggcacgcatgacgctctcaacaaatgcagccactatggtattacagttaagccaggcaaagaggatggagggcaaagagcagctcccacaggggaagcagcaggtgcagcacctgggctggaaggagactggacacagcaaagcaggaagctcctgacagagcactggtgccctgcctggcatccctgtcactgatgctcctgccactttgtgccaaatctcccgcccactggagctctgattcggatctgtacagtgcaactctagggcctggtagtgccttccacgtgggggttaagtaacacatggctgctgagtcaatgtatgaatggatggatcaatggatagacggacagatggtctagtgattgag

SEQ ID NO: 207745 - DNA, 327 bp, Homo sapiens
ggagtgcaatggcgcgatctcggcttactgcaacctctgcctcctgggttcaagcgattctccagcctcagcttcccgagtagctgggattacaggtgcctgctaccatgcctggctaatttttgtatttttagtagagacggggtttcaccatgctggccaagctggtctcgaattcccgacctcaggtaatccgctcgcctcggcctcccaaagtgctgggattacaggcatgagccactgcgcccagcctaaactcgtgctttcactggctgatatatagacagtaagatgttgaaaaggaatttcaatgtgagaaaatgccca

SEQ ID NO: 207746 - DNA, 497 bp, Homo sapiens
gccgctgagtgtttatgctttcggggcataaagacatgaaggcaataaggagacttttctcctcagaggccgcccatggctccccatgggtgtctcacacaggggagaccaactcatctggcacccaagaaactctctttcccacaagtattccacagaggagttaaagccaagcctttggatttcagactcaattattttatccaaggatgagtatcacacatgaaggtttgcatgtgaaataattcatgttattattcatttaaattttgttaatcccacttcagcatacctagatgagggagttgtttttaattaattaatatttctgctggagttgaaaaggatcatgtgaacttttggaacaaatattgcttcttgcatttctaattgcttatgaacatcagcctgcctgcccttccctgcacataacagctaggcctgtgcgtagtttttgtttcatcatgtacgttaagattgtcttagggtacactctg

SEQ ID NO: 207747 - DNA, 223 bp, Homo sapiens
taactgaagcacagatctcagaatatgaagttatgggagatgaggcatgataaaaaggtacacatgatcctaatcatgaaggatcatcatatattatgctcttaggttcataactcaccctacaggagattagaaaacaacagaaaaatgttaatcaaaggttgatattcatcagatttgctcaggaaagtaattctctagtaatggcattcctattaaaaag

SEQ ID NO: 207748 - DNA, 439 bp, Homo sapiens
gagacggagttttgctcttgttgcccaggttggagtacaatggcgccatcttggctcactgcaacctctgcctcccaggttcaagcaattctcctgccttagcctcccatgtagctgggattacaggcatgtgtcaccctgcccagctaattttgtattttaggtagagatggggtttcatcatgttggcaaggctggtcttgaactcctgaccgcaggtgatccacctgccttggcctcccatagttccgggattacagatgtgagctgctatacccggccacatttcagattttaataaatgtacccatagggagaagtataaagcgttgagctcaacgctttatacttcattagctctagaggtccatgcatacttaatattatactagaattcaatacggaagtataaagcgttgaggaagtataaagcgttgag

SEQ ID NO: 207749 - DNA, 391 bp, Homo sapiens
aggatccccagtccaagtgacaagtgtggttgtgtcaaacctgagttggtgacatctctatgctgctattgtcacaagctcatattgctggacagcaaactatgagacccaaagtgaaaagaagtataacgtaacggttatttctgtgtggttggttgacaagtgatgtatttaaaaaatatttttaggcatgagctaccgcgtccggccaaacttttaagtcttacagttggattatgaacacatgataaaaactattctttgtaatgccaaattaataaaacacaaagtttggtaatagttattcttatttaatttttagaactggtcagttaatgaaatggattgcttttgtataatttgaatatttttcagtgggaatcataagagc

SEQ ID NO: 207750 - DNA, 571 bp, Homo sapiens
aatcagcggacataaaagcagctattataaatatgctttataacttttaagaaagcagagaaaaggtcatgatgatgagaggcatggaagatataaaaaagtttcaaatgaaacttacagaggagaactttgaaacaaaaaacataaaagatgagattaacagcatattaaacactgtggaagatcatgaagttaaaaaaacagcaatagtataactattcaaaataaagtacagagaggaaaaaatactgagaaaaaatggataatttcaagtggtctaaaacatgtgtaactggaggcccccaaaaagggaagatacagaagaaattattttaaaagtatggctgaaaattttctgaatttcatgaacactataaaaccagagacccaagaagctaaagaatagcgagaaagaacaaacataaagaaatcatactaatgcgcatcataatctaattacagaaaactaatacaagagaatatttgtatttaggccagaaaaaaagaacacattatatacaaaagaactaaaataagaataaaagtaggcttattgccagaaccatgtaaa

SEQ ID NO: 207751 - DNA, 378 bp, Homo sapiens
tgctgtagccatacataaagagatggaggagaagcaagagggatttattgaatactaggtttgagcaaaagtaattgcggttttgccatcatgccaaaagctacagttacttttgcaccagcctaatatttactaagtgccagatattcttacttaccttatttaaatcctcaccaaagacacgagttggaatttacaaatatgaaaattgaggcatagagttaggtaatttgcctgctatcagacagctagcaagaggagaaccaggacgtaaacctaggtctaggaagctatcaactaaaaatgtcctgtaaacttcctgtacgtcatccattgttcacgtatcattactgggttgctgtccttgcccacaatacc

SEQ ID NO: 207752 - DNA, 277 bp, Homo sapiens
agggatataggatctcacttttttttgtctctctccaggattacagagataaagcatttatgcatatacagaaccacgggattttagaagttgtccatcagttcctctggttgttttggtacaataaaaaagtgctttttttagagatagaatctctgttgcctgggctgaagtgcagtggcctgatcatagctcactgtaaccttgaacccgggaagtggaggttgcattgagccaagatcgcactactgcactccagcctggcaacagagtatta

SEQ ID NO: 207753 - DNA, 143 bp, Homo sapiens
gggaaacaatttttatagctaaacctaccaaaaaaacccaaggagaataaaaatgacatgtagcttttaaagtttgtcacaggaagcaactaggagacataaagataatggttctcacattctcatttccttaagcagcttct

SEQ ID NO: 207754 - DNA, 769 bp, Homo sapiens
gaggtttcaccatgttgtccaggttggtctcgaactcctgacctcaagtgatccgcccacctcggcctcccaaagtgctgggattactggtgtgagccaccatgcccagccagtggttgaattttttaaaaagtgttcatggggtgcttgaaaactaaaatatccttctagatttgtaagacagtatacctgcatactggtgtggcttccacacttgagtaaaagcttcagagtaggtatcctagatttccccaagatgctctactcttaaaatagtgccattcattttctaggtgggatcatattccacgctgactatattgctaggggtggcccagagggtcaggcctttgggaaatagcatggcctttaccagcttcccttctctcccaaagaacttcccttcttgggctttagattgaggaaggggctgagtggtaggcggtgctgctgtgctctgatgaagacccatgtggctagcaacagcgcttaccttttgtctctgggtcctggcctggggccatcaatccactttgggccactcactgtctgctctgcctccaccaatcagaaacccttccaaggaacagtgagagccaaagccaagagaagccttcttccctgtttggtgattgtgtgacagtgggtgaacctctctcagagagaactagaaagaactcagtgcttgtactccacagtgagtaatgtcaggtctgacccatcctgaagcctgtcttgccatgcttttacagtgttggaggcttctaca

SEQ ID NO: 207755 - DNA, 184 bp, Homo sapiens
gaagacgagactcagctttcatttttgatgttgtcatagagaagactctatggtaatgcttattttcacagtcaactttctcttcttttcccccagacagaaattgcaaactcaggtgagtgacagctttctggagtctgcaaacatagattattttccctcttttgatggcaaatttcttata

SEQ ID NO: 207756 - DNA, 104 bp, Homo sapiens
gaagaagcagaagtccaaatcaaggacaatgagagtattgaactaatgtatctagtatcaagacccaaagtccattcttaaaggaaaacatactccaagagggg

SEQ ID NO: 207757 - DNA, 512 bp, Homo sapiens
acctatgcctgctcacgaatctattactatacacccagaaaatacaaacatatcaactaaaatactaaaagcaattcttcaaaagtcatcactatagtagataataaacatgaaactcaattgcttcctttatttaaatagccagataataatgcaattgatgaaatagcctcataaaaacagaagcccttgccctccctccaaaatgtttttagaaataaatataacaaaaatatatggtttcttaaaaataacaaatatgcgtatcaacaagaaacacagatatgacaagatgaaaatcataaatgccactaaagggcatcaaacatcaaataaatgggaaatctatcttcctagaaagagatatgctatcgtaaagttatcaatgatcttctaaattaatctacaaatgcagaccctctcaatcaacataccaccaagaattattattattattattttgagatgggagtctagctcagtcccccaggctgggtgcagtggcacgatct

SEQ ID NO: 207758 - DNA, 203 bp, Homo sapiens
agagccattgatgctaagtgccacagggattcagagtggagagaatacatctgcccttgacaaacagaaaaggctacatggaaaaataggtattactggatgttctctgttaatctctccatcaaggcacccatcttcagaagaccgtgccctttagaagtccaaactatgtagctcagagttcaaggttggccatgcagtca

SEQ ID NO: 207759 - DNA, 711 bp, Homo sapiens
agggtcacaccactgtgcccggctaatttttgtattttttgtagagacagggttttcaccatcaggccggtcttgaactcctgacctcaactgatcacccgcctcagcctcctaaagtgctaagatagccacggtgcctggttagaatatattttttaaatgtgccttaaaatttctcaatacaaaaaggttcaatgaacattatctaggaaataaagaattaaaaaaaataagattactaggtagaaaataaacatttaaattcatagaaagggattggaagattatataccaaactttttttttcttttgagacaagggctcactctgtcgcccaggctggattgcagtggcacaatcacagctatatatgtgtatataattttctaagtaaagaaagtcctgaaattttaggttaaaaggtgtattagggccgggcgcggtggctcatgcctgtaattgcagcattttgggaggctgaggcgggcaggtcacttgaggtcaggggttcgagatcagcctggccaacatgatgaaaccccatttgtactaaaaatacaaaaattagccaggcatagtggcaggtgcctgtaatcccagctactcgggacgctgaggcaggagaatcatttgaacctgggagatggaggttgcagtgagctgtgatggcaccactgtgctctagcccgggcaacagagcaagactgtctc

SEQ ID NO: 207760 - DNA, 111 bp, Homo sapiens
tcaaagtgtggcatccaaacctgcagcattagcaccaactgggaacttgtaagaatgcagactcttgggccccagatcttctgaaccaataaactggagacgaagcccaga

SEQ ID NO: 207761 - DNA, 180 bp, Homo sapiens
tctccttttcttaaaacaagcctaaatgctcctctgggactctagtacttcaggatcttctgattcatgccagaccgacgtaaatcatccctcctgccctctgctcaggatcaagtggaaagttccaaggacagggcatgggagtgggggcctaggaccagaaggttacataaagcaaga

SEQ ID NO: 207762 - DNA, 272 bp, Homo sapiens
aggcagaggttgccgtgagccgagatcgagccattgcactccagcctgggcaacaagagtgaaactctgtctcaaaaaaaataaaaataaaaaataattaccttacaatcaagaaaaatttaaggattttcaatatcgtcccttctatttaactcaaggttttagccaggaaaataaggccaggaataaatataaaatgtataaggtttggaaaggaagaaacaatcttgccattaattgcaaacagcaagaatgtttacaatgcttgggat

SEQ ID NO: 207763 - DNA, 748 bp, Homo sapiens
tattgtgttgcttaagtttggtgatattctttgttaaagagaagttctaaattttgatgaagtccaaattatcagtctttcactgcttttcagttttgtctcatttaaggtctttactacctcagatcacaatgttttctgtgttttttctagtatttctttttatatggtggagctaagatcatttttctagtatttttaaagtcttatttgtacatttataaaatcatctataattaatttttctgtatagtgttaagataggactttttcttgtctttttttccaaatggagatccagtcaaatacctgaccattttaatgactctacaacacacctttatctgtgaccaactctgttcagaaagctggcacttacaggcattcagtaaaaatttattacatgagttaagtagagagggagaatgtcaggcattttaggcggggaactcgtgtgagcaaatgctgaggctggaatgcacaagtgtgtgctgagagctacatgtggacctctcttgttcagccagatgatcccttctcaggcccacttgacaccctgagctttcctttctgccaatactgggtcccccttgggcccagcctgctctccctcttcaatggctgctggccattccctccgtctcctactcatttctttgctgtaactaaagttgagttcataggtcctttcttttcaaagactgaccactgatcactaccagaggacaaacgataacaaaaagaataa

SEQ ID NO: 207764 - DNA, 646 bp, Homo sapiens
tattgtgttgcttaagtttggtgatattctttgttaaagagaagttctaaattttgatgaagtccaaattatcagtctttcactgcttttcagttttgtctcatttaaggtctttactacctcagatcacaatgttttctgtgttttttctagtatttctttttatatggtggagctaagatcatttttctagtatttttaaagtcttatttgtacatttataaaatcatctataattaatttttctgtatagtgttaagataggactttttcttgtctttttttccaaatggagatccagtcaaatacctgaccattttaatgactctacaacacacctttatctgtgaccaactctgttcagaaagctggcacttacaggcattcagtaaaaatttattacatgagttaagtagagagggagaatgtcaggcattttaggcggggaactcgtgtgagcaaatgctgaggctggaatgcacaagtgtgtgctgagagctacatgtggacctctcttgttcagccagatgatcccttctcaggcccacttgacaccctgagctttcctttctgccaatactgggtcccccttgggcccagcgtcccctctcagccgccacccccccgggaaacgaaccacataaca

SEQ ID NO: 207765 - DNA, 586 bp, Homo sapiens
agaccaagtgaaaagacccatacctcactgctgtatagcattttttcctccctgtcctcctcgtcttcctcctcctccttgctttttccttttctgtgtttctttcggatagcagttgttgctatgcctttaaattcacaaatattttgtctacaatatctaatctgccataaaaaccgtccactgtatttttcatttcagacattgtagttttcatttctagaagtttgatttgcgtgttttttaaatatatgtccagtctttgctctagctacattttgaaatatatggactacagatataacaattgttctaatgtcctgtctgctagctacattttaaaatatatggactacagatataacaactgttctaatgtcctgtctcctatcatctgagtcagtttctgttttattcctattttcactatgggtcttttcctgttttttttttttcctgcatttttggcaacttttgattgaatgccagattttgtaaaatttaccttgactcttttaataagtcttgaatttttgatggtaagaagctattttttttccatgaagtcatttgtataattgctaat

SEQ ID NO: 207766 - DNA, 347 bp, Homo sapiens
agtgtcttcaagaaatttacgtatggtccatcaagtaaacatttaggctattcagcttttttttgagaagttactttttctgattttagaaataaatgtccttttgtaaaatctggaaaatgatgaagtcagtcacattttctagtccttctatatgtttatatgcatatatgtatatatgtgtatttgacatcataggtaatattttgtgtctttgttttaaaaaactagagatatcctccatgttacagatagaaaaattatggtacacggaagtaaagctactggcctaatgccacacagtggtgtaagaggattcacagattcttctgctcctccttaagttt

SEQ ID NO: 207767 - DNA, 360 bp, Homo sapiens
ccaagatttcaacctattgcctgagaggttcgctgtggcctaaagtgaagttacattaaaagactgcacaaaataaagtatctaccaaataccttttctttctgggttaaattctttatctgcaaggctggactcagcatgctcgggggaatgagtaggtctacatgaacggtgagcctccaggaacgcagcttctccacagattttatctttttcactttatatttgaatcagaatgtactgatgggtgatcatttggatgcagaagtgcaagattccactcattcttcacttctctctcctgagataacggccacctgcccatgcacacatgcgtggggtaggaggtgggtaccgagc

SEQ ID NO: 207768 - DNA, 566 bp, Homo sapiens
aaaaaaaccccgtagtgcaacaactgcctcttcctggggatgagtaagcactcagtgacatggagcccggatttgctcttagataaggagggatagagaccctctggaagggctgtggggatgcagcagtggggtggctaggctcagcattgaggagcccccataactcatgctcattccctgcacacaatgaggactgtggaagcgtttcttctgcttctcttaaagccctggaaactgagctgtggcttgatggattggcctgttgggggtatccagggagtgcgcgggagatgtggaccaacagacttgatgattgtttctcaagcacaatcttcctggggaaaagagaataaagagctcagacagtgagatcccaataaaatgaagatgggaatttattgttgaggaaaagaacctgctatgtttgaatgcttgtcctttcccaaacccatttagaaattgatccccaatgtagagattaagtttaagaagtgattggggccaggggcagtgtctcacacctgcaatcccagcacttttggaggccaaggccagtggatcac

SEQ ID NO: 207769 - DNA, 802 bp, Homo sapiens
tcagtatcaacgggaatggaagcttcctgagcacagactgtcttaaccttccagtaccaagcacaaagctgcacatggaatataaatagaaagcaatgttctagaagatggagaaggggtgaatggctgggtttaactgtagagggaaagaaacactgcaaagagaaatgcaaatgtgtaagtaaactgctcctcaggacagaatcatggaggagtctggggatcagaggcgccaggtccctgggaagatggacatgggacttgctgaatgtgtgtgctggaagccagccacccagatgaccatcacaacctcaagtagccaggcagcgattccttcttcccttgggcagaagacatctggggaagggaaggaggcaggaacagatggatggagggaccgaatgagaacggctccagatcgagggagactgcgcacaggcaaggatgtaggtgaggcccaggatcgaaaatcgcaatattgagtaaagcttcaatctgatcaacaaaaatatcaaccttctaatgccagtctcttaaatgctctcttaaaaatgctagcagccggttacaagaatccctcccttccaggtagattgggggaatctcacctagaataaaagaaaaaacctatgggaactgacattaatggtttttaaagaaaaggccaattcccagtcaccctgaagttcaacgcaccacttgccatccctgacagtacgcatgaaactttcacttggtttttgagtgcctcactcgcaagtctgaaaccacacccagcaatccacaacatttgagatcatct

SEQ ID NO: 207770 - DNA, 2637 bp, Homo sapiens
agcgtgagccgcggccccagccgggccgagcgcgctgcctgagctgagccgccgtaggtgaggggcccgcgtccccgcccgccctgggcgccgcgcctggcactgatcctgccggtcgcccactgtcgccgccgccgccgcccgcgggcaccatgacagctctgagcgctggggttacagactgtggttttgtgcttgctcaccaaagctaacctcagcatgctcaaaaggaagcagagttccagggtggaagcccagccagtcactgactttggtcctgatgagtctctgtcggataatgctgacatcctctggattaacaaaccatgggttcactctttgctgcgcatctgtgccatcatcagcgtcatttctgtttgtatgaatacgccaatgaccttcgagcactatcctccacttcagtatgtgaccttcactttggatacattattgatgtttctctacacggcagagatgatagcaaaaatgcacatccggggcattgtcaagggggatagttcctatgtgaaagatcgctggtgtgtttttgatggatttatggtcttttgcctttgggtttctttggtgctacaggtgtttgaaattgctgatatagttgatcagatgtcaccttggggcatgttgcggattccacggccactgattatgatccgagcattccggatttatttccgatttgaactgccaaggaccagaattacaaatattttaaagcgatcgggagaacaaatatggagtgtttccatttttctacttttctttctacttctttatggaattttaggagttcagatgtttggaacatttacttatcactgtgttgtaaatgacacaaagccagggaatgtaacctggaatagtttagctattccagacacacactgctcaccagagctagaagaaggctaccagtgcccacctggatttaaatgcatggaccttgaagatctgggacttagcaggaactagtatattcaccgtctatgaggccgcctcacaggaaggctgggtgttcctcatgtacagagcaattgacagctttccccgttggcgttcctacttctatttcatcactctcattttcttcctcgcctggcttgtgaagaacgtgtttattgctgttatcattgaaacatttgcagaaatcagagtacagtttcaacaaatgtggggatcgagaagcagcactacctcaacagccaccacccagatgtttcatgaagatgctgctggaggttggcagctggtagctgtggatgtcaacaagccccagggacgcgccccagcctgcctccagaaaatgatgcggtcatccgttttccacatgttcatcctgagcatggtgaccgtggacgtgatcgtggcggctagcaactactacaaaggagaaaacttcaggaggcagtacgacgagttctacctggcggaggtggcttttacagtactttttgatttggaagcacttctgaagatatggtgtttgggatttactggatatattagctcatctctccacaaattcgaactactactcgtaattggaactactcttcatgtatacccagatctttatcattcacaattcacgtactttcaggttctccgagtagttcggctgattaagatttcacctgcattagaagactttgtgtacaagatatttggtcctggaaaaaagcttgggagtttggttgtatttactgccagcctcttgattgttatgtcagcaattagtttgcagatgttctgctttgtcgaagaactggacagatttactacgtttccgagggcatttatgtccatgttccagatcctcacccaggaaggatgggtggacgtaatggaccaaactctaaatgctgtgggacatatgtgggcacccgtggttgccatctatttcattctctatcatctttttgccactctgatcctcctgagtttgtttgttgctgttattttggacaacttagaacttgatgaagacctaaagaagcttaaacaattaaagcaaagtgaagcaaatgcggacaccaaagaaaagctccctttacgcctgcgaatctttgaaaaatttccaaacagacctcaaatggtgaaaatctcaaagcttccttcagattttacagttcctaaaatcagggagagttttatgaagcagtttattgaccgccagcaacaggacacatgttgcctcctgagaagcctcccgaccacctcttcctcctcctgcgaccactccaaacgctcagcaattgaggacaacaaatacatcgaccaaaaagtaagatctgctgtttcgaataaccaggcttctaaaaagcatctatgtttgagaaaagaaccgcagagttctttagggtcctggaatccaatttctcaagagaataatgaaaataaaatgatttcatttgtaaaagatatcatgaaacctaacattttttactctatgcattgaaattttgcatttgcccgtgtaagcttttgagctgcgccacgtggcagccatgcgactttgtaaacatcaagagcctcccaaatctgcattttctcaggtgcggaataaagggctgggatctccaaggctcagtccaggtgtaatgacctgccatctcctgc

SEQ ID NO: 207771 - DNA, 2653 bp, Homo sapiens
agcgtgagccgcggccccagccgggccgagcgcgctgcctgagctgagccgccgtaggtgaggggcccgcgtccccgcccgccctgggcgccgcgcctggcactgatcctgccggtcgcccactgtcgccgccgccgccgcccgcgggcaccatgacagctctgagcgctggggttacagactgtggttttgtgcttgctcaccaaagctaacctcagcatgctcaaaaggaagcagagttccagggtggaagcccagccagtcactgactttggtcctgatgagtctctgtcggataatgctgacatcctctggattaacaaaccatgggttcactctttgctgcgcatctgtgccatcatcagcgtcatttctgtttgtatgaatacgccaatgaccttcgagcactatcctccacttcagtatgtgaccttcactttggatacattattgatgtttctctacacggcagagatgatagcaaaaatgcacatccggggcattgtcaagggggatagttcctatgtgaaagatcgctggtgtgtttttgatggatttatggtcttttgcctttgggtttctttggtgctacaggtgtttgaaattgctgatatagttgatcagatgtcaccttggggcatgttgcggattccacggccactgattatgatccgagcattccggatttatttccgatttgaactgccaaggaccagaattacaaatattttaaagcgatcgggagaacaaatatggagtgtttccatttttctacttttctttctacttctttatggaattttaggagttcagatgtttggaacatttacttatcactgtgttgtaaatgacacaaagccagggaatgtaacctggaatagtttagctattccagacacacactgctcaccagagctagaagaaggctaccagtgcccacctggatttaaatgcatggaccttgaagatctgggacttagcaggcgagagctgggctacagtggctttaatgagataggaactagtatattcaccgtctatgaggccgcctcacaggaaggctgggtgttcctcatgtacagagcaattgacagctttccccgttggcgttcctacttctatttcatcactctcattttcttcctcgcctggcttgtgaagaacgtgtttattgctgttatcattgaaacatttgcagaaatcagagtacagtttcaacaaatgtggggatcgagaagcagcactacctcaacagccaccacccagatgtttcatgaagatgctgctggaggttggcagctggtagctgtggatgtcaacaagccccagggacgcgccccagcctgcctccagaaaatgatgcggtcatccgttttccacatgttcatcctgagcatggtgaccgtggacgtgatcgtggcggctagcaactactacaaaggagaaaacttcaggaggcagtacgacgagttctacctggcggaggtggcttttacagtactttttgatttggaagcacttctgaagatatggtgtttgggatttactggatatattagctcatctctccacaaattcgaactactactcgtaattggaactactcttcatgtatacccagatctttatcattcacaattcacgtactttcaggttctccgagtagttcggctgattaagatttcacctgcattagaagactttgtgtacaagatatttggtcctggaaaaaagcttgggagtttggttgtatttactgccagcctcttgattgttatgtcagcaattagtttgcagatgttctgctttgtcgaagaactggacagatttactacgtttccgagggcatttatgtccatgttccagatcctcacccaggaaggatgggtggacgtaatggaccaaactctaaatgctgtgggacatatgtgggcacccgtggttgccatctatttcattctctatcatctttttgccactctgatcctcctgagtttgtttgttgctgttattttggacaacttagaacttgatgaagacctaaagaagcttaaacaattaaagcaaagtgaagcaaatgcggacaccaaagaaaagctccctttacgcctgcgaatctttgaaaaatttccaaacagacctcaaatggtgaaaatctcaaagcttccttcagattttacagttcctaaaatcagggagagttttatgaagcagtttattgaccgccagcaacaggacacatgttgcctcctgagaagcctcccgaccacctcttcctcctcctgcgaccactccaaacgctcagcaattgaggacaacaaatacatcgaccaaaaacttcgcaagtctgttttcagcatcagggcaaggaaccttctggaaaaggagaccgcagtcactaaaatcttaagcaagaggccattaccgacgagctcacccattagcatccgctgttgtctctacttgggaagatcacattgtcactctagtggagtcagaatgtataggctttttccacacccttgttctgggacattaagaaagaagacatggagacaaagaagaaaagaaccggggaccccctgctactgtgtctataaacaactagtggtgtttaaaggctaataaagctccaaagatctctcttataaaa

SEQ ID NO: 207772 - DNA, 2530 bp, Homo sapiens
agcgtgagccgcggccccagccgggccgagcgcgctgcctgagctgagccgccgtagactgtggttttgtgcttgctcaccaaagctaacctcagcatgctcaaaaggaagcagagttccagggtggaagcccagccagtcactgactttggtcctgatgagtctctgtcggataatgctgacatcctctggattaacaaaccatgggttcactctttgctgcgcatctgtgccatcatcagcgtcatttctgtttgtatgaatacgccaatgaccttcgagcactatcctccacttcagtatgtgaccttcactttggatacattattgatgtttctctacacggcagagatgatagcaaaaatgcacatccggggcattgtcaagggggatagttcctatgtgaaagatcgctggtgtgtttttgatggatttatggtcttttgcctttgggtttctttggtgctacaggtgtttgaaattgctgatatagttgatcagatgtcaccttggggcatgttgcggattccacggccactgattatgatccgagcattccggatttatttccgatttgaactgccaaggaccagaattacaaatattttaaagcgatcgggagaacaaatatggagtgtttccatttttctacttttctttctacttctttatggaattttaggagttcagatgtttggaacatttacttatcactgtgttgtaaatgacacaaagccagggaatgtaacctggaatagtttagctattccagacacacactgctcaccagagctagaagaaggctaccagtgcccacctggatttaaatgcatggaccttgaagatctgggacttagcaggcgagagctgggctacagtggctttaatgagataggaactagtatattcaccgtctatgaggccgcctcacaggaaggctgggtgttcctcatgtacagagcaattgacagctttccccgttggcgttcctacttctatttcatcactctcattttcttcctcgcctggcttgtgaagaacgtgtttattgctgttatcattgaaacatttgcagaaatcagagtacagtttcaacaaatgtggggatcgagaagcagcactacctcaacagccaccacccagatgtttcatgaagatgctgctggaggttggcagctggtagctgtggatgtcaacaagccccagggacgcgccccagcctgcctccagaaaatgatgcggtcatccgttttccacatgttcatcctgagcatggtgaccgtggacgtgatcgtggcggctagcaactactacaaaggagaaaacttcaggaggcagtacgacgagttctacctggcggaggtggcttttacagtactttttgatttggaagcacttctgaagatatggtgtttgggatttactggatatattagctcatctctccacaaattcgaactactactcgtaattggaactactcttcatgtatacccagatctttatcattcacaattcacgtactttcaggttctccgagtagttcggctgattaagatttcacctgcattagaagactttgtgtacaagatatttggtcctggaaaaaagcttgggagtttggttgtatttactgccagcctcttgattgttatgtcagcaattagtttgcagatgttctgctttgtcgaagaactggacagatttactacgtttccgagggcatttatgtccatgttccagatcctcacccaggaaggatgggtggacgtaatggaccaaactctaaatgctgtgggacatatgtgggcacccgtggttgccatctatttcattctctatcatctttttgccactctgatcctcctgagtttgtttgttgctgttattttggacaacttagaacttgatgaagacctaaagaagcttaaacaattaaagcaaagtgaagcaaatgcggacaccaaagaaaagctccctttacgcctgcgaatctttgaaaaatttccaaacagacctcaaatggtgaaaatctcaaagcttccttcagattttacagttcctaaaatcagggagagttttatgaagcagtttattgaccgccagcaacaggacacatgttgcctcctgagaagcctcccgaccacctcttcctcctcctgcgaccactccaaacgctcagcaattgaggacaacaaatacatcgaccaaaaacttcgcaagtctgttttcagcatcagggcaaggaaccttctggaaaaggagaccgcagtcactaaaatcttaagcaagaggccattaccgacgagctcacccattagcatccgctgttgtctctacttgggaagatcacattgtcactctagtggagtcagaatgtataggctttttccacacccttgttctgggacattaagaaagaagacatggagacaaagaagaaaagaaccggggaccccctgctactgtgtctataaacaactagtggtgtttaaaggctaataaagctccaaagatctctcttataaaa

SEQ ID NO: 207773 - DNA, 2579 bp, Homo sapiens
agcgtgagccgcggccccagccgggccgagcgcgctgcctgagctgagccgccgtaggtgaggggcccgcgtccccgcccgccctgggcgccgcgcctggcactgatcctgccggtcgcccactgtcgccgccgccgccgcccgcgggcaccatgacagctctgagcgctggggttacagactgtggttttgtgcttgctcaccaaagctaacctcagcatgctcaaaaggaagcagagttccagggtggaagcccagccagtcactgactttggtcctgatgagtctctgtcggataatgctgacatcctctggattaacaaaccatgggttcactctttgctgcgcatctgtgccatcatcagcgtcatttctgtttgtatgaatacgccaatgaccttcgagcactatcctccacttcagtatgtgaccttcactttggatacattattgatgtttctctacacggcagagatgatagcaaaaatgcacatccggggcattgtcaagggggatagttcctatgtgaaagatcgctggtgtgtttttgatggatttatggtcttttgcctttgggtttctttggtgctacaggtgtttgaaattgctgatatagttgatcagatgtcaccttggggcatgttgcggattccacggccactgattatgatccgagcattccggatttatttccgatttgaactgccaaggaccagaattacaaatattttaaagcgatcgggagaacaaatatggagtgtttccatttttctacttttctttctacttctttatggaattttaggagttcagatgtttggaacatttacttatcactgtgttgtaaatgacacaaagccagggaatgtaacctggaatagtttagctattccagacacacactgctcaccagagctagaagaaggctaccagtgcccacctggatttaaatgcatggaccttgaagatctgggacttagcaggcgagagctgggctacagtggctttaatgagataggaactagtatattcaccgtctatgaggccgcctcacaggaaggctgggtgttcctcatgtacagagcaattgacagctttccccgttggcgttcctacttctatttcatcactctcattttcttcctcgcctggcttgtgaagaacgtgtttattgctgttatcattgaaacatttgcagaaatcagagtacagtttcaacaaatgtggggatcgagaagcagcactacctcaacagccaccacccagatgtttcatgaagatgctgctggaggttggcagctggtagctgtggatgtcaacaagccccagggacgcgccccagcctgcctccagaaaatgatgcggtcatccgttttccacatgttcatcctgagcatggtgaccgtggacgtgatcgtggcggctagcaactactacaaaggagaaaacttcaggaggcagtacgacgagttctacctggcggaggtggcttttacagtactttttgatttggaagcacttctgaagatatggtgtttgggatttactggatatattagctcatctctccacaaattcgaactactactcgtaattggaactactcttcatgtatacccagatctttatcattcacaattcacgtactttcaggttctccgagtagttcggctgattaagatttcacctgcattagaagactttgtgtacaagatatttggtcctggaaaaaagcttgggagtttggttgtatttactgccagcctcttgattgttatgtcagcaattagtttgcagatgttctgctttgtcgaagaactggacagatttactacgtttccgagggcatttatgtccatgttccagatcctcacccaggaaggatgggtggacgtaatggaccaaactctaaatgctgtgggacatatgtgggcacccgtggttgccatctatttcattctctatcatctttttgccactctgatcctcctgagtttgtttgttgctgttattttggacaacttagaacttgatgaagacctaaagaagcttaaacaattaaagcaaagtgaagcaaatgcggacaccaaagaaaagctccctttacgcctgcgaatctttgaaaaatttccaaacagacctcaaatggtgaaaatctcaaagcttccttcagattttacagttcctaaaatcagggagagttttatgaagcagtttattgaccgccagcaacaggacacatgttgcctcctgagaagcctcccgaccacctcttcctcctcctgcgaccactccaaacgctcagcaattgaggacaacaaatacatcgaccaaaaacttcgcaagtctgttttcagcatcagggcaaggaaccttctggaaaaggagaccgcagtcactaaaatcttaagagcttgcacccgacagcgcatgctgagcggatcatttgaggggcagcccgcaaaggagaggtcaatcctcagcgtgcagcatcatatccgccaagagcgcaggtcactaagacatggatcaaacagccagaggatcagcaggggaaaatctcttgaaactttgactca

SEQ ID NO: 207774 - DNA, 626 bp, Homo sapiens
gcctgactcctgggtgggtggggtacaggcagttaggtgctgaatgaagctgccatccttgctgcagcttctaactggtaaaaagatccaggatggagatgggaaggttagaaaggcagccctcacctctgaggacagaggccggggtccaggcccgtgggcgcaaaggtgcctcatagcatagccagcattcagcacacacaaacctactgcccacatttgggctcagggttggccatttgctagttctgctgccctcttaagatctgactgccaaataaatcatcctcatgtccttttaaaaaaaaaaaaaaaaaaaaaaaaaaaaaaaaaaaaaaaaaaaaaacaaaaaaaaaaaaaaaacacaaaaaagaaagcgaaaacggaacaacgaaaaaaaaagaaaagaaaagcaacaaacaaaaaaaagaaggagaacaaacaaaaaagaaaaaggaagaaccaagagaacgccgacaagaccgacaaaacgggcaacaacgataaccgcacacaactccgacagaaagcaaacggcaggacgggaagaagaacagggagcagacaccagagccgcggagacaaaaaacccacgcaagacccgaacaggagctacgcaaacgaac

SEQ ID NO: 207775 - DNA, 389 bp, Homo sapiens
tgcaaaacacatgtagacatggtttcagattctacatcacaactaacctttaagaaattaccacttgttaagttttgttgcagaatcagagtattacaactatctgaaaaagctaaaataccccacccaacatactggtcataaacttcaaccagaaacatatatagcaacagattgataggaaaatccagctgtcttctatcaaggccaaacattaaggagatttacaaaaatgtaataccatcaccattccttcactaacttattttggaatatagtttttcattaaaatgttatttattaaatatattaagctgggtatgcacacctgtagtcccacctatttgggaggctgaggcaagaggatcacttcagcccaagagctcaag

SEQ ID NO: 207776 - DNA, 197 bp, Homo sapiens
cgtgcactctgggccaccgagatgagaaattcagattgagaaacttggccggtcagtgacggagctggggctcgctctcgggtggtcttgctccagagatttgatgagaccctggttgttgcccaactctattactggccgcgtgaccttgggactctgagcccctgacttccctgtcacaccaggaaatgcttggt

SEQ ID NO: 207777 - DNA, 377 bp, Homo sapiens
tgccttcaaaatcctcttcgtgaggtttatagaattcctaagaactcaggaaagacatcagcagagagcaatgatcgtcatagccagatgcactgtcacctccattcatacagcactgactttgccctttcagtcccatggggtttacagatctgttctcctaacagcttcttgcctatttcacaatgcctattgcaaaactagctccacacagaatgcacccacccagctacttgtcgaattacaacctgatgatggatccaccagaaactaagaatggaaaggttataaagaaatcacagcattcatcttctggaagaaaaagactatttcttagaaagtaaaataaatgaataaaagcacttaataaggagcat

SEQ ID NO: 207778 - DNA, 470 bp, Homo sapiens
gtctgtagcccacgttcccagcaggggagcctccccaaaggtctctggatccccttcggaaactggaaaaagtaggaacgctgatagaggttgttctctctccctgtagcagacacagcgagttcctgaccaagtggcacacctctttccctttctaatgaaatgcagtcttcctaaggtgttcacgctcctccctgtgaccttaagcttcaaggttagcagcccatcccaactccaaagaagtccaaattgccacggactccgttcctggcaggcacagatgtagacataagcgtgagcgttaactccatcaggcgggaactgaggagaggtttttgattctgatttctttgctgataaggtgggacatggagaaagatctttccaccttttccatggattttgtcaagggagagcctggctgtgcttgaatgaggtgcctggggtgggtgcaggcctgagaagtgcca

SEQ ID NO: 207779 - DNA, 311 bp, Homo sapiens
ataaatggtttcttgaaatggaatcgctcctggtgatgatgctgtgaacactgttgaaacgataacaaaaagcagattactaaatttagttgataaagtagcagcagggttttagaggattgactctaattttgaaagaagttctactgtgggtaaattgctatcaaacagctacagaaaaatctttcatgaatggaaagtcaatcgatgagtcagactttacttccgtcttattttaagaacttggccaggcacagtggctcacgcctgtaatcccagcagtttgggaggccgagacaggcggatcattt

SEQ ID NO: 207780 - DNA, 111 bp, Homo sapiens
gcagggagggagtggctgggggaagggaggaacgtggagtgactgctctacgggtccagggtttcctttcagggggatgaaaaagttttggaattagatagtggtgatggt

SEQ ID NO: 207781 - DNA, 113 bp, Homo sapiens
tgccagagatgagagtgaataaaataaataaatgagacctgaaacttttcaatgtgtactaataggttttataccacccagtttttgcatatgagcaaaatgtaaatttccta

SEQ ID NO: 207782 - DNA, 746 bp, Homo sapiens
gagccactgcacccagcccacctttgtacttttaatgctcagggacctggggggggacccaggccaggacttgccatgtacagagtcaagaccgcccagtgtgtgcttgtctagtcccttgtgtacgtggattcaagccacataactcttctagcccagcacgctcccagcagggcccacctccccgcctaagctaactgcagtgctcttggtcggggaacccatggtctgaatgcgagtaccctgctgggtccaggacggtggagactcacgcttctccccaaccaaacagtgatctgcttgctgcctttggattaggccaggagaccctccctcactggccttttattaagaaagaaaatcagactcgtctttgaactcagaactctcaagttcatttgaactctcaaattcttgtgcctgtgtgagtttttctcctctgccttgtccagccgcggggcatgtggcgtcgtacagtccttaccaatgtttggagttgcctgccctaaggtgcggctgagaggctgagaagatgctgagtgacagtccacaggctgggagtgcagggctggtggggcttcatgctggtaaagtgaggtggttctcccagagcccatttggtaccttcctcttcagatgcacttctgatattatcttctttattctttagccatacctaaaaggcagggaagggccgcatctcacaatcctgctttacagatgggaacactgatctatagaatatg

SEQ ID NO: 207783 - DNA, 847 bp, Homo sapiens
  misc_feature (767)..(767): n is a, c, g, or t
gagccactgcacccagcccacctttgtacttttaatgctcagggacctggggggggacccaggccaggacttgccatgtacagagtcaagaccgcccagtgtgtgcttgtctagtcccttgtgtacgtggattcaagccacataactcttctagcccagcacgctcccagcagggcccacctccccgcctaagctaactgcagtgctcttggtcggggaacccatggtctgaatgcgagtaccctgctgggtccaggacggtggagactcacgcttctccccaaccaaacagtgatctgcttgctgcctttggattaggccaggagaccctccctcactggccttttattaagaaagaaaatcagactcgtctttgaactcagaactctcaagttcatttgaactctcaaattcttgtgcctgtgtgagtttttctcctctgccttgtccagccgcggggcatgtggcgtcgtacagtccttaccaatgtttggagttgcctgccctaaggtgcggctgagaggctgagaagatgctgagtgacagtccacaggctgggagtgcagggctggtggggcttcatgctggtaaagtgaggtggttctcccagagcccatttggtaccttcctcttcagatgcacttctgatattatcttcttaaaagtaaataatagatacgcactgacgaggacaaaaagtaggtgaagcgcagcccacatcagatgcccaggccaaatcagatgccagttcaaatcagaggcccagntcaaatcacatgcccagttcaaatcagacgcccaggtcaaatcaaatcacatgcccagttcaaatcaatcatgccccatt

SEQ ID NO: 207784 - DNA, 306 bp, Homo sapiens
gcctagatggcctctgttgggacagctgaactctcctccacatagtctctcatcctccactagcattgcctgggcttttttagatggctgtggtgacactccaagtgaagggacagaagcacacatgacggctccctgaggccaggaatcagaacgggcccaccatcactcccaccgcacactactgaccaaaacaaatcactggccagcccagattcaaggcgaggggaatagaccctaacttttggtgtgaggaactgccaaatcatgtgacaaagagtggggatataagtaggagggaagact

SEQ ID NO: 207785 - DNA, 1311 bp, Homo sapiens
agcggagcggctcacgccgaccaaggccttgtcagaaggctcgaggccgagctcacgctgtgcaagacgacagggcccttcccgaggcgcgcgtgcgcacggccatttgcaccctgccctttcaaccccgtcgtctcgtgcccagcacatcttggctggaactggtaggggcgtggcctggcctcaggaacgcactcttgctctgctcctcacgcctcgcgcaggatcctcgcgccgggaggattcgcacccaaccccaagcccggttgggaacgtggtgtccgagaccgtctgggatccccgcgcgcacggccggcttcccgggacccgcgcgagacgctgtctgatcgggctccctagagtggggcccggagaaaccagaacggcgggggcagcctcacgccattttgcacgccctgagatgtttggttccagcagatacttgggttcctctgaacagcccagagctaattcactgggtcccagtgacaggaccttggttttgtgctccctagtggaaggggaagataaggtcaacccctccgaaccacatggactgagaatggaggagaaatggttgctcaaaggaaaactgaggaatcagaggaaccaaaacaagctcctgtccccaaacaagaagcagaggaaaaaccacactagcaagctgcaagagttggcactgctgctgcccatagccctgaagacggggaccaagaagctcacaaagaaggagattctggtgcatgtcctgcagtacattcagtacctccagagaaacatcgatgccgccaaggccttgttcaaatgccacatcaccactggggaaggtggacttgcggggctgggtcagaaaccagcctggggcccagccaggcggaggagacactctaccccctccagctccccaagctctcagaagtcctgtctccagggggcgtgccagaagcctcggaagaagaagctgacccaggcatcagaaagccagactcggaccccgaagcctcgccgctctctggccctgaacaagcctgagaagctggtggccccatccccagaccagaaaggaagtggcacaggggggaccactacccctccaaggtgccctgactcctgcggtcacccgaggcctgcatcatcctcacctccaggtgacagaaaaggaggacagtcccagctgacgctgttggatctggccgaggacaccatccactgtgacatctcaagctgctggtgccagggcagtgtccaggatgacgcacctttccctgcgctcctggctcaggaagatgtggcgaggatccattttctcaa

SEQ ID NO: 207786 - DNA, 216 bp, Homo sapiens
ctttgaagtcctggatgtgagtgagatggggccgaggggggagtccagaggagctgagaacagggctttgatgaactccagcatgtaaaggcaggtggaagaggatgaactggcagaggagaggacactgagaaagatgaggaaggaaggaagcagaagagtgcagtccttctggtccttctgaaccatgcacttgctcacggccctcccttatgc

SEQ ID NO: 207787 - DNA, 544 bp, Homo sapiens
agggattctgattaaaacatggtgtgccttaaaatacacagagtagctgatggagtaaggaaagctccacaggatgcacaggcgtagatgtgttctggagcggcatgccagccagtgcaagggagcagggtccattcgtgcgagaggcagctgcaatggatgcccggtccaaaatgtccagcgactccatgctgagcagggcccaggctttaatttaggatgaaaccccaaagtaagtgtgttactgtgtcatttgacaaatccaaaaagaatgagaaatcaactgatgagtggcttggatatgttcatctctggtttaagtggacatcataatatgtatctacaggagtccattaaactggaaattaatctgaaagaacttgaagactttttcttctttgttaagcagttatagagcttgtttccattaaaagacttcttcctacagttttaaaagttgaaggtgtctgttctgcaaagtgctgcactcagttaaataagctggttattggctaaaataaagattgaattgaagttatctgtg

SEQ ID NO: 207788 - DNA, 391 bp, Homo sapiens
atcagtgaaattgcggctgcactaatggctactcttaaactaaaagcaggttcaggaaggccacatcaacagccaggggatttttgagttctgccagcatcacaacatagagccttttaggaaacctaaaggttcttgagacttcacaatcttcaaacactggaaatggggcacaaaacacttttcaatttccctttaactggtagatcatatggataccaaagaaacgatgtgccacagttgtacctcaggccactctcacatacaaacatgctttcaggacatgggaacgatgtcacactgccacttttctaaaataaaaggtggctaccttactccttgatcttgtaaggtgggggttggggccgagtttgtgaaaactgaaagaaag

SEQ ID NO: 207789 - DNA, 458 bp, Homo sapiens
tatttaagttacatttttaaaattattttttgttttagaaataatctctcatagtcccaacactgctgatacacactaagctttctttctgaatctaaaataaaaattgaaatttaataagaagtacaaatgagatctaattaaactaaagagcttctgcacagcaaaagaagctaccatcagagtgaacaggcaacccacaaaatgggagaaaattttcacaacctactcacctgaaaaagggctaatatccagaatctacaatgaactcaaacaaattcagaagaaaaaaacaaacaaccccatcaaaaagtgggcgaaggacatgaacagacacttctcaaaagaagacatttatgcagccaaaaaacacatgaaaaaatgctcaccatcactgattaaggagatactgcaactgataccacagaaattcaaaggattattagtatctactatga

SEQ ID NO: 207790 - DNA, 684 bp, Homo sapiens
tgccactgcactccagcctggcgacagagtgagactctgtctcaaaaaaaaaaaaatacacatatatgtgtgtgtatatatgtgtgtgtatatatatacacactaatagtatggataactcaatagctttcacattgattgaagtttttgaattgtcccatgtcttaactgattcttgtaatgacagatgaatgagaaggcaccatagagacactcaagggtttgcaaatccagtcgaatacacctatttagacctaagaaggagatccacacagcacataaaaacatccgtgtggaagtcataggtgtttagaatggaatgctttactgtgagtgtgagacggggaactgtcttctaaagtggtcagtttctcccaacagtggcatagctgtgcatctcattaatggacagaactggtattgagtttagacttgggccattttgacaactctgtgtgcttctcgagcttcccatgatagcaagaatggcagtcaagtcagcagtccccaacctttttggcactagggaccggttttgtggaagacagtttttccgtggaccttggggtggggagggatagttttgagatgaaactgttccaccccagatcatgaggcattggattctcataaggaacatgcagcctagatccctcatgcacagtttacaatagggttcatgct

SEQ ID NO: 207791 - DNA, 275 bp, Homo sapiens
atgaaggtaaatactctgggacttgtttttggttttagtttttgatcactattccaaggaggttggttccttttcaatcccccctgcccccacctggtagtctgaatttgagaaatatgtacctacacattatgtggggggtgggggagatctagtcctgattaacgtggcatatttttgtttacttgaaaattgcttcccaagattcaatctggttttcagaaaattttaaaattacattcccacgtacaaataaattgtatgctttctggata

SEQ ID NO: 207792 - DNA, 562 bp, Homo sapiens
tgcctcaaatctcagtttgatttagatcatggaaataatgccttttatctgtatggacatcagagtttactcagcccctttccctctgcccccttcatttgatctgcactctctaacctcatgaagttgtctgaactagtgttattattctcattttgccaatgagtgaatgagactcagaagaaagcatctaggttagagatttctaggcaatgtttctaatgtttccttcagtaaaattgttgttgctctatcaagtatatgagctggttgctgttttctgtctttgatgagtgacaggattcccttttatgtgtctcactgggtctgtctcctagaggcctcatgagacttaatgagtagtatctgtaaggtgcttgaggatccccagataaaaggagcacctgttagcatttatgatggaagtagcggggcctcttgaaaagctgtgcccttgttgttaataatgctggctagaggagttgcaggcgaggctttgcccaaagcctttattagtcattactctcaggaaatgcagcctcaccaggatgttactttgtaa

SEQ ID NO: 207793 - DNA, 939 bp, Homo sapiens
actgagaggagacacaaggagcagcccgcaagcaccaagtgagaggcatgaagttacagtgtgtttccctttggctcctgggtacaatactgatattgtgctcagtagacaaccacggtctcaggagatgtctgatttccacagacatgcaccatatagaagagagtttccaagaaatcaaaagagccatccaagctaaggacaccttcccaaatgtcactatcctgtccacattggagactctgcagatcattaagcccttagatgtgtgctgcgtgaccaagaacctcctggcgttctacgtggacagggtgttcaaggatcatcaggagccaaaccccaaaatcttgagaaaaatcagcagcattgccaactctttcctctacatgcagaaaactctgcggcaatgtcaggaacagaggcagtgtcactgcaggcaggaagccaccaatgccaccagagtcatccatgacaactatgatcagctggaggtccacgctgctgccattaaatccctgggagagctcgacgtctttctagcctggattaataagaatcatgaagtaatgtcctcagcttgatgacaaggaacctgtatagtgatccagggatgaacaccccctgtgcggtttactgtgggagacagcccaccttgaaggggaaggagatggggaaggccccttgcagctgaaagtcccactggctggcctcaggctgtcttattccgcttgaaaatagccaaaaagtctactgtggtatttgtaataaactctatctgctgaaagggcctgcaggccatcctgggagtaaagggctgccttcccatctaatttattgtgaagtcatatagtccatgtctgtgatgtgagccaagtgatatcctgtagtacacattgtactgagtggtttttctgaataaattccatattttacctatga

SEQ ID NO: 207794 - DNA, 1031 bp, Homo sapiens
tgcacacactgacaggagtccaagaatgtgcactgagggagcgtttccgcacagatctgcgtgttccttaccactcacacatgtgcacacacatatccatgtgtgtgtgccagtgctttggggctctgttccacggggcatgaagttacagtgtgtttccctttggctcctgggtacaatactgatattgtgctcagtagacaaccacggtctcaggagatgtctgatttccacagacatgcaccatatagaagagagtttccaagaaatcaaaagagccatccaagctaaggacaccttcccaaatgtcactatcctgtccacattggagactctgcagatcattaagcccttagatgtgtgctgcgtgaccaagaacctcctggcgttctacgtggacagggtgttcaaggatcatcaggagccaaaccccaaaatcttgagaaaaatcagcagcattgccaactctttcctctacatgcagaaaactctgcggcaatgtcaggaacagaggcagtgtcactgcaggcaggaagccaccaatgccaccagagtcatccatgacaactatgatcagctggaggtccacgctgctgccattaaatccctgggagagctcgacgtctttctagcctggattaataagaatcatgaagtaatgtcctcagcttgatgacaaggaacctgtatagtgatccagggatgaacaccccctgtgcggtttactgtgggagacagcccaccttgaaggggaaggagatggggaaggccccttgcagctgaaagtcccactggctggcctcaggctgtcttattccgcttgaaaatagccaaaaagtctactgtggtatttgtaataaactctatctgctgaaagggcctgcaggccatcctgggagtaaagggctgccttcccatctaatttattgtgaagtcatatagtccatgtctgtgatgtgagccaagtgatatcctgtagtacacattgtactgagtggtttttctgaataaattccatattttacctatga

SEQ ID NO: 207795 - DNA, 382 bp, Homo sapiens
agcattttaggaaacttctttgagattttgaaactcctttgaaaacttcttgagattttgaaaatcaaagaattatttgtggaaaagggaagaaaatgccttcattcaacacgtttattggaccctgaatgtgtgagacattgttgtaggtagcgtagatacagatatgtgctaaataaatacatacataagaccattatccctggagagcttttgatctgctgtgggagagaaagtttgtagtgtgatgcagaggtgtgactaaactgccatggagatgggatggagtagctgacctttgaaatcaaggatgaattctagttttacaggatgaagggcacgggtggcaggaagacattccaggcatatagtatagtgtatt

SEQ ID NO: 207796 - DNA, 532 bp, Homo sapiens
tattatttcaaaggccactataaaggcagagaaattgagaaatactgagatgacagttttaagtataattaagcaatttgcttacaaaattacccaaagcaaatttttcttattttaaagtatttagttgttaagtaagaccaattatttaatttctatatctacacttacagtttaagatacacactttcctcatattatagtccaggtcttgacctaattatgtgactttgaataaatcccacatatctacagaatgtttcttccagctgcaataacctagaactagttagagagattttggtctcttctattaatatttagagaataatatatcagcataggtgtacatgtagaaacatgctgaaaaactaaattgttagctctagtcttatttcagttaactttatagtcagacattactactaaaaatgttttttaaacttgaagttactttcaaggctaaaaagttacacaattgtgagtatagtttcacgattgaggtatttcacaatttcattcacagttgtga

SEQ ID NO: 207797 - DNA, 330 bp, Homo sapiens
aattgcttttgaggacttagccataaattcttcgccaaggtcaatatcaagaaaggtatttcctagaatttcttctagaattttgtagtttgaggtcttacatttaattctttagtccatcttgagtgaatttttgaatctgatgaaaggtaggggtccagtttcattcttctgcatatgggtaaccagttatcccagtaccatttattgaacagggagtcttttccctattgctctttttgttgagtttgtcaaagatcagatggttgtaggtgtgtagctttatttctgggttttctattctgttctcttagtctgtgtgtctgtttt

SEQ ID NO: 207798 - DNA, 370 bp, Homo sapiens
atcagtgccggcctcattttattcacggcatgttcatcgtgcaggcaataggagcgggaggctgctttctgtccttggcttctaaccacatggttgcatcctggtgtgtttttctatttgtgtatatttgagagaacaataagttatgtttatgctttcctttcaagaaggagagtctatatttttcatccttggacttaatcagagcctaatttttgtaaaaaattcatttacttgaagtacaaagctattgtgtgttgcacttggggtttctttttgtgttgttttgataaagaaggattccaaggccaaagtttcccagtgtcattttaagtaagacctgcaaaatattcagggtcttaggtgaaaa

SEQ ID NO: 207799 - DNA, 376 bp, Homo sapiens
aagaaaggaataattaacttagaatcctgccacttcacagccttactgaaatagtgaatctaggccatgaccattaatggccactgaaatcactgggtaaaagctgacaaggtacaagggaataatcaaactgataacacctgaaacctgatcaatcataacatcacagacagagatcatttgccacatgatgtaatacaacaaaaaaataccaccacttaagaagtattctttgaaaaaacaaagtgaaacaaaaaacctggattcaatgcagtcaagacataaaccagtatacagaaaatgcaggtaaaacaagattggccttgttgcagtagggtgatgaatatggggaggtattcctaataatatgtaaagg

SEQ ID NO: 207800 - DNA, 796 bp, Homo sapiens
caaagggaaccaggagaagaagaacttgataacaggaccttgcataattaatcgattgatcactgaacttcattgtcatatttctacggtcaaattttgggagaaagctgtcgcaaattcatcagagtgtagcaatgcccgagttgtaactgagttccatctggataaaaccaagatagaaattgtgcctcataattgatattttgaggattccatgaagtaataaatttattatgtgctaagaaatatgtgcctgatggagtcttgttctgttgcccaggatggagtacagtgacacgatctcagcttactgcaaccactgcctcccaggttcaagcgattctcctgcttagcctactgagtagctgggactacctacaggcttgcgcttccatagctgactaattcttgtatttttggtagagatggggtttcaccatactggccaggctggtgttgaactgacctcaggtgatacacctgcctgggcctcccaaagtgctgagattacaggcgtgagccaccatgcctggcctattttggtatttacttatatttgaatattcttaactctgttattggtttatgtaaacaaatagttaagaactttcaaagataagtgtattttcacaattagtttcatgataatttttgctgcatcttatccttgtaacaaaatgttatataacctcagggaagaaaattatcttcactgacactttatcttctaaaaaagatttttaattgaggtgtagcaaaaataaaacattaaatctcagtgtacaagctggtgagc

SEQ ID NO: 207801 - DNA, 667 bp, Homo sapiens
agctaaccaccctgcccaccccacttcacaacaagcccagatctctcccacccggacctaaacttacccagtctgtaagcgggggcgggctctggccttagttggtgtccccctccgcgggtgtttgttcggtaaacctgtgttgctgtagagccgcctccgtccgtttttcctcccgttcctgcgctaacaatgacattataccaaatgtaactgatatactaatacatgctgctgtaataaggagtcctcatttaagttactgtgtccaaaatgagtttccagtggtcctccatcttgatacatgctccagtatcacttatacagaaagggtggacatgataaaaccaagatagaaattgtgcctcataattgatattttgaggattccatgaagtaataaatttattatgtgctaagaaatatgtgcctggtatgttgatttttctaattattattttatatgtgatatatacacatacatgtaggtcatatatataaagttatgattcattctaaaagtttataagaagctgatttttattgtattgtaatttaaaatctgtaatttctgtaacttatgataaaataacattttacctttgtactctcttaagaatatagaatgcttataaaaatacaataaagtataatacttaagttaaaa

SEQ ID NO: 207802 - DNA, 404 bp, Homo sapiens
agccagaccttggcaatgaccttgagcagtaggatatacataattctgacaagcttagtgttccaataatgggacactaggcataaatgggttaattttccagatcatcttcctgttgatttataaaagctgaattttggtcatttttccctccttttctacttttctattgaagaaacagatggagttgctgaaactgtcaagtactcagcaattagagagaaggaggtaaagcccaaaagccttattaacatataatttcctgcacaggtttttccctctccccctagacctgctttattttacataatgccccttgcttttgacactccagccttctcattccttggagatgccatatgccctgctgctacggggcctttgcttacattgcttcctatgcc

SEQ ID NO: 207803 - DNA, 317 bp, Homo sapiens
acctttgcctccctaattgctgggttttcaggtgcaaaccactgctcctgccaatagtgacacattttacaaatgtttgccattcagacattcaggactttcaagtcctccttgaagccttctgtccaccttctttaccatctcttaccacttatctgcaaacttttatttaacttgtgaacacatcctacctgcagggcctcttgggagtaggtttgggtttagaaataaatttttcaggcccttagcacattttttatgtcatttgtatttgggtactagctcagcagtttattcctttgcctctttttggctct

SEQ ID NO: 207804 - DNA, 414 bp, Homo sapiens
ctgattaagtaggttatgcttctctttcatgtaatttcttttagttcaatttaatattgaagaactttgtcccttcactttctttttaaaagagaaagagattaaacctggaaagacaagacacttagccacttttatatacttcaatgcaaaaagtacctttgctacttaatagccgatgaaagttgttctctgaagcaaaataatctccatgatggctaataaaatgaacttaataatgatcagatgagagaaatgaatatttctctcatattaaagtatatacttagaattaaaattactctaaactgataaaaatttaataagggaaatgttatttttaaagtatcatttctcttgtatcttacatttcttcactagagcatagaaatatatgcaaaattacaaaaaaaa

SEQ ID NO: 207805 - DNA, 217 bp, Homo sapiens
tccccctgttgtgttgaggacactattaagttccctgccattacctggtgcttaacacatagtagatgctctattagtgttggaatggatgagctctagtgagtaagcgcctaagacaacacagaccctaaggtcttctgaacccaaccaagtgccctgtttttgctgctataccaggctgtccttcttcccactgccatcctcctggttctgttct

SEQ ID NO: 207806 - DNA, 367 bp, Homo sapiens
tgatctcccagcccctaaaatgacattctcttatgaaagaagacagaaagggaaggaaatcagtctatcacaaaaatccatctttattgctacctcttaaataattttcaaatctattcatatttctgtatttccatttatatcatgttttaacagacaaggaataagaaatcagttaattgaattgatcagggagggtctcagggaggagatgagacttgaaaatgggttttgaggtttagctattgcttggagaagagaggaaggtaggaattccaagcaaaagggaagaaaggataaaagctccaagatggacgtgatcatggtacatacatatgagtgtgattatggttatgggcaaagagac

SEQ ID NO: 207807 - DNA, 338 bp, Homo sapiens
gccgctgtactacatggactaacttgtggccataagatgaatatataattaaatgctgttccaacctagacacaatacatgctgaagggcttcagagaaggaagcaagcaactgtaaagtcgaagagtagggaaaagccgcagggaggaggaccaagaccttccaggggaggggagaggaggctcttttaggctgagggcaccacccaaataacagaaagttctagtgagctgagtcatggccaatgaggaactaaagtgtaacatactttaaagacccaccttagcctcccgctgccgcaaatctggcacggcactgaagagcagcccaactgatcc

SEQ ID NO: 207808 - DNA, 453 bp, Homo sapiens
tgagactgactgaaaacaaaaacagaactcttacagagagatcaaacattgacctttgcaatgtcatctgttgctaggatgatagttttggtaagttataaagcatggcaccctaagtatagggaatcatctaagggaactgctttctaggtatgttagagcttcgaaagtcataatgaatatttccattaatgtgaattgagtagttatttttgacatacttagtgatatcttggtattttttcttataagtttaataagctgcttatatgctattagcaattagacttgatcatttgatagaatctttagtttgtaaatgttttctttcattacctaattcatagttttatatggttctatcttactctgtttttattaggattaggttttgaacttcaaaaaatgtcctttggcctccgtcacagtggtcctgtaattacctaacctata

SEQ ID NO: 207809 - DNA, 401 bp, Homo sapiens
taaagccagtttcagtttcactgaaatcactggttacagttccttaaaattaaaggaaagtgattattttggggggtaattaaatgggaacatgtccattcaaaaaagacacaactatatacaacaccaactttgaaaataatttaaaaatgtttaaaacttgattacttttggcagaaattctatctttaatcttaaataggctatggataaggagttaaactttcttgcctattccatgcctgcagtcacctttgtccatgaatgctttgtctaacacataagtctcagtctataagtccatcatctcctaaaatttccaactgccagcacaagctgctgtaatgatggcatgatgactcacatccttacctacacatgcacttccattattcattgta

SEQ ID NO: 207810 - DNA, 186 bp, Homo sapiens
ccatactacgcccctgttagctgatactcatccccaaatcctttcatttataccaagggcttttatggccgggcgtggtggcacacgcatctgtaatcccagcactttgggaggctgaggcaggaggatctcttgagcccaggagttcaaaaccagcctgggcaacatagtgagaccctgtatcta

SEQ ID NO: 207811 - DNA, 258 bp, Homo sapiens
ggaagtaacaagaaataccgtgccctgaggttggacgtgggggaatttctcctggggctcagagtgttgtactcgtaaaacaaggatcatcgatgttgtctacaatgcatctaataatgagctggttcgtaccaagaccctggtgaagaattgcatcgtgctcatcgacagcacaccgtgccgacagtgactcctgaggaagaagagattttggcattctttttcctttcatcatatttcttctgaatttttttagat

SEQ ID NO: 207812 - DNA, 676 bp, Homo sapiens
gactggaccggcagtgaggcagatcttggggttaaactttcgccaaaatccattgttctataaataagccaaacgacttccattgaccaagcactctgacttcccaaacactgccaagaacacatccagctgaccacctggtataaatgtttaatagccaaacccaaatgtctaaagcctgcttactcagcagtccactaaggcatatgtacaggttcaaaagcaacaatatggcatgtgacagggtcacctggcaggttaaccaggcaccgaaagtatgagccacccatatgtgtggattcgtcctaacgctgtcagcccaccgggtcctgagtcctctctctggtgacaagtgggaagggtgtgagaactggagactgtccacatgtggcttcatctaaaaggtatgaccagaggcattactgacatcccaggggattcctgaccctagctgacaggtgccccagttaaaacacaccccaaagctagggctgctggaacagaaaacagctcccctcaaaggtctgcagcagcccctctgcaggcacaccgcctcaggctacatatcctcaaattcaggggatcttggaataactcgtgcattgcacaatcccactaacaagtgcggaaaattaagttactttaaaattacaaacttgggccaggcgcggtggct

SEQ ID NO: 207813 - DNA, 673 bp, Homo sapiens
gtactaggaaagagtcttgtgggctttgaacgtgcagactacacagccattgttctataaataagccaaacgacttccattgaccaagcactctgacttcccaaacactgccaagaacacatccagctgaccacctggtataaatgtttaatagccaaacccaaatgtctaaagcctgcttactcagcagtccactaaggcatatgtacaggttcaaaagcaacaatatggcatgtgacagggtcacctggcaggttaaccaggcaccgaaagtatgagccacccatatgtgtggattcgtcctaacgctgtcagcccaccgggtcctgagtcctctctctggtgacaagtgggaagggtgtgagaactggagactgtccacatgtggcttcatctaaaaggtatgaccagaggcattactgacatcccaggggattcctgaccctagctgacaggtgccccagttaaaacacaccccaaagctagggctgctggaacagaaaacagctcccctcaaaggtctgcagcagcccctctgcaggcacaccgcctcaggctacatatcctcaaattcaggggatcttggaataactcgtgcattgcacaatcccactaacaagtgcggaaaattaagttactttaaaattacaaacttgggccaggcgcggtggct

SEQ ID NO: 207814 - DNA, 491 bp, Homo sapiens
tcgcctgcatgtagttggggatgcatggggatatgctgtcacatacttttgttgtatatgttgtctgtgggatttcttttctttctctttctgtcatctgtgttgatacattgtctcttaaagaccaccctagttttcaccatctttctagaagtcctacataatacttttaaggaaagtagattctaatttaaatgaaatacagatgaatgcatttaaaacggattatgtaggctggacacggtggctcacgtctataatcttagcacttttggaggctgaggcgggcagatcacgaggtcaggaggtcgagaccagcctgaccaacagggtgaaaccccgtatctactaaaaaaatacaaaaattagctaggcgtggtggcatgtgcctgtaatcccagctactcaggtgtctgaggcaggagaatagcttgaacccaggaggcggaggttgcagtgagccaagacagcaccactgtactccagcctgg

SEQ ID NO: 207815 - DNA, 341 bp, Homo sapiens
ggctgcttgagtttcctcacagcatggcagctggtttcttccagaatgagtgagaacttgctttttatgcccttgatgtggacatcacacactcatttatttctgcagtgacagcctatcccacttactgtcgggggaggagagtacacaggatatgaatgtcagaaaacaagaccactgaagtgatcttggagcctggttgccacatgaaatatataaacaagcgaatttatggtcatacataaatggtttcacacaaaacaaaagcaaaagacccctaaaaaccagaagagcacacacagatatacacatgccatgcacatgtgagcacatagagtaaa

SEQ ID NO: 207816 - DNA, 496 bp, Homo sapiens
agcatttcagtcatttaaagtctttctcatttacttaaaaaatgcacttaagttacaaatgttcccctctgacctgcttttgtagcattccacagtaatgatatatgttgtcttattgacattctattatacctggcctgtaattttagttttgattttctctttgagcaaagatatttttagaagcatttgacattaagtataacattttatacttttctgattatattttgatgctgatttctatctctattttctagcacagtattaattttctaaattaaaaagtattttgatattttcttattagatcattgtatagtcaattctttaatttctttgggcaatttaaaaattgtgttttctctataaagaattttatgatatctatcaggtcaatgttttattcttatttgtcttttataatattacttatttctttgtccactgatatttcttgaacttagagcaataaattgaagtcaattactaaatt

SEQ ID NO: 207817 - DNA, 338 bp, Homo sapiens
aaaagcaattttttaaattgtcgtatgttcggaagggagggtcttattcaaaaagacttggacgcagagcagtgagtatccggggaagggagttgtctgaggtggtggcttggtcagaactgcattttggtgaaatccattgcagggcccagccgtggtccagcctgaagcaggcattcattccaaggtagaggagctcctggagctcctgccaggagccagaccctgttctcagtgctgggcacccagacaaagtccctgcccttgtggacatcctggcaattccatagatgtctgggaagactgcagaagccagagagaagggcctttgaagtgga

SEQ ID NO: 207818 - DNA, 502 bp, Homo sapiens
agagctggaagttagttggaactggagaatgagaccacatctgaacaccagccagagaagcaggggtcttccagaggttatccggtccagcatcccgcctccaggcagaactggactgtgctctggtccggcggcacgggttccagctctgttctgcctcctcccaacagcgtgtgagatgagcaagggatggagcctgtttcttgcacctgtgaaatggggttggtaaaggtaccccctgcatcaggtggttgtaaagattaaatgagctgatgcacactctgctcctggcacagcggaggcgctacctaagtggaagtgtgcgtcactgtcggtgtcgtgaggctctcgtctgccttgtcctgccttgggtgggagattggacctccctgggggagcctgggtggtgcaggcaggcagggctgagctgagcagcctccctgtcacctacatccctcggactaatcattttctttctgttcctcagtttccttatctgtaa

SEQ ID NO: 207819 - DNA, 827 bp, Homo sapiens
aagcctaggtttctgccactctgggtgaccctgtatttccttctggtgcccatcccttccatctgtccagttaatatttcctcctttttaaaatctccaagaagctgggtctcatccagatctcatttagaaccaactgggttttgaaagcccatgtggataatggccaccatcctaagcccaaagcgaaagatggtagaaggtggcaggtagaagtcactgcaaggaaggggatgggattttccatcctaaaagttttggagagggaaatccaggctattaaagtcataatttccaggtatttctattttccatttctcagcttcaagagaggtgttagcagtattttctccattttcagtctccctccaagctctgccctttggagaggtctgccccactctgtcaagtggaatctttccctctctggctctacctctctcatatattgaattcctccctttcccctgattagagaaggggatcaaggggggaaagagatcagccttggtccctaggcctccagaaatgccctcctaatctccaccttttcttaacccccaaaaaggattaacatccctgactttatgtgggatagtatatactgccacatcagtgtttgagtcattccccagagggaaggggaaccctcctccatcttttttgcaacatctcctatcttccttttgctgttgcttttttcccacttacacttggttttgttctatcctacactacagatttctattttgaacttgctgccttttttcatattgaaaatgtgacattgctccaagagccaaaaataaatgtgaattggaaaaaaa

SEQ ID NO: 207820 - DNA, 1167 bp, Homo sapiens
gcatgctgcaacgactctcttaatcctccaccgctacagactaaatgagggatttcttcttggtttggatccattgctggcaaagttgttatctatgcaacaagccagagaaactgcagttcaacagtacaaaaaactggaagaggaaatccagacccttcgagtttactacagtttacacaaatctttatctcaagaagaaaatctgaaggatcagtttaactatacccttagtacatatgaagaagctttaaaaaacagagagaacattgtttccatcactcaacaacaaaatgaggaactggctactcaactgcaacaagctctgacagagcgagcaaatatggaattacaacttcaacatgccagagaggcctcccaagtggccaatgaaaaagttcaaaagttggaaaggctggtggatgtactgaggaagaaggttggaaccgggaccatgaggacagtgatctgattgaaaaaaaacgacagtctggggaagcgatcacatctggtgaccaggctgcttcattcaacactgtgtaaacaccaaagccttaacttagcaaacagttgttagaagtgggacactccaaccacattccaagctgagataaaatcaaatcacaaatgtttaaccactttgctgctgacttgagttatttatccaaatatattaactatagacttttaccaatgggtagctataaggttacagcttattttgtaactattttatatctcaatatctttaatataaatctttttactgagagatcattatagaaacatgttaaagttggttaggatcatatcttcacatatggccctttctgaatcaaagtgcggcaaagtaaatattgtctaagctttaatccactgtgttaggtcaaaacttcaaatacatgcatttttcaatatagggtatatttcttaactgatgagagaggcttagacatgagtgtgtagtcttccttcaatgcgtgtatgtaatctttgttagtataaaagatattaaatataggtgccaagaattaaatgtataatttgtttaataagagatggatatattaaaattacattcatcaaggcatgatttttgtttcactacaaataatgcaaactgttttcaataaaaagaggagactgttaatgtgtacttataaattc

SEQ ID NO: 207821 - DNA, 1203 bp, Homo sapiens
cgccccgctcctccgccggatcgtctgtgggtgagtctcgagccaggaggctctgagccagtggcgattggctgacgcggtggctgcgcactcggcctgagaaactcggcaagcgcgcagtgtcgactccccggtctatgccaggcgcatctcagataccagcattgccaccggtgggtagaacactaagtgggctcttggagtccctgattccagaacttgactcttggatgacatttctggacctgctctgggccagagaggagaccacttcccttaagggaacgaggtctcactatattgcccagactggtctcgaactcctgggctcaaacagtccccctgcgttggcctcccaaagtgatggaattacaggtgtgaatcactgcatctgactatggcaaggatctctgtcactgagctaatccaaaagtaaatgagaaacttagaaaaagattgccaattccaaatcaacatatttagagaaaattggaaaaggagaagcttactacagctttatttgaggactttttaaagaacgctgggttctatctgtgagctgcaaatcttggagcaaaaaccagagacattgccagagcaaacaagaacagaaatacaaatggagaactggtcaaaagacataacccacagttatcttgaacaagaaactacggggataaataaaagtacgcagccagatgagcaactgactatgaattctgagaaaagtatgcatcggaaatccactgaattagttaatgaaataacatgtgagaacacagaatggccaggcagagatcaacgaattttcagatcatcagttcttatccagatgatgagtctgtttactgcactactgaaaaatacaacgttatggaacatagacataatgatatgcattatgaatgtatgactccttgtcaagttacttcagactcagataaagagaagacatagcatttcttctaaaagaattggatattctcagaacaagcaataaaaaggtataatatggaaagtctgataattgtatagtatgggtttagctgttgatcttctaaatttcctttgttgcccatcataattcagttttattttgcactttaatcatttaacagtagctttatgtttttgccataccttgccatcagggtatggttgagttaaggggttgaaaatgaaagcatttttttgatttcatac

SEQ ID NO: 207822 - DNA, 937 bp, Homo sapiens
cgccccgctcctccgccggatcgtctgtgggtgagtctcgagccaggaggctctgagccagtggcgattggctgacgcggtggctgcgcactcggcctgagaaactcggcaagcgcgcagtgtcgactccccggtctatgccaggcgcatctcagctaatccaaaagtaaatgagaaacttagaaaaagattgccaattccaaatcaacatatttagagaaaattggaaaaggagaagcttactacagctttatttgaggactttttaaagaacgctgggttctatctgtgagctgcaaatcttggagcaaaaaccagagacattgccagagcaaacaagaacagaaatacaaatggagaactggtcaaaagacataacccacagttatcttgaacaagaaactacggggataaataaaagtacgcagccagatgagcaactgactatgaattctgagaaaagtatgcatcggaaatccactgaattagttaatgaaataacatgtgagaacacagaatggccaggcagagatcaacgaattttcagatcatcagttcttatccagatgatgagtctgtttactgcactactgaaaaatacaacgttatggaacatagacataatgatatgcattatgaatgtatgactccttgtcaagttacttcagactcagataaagagaagacatagcatttcttctaaaagaattggatattctcagaacaagcaataaaaaggtataatatggaaagtctgataattgtatagtatgggtttagctgttgatcttctaaatttcctttgttgcccatcataattcagttttattttgcactttaatcatttaacagtagctttatgtttttgccataccttgccatcagggtatggttgagttaaggggttgaaaatgaaagcatttttttgatttcatac

SEQ ID NO: 207823 - DNA, 1012 bp, Homo sapiens
cgccccgctcctccgccggatcgtctgtgggtgagtctcgagccaggaggctctgagccagtggcgattggctgacgcggtggctgcgcactcggcctgagaaactcggcaagcgcgcagtgtcgactccccggtctatgccaggcgcatctcagctaatccaaaagtaaatgagaaacttagaaaaagattgccaattccaaatcaacatatttagagaaaattggaaaaggagaagcttactacagctttatttgaggactttttaaagaacgctgggttctatctgtgagctgcaaatcttggagcaaaaaccagagacattgccagagcaaacaagaacagaaatacaaatggagaactggtcaaaagtttgctacttcgcatatccctacttgaccttttttggagcaaatgcctttgtgaagtcttcctagagtcttccagacataacccacagttatcttgaacaagaaactacggggataaataaaagtacgcagccagatgagcaactgactatgaattctgagaaaagtatgcatcggaaatccactgaattagttaatgaaataacatgtgagaacacagaatggccaggcagagatcaacgaattttcagatcatcagttcttatccagatgatgagtctgtttactgcactactgaaaaatacaacgttatggaacatagacataatgatatgcattatgaatgtatgactccttgtcaagttacttcagactcagataaagagaagacatagcatttcttctaaaagaattggatattctcagaacaagcaataaaaaggtataatatggaaagtctgataattgtatagtatgggtttagctgttgatcttctaaatttcctttgttgcccatcataattcagttttattttgcactttaatcatttaacagtagctttatgtttttgccataccttgccatcagggtatggttgagttaaggggttgaaaatgaaagcatttttttgatttcatac

SEQ ID NO: 207824 - DNA, 929 bp, Homo sapiens
acattttcagctttgatttgccaggaacttcaggtggctgtatggaaatgtaaacctttgtatgaaggagtgtatcagtgcgtcagaacttggcacccacaaggatcttaagaaaacaggctatttgttccttggagaaactattctctaatccaaaagtaaatgagaaacttagaaaaagattgccaattccaaatcaacatatttagagaaaattggaaaaggagaagcttactacagctttatttgaggactttttaaagaacgctgggttctatctgtgagctgcaaatcttggagcaaaaaccagagacattgccagagcaaacaagaacagaaatacaaatggagaactggtcaaaagacataacccacagttatcttgaacaagaaactacggggataaataaaagtacgcagccagatgagcaactgactatgaattctgagaaaagtatgcatcggaaatccactgaattagttaatgaaataacatgtgagaacacagaatggccaggcagagatcaacgaattttcagatcatcagttcttatccagatgatgagtctgtttactgcactactgaaaaatacaacgttatggaacatagacataatgatatgcattatgaatgtatgactccttgtcaagttacttcagactcagataaagagaagacatagcatttcttctaaaagaattggatattctcagaacaagcaataaaaaggtataatatggaaagtctgataattgtatagtatgggtttagctgttgatcttctaaatttcctttgttgcccatcataattcagttttattttgcactttaatcatttaacagtagctttatgtttttgccataccttgccatcagggtatggttgagttaaggggttgaaaatgaaagcatttttttgatttcatac

SEQ ID NO: 207825 - DNA, 1686 bp, Homo sapiens
cgccccgctcctccgccggatcgtctgtgggtgagtctcgagccaggaggctctgagccagtggcgattggctgacgcggtggctgcgcactcggcctgagaaactcggcaagcgcgcagtgtcgactccccggtctatgccaggcgcatctcagctctggttgaagaagtgtattttgcgcagaaggaacgtgatgaagctgttatgtctagactgcaattagccattgaggagagagatgaagcaattgcacgagccaagcatatggaaatgtctctaaaagtgctagaaaatattaaccctgaagaaaatgacatgacattacaggaattactgaacagaataaacaatgcagacacagggatagctattcagaagaatggagctataattgtggatagaatctacaagaccaaggaatgtaaaatgagaataactgcagaagaaatgagtgcactaatagaagaacgggatgctgccttgtctaagtgcaaacggttagagcaggagcttcatcatgtgaaagagcagaaccagacttcagcaaacaacatgagacatctgactgctgaaaacaatcaagaacgtgctctgaaggcaaagttgttatctatgcaacaagccagagaaactgcagttcaacagtacaaaaaactggaagaggaaatccagacccttcgagtttactacagtttacacaaatctttatctcaagaagaaaatctgaaggatcagtttaactatacccttagtacatatgaagaagctttaaaaaacagagagaacattgtttccatcactcaacaacaaaatgaggaactggctactcaactgcaacaagctctgacagagcgagcaaatatggaattacaacttcaacatgccagagaggcctcccaagtggccaatgaaaaagttcaaaagttggaaaggctggtggatgtactgaggaagaaggttggaaccgggaccatgaggacagtgatctgattgaaaaaaaacgacagtctggggaagcgatcacatctggtgaccaggctgcttcattcaacactgtgtaaacaccaaagccttaacttagcaaacagttgttagaagtgggacactccaaccacattccaagctgagataaaatcaaatcacaaatgtttaaccactttgctgctgacttgagttatttatccaaatatattaactatagacttttaccaatgggtagctataaggttacagcttattttgtaactattttatatctcaatatctttaatataaatctttttactgagagatcattatagaaacatgttaaagttggttaggatcatatcttcacatatggccctttctgaatcaaagtgcggcaaagtaaatattgtctaagctttaatccactgtgttaggtcaaaacttcaaatacatgcatttttcaatatagggtatatttcttaactgatgagagaggcttagacatgagtgtgtagtcttccttcaatgcgtgtatgtaatctttgttagtataaaagatattaaatataggtgccaagaattaaatgtataatttgtttaataagagatggatatattaaaattacattcatcaaggcatgatttttgtttcactacaaataatgcaaactgttttcaataaaaagaggagactgttaatgtgtacttataaattc

SEQ ID NO: 207826 - DNA, 967 bp, Homo sapiens
cgccccgctcctccgccggatcgtctgtgggtgagtctcgagccaggaggctctgagccagtggcgattggctgacgcggtggctgcgcactcggcctgagaaactcggcaagcgcgcagtgtcgactccccggtctatgccaggcgcatctcagctctggttgaagaagtgtattttgcgcagaaggaacgtgatgaagctgttatgtctagactgcaattagccattgaggagagagatgaagcaattgcacgagccaagcatatggaaatgtctctaaaagtgctagaaaatattaaccctgaagaaaatgacatgacattacaggaattactgaacagaataaacaatgcagacacagggatagctattcagaagaatggagctataattgtggatagaatctacaagaccaaggaatgtaaaatgagaataactgcagaagaaatgagtgcactaatagaagaacgggatgctgccttgtctaaggtaaatgagggatttcttcttggtttggatccattgctggcaaagttgttatctatgcaacaagccagagaaactgcagttcaacagtacaaaaaactggaagaggaaatccagacccttcgagtttactacaggtttgtatgtgagaaagagaaaaaagattttgtattgggttatgtgtaaaacatattcttacagtggatcatggtagaaaacattgaaaaaacacaccgatgcacaatgccatgtatattctttcattactaagtttaaaaaatcctcaagtctgaaatgtaggaattcactaagggtgctgttaagtttttgaaagatttttgttttaatttggaccttttctcagaataaagttaaaatgcataaaatgcaattaaatcaaaataagttttactgaagtacaattaagaaaatattatgtcatgatatatcatgatatacatgcatcattattaatggata

SEQ ID NO: 207827 - DNA, 913 bp, Homo sapiens
cgccccgctcctccgccggatcgtctgtgggtgagtctcgagccaggaggctctgagccagtggcgattggctgacgcggtggctgcgcactcggcctgagaaactcggcaagcgcgcagtgtcgactccccggtctatgccaggcgcatctcagctctggttgaagaagtgtattttgcgcagaaggaacgtgatgaagctgttatgtctagactgcaattagccattgaggagagagatgaagcaattgcacgagccaagcatatggaaatgtctctaaaagtgctagaaaatattaaccctgaagaaaatgacatgacattacaggaattactgaacagaataaacaatgcagacacagggatagctattcagaagaatggagctataattgtggatagaatctacaagaccaaggaatgtaaaatgagaataactgcagaagaaatgagtgcactaatagaagaacgggatgctgccttgtctaagtgcaaacggttagagcaggagcttcatcatgtgaaagagcagaaccagacttcagcaaacaacatgagacatctgactgctgaaaacaatcaagaacgtgctctgaaggtaaatctccgttccttcttgcaggcaaattaaggttgtaagcccttggtgccagctttctgtgctgcatatatcagttgtgtacatttcagcagaagtgagctgtggtgtttgccaacaaccccttctttaaacacagatacagcacccttttgttatggtattattttatttcacgtatgtgtacgtgaaaacaacacattttctgaattttgagtggtggtatattaataacttttggtaaatgtttattctgtttcttttttatatcattaccttttgtagttaataaaaagtgaccatactaaaagaaaa

SEQ ID NO: 207828 - DNA, 689 bp, Homo sapiens
ctaatccaaaagtaaatgagaaacttagaaaaagattgccaattccaaatcaacatatttagagaaaattggaaaaggagaagcttactacagctttatttgaggactttttaaagaacgctgggttctatctgtgaggtaaatctaattttattctccttaaaagcataaaaaaaaacttgcatagtgttttatcatgtttactacaaaaacaaataagagagaggagtatcattaattccacaagttagtggtggtctttatgttttttaaaattagagtaatattcttaaattacttttataagtaaaatttattaaagtaatctatatgaatatatacacagtaaattcaaatcagtaaatttgaaatttttggtataaaatttatgacaaataaagtaaaaatgtatttttcttaaatgcttaaaattgtagttgaagaagatttcagttaaataaattaaatggttctctacccaaatcagcatgaatgtctaaaaaacttaacctgaactgtatatactaaaatacaagtgtgaagaaaagaacctttttctgagaaaaagatttaatttctcctgttgaaattctcagttaattgtcccattgtaaatgttttagaaaaccatttatcctgtaaattctctgttaaacaaaggtaagatttaggtgtgttctgatatattg

SEQ ID NO: 207829 - DNA, 978 bp, Homo sapiens
cgagggggtggggctatgcccggacagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggtgaagactgcaggccggagctagccgaattcgaaaaactctcggatcaggtgaagatcagtgaagaagccctgagagcagatggctttggagacaatcctttctatcactgtttggtagcagagattcttccagcgcccgggaagctactggggccctgcgtggtgggctatgggatatactatttcatctacagtacatggaagggacgcaccatttatctggaggatatctatgtgatgccggaatatcggggtcaagggattggttccaaaataatcaaaaaggtggctgaggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtcctga

SEQ ID NO: 207830 - DNA, 876 bp, Homo sapiens
cgagggggtggggctatgcccggacagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggtgaagactgcaggccggagctagccgaattcgaaaaactctcggatcaggtgaagatcagtgaagaagccctgagagcagatggctttggagacaatcctttctatcactgtttggtagcagagattcttccagcgcccgggaagctactgggtcaagggattggttccaaaataatcaaaaaggtggctgaggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtcctga

SEQ ID NO: 207831 - DNA, 359 bp, Homo sapiens
cactctgcatccttcaaagaaaggggaacctcctacggtcgatggcacttggaagaccccttccttcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtcctga

SEQ ID NO: 207832 - DNA, 1308 bp, Homo sapiens
  misc_feature (1180)..(1180): n is a, c, g, or t
cgagggggtggggctatgcccggacagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggtgaagactgcaggccggagctagccgaattcgaaaaactctcggatcaggtgaagatcagtgaagaagccctgagagcagatggctttggagacaatcctttctatcactgtttggtagcagagattcttccagcgcccgggaagctactggggccctgcgtggtgggctatgggatatactatttcatctacagtacatggaagggacgcaccatttatctggaggatatctatgtgatgccggaatatcggggtcaagggattggttccaaaataatcaaaaaggtggctgaggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtcctgaaaaaaaaaaaaaaaaaaaaaaaaaaaaaagttgtgtgtggggcggctggggccctgagaaaaggtttttaaaaccattgtggtgtggggggggggggccccaggggttaggtggaacatggtggcccctaaagggtgttcccagaaggagaaatccgggccgcaatgagaacaaaggtggtcggggatttccccccacattnaaaaaaagcgcggggggaatcccggaagggcttccggaaaccaattcccaggggtggagtccgcgagggcatgcgcgggttccttacagacaggggggttccaggcggaacccggaatttaaattgca

SEQ ID NO: 207833 - DNA, 1257 bp, Homo sapiens
cgagggggtggggctatgcccggacagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggtgaagactgcaggccgggccggtaacccgggggtcagagtggcgcggccagagcggggtcgtaggaggcgggggcagggggaggggctcgccttgggaacctgctcggggagcagcggggcccttctgctctaatctagcttccgtacccacgccttaggagctagccgaattcgaaaaactctcggatcaggtgaagatcagtgaagaaggtgggggctcagcgcccaggttctggcggaggctggggaggaaatgagggatgggttccccaggcgacagctccaggctgggcatacacccacgtcctctttctctatctctttgtcacaactccaatctcggcagccctgagagcagatggctttggagacaatcctttctatcactgtttggtagcagagattcttccagcgcccgggaagctactggggccctgcgtggtgggctatgggatatactatttcatctacagtacatggaagggacgcaccatttatctggaggatatctatgtgatgccggaatatcggggtcaagggattggttccaaaataatcaaaaaggtggctgaggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtcctga

SEQ ID NO: 207834 - DNA, 1269 bp, Homo sapiens
cgagggggtggggctatgcccggacagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggtgaagactgcaggccggagctagccgaattcgaaaaactctcggatcaggtgaagatcagtgaagaagccctgagagcagatggctttggagacaatcctttctatcactgtttggtagcagagattcttccagcgcccgggaagctactggggccctgcgtggtgggctatgggatatactatttcatctacagtacatggaagggacgcaccatttatctggaggatatctatgtgatgccggaatatcggggtactgggcagaagctgaggctggggtgggagcaaagcaccccacagaccccactgttatcccctgtccccagagcccagccggtgtcattttctgatccccttcagctcaaacaatagctattttttgcctctttctctccacaacaggtcaagggattggttccaaaataatcaaaaaggtggctgagtgaggtgaggagatgggtggggcgacaagtgaggacctgaagaagcaagggtatatggaggggggacccgggttgaaagagggagtgagaaaacctttttcttttttgaccccagaaaagttagtgttgtcttctcccacaggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtcctga

SEQ ID NO: 207835 - DNA, 1127 bp, Homo sapiens
cgagggggtggggctatgcccggacagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggtgaagactgcaggccggagctagccgaattcgaaaaactctcggatcaggtgaagatcagtgaagaagccctgagagcagatggctttggagacaatcctttctatcactgtttggtagcagagattcttccagcgcccgggaagctactggggccctgcgtggtgggctatgggatatactatttcatctacagtacatggaagggacgcaccatttatctggaggatatctatgtgatgccggaatatcggggtactgggcagaagctgaggctggggtgggagcaaagcaccccacagaccccactgttatcccctgtccccagagcccagccggtgtcattttctgatccccttcagctcaaacaatagctattttttgcctctttctctccacaacaggtcaagggattggttccaaaataatcaaaaaggtggctgaggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtcctga

SEQ ID NO: 207836 - DNA, 1355 bp, Homo sapiens
cgagggggtggggctatgcccggacagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggtgaagactgcaggccgggccggtaacccgggggtcagagtggcgcggccagagcggggtcgtaggaggcgggggcagggggaggggctcgccttgggaacctgctcggggagcagcggggcccttctgctctaatctagcttccgtacccacgccttaggagctagccgaattcgaaaaactctcggatcaggtgaagatcagtgaagaaggtgggggctcagcgcccaggttctggcggaggctggggaggaaatgagggatgggttccccaggcgacagctccaggctgggcatacacccacgtcctctttctctatctctttgtcacaactccaatctcggcagccctgagagcagatggctttggagacaatcctttctatcactgtttggtagcagagattcttccagcgcccgggaagctactgggtaagagcacctggcccttagaagtccacctctccagccggcctcagaggtctccccacaggcttccagaagccttactccccttttctctctctcagggccctgcgtggtgggctatgggatatactatttcatctacagtacatggaagggacgcaccatttatctggaggatatctatgtgatgccggaatatcggggtcaagggattggttccaaaataatcaaaaaggtggctgaggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtcctga

SEQ ID NO: 207837 - DNA, 1019 bp, Homo sapiens
cgagggggtggggctatgcccggacagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggtgaagactgcaggccgggccggtaacccgggggtcagagtggcgcggccagagcggggtcgtaggaggcgggggcagggggaggggctcgccttgggaacctgctcggggagcagcggggcccttctgctctaatctagcttccgtacccacgccttaggagctagccgaattcgaaaaactctcggatcaggtgaagatcagtgaagaagccctgagagcagatggctttggagacaatcctttctatcactgtttggtagcagagattcttccagcgcccgggaagctactgggtcaagggattggttccaaaataatcaaaaaggtggctgaggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtcctga

SEQ ID NO: 207838 - DNA, 1646 bp, Homo sapiens
cgagggggtggggctatgcccggacagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggtgaagactgcaggccgggccggtaacccgggggtcagagtggcgcggccagagcggggtcgtaggaggcgggggcagggggaggggctcgccttgggaacctgctcggggagcagcggggcccttctgctctaatctagcttccgtacccacgccttaggagctagccgaattcgaaaaactctcggatcaggtgaagatcagtgaagaaggtgggggctcagcgcccaggttctggcggaggctggggaggaaatgagggatgggttccccaggcgacagctccaggctgggcatacacccacgtcctctttctctatctctttgtcacaactccaatctcggcagccctgagagcagatggctttggagacaatcctttctatcactgtttggtagcagagattcttccagcgcccgggaagctactgggtaagagcacctggcccttagaagtccacctctccagccggcctcagaggtctccccacaggcttccagaagccttactccccttttctctctctcagggccctgcgtggtgggctatgggatatactatttcatctacagtacatggaagggacgcaccatttatctggaggatatctatgtgatgccggaatatcggggtactgggcagaagctgaggctggggtgggagcaaagcaccccacagaccccactgttatcccctgtccccagagcccagccggtgtcattttctgatccccttcagctcaaacaatagctattttttgcctctttctctccacaacaggtcaagggattggttccaaaataatcaaaaaggtggctgagtgaggtgaggagatgggtggggcgacaagtgaggacctgaagaagcaagggtatatggaggggggacccgggttgaaagagggagtgagaaaacctttttcttttttgaccccagaaaagttagtgttgtcttctcccacaggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtcctga

SEQ ID NO: 207839 - DNA, 1548 bp, Homo sapiens
cgagggggtggggctatgcccggacagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggtgaagactgcaggccgggccggtaacccgggggtcagagtggcgcggccagagcggggtcgtaggaggcgggggcagggggaggggctcgccttgggaacctgctcggggagcagcggggcccttctgctctaatctagcttccgtacccacgccttaggagctagccgaattcgaaaaactctcggatcaggtgaagatcagtgaagaaggtgggggctcagcgcccaggttctggcggaggctggggaggaaatgagggatgggttccccaggcgacagctccaggctgggcatacacccacgtcctctttctctatctctttgtcacaactccaatctcggcagccctgagagcagatggctttggagacaatcctttctatcactgtttggtagcagagattcttccagcgcccgggaagctactggggccctgcgtggtgggctatgggatatactatttcatctacagtacatggaagggacgcaccatttatctggaggatatctatgtgatgccggaatatcggggtactgggcagaagctgaggctggggtgggagcaaagcaccccacagaccccactgttatcccctgtccccagagcccagccggtgtcattttctgatccccttcagctcaaacaatagctattttttgcctctttctctccacaacaggtcaagggattggttccaaaataatcaaaaaggtggctgagtgaggtgaggagatgggtggggcgacaagtgaggacctgaagaagcaagggtatatggaggggggacccgggttgaaagagggagtgagaaaacctttttcttttttgaccccagaaaagttagtgttgtcttctcccacaggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtcctga

SEQ ID NO: 207840 - DNA, 1219 bp, Homo sapiens
cgagggggtggggctatgcccggacagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggtgaagactgcaggccgggccggtaacccgggggtcagagtggcgcggccagagcggggtcgtaggaggcgggggcagggggaggggctcgccttgggaacctgctcggggagcagcggggcccttctgctctaatctagcttccgtacccacgccttaggagctagccgaattcgaaaaactctcggatcaggtgaagatcagtgaagaagccctgagagcagatggctttggagacaatcctttctatcactgtttggtagcagagattcttccagcgcccgggaagctactgggtaagagcacctggcccttagaagtccacctctccagccggcctcagaggtctccccacaggcttccagaagccttactccccttttctctctctcagggccctgcgtggtgggctatgggatatactatttcatctacagtacatggaagggacgcaccatttatctggaggatatctatgtgatgccggaatatcggggtcaagggattggttccaaaataatcaaaaaggtggctgaggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtcctga

SEQ ID NO: 207841 - DNA, 1028 bp, Homo sapiens
cgagggggtggggctatgcccggacagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggtgaagactgcaggccggagctagccgaattcgaaaaactctcggatcaggtgaagatcagtgaagaagccctgagagcagatggctttggagacaatcctttctatcactgtttggtagcagagattcttccagcgcccgggaagctactggggccctgcgtggtgggctatgggatatactatttcatctacagtacatggaagggacgcaccatttatctggaggatatctatgtgatgccggaatatcggggtcaagggattggttccaaaataatcaaaaaggtggctgagtgaggtgaggagatgggtggggcgacaagtgaggacctgaagaagcaagggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtcctga

SEQ ID NO: 207842 - DNA, 926 bp, Homo sapiens
cgagggggtggggctatgcccggacagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggtgaagactgcaggccgccctgagagcagatggctttggagacaatcctttctatcactgtttggtagcagagattcttccagcgcccgggaagctactggggccctgcgtggtgggctatgggatatactatttcatctacagtacatggaagggacgcaccatttatctggaggatatctatgtgatgccggaatatcggggtcaagggattggttccaaaataatcaaaaaggtggctgaggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtcctga

SEQ ID NO: 207843 - DNA, 956 bp, Homo sapiens
  misc_feature (41)..(41): n is a, c, g, or t
aaataccccattttagcatggattatttcttgaaaaaaacncctatcagtgaagaagccctgagagcagatggctttggagacaatcctttctatcactgtttggtagcagagattcttccagcgcccgggaagctactggggccctgcgtggtgggctatgggatatactatttcatctacagtacatggaagggacgcaccatttatctggaggatatctatgtgatgccggaatatcggggtactgggcagaagctgaggctggggtgggagcaaagcaccccacagaccccactgttatcccctgtccccagagcccagccggtgtcattttctgatccccttcagctcaaacaatagctattttttgcctctttctctccacaacaggtcaagggattggttccaaaataatcaaaaaggtggctgagtgaggtgaggagatgggtggggcgacaagtgaggacctgaagaagcaagggtatatggaggggggacccgggttgaaagagggagtgagaaaacctttttcttttttgaccccagaaaagttagtgttgtcttctcccacaggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtcctga

SEQ ID NO: 207844 - DNA, 638 bp, Homo sapiens
ggatggcgtcactttcctgccaactttctcgttgcctctccttgaaagcagaagaagcccccagccctcagcttccgtcagatcttgggctcctagggccttgtacaagtccatggcccactgttatcccctgtccccagagcccagccggtgtcattttctgatccccttcagctcaaacaatagctattttttgcctctttctctccacaacaggtcaagggattggttccaaaataatcaaaaaggtggctgaggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtcctga

SEQ ID NO: 207845 - DNA, 926 bp, Homo sapiens
cgagggggtggggctatgcccggacagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggtgaagactgcaggccggagctagccgaattcgaaaaactctcggatcaggtgaagatcagtgaagaagccctgagagcagatggctttggagacaatcctttctatcactgtttggtagcagagattcttccagcgcccgggaagctactgggtcaagggattggttccaaaataatcaaaaaggtggctgagtgaggtgaggagatgggtggggcgacaagtgaggacctgaagaagcaagggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtcctga

SEQ ID NO: 207846 - DNA, 938 bp, Homo sapiens
cgagggggtggggctatgcccggacagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggtgaagactgcaggccggagctagccgaattcgaaaaactctcggatcaggtgaagatcagtgaagaagccctgagagcagatggctttggagacaatcctttctatcactgtttggtagcagagattcttccagcgcccgggaagctactggggccctgcgtggtgggctatgggatatactatttcatctacagtacatggaagggacgcaccatttatctggaggatatctatgtgatgccggaatatcggggtcaagggattggttccaaaataatcaaaaaggtggctgagtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtcctga

SEQ ID NO: 207847 - DNA, 1087 bp, Homo sapiens
cgagggggtggggctatgcccggacagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggtgaagactgcaggccggagctagccgaattcgaaaaactctcggatcaggtgaagatcagtgaagaagccctgagagcagatggctttggagacaatcctttctatcactgtttggtagcagagattcttccagcgcccgggaagctactggggccctgcgtggtgggctatgggatatactatttcatctacagtacatggaagggacgcaccatttatctggaggatatctatgtgatgccggaatatcggggtactgggcagaagctgaggctggggtgggagcaaagcaccccacagaccccactgttatcccctgtccccagagcccagccggtgtcattttctgatccccttcagctcaaacaatagctattttttgcctctttctctccacaacaggtcaagggattggttccaaaataatcaaaaaggtggctgagtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtcctga

SEQ ID NO: 207848 - DNA, 656 bp, Homo sapiens
attcctagaaggatacagggaattggcttgaactagctattttggaacttggcaaatactgcaaggcaagtcagtggtgagtttgtcacttggatatggaggtggcatgcctttctgtacatccccaaatttaactcttacaattcggaaagtgctggggctctggtgtgtctgattttagcagggttctgtaggaaatgcatgcagtgtttttgtggacgttctcagggctgactttgaaattaaaagtagccagttaagatctttgttcccctctatatattcctggtgctgtgaaccagcttggccttctgactgacacagacttctggctccaatcctcatgatacacttaagagaatgtggttgtgcctaaggtggggtctgacttttgaaaaatctctcttctgttagcttcctcatagagagagttggcaaaagaaatgagctccttgaaggcctctgaaagcagctcagaaatgtttttttgtgagaatggatgccaaaacagcagctaacagcagcttcaggcagtatagtcttgttcttgtgaaagtgcttatttaatgagaccagtagcaccgtggtaccttatctggtaccagtctgcctgccggcttttggacctgcacaccattttctctgacagtggctgt

SEQ ID NO: 207849 - DNA, 152 bp, Homo sapiens
gagataggattctgtgcttaatttcaaaaaggatttacagcttatgacagtcttagcaacttcctctaaattatgtagattactattccagtagtagatagatcaagtatccgtgttttaggacagcttttaaattgggcaaatgtaagaca

SEQ ID NO: 207850 - DNA, 430 bp, Homo sapiens
aattcagcaggaaagaagtgcaagagaaaaatattgcccgggatggtaataatttggtttgaaagtctcatagatgatgcaactccaaggtcattctttgtttcctaccaatttcaggttgcaaaaggaaagcaatatctggtagcagaaaggagcaagtgttgggtagtttcaataggacctggcagctccccctagctgagttaaaacacggctctgagcacattgctaatagtgtcagtcacaaataatcagattctgcatggttttagtatccaaatctgatcccagtttattctgagaacaaggccatctgccagccaggcaatggggaagaaaagccagcactctactgcctactattgccacctgccggctgctggtggaatcacatgctcattccttcctagagaaacttcccgttctaaca

SEQ ID NO: 207851 - DNA, 521 bp, Homo sapiens
ggtcacatggttgttaggtgctgaggatgagattaaattcaggcagattggctcttgtgctccaaacccatacatgaacacacagcaacatcaaagccttttcatggcatcttttgcatgatgcaataggtaaaaatggtccccattttattccattcaatttatataactacgtttaagaagaaataaaatcactaagagaaataaagtttggtcttgggctttagagaagcttttctgggccgggtgccgttgctcacgcctgtaatcccaacactttgggaggccgaggcgggcggatcacgaggtcagggatcgagaccatcccggctaacacggtgaaaccccgtctctactaaaaatacaaaaaattagccgggcggggtggcagacgcctgtagtcccagctacttgggaggctgaggcaggacaatggcgtgaacccgggaggcagagcttgcagtgagctgagatcgcgccactgcactccggccttcgcaacagagcaggactccgtctca

SEQ ID NO: 207852 - DNA, 422 bp, Homo sapiens
aaggtatctgagcacctcacacttttcttcatccttcctacctctattaaaaacagtttccaggaaaggctgtgagttcatttttactaaataaatggctgctggactttgatatgtggccttacccggatatcaaaagcattgtctgaagcaggatttttcacaaactcagcactattgacattttggggctaaataattatttgttgagggaagccactgttctgtgtactataggtgcttagcaggatccttgacctctacccactgaatatcaatagcactcttctcccagttgtcatgaccaaaactgctttcagacattgccaaatgtcctatgggggcaaaattacttacagttaggaatactggtctaaaaaaatgaaaattcttctgtacaatcttttgggcctcatcaaata

SEQ ID NO: 207853 - DNA, 339 bp, Homo sapiens
attattgtaggagattttcagaccatttttagctatagtcttcccaaaccaaagccttcttcttctgagggaaactaggatgaaataaagctaatctgaacggctgaatagttttttgtgggaatgcaaaaaaaaagaaccaagagcgcccctgagcagcatacctgaggcaggtaccctcaaagtacagtgcaaaaaaccactggtagaggacaagaccctggtgaggactcctgggttcaagtctttttttttttttttgagacggaatctcgcactgtcgcccaggctggagtgcagtagtgcgatctcagctcactgcaggctccgcctcccgag

SEQ ID NO: 207854 - DNA, 885 bp, Homo sapiens
tcgactctacaggatctgtcccggtatccccactgcagtttgacaaagggaaaagaaaaaaaaatacatatatgtatatatatgtatgtcaagaaaaattccaattttttcagagatacttgtttttgggcagcctattgctcagttgagattctctgaatggaccttccaggtggactttcaccttggggtggagaagaagaataattcatggaaggaaagactctccatactcagattggcatcctagccaactctttcatgggagaaacagagtaggtgtagttgatcgcccaccatatgttccatgtatggctatgtgcgcatctatcttgatttattagggacttctttctgtaattttgtaaaggtcaaagctagcataatcaccaactccaagaatatgcctgttggatccaaacagcatattgcgctgcattacatcctctgtcgaagcaactgaaatttctctgacataagcttctaacaagggtgggaatatgaattatgcacataatgtacttgttattttgggaggatgctttagacagtcactcagtcaataagtattagttgaatggttacaaattttctaacactgtgctaggcactgtgggaaatacaaaagaagtataatacatggtctttacccacctgagtctacagtgttattgtggaggcaagacaacgaaatttttcaaaagtatagatgagcaaatgcttcattgtatggtaccgagattggatgtagtctcagagagagggaagtatcatccaagaaggctttgcaaaatcaagtcttgaaagatggataggatttggagagagcaagacctttttattttagggaaacagcacatgttaagggaggaaagggtatggtat

SEQ ID NO: 207855 - DNA, 288 bp, Homo sapiens
caacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcg

SEQ ID NO: 207856 - DNA, 191 bp, Homo sapiens
gctgggattacaggagtgagccttggctcccagctcaggtctactcttgaatgtcttggcatggctggagagtatctcacggcctagcagatgataacactgtgcattcacaatcaccaaacacaattggcttctcctcatggcatggcaagcttagtactactttcttttaggaagcaccatcctgcttt

SEQ ID NO: 207857 - DNA, 546 bp, Homo sapiens
gccagtctgaaagatctacatgctatatgattctaattctatgacattctggaagaggcaccactatggcatcaggaacaaggcagtgtttcccaggggttctgatggagggagttatgaacaggtgaagaacaggatttttagggcagtgaaatgactctgcatgatacagtaatagtggatatgtgtccttatatatttgttaaaacccatagaaggtttgataccaagtgtgaattcaatgtaaaccatggcctttggttgataatgacgtatgaatgtaggcttattgattggaatgaacgtgcccctctgatgtgacggtgtggaaggttgcaagttagggagagggtaatgggagaactctgtactttctgctcaaatttgctttgaatctaaacaatctaaaactgctctaaaaaaaaagtctattaattaaacttgttaaaatagagaggagagatagggagtatttgaagggatacaatccccaactgggtagatcatgaaggtctcagggttaagagtccagctaaggaaacacct

SEQ ID NO: 207858 - DNA, 484 bp, Homo sapiens
cgttttgaaggagctgtgtatgacaaactgtcaggagtagaagaagggaagttgggaggagtgggacacaggattccaccttaaaaccatctctagggaacaacaattccagagaatacctccaagaggttcagagtgaccctctgaagagtcagtaggatgtatcaaaaaatggaagaaatcaaaatagctgaagtgtggccaggcgtggtggctcaggcctgtaatcccagcactttgggaggccaaggtgggtggatcacttgaagtcagaagttcaagaccagcctggccaacatggtctctactaaaaatacaaaacttagcagggtgtggtggcccatgccttgtaattccaactacctgggaggcagaggcaggagaatcatttgaacctgggaggtggaggctacagtgagctgagatcgcatcactgcactctagcctgggtagtggagcaagactctgtctcaaaaaaaaaaaa

SEQ ID NO: 207859 - DNA, 206 bp, Homo sapiens
cctttataagggaattaaataacatagttggacatttttgaagccttcaattataatttttatacacacataagacaaaaaagtgagtacatttgctaatcacttttaaatttcaaatcttaggttgagacatttttacactaaaaatatgaagttaaaatcaaatgttattttaaaaccagaaatactattgatggatttaaaga

SEQ ID NO: 207860 - DNA, 430 bp, Homo sapiens
tgtacctggacacagagtgaaagagcaggctgaaggagcctgctgtatctgagcacaggctgctctcagcaagtacacatagagacttgcttttgggcccaatgatcccctttactagcaaaatgacgtaagtagcaagagtctcaaagtgctaggcacagtgctcatgcctgtaatcccaaccctttgggaggccaaggcgggcggatcacttgaagtccagagcttaagaccagcctggccaacacggtgaaaccccgcctgtactaaaagtacaaaaattagccaggtgtggtggcaggtgcctgtaatcccagctactcgggaggctaaggcaggagaatcacttgaacccaggaggcggaggttgcagtgagccgagattgcaccactgcactccagcctggctgacagagcgagactccatctc

SEQ ID NO: 207861 - DNA, 354 bp, Homo sapiens
agtccccgtggtgtgtcgcctctgtacttgttctagagaggcagggatgactgagacaacacaggtcctgctcccaacaggactagcgtgctagtagggatgctggtaccaaagaggtgtcctgaataaaacatgctaagtagcatgattgagtaaacatgcagggccaagggcactggctgcagctgcccaacaggaggcagtagatggagcagcaaggaggtggccctggatgttggcatgaccggcacaaggtctgaccctggggccccgtggctctacaaagccctctgtgaggccagctcccatcccttcttctccttcagctacaggagtagctccaaaagttaaaaa

SEQ ID NO: 207862 - DNA, 437 bp, Homo sapiens
atgaatttatagaacaaatgtttacagaaaagtcttagggaaatgtagtggttggcctgccttgtgtttatgatgtgggcagtttaataagacacattcagaatatttggtcagcccaaacacagattgtcctacatctggaaagtgtgtttgctgccacaagaagattctttactttctggcagtgctgtggctaagattttttttttctttttttttttttaaccctgcagttttccttgtatcagtgaaagaaatgcctaggtagcacatgatcatgccaaccagacactctaggagaggaagcatgagtgtgaggaaaggacaacaggggaaaacagccctcatcatcacctgaggacacaagcaaatctgcaatctcaggaaaattctctttccagaattctagaaattctggaaatttctctttgttctat

SEQ ID NO: 207863 - DNA, 645 bp, Homo sapiens
ggttctttgtgggaaatggtattttgatattgcaaccttttctctaggggtgctcatagttattgcagtggtaatgtttctaggcctttttagtgggtagagctagagaaaaaaagttttaagagatcttgagttcatactgatattttaaatttcaatttagggtatagcatttttatttcttttatgtttatattttttcttatgctgaaaatgtggttttagtggcaataatattagatttatttgctttatcttataatgtataaaataacaatttatattaataatatgattatggaaaacattttaagattaaaaactggtcaggtatggcaggtcgcgcctgtgatcccagcactttgggaggccgaggggggcggatcgcctgaggttgggagttcgagaccggcctgacaaacatggagaagccccgtctctactaaaaatacaaaaaaaattagccgggtatggtggcgcgtgcccgtggtcccggctgctcgggaggctgaggcgggagagtcacttgaacctgggaggcggaggctgtggtgagctgagatcgcaccattgcactctagcctgggcaacaagagcgaaactccatctaaaaaaaaaaaaaaaattaaaaactttaattttttt

SEQ ID NO: 207864 - DNA, 462 bp, Homo sapiens
tcttttttagttcaaagcattcagcaccatactttggggtaacgtgttctgagtcccagcactgatacatagttatcctattccacacctataactttatgtatttctctcagcctgaaatagtctttcaacctttcaatttttgcctcttcaaattttatgtatcttttcaagctcagatgtaataccttcataaaatttgttttggtgatctgccatgctcttatatgctccccataaaaggaatgtgtgatttcttcagtctttgaaaaactgtcatttttgtttgtgctttttaaaagatatgtatatatactttgtcttaggattacttttatgtgtagagacatagtaactgtgtctagcgcaggctattatgcttcagatccagtagattcaggtaatgtttagtgcctactgtgtacttcttcacttactcacctgtaacacctttttgaaata

SEQ ID NO: 207865 - DNA, 397 bp, Homo sapiens
tacttttttctttcagagtacaaaattgtccaaaatcattttatatttcaagtccccttgtggcacatatagaatatttggccttatctagcctatttaaaacaagagagataggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaa

SEQ ID NO: 207866 - DNA, 700 bp, Homo sapiens
gcaaccagccctttttcttaagctgtctaggagctttcagtcacccagtcatctcagtaacatcaccaaatgcattcttactatggtgatcccaaaggtcttagaggctcttgtgttagaaacctgggactaagaccaaatattcaaacaaaagatggtcctatcacctttatcaccaaggcctttataagaacttgagaagctctgtgccaggacgaggggcagaaaccaaatgtgtattttttttctttttcttttgaacacagagtctctgtttcacccaatctggagtgcaatgatgcagtcgtagctaactgcagcctcaaccacctgggctcaagcaattctcccgcctcagccttccaagcatctgggactacaggtgcacaccatccatgcccagctgatttttgtatttttttgtagagatgggatcttgttatattgccgaggctggtcttgaactctggggctaaagcaatcctttcacgacagcctctcaagtagctgaaactacagatgcataccaccatgcccagctaattttctcttatttctttttgttgtttaattgagggggggggtctcactgtgtttcccaggctggtcccgaacttctggcctcaagcatttctcctgctttgacctcctaaactgttgggattatggttgtgagccccggcctctgtgtccagcaatc

SEQ ID NO: 207867 - DNA, 222 bp, Homo sapiens
catatatatttaacacactgctccttcacacacacacatacacacactctcacacatacactcacatacaagatgctactgacagactgcaatctagaacatgccttcctattctaatacaaatgagtctacattttcttttaacttggcaaggttgaaaaacagactcatcatagtaacttagcagtggccacacctaagaaaagcggcatgactacacag

SEQ ID NO: 207868 - DNA, 604 bp, Homo sapiens
gtgtggtggaatctttgacttttcctttttccgctttcttttttaataacagctttgttgagataaaattcacataccaacaattcactcgtatgtgtacaattcagtggttttaaaaaatgtattcaggatgttatgcaaacatcatcacaatcaattttagaaaatgttcatcttcccccaaagaaacaccataccctttaacagttaccgtcccagatcaccatctcaccctaggcaaccactaatctgttttctgtttctatggatttgcctattctggaaatttaatataaatggaatcctacagtatgtggtctgttgtgacacttagcttaatgctgtcaaggctcatccatgttataacatgtgttagttttttttctatttataattaatttttgttttgagacaggatcttactctttttcccaggctggaatgcagtggtgcagtcatggctcactgcagctacaacctctggggcttaagcgatcctgctgccttagcctctcgaatagctgagactgtaggcccatgccaccacgctcggctaattttttttcttttttgtagagacacagtctcactatgttgcctacac

SEQ ID NO: 207869 - DNA, 353 bp, Homo sapiens
tttgactgacaggaaacttgctactgattcttgtgggcaaggataatctcaaaacaattatataatcctcctcgtttttcctctaaaacgtttgtctttctttacctccctgaaatgcacatagtttactatggcacctgccatccaattgcagtgcctattctcaggtaaataacattttcttttagaaataacatttctaaaatgttacagtgacaatatttacaatgacaaatttgttcttttcaatcagtttcagcatccaattgattctatatgtttttatagttaaaatatataacaaaatgtaaatttctacttataaataaatgcaaatgatttcattctaaata

SEQ ID NO: 207870 - DNA, 526 bp, Homo sapiens
aacaaaaagatacatcgtttaaaatcagttgggtggggggcagacagtgagatgccaaagagcatatacacttgaatatatagaatttcaagtaagtgcaatgaaggaaaagaatgagattcagtaagagagaatagaaagaactttagagtgaattatcaggagacctttctgaggagtcaatttagtgtaagtcctaagcactgtattacctgttccattgtgttacttgttttgctcagaaaggtcaggtttctggtaccatgccaccaagattaaaagattctctgtgcaaagacaggcagcaaatcagaggaagaaataatttttagactagcaatatatgaccttgtggagttaatgttctttaaaaccatttatgaagaaattgtgatcaagggacctactttttttttgagacactgaaaatattattatttactgattggtttactttgtttttttctttcagcatactttaagattgttttatgtctctgtacctttgaaagagttatttacccat

SEQ ID NO: 207871 - DNA, 475 bp, Homo sapiens
ctgaactcagagattcaggacttggtgagcacttcaatatttctgtgtctggagaatgttaacttaggcctggatcacttgaaatttttaccatttattgagtaaaaattttgtgtatagcactatgctaacccctgaggctctctcattgccaagttttttcaaagactctggatttatgtaaaagaagataggccaggcacagtggcgctcacctataatcccagcacttggggaggcggctgaggcgggtggatcacttgaggtcaggagttcgagaccatcctggccaataaggtgaaaccctatccctactaaaaatacaaaaattaactgggcgtggtggcatgtgcctatagttccagctactctgaggcaggagaatcacttgaactgggaagcggaggttccagtgagcggagatcaagccattgcactcaagcctgggcgtcgcagcaagacttcgtctcaaaaa

SEQ ID NO: 207872 - DNA, 306 bp, Homo sapiens
ggctttatagaaagtattgtgccagtatctgctgttgctgagggttcagagagcatccagttgtaacagaaggggaaggagacagtcttgtcacagcgagagagagagagcgagagatgggagggaggccactctcttaaacagtcagctccagtgtgaactaatagagcaagaacgcactcattactgtggggaggggaccaggccattcatgagggatctgtccccatgacccaaacacttctcagcaggccccagctccaacattgggggtcacatttcaacatgagatttggaggggacaga

SEQ ID NO: 207873 - DNA, 434 bp, Homo sapiens
tgggagtatttccccagtgtattaaagacttgatacatggctgagagtcttccactacccagaggctgccataatcctggttgactctggtatctacaaagacaaccccccagtatcttcatcatggtcttggaccccctcatctctagtgaacatctgccctcctcaccttcagttacctgtatttacaggttcacaaagaagagcttatcatcacccctgtgtcacctccagattctaagcgtcccatccagtacaacctactgtggctccagtcagccagagtgctccacgttctatttccaacttaccactatctcccaggctctagccactgcttctcctctagattactgtgtagtccccagactagttgtctttcgttttgccacctacactccattcttcacccagcaatcagaagatcatttgaa

SEQ ID NO: 207874 - DNA, 337 bp, Homo sapiens
catgcagcaagccttgcaggatggaaggcaccctggggacggcgacccacgggccttctctgtgcttcctgctctctggaaatgggtgcatccgggtcacatcagaagttcactgttctttgcttgtcccgaggttccttcctgggacagtccttagttgaaactattcatggagccttccctgcacccttcacttggggacggctccctctcttctctcctcttcccagaaagaaactgccatcaggaggtggcattaattaacaatgaacaccagaggaggcatcgggccaggcaggtgacgccagcttaggaagcacctgatgcactggtcccc

SEQ ID NO: 207875 - DNA, 182 bp, Homo sapiens
aatcattgttcttgagtttgaaaccatttcttacactcctttctatcccctacagcagggtgtctcaaccttggcacaactgacattttgggtcaggtagttctttgttgcagaggggccgtcctgtgtgttaggatatttagcagcatacctgccctctagccactagatgtcaatagcac

SEQ ID NO: 207876 - DNA, 350 bp, Homo sapiens
actttcttgtccaaagccccgtggaggtgaaattcctacccacccttctttcctgttccctctcttacctgtgataactaagtggggctaatacaaccttggtactaacctggtctcaaatctctgtctataaacatctaactaaagagatttcatggactgctgatcacatttctagagtgaatataaaactatgagaaaatctatagaggatttgcatcaacatatattctttctatttttttctagttttcttttgaaatgcagcatattccaaaaggcttacaagatagtataaagctgctgggatggaggtctcttccttgttttgaatttccactaaaaaaaaa

SEQ ID NO: 207877 - DNA, 450 bp, Homo sapiens
agggaatgtgaattctggttttatccttgttgatttggcagctatcaggcagtcctcatcagacaaacacagatgaacattatatttctagggagagatcaggctaaagagatacagtaagctgtcagggccatgggaatgcccatcaccattgtgagagtaggtgaaatcatggagaagagcaaagggctggtgcagattcattcttaaggaaacatctacatttaataaagagcattacatggaaagagtttcattaaagaccaaatgaattgttgaagatatcagaggcagttaggataatgcaacattgtgaaagccaaaagaatagtttttaacatattggcttagaaattaagaaaaattagaaggtagaaaaagtaattggacttggaaactggcatcagtagaattggagaaatgatacactttgatttgcaaagtttgaca

SEQ ID NO: 207878 - DNA, 143 bp, Homo sapiens
gagcccaggagtttgctgcagtgagccgtgattgcaccactgcagtccatcctgggtgtcagagcaagaccctgtctcaaacaaacaagcaaacacaaaataatagtactttccttgtaaggttgtcttgaggattaaatgaa

SEQ ID NO: 207879 - DNA, 293 bp, Homo sapiens
tggtattaggttggtgcaaaagtatttgtgatttttgccattacttttacaccaacacaatattttaaaagccagagttggaattttcgtaacccaatagaaccagtgatacactgggtttttttttatttgttttctttaaattgttgtttagggatctttgtttttgagacagggtctctcactctggttgcccaggccgaagtgcagtggtggtgtcttggctcactgcagcctcaacctcccgggttcaggtgatcctcccacctcagcctcccaagtaactggggcta

SEQ ID NO: 207880 - DNA, 444 bp, Homo sapiens
cccctgctttgatggagcacacgcttcacatcgacccacacgctacccccacaacgaagccatgcagcctgctccaaggacagggaggccgaggaggaagcacattgactgggggcacgtgcaaggtcgtcctcgtgcaggctccgagctctgggctgggacagatgagacctgtccatgccgaggcctccttggcacgtgggctccactgtctctgctcctttctttttctgtgctccgtggaaagaagatcattgtggccccacacctcccggtgcccctgtacttcctcctgggccactcagcagaattctcgggccctgtccatggcatttgggtgggggccttgccagtcctccatgagcccagaagctcctggtgccttcagccatcttggcattgtcaggggagatttttttttaattaaaagtctgccttggagta

SEQ ID NO: 207881 - DNA, 732 bp, Homo sapiens
ataaaacaaacagggattggactgttttaaggcagcatgaccagcacatgctgtctctgtccccagatctgtatgaaacccaaataccaaccagaagaagcttgacaaggatggactcagaacaagcagagctggatggagcaaatggtaccaatctaagatgacctcatacatctgtgtcataagaaggatcatcttggcaactggacccaaatactcagtatttaggctaagactcctaatgttctccaagttttccatgcctgaccaaacattctattgactagcattctttatgaaatatattcagtcaagctacagtcaagccttgaagatccaggaaccttttctctaacatatattttcctatttgtgttctgatttattacaccatatactatcttaacccatgttctttcttccacgcaactgcctgacaggagagaattctggggcctcataggctcaccaccaacatcaggatgctgtgctcaaagtcagcactcataggccacaaagcatcatccctgatgcctcagaagctggactaatgatcacagtgtcatcagagtgtacctctcccggtctcgcccaagtcccttatcgccgtctcccggccctacaaacgccagtccccagtttcccctcatccgaccattgcggccacagggccccctccaccccctcctcctccgacccgctcttcgcgccggcctcccccctccgccccct

SEQ ID NO: 207882 - DNA, 636 bp, Homo sapiens
cagagcttgcgttgatcacattcatttattcattcaacacatttttctaggaaactcactgtatacactaaacactattctgtgtgctcaacctagaatgtcttctccagaacaagactagtgtagaaatacaggaatgtaaattctgtcagacggactagatctaaagaattaccagcataaatgtttgcatttctgctgaagccagaagcttttccttcttcctagacaccatttcatccttaattattacttctggttagttttccattgccaccataacaagttacaaaatgtggcttaaaatagcacaaatttattatcttcacaattctgtaggttaggagtccaggttaagagtttcgcggtgccaagatcaatttgttggcagggttgcattctgttaggaggctctacaggagaatcatttccttgtcattccaccttctacaggacatcctcattccttggcttgtgacctccttcttccatcttaaaaaccagtgctgtttcatctctatgacccttctgttaccacatctctctgacaccagtgtggagaggttctctgcaggactcatgattaaatgaggcccaccggatatccaatctaggcttatctccttgtcttgaaat

SEQ ID NO: 207883 - DNA, 342 bp, Homo sapiens
gcaggctgagaacgtggaggaaaaggagccagatgttggctctcaactcgtgttgatcactgggtggctttttaaaatcccaatgcccagtgccccatcaccagttaaattattgttgctgggggtacacccagagttcaagctctccaggtggttgtgcatggtggctcacgcctataatcctagtaccttgggaggctgaggcgggaggatggcttgggcccgggaggttgaggctgcagtgggccatgctcaggccactgcactccagtctgggtgagagagcaagaccctctctcaaaagaaaaaagaaaagaaagaggaaaaaaagaactttactga

SEQ ID NO: 207884 - DNA, 214 bp, Homo sapiens
ctggaagtgatagtcacataaatgctgccctcagttctccctaaccttgtgttgtgcctgccttcacagttcttcatatctttcttgctgagctttagaaagtgattagaagaacagaataccttaccagtaaaaggatttttgctgcaattccttggcagccttttctttccattaaaatttttttgaaatttggaaatcatttctaacttac

SEQ ID NO: 207885 - DNA, 210 bp, Homo sapiens
ggggacgctggaactgaaagtggacagcagcgggccgtgcagcctggcctgccgtgtaaaggacctggggctcgggctgagcttgttgaggccccagggggctggtcagcatggctggtgggagtgtggaggtgacacccagcacattcacatgctacctgagtgccacgtgggctccgggtggtttttacattcaaattcagcaagtgc

SEQ ID NO: 207886 - DNA, 329 bp, Homo sapiens
ccaaagtcagagtgccaggatgttctggttttggggagggcccttttgcggttgcagactgttgggtttttgtataagcacatggggaaagaagtgagagctctcttaggtcccttttataagaacactaagcctattcatgaggcctctactatgacaacctaattacctcctgaaggtcccactactaataccattacattgacagttacgatttcaatatacagattttgagggtacactttaaaaattcagtccgtaacattctgccccaggttccccaaaattcatgtcttcacatgcaaaatgcagtcattccattccaacaa

SEQ ID NO: 207887 - DNA, 597 bp, Homo sapiens
ggtatctgaaaatgtgatgttagtgtcattgtttaggattcaaatgtgcaagatctgttgtctgaaattatttatgccaattctcttaaaatcttctttgagattctaaagtgctaaagatataatgcatcatcaaacgcattattactttaagcattaattaatttcatatagtgagagaccttagatttgcatgcaaaaagagagtgacttacgagagagtggcattcagaaacaaagaagtatctgtaagttctcttttcacatcaaagcttgatacacgagcagagcgtggtgccctattttgacaaagttcgccaattatcagaacaagaatgctttttaaaaacacaagttgtttcttctactgacaaatcattaacgaaatgatgtaagggatcttgaaaaaaaaatcactacataatctttttctcccaatgaatagcctgttttagaagcacatggtttttagtttccagtaagtttcactattattctatttcaagaatatttacagatatagttgatatataaatatacgcatatatatgccagatatagttttgcaaacacatttgctgtctaatttactttcta

SEQ ID NO: 207888 - DNA, 182 bp, Homo sapiens
ctatcttctctatttccttttgcaacaaatttagagatcatttctgttatctccttgacttctctacctccttttaaatctattacagtctgacttttgattctacctttgttaataagatcactaataatgtccttatcttccaaatccaaatttgctttttagtttttctttcatgatgt

SEQ ID NO: 207889 - DNA, 174 bp, Homo sapiens
ccacaagtcacttagactccatgggcttcagttttttcatttgtaaaatgtaaaagtcaaactagatatctcttttaataggtgagctgaatatgtttccatttattggagaaacctcaatctttttatgttttatttaccatattatgtatgcatgattgtaagtatgtaggt

SEQ ID NO: 207890 - DNA, 210 bp, Homo sapiens
gatagacattgggaaagggattcacagaggtccttcaaggatattgttagaaaagccacggaagactggcgggatggctcatacctataattccagcacttagggaggctgaagtgagaaggttgcttgaggccaggagttcaagaccagcctgggcaacatagcaagatcccacatctacaaaaaataataattagctgggtggggtgg

SEQ ID NO: 207891 - DNA, 247 bp, Homo sapiens
gttcttgctgaactatgtgccatgctattttatgactctgtatctttgttcattctgctccctgtgcttggaatatctttcccaagtttgttctgcctggataacacaaacttaacacctcttcagtaagtattttcctgacttctctgatgtggaactgactagcctttctttgtgcccctgactatactccttatgtgcttttgttaaagcatccagagtgtttatatacatggtgtatctttca

SEQ ID NO: 207892 - DNA, 143 bp, Homo sapiens
atttcttttcagggtgtttgtgccctgattatcaaatgtacagcttgaagggagttcatgtcttaaagtaatgaattaagagttgacctttgttgactgctaaaatattcttatatgtgaaagcatcctggaaaaatacgtta

SEQ ID NO: 207893 - DNA, 257 bp, Homo sapiens
cctctctcaacattactcacttaggatatttccaattatttgctattgtaaatagactccagggaatatctttaagcatacggtttagtctttggacttttaatctactgagaaggcgtatctgagtatttcttgacttgacttgttatcatcagagtgaggcctaagaaactgttgcattcattcattcatttatccatccatctattcatttatttgaaacacatttaccaagttccttcttaatgttagagata

SEQ ID NO: 207894 - DNA, 473 bp, Homo sapiens
caggaataagtccccaaatttgaaatatcattatcagtgttttggctgatagaaaacaggttgtggttactgaatttgcctcttagagtgggctgagcaggggtagcttattcattggaattgaaaacaactctagatggatttgaggggaataagatcagagtttttgtggatcacaagctggctgtacatcagtaaagacctcccattatatgaaaaattctaagttaatactggaataagttgacaaggctaaacctatcataggtcctaggctgtgttttggtggggaccctccaggaaaatctccttttggggctggagagttccctagagaaattagtgatcaccctgtccactaaatgaggtctctggtctcttactataaaactggctgatgcaacttgattgtaatttactagtttgacttcggttgtgttcaaaatattaaagcatgatagtgtttaactgta

SEQ ID NO: 207895 - DNA, 489 bp, Homo sapiens
cttgggataataatggtatgtatccgagaggattacagattagtgagattatacattcacagtactgtatattatttgttgtatgaagtctggagggatacagaatagcatgtagtttgagtacacttttgtaggagaaaatatacaaagctatacataggcttctaacaaaacctgcaaggctatatgccaaaacgttaatagtatttatctatggctagtgccattgacaaatcaggttttaacaaatgcttttctgttgtagactcgattttttttaacattcaacatatattgcttttataattggaaaataattcttaccacctgctgtcaggagaagaaaagaagagaaagataattctacttaaaattaactcttagggttgggcagttggagcagtgtttaatcttataaatgtagcttcataagatctggtcctatatgaaagtttaaatgtagcttctgtaagatctggccctatgtgg

SEQ ID NO: 207896 - DNA, 411 bp, Homo sapiens
aagtgttctgctaacattttttgttgctttattaatgcttgccctgggaatcatatcataaacagtttaggtaaacaataagttaacaacactgagaattttcctgtttcaccaaacgtgtcttatctacaggctgcagacattcagcattaccttgtcccttgcttctgttctctttataaagctctggacaagaggcacacaacagacgtgtcccagctgctgactcagtgtgacagagcactgttgccagtgcccaggtgactgcagtgggccacactgcaggattgatggtttaactctctgtagcttccaaatcagattattttcatttgcgcaaaggcacaccagcaggggtgtgtactgtttgacgcacagatgacaatctggccggaagctagtacttgggga

SEQ ID NO: 207897 - DNA, 861 bp, Homo sapiens
ttttttaattctcaggaaaaaaatcatttagctggatttttatatgaagataaatagttttcatacaaatttaatttcacagaagctgccattattctaatgacgtgggtataacctcactttcaaaagcagaaagaaacactttagcaaacacataaaaattcttaagatattcacactttaaaaaatgtaataggcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggtgcggtggcgggcgcctgtagtcccagctactcgggaggctgaggcaggagaatggcgtgaacccgggaagcggagcttgcagtgagccgagatcgcgccactgcagtccgcagtccggcctggccgacagagcgagactccgtctcaaaaaaaaaaaaaaaaaatgtaataggcaaatctgtggcctggaactcttgtgggcagtgcagtgtttgctttgtgcaagctgtcaggcctctcagcatcaagagacagtacctccttcctggccagcacccccaacggtgagcgccgtgacccaccaaacagcaggtgagattggagacctggctggatgagcaaagcaggaaagcagttttgctatccgggcgaatggagttacggaccttcttccaggttaagaagaaagccacgttcggagcgccctgtgttgcagtgatgggtttgttgagcacccaccaatttagtcaggaaaactgatgcagacgtgtggtctgggggtcttcatgaatcggccagaa

SEQ ID NO: 207898 - DNA, 392 bp, Homo sapiens
gaacaatttctttcccaactcctgcacagggatgacggcatatcactcaaacatccatttctccttgatatggtttggctgtgtccccacgaaaatctcaccttgaattgtactcccataattcccacgtgttgtgggaaggacctggtgggagataagtgaatcatgggggccgtttccccagtactgttctcgtggtagtgagtaagtctcatgagatctgacagttttttggggtttctgcttttgtgtcttgctcattctctctttgcctgctgtcatccatgtaagacgggacttgttcctccttgccttccaccatgactgtgagacttccccagccacatggaggtgtaagtccaattaaagctccttctttggtaaattgccca

SEQ ID NO: 207899 - DNA, 120 bp, Homo sapiens
caaagccacacacagcacttcagaggtggcagggaggagacagaattcacagtggaaattcagagggacttactcaaatcaaaactaaagtcaaggcctggatatttcctctatttgatg

SEQ ID NO: 207900 - DNA, 563 bp, Homo sapiens
atgctgctacatggtcagggctttcatcctatcctggtataaaagtcataccgctttctaagaaatctttttacttttaaataatatacatattgcttgatttagatacccaatcaaaacacattctttccaagtatgaaatttaatttgtatacatatggaataaagataaatagaaaatccattttgctaatatacgtaatagttgcatgtagctgaccaaagcattcacatgtggggcctaaacatttactgcttcttggtcttttggctaaagttgggtgtagtatctgttctaggatttctggagcagggagatggaacagaagcttgcttggaccactccatgtattgaccgggtactgcactaactctaagaaccgcgcaccaagaaaaccaaaaccaaaaccatgtcatgcctcttagctgagctaaggaaatgcattatatgactgtgtccataaacgtgtctcttggccaagaagcttccttcacacagttaacctttcttttcttgctgatggccctcataccactgagcctctgcttagagaggaaagaaa

SEQ ID NO: 207901 - DNA, 319 bp, Homo sapiens
tgtgcacactaggtattcccagtgggctacagccatgcctctctctgcttcaagttccacatctggaaaatggactaatgatacctgcttgtcacattgcaagggccacaaaaatagaaatgagatgccgcatgtgaatggagcttgaggaaaatcaatacaaatataaataaacttatttatatgagtcatacttcaaaaaagaataccatcatactgtccttcatggtatcacccttaacaagacaatgccaaccatctaagttccctcgccccatcagactcctttaatacactacatctagtattgtttaatttt

SEQ ID NO: 207902 - DNA, 500 bp, Homo sapiens
atagtcagtccacagtacaccggcaccagcaccaccttccctcttcacattctccatcccatgaatctttgccttaggaaaccaaagcttcctaaaagtagccatgcctgagtccttgtctaggcccctggtatccaattagccagaatgggatgtaggaggcgagattcaaaaacataaactagtttgaaaattgccttcagttttctataatgcttcgcttcatccatgttcccttaaacttctaaagataaataggcctatagtaatacaaaattggattgatttaaaatgatacctgtgatctggtaggatctggaacttactagaacaccaagaatacaaattaattggtatgattttgaatttatagacctgggctgggtttacattcaattttatgtcataagagtgggtttaataacaatatttattgtctaacaacatacaagatctacttaacaaagtatttcaaatatttttcataagttgttgccaaa

SEQ ID NO: 207903 - DNA, 1031 bp, Homo sapiens
tgacagtgctatgcatgaatatgtttgtgtacttaggcattcttatattccgggtctctttgcacagagattatataatttgagataattgcattacatcgtgttattattttaccttgaaattagagaactgctaaaatatgcactggaagtttccaaatcctaaagctctctaacagctaagtagaaattagaagtagaaaggaataatttgaagccattgtcttagaccatttggccttccataacaggatgcaataaactggttggtttacaagtattagaaatttattttttcacagttctgaaggctgggaagtccaatatcaaaatgccagtaggttctgtgtcaaatgcgggcctgcttcctatttcataggcacccatcttctcattgtatcttcacatggtggaacaggcaagggcactctctgggatctcttctatgagggcgccaatcctattcaaaagatccccaccctcatgatctaatcacctgacaaaggcctcacctccaaatctaatcacattgaggattagggttcaacatacgaacctttggggagacataagcgttcagtctatagcactgattgatggagtctggtttcatcatttcatagttatgtatctctattttgcagacataagtcatgggcaggagggtgactacagaggcattcccatcgtaagtcatctaacagaaagcaaagcttagggttacttggtaaagtgactcacagatctcttcattgcagggctgtgaaactctacaaggagcagctcttaacagcctcaagatctggggttttgctcatgaatgacactatcttatgactttacgtaaatccttgggggttctcagagtctcagtttgctcattagggagtagattaaatgatttcagaggttcctactagctctaaacaagtataaatgtataaacaagtaaaaacagttcatcaaaccgactggtgaatcctagtagtgacacatttcaattgtagaacactttagggtttgtacaggtc

SEQ ID NO: 207904 - DNA, 298 bp, Homo sapiens
cacagttttgccatgtctaacatcagtccttcatcctgcacgttcacctgtttgttctctctcagtccttttctgaagacttgaaaagagctaattacttggagacattccttttcaatagctttccaaattgctctattctgcaagccaaatatatatattatatgccctttagacttttcccagcctctctctcttgatttttaaatgatctcagagattttcacataagcctacatttttagagctagcacagccacagagatcaatgagtccaactatgtcaggataaaactga

SEQ ID NO: 207905 - DNA, 168 bp, Homo sapiens
caggtcagtccttcacggggtgtagccaatgggaggcctgtcaaagacaccgaggggtattgccgggttccttttaataaaaaccctaattgaggaagctcttgggcctcttgctggagccccgctcccagtctgtgaattgtcttcaataaacctgtgctttcctta

SEQ ID NO: 207906 - DNA, 361 bp, Homo sapiens
gagtcctctgaggacgactccagagtccctcaactccttggaggagataagcagccaacacagtgttgttcagcagatgccaccgtctgccatgtaagttaaataaggcagacagcagcagctaaggagattttagcctcctgttctaaacagtattttagcttaacagcagaaaacgtttaacatgttcccccactcctagaaaaacaagcaatttatcttcagggagagggagaaaaagcactttccaccattctgatgggtcatcaagtttaaaagctctcttatccctaaacctttagagaaactaacagaaagtatgtttccctttccctgcagcttatttaccttgcaaattgtt

SEQ ID NO: 207907 - DNA, 250 bp, Homo sapiens
tcctccatcattaatattcttttcctgacttgcccattgcagagtctaattgaaattcacaaagataaaaagcatgccatttaaaaccttgcaaccagagaacctaagtatcttatacttggcatgaacagttcacttgctactgtattttcctattttccatttctgtgagtcaatcttcattaaaatctctatcacctctccatttatattactaataaattgttgatattttgataatggaagttaa

SEQ ID NO: 207908 - DNA, 174 bp, Homo sapiens
ggccccttggtgctagtatagtatctccttcctccatcttctgacaaaaacctagctctggaccagcgggggcaaaattcccagccaaggaaccactgcactgacctacagctcaatggtctcccagttactaccccgtgagacagcaagtagaaaactgcctcctctttctcc

SEQ ID NO: 207909 - DNA, 363 bp, Homo sapiens
tcctttctcatattggtaattctgtaatgactggttatgacccgccccctcccccatatttaattctcatcagcccagctctccactttgctattaatgatagcagccagcaaaatagctttcaacatgccattgacagtctggtttaagagagcacttgaagtagtgctagacagctgaaagcacccataattgtgtaccagagtgagaactgcgtgctcaagggccttgtttttatatgcttaaagggacaatatcttgttttcaacaaatgctctctgagactcacagccaagatgctttcttcctttttccttttcctttcttcttttggctttctcttctccttcaaaatacatattt

SEQ ID NO: 207910 - DNA, 396 bp, Homo sapiens
gtcattgcctaggcagaaacatgatttggtaagttgacgctttctaaaatacgatgttcttggaacagaaatgtgacttgggtgtttttgtcttgtttattataccagtgccttttgactactttgtgaaattccagtttataatcaggaaataacagttccttctgcgtttctatagtagtaggctaagccttacttgttctgtttgcatttctttaaatgtgtgggcttaggaaacaggagccgggagtccagtgtgttccgaatgtgggatttgtggggtttgagcactggccgcctgactttggacaagtcgcttaacctttctaaggttaactttctgatctgaaaaataagcccagtaatttatttaataagatttttcttatagtcaac

SEQ ID NO: 207911 - DNA, 385 bp, Homo sapiens
ttcaccttccaccgtgattgtgaggcctccacagccacatggaactgacctgttctgaatggtgctgaagccccatgtgacagagtccatgcccatcaggaggctgaccttcaggacaagagaggatgcattcttaaccacagctgtcaatggcagcctgattctttcacgctgaaaaccggatcactgcatcttatagcaatcgacattcccagcacatgaccattcagtcaacaacttttaactgagcatctactaggtaccaggcctctgtgctaggcgctggggggcacaacaggtagcatcctctttctcaacacagtctaatggccaaaaaagcactccgcaatatagaaggcagaagaggccggggacggtggctcac

SEQ ID NO: 207912 - DNA, 298 bp, Homo sapiens
ttacaggcgtgagccaccgcacctggccctaaaagtagccttcttttcccttttaaagagttagtgtccatagctactggatgccattttggttcaggtggaccgtgaataggtttcactcatcatgcccaaaggttgccactcctgacaagtcacagacaacgcttgcaccatcatcttcttccttcagagtctgtggtcccctggatgtcactaaggtcctgcttcctgtaccaataggttttaaacactacccaaggcaggctggctttaaatatcctacttaatctggctgaca

SEQ ID NO: 207913 - DNA, 670 bp, Homo sapiens
atctgacgtcaacccaatcaacagaaaagtaagatggaagagggaaattttgcctggaagcctggaatttaaactgaagtttccagagagctcttacttggtagactttttgaaaacatcttttcctatatcgtcagtaaagaagtaacttgtttaggcaaagcacgttatggctttttcttgcctagtttaggtctgtgcttaatgactactggaatagcagcaaacataacatcctgataacatttgggaggaaaagccatatttgaaaattggtgaaatgcaataatctttaaaccaggaatcatcagtttgctaataaaaggtatatggctccaagttacgtattttgtcagggtcctctggcattttcactagtcattttgctagtgtgtacaatgattcctatcttgctgtaaaacttggtgatttttttatattgttgaactaggtgacatgaatattgagtcagatcacataatcttagagtaacacataagtgattatgtagcgttgtgggtggaaacaattctggataaaaagtgcatgacagttcagaactactgtgcaggcagcctgtctgaaatcaggtttaaaaattggccctgtctccagctgactcgttttgtcagactgagtcataggattaacccttgacatgttcctttaa

SEQ ID NO: 207914 - DNA, 422 bp, Homo sapiens
aggacttttagaacacagaacactgtcatatggagatatgaagttatgtacaccgcattatgtggcagaattgaataaatttgaacagaaagttacagaaagttgtggaaggttcaaatagcatagaactaactaactaaaaggagtttgatgtggcatctcaattcacagacatttcaatagttacctcctgaggatacactgccccagccattataggacctgttgccattccctaatgtaccagagcatctcccttcttacactgcatctttgtaccaacgacaaaaaaacaaaagtaggcaaacgaataacattgataatgatggctaacatatacggagtatttaaggggcaagtgtaaaggtacagacatggaatcgaagttagaaatgagtgacttagcattatttcactgaaac

SEQ ID NO: 207915 - DNA, 260 bp, Homo sapiens
ccattggaagaaatcaaatgaaaagctgtgatttctaactacaatcaattcatagttcaaaagactgggcacgagcaaagacaatgcagtgccagacccactgtagtttccctacaaaactgccaccctcccttccccttccccttttctctggcttatcataatcctatacttttagagtgttaagaagaggatttacagatttagattagccaactgtgagaaaagcgaggatgcatatactcggaagctttttaaaa

SEQ ID NO: 207916 - DNA, 535 bp, Homo sapiens
agagttcattttttgcttttcattgttattattaggtatttattaagaacttcataatttgtgaaatgttctaagacttccctttcttaagctatttgccaccttagtcctttagagaatgagatggagaaattaacctaaaattgttctttggtccttatcccagcatggaagcagaaacatgaaacacagagggcagagcaaggtgtcatcaggtcaggggaaggtggtacacttgaccagcacctgagtcactggtccagtgcttgcctggctgaccagactttcctccctgacttaccacaccattcaggtttcttttcttttgacatgatgttcttctcctgttatgaatgacagcatagctacaaagacactacactttgtgttaaaaacaattaaagaaaactgattttgtggtttttatagcagttggcttggagatctatctataaaccattctattaattccaatttattctctcacactctaacagacaaacagtcagaaaataataaaagtggataaatcatt

SEQ ID NO: 207917 - DNA, 402 bp, Homo sapiens
tgtgtaaaatatgttgtgtgtgtgttttttttttccacagcaactgctttttgtgtgtgtggtaaaatatgtatgaaataaactgccattttaacctttttatgagtagaactcaatggcattaattacattcaaaatgctgtacagccattgccacaatttctaaactttttcatccccccaaatggaaactatgaacccagtaagcaataattcctcattcttccctccttcctactctcagttcctgaaacctctaatctactttctgtctctatgaatttgcctattcaaaatctttcatataaatggagtcagatcgtatttgtttttttgtgttggcatatttgactcagaatgttgtagcatgtgtcagagcttcactccttttcatggccgaat

SEQ ID NO: 207918 - DNA, 364 bp, Homo sapiens
acatataaaatacacatgaaacaatatgaaaatggcaaataagtcaggaggaaaatgggtaaaatatatgaataggcatttcatacgagagaaaatatgagatagccaagaaacatgaagaaatactcagcatcattaattgacaaggaagtgcgaactaagaccacaattagatgccattctatacccagcattaaaaagttggcattactacacgttggagaggctgtagatgtggtagttctgctactaccttttggtagtgaagttataaattgccaaacacactttagggaaagtaaaaattggcatcatcatgaaaagttaaatttaagattactccctaactcttaggcatgtactt

SEQ ID NO: 207919 - DNA, 268 bp, Homo sapiens
atagaagctgaattacttctctgaggatgtcttgtcactaaaacatggagaatccaacctaccctgcgtagttgtggaatccctcagatgacagcagtgaaggtacctggcagggtccttgcatacaggaggcataggataaattagcctttacttctttctcccctcttccctggtcccaaagccatccaagacctgcaagaacctccattacttatcaagtacgggaacatcactgaaagaacctaaataaattttctaaagtaga

SEQ ID NO: 207920 - DNA, 152 bp, Homo sapiens
gtaagtatatgccatcagctcaaggctagaaataagctgatcgaatctgataaaaacaccataaaaaaccattccttcattctaggttacagggtcctctcctttatcaaccattagcttattccttgtaattctgaaacataattcagata

SEQ ID NO: 207921 - DNA, 596 bp, Homo sapiens
ttctgtgagcgctgtgaacagagcttcgcagagcccactctgctggccctgcaccagtgcagtgagacccatatacagcctgtgcagggcctctctagccccccatgctctgtagagctgcctcccagcaacccaaccctccctggccctctgcagggccagagcccgccagttagccccctatcatgccctgtgtgtagacaggagtttgcccaaccccaggccctgaagagccacttcaagattcaccggggcactcctgacaccttctcctgcccagaatctggctgtgtgttctctgctgaagatcgcaagggtctgcagcaccacctgaggcagactcacagagcagttcctgtgccctgttctttccggggctgccccctgcttttcgggagccagcagggcatggagctgcaccggcaggcgcattaccctttccactgcagccactgcagcttcataggctccaacgtcaaactcttccggcagcatcagcggagccatggtgctgggacacagggagaactttctgccgttcagggccttccatcccaggagctgctgccaggtatgaggccaagggccaagcagtt

SEQ ID NO: 207922 - DNA, 445 bp, Homo sapiens
agagtttgcctgaaagcaatgttgcctgggctgttctgagaaacagcttctttctcaggacaccttgagggtggactgaattcaaggaagatgactttcttttcctggtagtactccaggaactggagcctttcaaaactacatgacatcatctttggcctggagaattttgaatttaagcgagaggctttgcctgttcagaaaactagggttagattcagaggatgtcttaaaaatgatgtcaaagccagaatttgatgtcaaagcctaatcctttcagcaaggaaagaggcttcttccagatgaagaacaatggccctgtctcactggtggcaggagaaagggttgctaactgacattcttagaaggcaccactgtgtatcaccctgtgccttgaggacaagatgtactcaagacccatttcccaactctaccttctctccag

SEQ ID NO: 207923 - DNA, 630 bp, Homo sapiens
tggtcgtactccagaatggctgaccccctgaaggtgtacccgccactgaaggggagcttcccggagaacctgagacaccttaagaacgaccaccgaggtcgttctggagattcagagtaggggggactgggggtgcaccttggactttggaacaagacagacctaggctccagtgccagcccacacctcacattacatctgtctgcttggacaggagatttaatcctagcctcaggatccctatctgtaaaatggggataacaaggcctacaatggcacagaatgaaagacgaccaaattagaccctatgtcctgaaagacttagcctggtgctgtgtccacaacagacacttaaacaatgttaacccagcaggtcctcaccactcactggctgtgtggctttagttaaactgtctaggtgtcaattgcctcaccttacaatggggataaagaacatcaccactttgtgaagattatgacaatggaagcaaaacagccagcaagataccctggacacatcaggagcccagtcaatgtcagcggtcagcatgctctcacttcccatccactgtctatttaatcaaagttaatcattcacagagcaagaaagaagtcctgttgttttttttc

SEQ ID NO: 207924 - DNA, 408 bp, Homo sapiens
tatttaacagtaataaaaacaaagaacagcaggcttacacaacattccagactaaatgacctcacagagacatatacacacttttcacccaacagcagcagaatacgtatttttctcaagcacatgggacccattctccagaacagatcatatgttaagtcataaaacaagtcttaaaatatttaagatcaaaatcatgtcatgtatcttttcaaaccacaatggaatgaacctaaaattaattacagcaagaaggccaggcgcataatcttgaaaaagaacaacaaaggcaaaaacatcacactccctgatttcaaattatactacaaagctatagtaaaacactatcatactggcataaaaacagacacaagccaatgaaacagaattgaggtatacggttaacta

SEQ ID NO: 207925 - DNA, 523 bp, Homo sapiens
acctgattctcactatggctttatttaaaatagaagaaataaacccttctaatatctgcatcttagtcttctgaattaaactcattgactaataaaagatttttactttggagggtttagcactgcatcaaaaaggaagcagatctctcctatttgttaaacgctaaggaatgaaagaaaataacaataaatctgacctctttttgtcatatggcacattaaatatctttgaaaaaaaccccaaaacaataataacaaaagcttgccgctctaaaacgtttaaaatatcggacacaataataaatttttaaaaatgcaaggctaagcaggttttaaaaagtatagggactctccaagaggaaaacaaaaccaggagcagaatccaaggatatagggaagcactgaagccagcagctcccttactgacagtgccaatcgtggaatgccaacagctttagttttaactgtatgcaaggggctggttacaaagctgggggttaagggagaaagatttagataggag

SEQ ID NO: 207926 - DNA, 546 bp, Homo sapiens
atcttgacaggaaattcaagacccttaatgccttatattacttccttatcatagtgagtagagcatgagagaatgtattgtgtgcattgagaagggtatgaatttttctgtttgattaatattcttgttattgcctgagtatgttcattgtgaattctcaaagtgtacccttggaagaaagagtatgctttcttttctcagaagaaaatagcatatcccattattttttgtgaatggacttgtttgccgttgcattgcattcattgagttttatggtggttgtttaagcatagagcctgtctttgaaatgaaaaatttattgaaatccatttcttttcttttcttttttgtttttagacagagtctcgttctgtcacccaggcttgagtgtagtggtgcgatctcggctcactgcaatctccgcctcccagaatcaagcgagtctcatgcctcagctacttgggagattgaggcagagaattgcttgaacccgggaggcggaggttgcagtgagccgagatggcgccactgcactccagcctgggc

SEQ ID NO: 207927 - DNA, 507 bp, Homo sapiens
tgactcaccctcactgtggctctggagctccaaccctgggacagcctagtgcttctgacaccctggctgctgagactgtagggagatggggtggacagaatcatggcccccaaagatgtccatgtcctaaaccctggattcagcgaatatgttaccttacatgacaaaaggggctttactgatgcgcttaaggattttaagatacggaaattgtccaggtgggctcaatgtaatcacaggggtctttataaaagcaaaagggaggcaggaaggtcagagagaggtttgaagatgctacgttattgactttgaagatggaggaaggagccatgagccaaggaatgtaggtggtgtctaggagctggaaaagtcaaggtaatgagttgtctcttagagtctcctgaatggacgaaaccctgtcaacaaccttgattttaaccaaatgagacccattttggacttctgacctccagaactgtgagagaataaatgtgctttgttttaagc

SEQ ID NO: 207928 - DNA, 295 bp, Homo sapiens
taccgagtcttccctctctccaattcctcagcatgttttccatgtgccggatccatcggatgatctgaccctcctgttcctcaccaccgtcctctatccctggagcactttgcctctgctccaggttgtagcagtgacatgccctacatggtgtcactgtgggactttctttctcacatctgtctgtgggatggatgactagcattaagcatattaagcatactgtctcgactatagaacaagggttggcatttgagctgggccagggcaacctctttgataaacaaccacacaa

SEQ ID NO: 207929 - DNA, 266 bp, Homo sapiens
atggaggcaagtatacaacacgttgcagtgtttgtagactcaatcctaactatatgaataatcacatcaaatgtaaatagtctgaatatcctaattaaaaaacagagattgggctgggcttagtggctcacgcctgtaatcccagcactttgggaggcagagatgatatttttattttttctttttttcaggctctaactccaatgggatgataattttgtaaaggacccaaatcatacttctaaagatgagcacatatatatcac

SEQ ID NO: 207930 - DNA, 234 bp, Homo sapiens
tgtttacaagcatcactggtgtgttacttaaggagcagcaagacaacccatgggtttattttatattttaaccccacccttatagttgctatttctactaatttaaagataaacttttgtgcacagtcaaaataatcacaaacgcatgttgcaatctgtatctacctttcaggtatttcttcctaaatactgaaagttataactaaaagtataaaaaattaaaaaacagagata

SEQ ID NO: 207931 - DNA, 120 bp, Homo sapiens
ctaatatgtaatcctgggatgaagaaatgaataaattaaaaatattaatcaaactgaaatgtcctatagaagagcttcaggaaccatcctgcccactgacaatgacttcatatgatgttt

SEQ ID NO: 207932 - DNA, 350 bp, Homo sapiens
aaggaaagaaggaaagaaggaaaagggctccatgcagcatttacctagcttgcctttccatcttttgccctgtgaggacacagcaggaaggccctcaccagaccaaatgccagttacttgagcttagacttcccagcctccagagctgtgagaaatacatttctgttctttataagttacccactctggggtattctgttatagcagcataaatggactaagacaatgggcaaaggatataagcaggtaattttcaaaaaagaaaacataagtgaccaacaaacttaatgaatgtatgttcaacctcataaataatcaggacatataaataaaaataaagagactatttc

SEQ ID NO: 207933 - DNA, 408 bp, Homo sapiens
aaccaggtgctgaataaatttgtcttagtttttatagtttttgtgtgtactgtacgtgttaggatattcttctctttctcataacactagcagtttctttgacaagaaaggagagcagcctcttaacaagaacagtgaaaatggaagtatttaagttttacaggttttccagctgtctttaattctccttgataagagtaacaacagacattatatttaatggaaaaacagaggcgttcctcctgaaatttagactacttatttattactttaggattttggtggttgggaaatgggatgagaaaacagttcactttgtgtattttttcatttttgaaccatgtgaatgtattacctattttaaatgctaagtgtaatggccctaaagtttcataatgactctggaaa

SEQ ID NO: 207934 - DNA, 253 bp, Homo sapiens
aggatgtaaaatggaacgaacagataaggcttttttcttaaaaccacaacccaagggcacataaagtatttttaagatagctgggaaatgtcattcttcactgtgaagacctagtccaacatatcaatatccacaacagcagaaccagagcagtggcaagaactgagtattggtgaaaaccaggtttaaaggggaagaacagaggaaggcttgttagtgctggtcctataggtagcaaatgttcgttccattt

SEQ ID NO: 207935 - DNA, 256 bp, Homo sapiens
gaggttgtatccaatttgtggaggaactttaatgccagcctatgacataatgacttcttgtgatccagagatttggtgtaacttgatatagttttgaaggaaagaaagttgctgagtgaaaataaaacacttgcaagggctgcaaaagacgcaatcaaaacagaaactatgtttcatttcagtcaaggcaaggaagtaaattcagtgttctagaaaagagtagaatattttcttgacaagagaacaataattccag

SEQ ID NO: 207936 - DNA, 621 bp, Homo sapiens
ttttttggtagttctcttttttagtttgtagaaacacgaaaccatgaaagaaaaaaatgtttcctttagttcagttctgccacaaatatggagaaaaccttttatcttaaagagcaagattgttctgtaaggttattttgattcctttgtttaatcctccacttaccatattttatgcactattaaatattgacatcaggattcctcctgattgcttttcctcttttttttctttccttctttccgtctttttctttgttcctttcttatttattaaagaaaaatagcaacagtgtagttctgcttactgatattctgatattatacaaagtaatttatttcccttctacagaatttatgtatgaggacctaaggctgttcagatatctaaagaaaggtttgaagccttcttctagctggtaattcccttctttattgtctggccctgaactagaaaagctatgatgggagggatgtggtcccttagtaaacagcaatgagctctggcccatgtgcaatttccctttctatctaaattcaaagaacagaagatctttgccttaaaccttgcaatgccaaggtctgctcctttgtgactatggtaaatttatcccactctta

SEQ ID NO: 207937 - DNA, 284 bp, Homo sapiens
tggctcaggctgaactatgcttactcaacatctccacttgaatgtctaatcatcctttcagaagcaacatgtccaagaccgagctcctgacatttcctcccaaacctgctcttcccacagataccccacaccaataaatggaaactccattcttccaagggttcaggccaaaagccttggctcattcttaattcctttttctctctcaccaaagccaattcaacagcaaatccacctacaaaatatatctgataccctatcacttttaccctctacctccctga

SEQ ID NO: 207938 - DNA, 835 bp, Homo sapiens
aaaaaccatatatatatatatatacacacacacacacacacacacacacacactccatatattcaaggtagaggaggaaagcatgagtgtgatgacgagcacaatgaaaaatataagaatgacccaaattgaacttctagagatgaaaaatgcagttataaataaaaacacactggattgcattaatagcaggttagacactgtggaagaaaatattagtgaatttgaagatacatagcaatagaaacaagaatgatgtcgtttaagttcattcctgttcctctttattttgattctctctgttaagtcttcatagaaaaaatcatctacttttctgaaatgcatgttgtcaaagaatcttggaatgtcaaccagtgatttttatagaggctctaattccctgcactgttagtaacttttgctgatttttatggacattggagtgagaaggacactcacgaggggttgctggcactgaaacaatattcgtaacacttgggtttagggtttcattgttagggaatggacctagttatatggccctgtgtcttgtcatttcttaaaatttccatgaggataaatatatgaagattttggtatttgtaaagcgttgtgcagaaagactttattttaatgattatcattatgttgttagatgttctgaaatgttagtttttctcttagcagataaagttaattccaatacctttgaaaatagactcaatctacatacctcactgccctaatgctatttttagtgttgtgtggaatatatattttaattagatttaattgaaattctgtttccagaattttaaatttcttaagttgagag

SEQ ID NO: 207939 - DNA, 152 bp, Homo sapiens
ctgtgaaagccaccctaggtacaatggtgggatagccataggacaactactacagacattctggttcaaaaagaggggaaatgggagacataaaggagttactggtctataactaacaactctgaaatccagctgggaaaatggaagtttct

SEQ ID NO: 207940 - DNA, 551 bp, Homo sapiens
ctcatttcagttcagaaaaaagaattaccagagacacttatgacagatggagcacgtcttcaggaactaacagaaaagctgaatcaattgaaaattattgcctgcctgtccctaattaccaacaacatggtgggtgctattacaggaggcctgcctgagcttgcaagcaggttaacaaggatttcagctgttctacttgaaggcatgaacaaagagacctttaacttgaaggaagtcctgaattctattggtattcagacttgtgttgaggttaacaagaccctgatggaaagaggtttacccactttaaatgctgagattcaagctaatcttataggtcaattttcaagcattgaagaggaggacaatcctatctggtccttgattgataaacgaattaagctttacatgagaaggctactttgtcttccaagccctcaaaaatgcatgcctcctatgccaggaggcctagctgtcattcagcaggagctagaagccctaggctctcaatatgcaaacattgtgaatctcaacaaacaagtgtatggacc

SEQ ID NO: 207941 - DNA, 793 bp, Homo sapiens
tctcctccgggaccatgaggagctgggcattcaactgctgtcgaagtgaccttgcccatagctcaggctccaactgccagttccaggatgccagatgccgggcctcacctgcatgggccagcccagcagaggggccagagaagggacctcaggctctgggcaggggatggtcagagtcaatggggttaggaggaagaaaggacctgggacagggaaatagatggagctacagagcagagccagaccagcagagagcctttcctgagaccctcaggccctccctactgcttccccaaagactctggtaaggagcaggcctaagacagacgtgagagccctccttgcagaagagttccttcttacctcccagtaccctgtccccctcacctggcctaggggggttaggaggcaaggcaagggaagagagcccgatctgctgatgaggtttcattgaagagtgcctgctggagcagtgaatgaacttagacttgagttccagtctgaggctcaccctaatcatagccacccatacacggagagactcgcacacagacgtgcaatcacctgaagaggcaaactgacacaccgacagagctcactctgaacctcggtcacagcaaggaatctgcactcgagctggcgatcgcctgaaaaacgggttaacaggtcgtcactcaaaggcagcagagccccagtcccatgacgtcttcgcccacagcctaaggaggtcgtgaagacagaaagccgaggagcaggcacagcaaatgatggtcaggatgcaggtaggggaaga

SEQ ID NO: 207942 - DNA, 347 bp, Homo sapiens
tggacacatttctgttactaaccttcctgggtagttgttttgttaagtttagttgtttagttgaatcctttccctgttggtactaaattgataagttgcttgcatatagtgtagtctatgaataattctctttgatttttatttgttgagtttgttcccacttccaaaggggcttgaggtagattgggttctgaaacaaagtgcagaatagagcaattatgtaaacatagatttcctggaggtcctgaggaggcaggtgctccaggcacctggtgatctgatttccactcttgggcattgcactctggtctgatttctgtaggtggagataaaatgggaaacattta

SEQ ID NO: 207943 - DNA, 304 bp, Homo sapiens
aaattgtgtatatgtgtgtgtatgtatgtatgtatgtatgtatgtatgtatgtatgtatgtatatgtatttctaacaccagtgcagcataactaatttaatgccagtgctgtgaactatatactgaatagctctgtgtgggctttgtagtctacagggatatcacattattagcaatcatatctgcttaggcaaagctggcttctacagatggctgctttcaagtgcaaatgaactggttagacgtgtcttgtttaatacatactcaagattcacaaatgggtattgattttttttttcaacca

SEQ ID NO: 207944 - DNA, 493 bp, Homo sapiens
atattcatatatctccaaaaaactgccaacccagaattctatagccagaagaaatccttaaaaaataaaggcatttcagtaaaagaaactatgaaaattcatcaccagcagacgttcactccaagaaatgctaagttaagttcctcaaactgtagggaaatgataccagagaaaaattcagatctctggaaagaaataaacagcatgggaaatagtaaatatatgggtaaatataaaagatgaggattttcatcttaatttctttaagcaactgggtgtagcactgtgtgcctatagtcccagctactccagaggttgaggcaggaggattgcctgagctcaggagttcaaggctgtagtgtgctatataacatctgtgaatagccactgaattccagcctgggcaacatagcaataccccatctctaaaaatagaatacagaagactgttcaaatttccaacatgactttccatggattacttatttaattg

SEQ ID NO: 207945 - DNA, 615 bp, Homo sapiens
atttaaattaacatgcacttataaagcccctgaatttaaaatactcatgagttagattagatttggaaattaatgttgccagcaggcagttttagttttctgttgaaaattgattccttccttcctcccttcctccctccttccctcctttcgacggtctccctccattgctgagcctggactctactgccgtgatcttggctcgctgcaacctccctgcctcgggctcccgtgattgtcctgcctcggcccgcccagtgcctgggattgcagggacgcgccgccatgcctgactggtttttgtatttttggtggagatggggtttcgccgtgttggccaggctggtctccagctcctgacctcgagtgatctgcccgcctcggcctcccgaggtgctgggattgcagagggagtctcgctcactcaatgctcaatgttgcccaggctggagtgcagtggcatgatctcggctcgctacaacctccacctcccagctgcctgccttggcctcccaaagtgctaaaattacagcttctgcccagccgccaccctgtctaggaagtgaggagcgtctctgcctggccacccatcgtctgggatgtaaggagcgcctc

SEQ ID NO: 207946 - DNA, 464 bp, Homo sapiens
catgcattgaaagaaaacattttgtttctaaattagtctaccattgagtgagaataatcaatatcaagaaagaagactatctttctcaactaaacaataatattccaatcagcttgggaagacctgaaacttgaataagcagtggaaatgccaaatataacagagggtatgtgctacagagaagtaaaaagggtttgactttttatgatgggattttttttttctgggtatgtaatctattttttttttaaactggaaagcatttttgtcagtgtgaatgagggtcaatagtgcagccagtggtgacatttttctttattttgcaaaatgcttttaaaaccaaaggctgctctagttgatggacagtatcagtcttgatctaaattgtaggacactttttcatgtaacataacatttggggattgggtttatttagtgtaatgaagataatttgatataaaaat

SEQ ID NO: 207947 - DNA, 82 bp, Homo sapiens
ggggcatgaaaacaaagcttaggagccaatacatggagtgggaaatctgtgccctgatacagaaacagcactcacagcacta

SEQ ID NO: 207948 - DNA, 402 bp, Homo sapiens
tcagtagttttcagaatgtctttgtgtgtctcataagttttttctctcaccgttgaacaataaatggttcattatttggccagttcaaaatcatcttttcagaaataatagagacctttgcttctgtttttagtacacagtgttacagaggggaggattttggtcttactctgtagatactgtttcattcctcggaaacagaatttttctctattcttgcggtaaaggaagttaaaactgtccctaagactgtgtttagatacctgagtgtatggtatctttgtttctttttggccttttgcccttttggtctaaggattcagtctccttagagcagacaaaaatctacttaatttaaggaaacttttctcctttttctctgttcttgctctgttaaagttc

SEQ ID NO: 207949 - DNA, 615 bp, Homo sapiens
accacaacctcctatcagcagcgggatcccaccaacctggcctgctctgtgttcttccacatacacgtcttgaaggcattttgtgactttggctatctgttatggtggcactagtgtccactagaaagtaatttgcatgtggcctgcaggacttgaggaaaactcagaatatgctaacccaatcttaggtctctgcttttactgttttttgttctagccatttgtctgctggtaatttctactctaacaggctgctgacttcttgaaagcaaggcctgggtcattctaacaggtataaggtgatatctcattgtggttttgatttgcatttcactgatgtttagtaatgtggagcattttttatatacctgttggccccttgtatatcttctttacagagtgtctattcaggtattttgcccatttttaatagggttatttgttttcttgcttttaagttgagttccttacatattttggacattaacccatgtagtttgtatagtttgccagtatcctttcccattttataggttgtttgttcactctgctgattgtttcctttgctgtgaagaagctttttggtttaatatagtcccttttgtccaattttgc

SEQ ID NO: 207950 - DNA, 383 bp, Homo sapiens
gagcctctctacattaacacatgctttctctctgtgtttgatctcctaaaagttaaactcttagtgtcgattaccaccaccccaggtaactcccaaaggaacacctttgggcaaaatttcccacttaaatctctactttttgtccacatatatgtatcagtgaacaaatcaaaatacatttatcatcttattgtatgtctggaattacgacagccatggagatttacagccaagactgttcccctatacatgatggcttaccatctagggaaggagacagcagcacttccaagaactcaaaactgaagtcactatttttccctcaatgaactgctttcccctttcagtcagaagtcatcagcaaccagttgcttcaaccttat

SEQ ID NO: 207951 - DNA, 213 bp, Homo sapiens
acccaaggctgtgtgtccaaaggcaactgtactgaataccggaaagcatgtatttgtttgctaaattgctctctttccaccagtgatatcaattctgaaatacttttgagatcttgacaataatcaaaaggtagccaggtgcatcggggaaagcactgacattggagtcagacagactgaagttcatatctgattctgctatatgacaacgtg

SEQ ID NO: 207952 - DNA, 715 bp, Homo sapiens
ctattagaataatgcattaatagatcacatctatttaattgaaatgtgacctcacatgactgccttgactgtatttgagatgaccgacttgaaatacccttagaatttagttcttccctttttccatttaaatgacaagcaaaaatggctgggcacagtggctcagcctgtaatcccagcatctggggagaccgaggtgggcagatcacctgaggtcaggagtttgagaccagcctgaccaacatggtgaaacctgtctctagtaaaaatacaaaaaaattagccaggcgtggtggcgcatgcctgtaatcccagctacttgggaggctaagacaggagaattgcttgaacctaggatttggaggttgcagtgagctgagatcatgctactgcactccagcctgggcaacagagcaagactgcatctcaaaaaaaaaaaacaaaaaatgtgtgagattgatcaggttaaacaccactagctttaagagaaaggcagttcattaacattcatacaacacagatttaagcacctatcagttacaggatataaattctccaaacaaggaaaaggttgctcccctgaagaagctcaccgtccaggacccctgaagaagctcaccgtctaggaggggatgtggagaagtaaacacattatcataattaccgtggaaggggctgtggttgaagtaaactcttggcactattagggaagctc

SEQ ID NO: 207953 - DNA, 341 bp, Homo sapiens
cactaactaccttccagaataaacaatggttcccatgttaggatcatgcataagagctacttggagcctcttagatgcagagcccatagggaatttcttctcatttcctgcttcactaaaaacattactgtgattttcaaatgagtcccagctgtaactgtaccacacagagcatcacagagtttcaccaggggctgctgctattcattcatggctcttactatgtgccaggcaaaaggtactaagctctggggcacagtggggaacaaaacagaccaaagtccctcctctttcagaacttacattgtaagtgggagagacacatgatcagctcatacaac

SEQ ID NO: 207954 - DNA, 472 bp, Homo sapiens
cggggcgagtggatcacctgaggtcaggagttcgagaccagcctggccaacatgatgaaaccccgtatctaccaaaaatacaaaaattggctggacatggtggcgggcacctgtaatcccaactactagggaggctgaggtaggagaatcacttgaacccgggaggcggaggttgcagtgagccaagatcgtgccactgcactccaccctgggcaacaagagcaaaactccgtctcaaaaaaaaaaagaaaaaaaatttaaaagaaattcttgagtatttcttttgccctgtgtttgccatgaaccaagaaagtttgggaacctctgtcatgtgacctttgaccagtcatttcactctgggtccaacttcccacgtctacaaatgatatgggtagaaaagaggatctctctggggtccttttctactgtgtgtgcatttatgtaaaatgtcagactcagctttgcacccact

SEQ ID NO: 207955 - DNA, 138 bp, Homo sapiens
aatcactaatatctctgcccagcaaatgatatcattaccctcagagttcaagaagactaagaaaataaaatcccttaagtagattacattcgcttcctattctgaattggttttacttgaattaatctaaattaataa

SEQ ID NO: 207956 - DNA, 146 bp, Homo sapiens
ttcctgaaccagcctcctgtctgctctccctacccccagtctttgctcactgtggccagagcagccagaataatcttgtataaatgtaaatgtaagtcatatcttactagttctctttataaaatgttccaggggcgggccgggcg

SEQ ID NO: 207957 - DNA, 429 bp, Homo sapiens
ggcttaggggcctttttcggattactttggtttcttctgttttttttattaatactttttagatataatgtaccatatatgttttaaaaatttcaaagagtaccaaaaatatatatagcgaaaagtaaagtcatctattcccactttcccttagtggcacagtttgcttctcaagatgccatggtggttattaccagtctcttgtatatcctcctggggaaattctctgcatatcaagcaaatttgaggatgtgtaattcctcttaccaattttgtgaagttttttgtttttctgttttgcttggtttgatacatgagtggttgctttgttatgcaggatgttctgtgccttgctttggtttctttgatgtgttttgggctccttaattagcaccatattgggctaccttgttctttttgatgactgcc

SEQ ID NO: 207958 - DNA, 736 bp, Homo sapiens
gggaagccccagggctcccagcccgccctcctgagactcggttgttggcaccgggggaggcccaccttatcgtctagcagacgcggggctgggcacgtgggcggtaggccctctggctctgatgcatgggaagctctagccccaacatctacccctccctcccaaggaggacttttgctccaggacgtggctcatgaccaacccaactcctatggctgattttgggcctgactggcttcctcctgggcttgcactgagtcccaagaaaggacccggagtggcaggaagccagtgggcctcagaccagactcctccaagtggaccccactcagcctcaaacccctcagggtctccctcatggagctggcagggtgacaaagaatggcttttggttttaagctatgctaacagtttgatgcaaaaaacatacgttttaaacatactggttttaaaaaaacacctccacccccacacggatgcaagggctggccccgggaacggaaccgatggccgaagcgtgtgcacaatcgccctgtggtcatgtgctcagcaccctgctctgctgggaagaactcagagcagacaggatgccctccctgccccgtggagcagccttcaggtcagggccgagggtggcttggggtgagccctctggccccacacgagctgcagagaccagggtcaagtatctcccagcacaaagcagctgtggcatggagagttaacccaagtcata

SEQ ID NO: 207959 - DNA, 274 bp, Homo sapiens
tcccacagcttattagagacagagctgagatttaagcaaggttagcgggtaacacaagcgaatgaggcagcccactgtgagacgatgggagtggtggggactgggcacactcctgagcccttgtcctgtgcccagggagctcccacactactcaggcccagctgatgatgccacgccagaatgcagaccccactgccaaattttctggcttgacaagataagcttatatttttatgtgagatctcctgatttttatgtaaaaacctccttttta

SEQ ID NO: 207960 - DNA, 279 bp, Homo sapiens
tccagtgtagaaaacattatatttgacccttggacaacaaagagattatattgaaggaattttattgattgtatcatgaataaaagctgaagtcaaaattaaaatgtaaaaaaataattcagaggatggaatatgcaaatgtaaactccaaacgatgtggctggaattcataaacatttactttatgcaagatactgtgctattccaggcactcctatggcatttaaagtacaattcttaccttccctaatttttcaacctagtagaggacaataggct

SEQ ID NO: 207961 - DNA, 115 bp, Homo sapiens
cagaaaatagaaatagaaaacaaaatgtggtagttgaagggagtagtaatggacaaaatgaatactaaagttgcaaccaagatctagaaaagctgaataaatgctatattaaagt

SEQ ID NO: 207962 - DNA, 428 bp, Homo sapiens
actatcctttattattattattgttaaagaatttctaggtctccttttaataaattggggcagccttatttttcccccagcaagtgaatctgttcttttgggttgaggtcgtacgtcctgaggggaacacaggtgttcccactccctaaagaggctacaacccaggccgggcgcggtggctcacacctgtaatcccagcactttaggaggccgaggcaggcagatcacgaggtcaggagatcaagaccatcctggctaacacggtaaaaccctgtatctactaaaaatacaaaaaattagccggacgtggtggtgggcacctgtagtcccagctactcgggaggctgaggcagggaatggcgtgaacccaggaggcggagcttgcagtgactgccctccagcctgggtgagagagcgagactccgttt

SEQ ID NO: 207963 - DNA, 457 bp, Homo sapiens
catttaccatactttattgatattatctgcttttatttttctcataatcagattatagactcttcaaggactacactgtatcttcatcttttaccccacatcctatcaaaattgtcctttagaggagaaaaaaacaaaatattaaaatgtgctgattgaaggctgggtgtcatggctcatgcctataattgcagcactttaggaggctgaatcaggaggagcacttgagcccaggagttcaagactagcctgggcaacataatgaaacccccatctgtacaaaaaaataaaaaattaaccaggagtgatggcacatacttgtagtcccagctactcgggaggctgaggtgggagaattacttaaggattacttaagcctgggagatcaaggctgcagtgagccatgattgcaccactgcactccaccctgagtgacagagcaagaccctgtctcaaa

SEQ ID NO: 207964 - DNA, 344 bp, Homo sapiens
ggagaaataaaaatattactggattaggaggaagaagactggaaattttagttctcactctgacactaaggcagtctgaattcagacaacttacttcccctttccaaggttcagttaacagggaagcggggaaaggcagatatgaaaaagttggaccagatggtaagacccctttcagctcccacataggactcgtaaatccagaatcctggccaggcaccacagacgtaccagactccaaagaactaatgtgaacatcaagagactcctcaagacctggcccagaaactcccttgcctgatttttagacactccctccaaccggatcacattgaaaaactgga

SEQ ID NO: 207965 - DNA, 656 bp, Homo sapiens
ccttttggtgcctccctccctcctttccaaaaggcccaaagaggcacaaagtcatgactgagaagagcggctgggcagggcacccgcctgggatgggctagggaccagcagcaggaggaggggctggggggccagccctgctcactttgagccttcacaggctggggagtgggcctggctcactctggactaggaagagtggcccccaccctagtcactaggtctgcccaacagctgaacaaaacctggcgctcccccaggcaaggggcacttggagaattggttcctggggacacaggcgaaccgcccaacaagtggaagttgtgcctgctgggtggccagcggatggctacagtggcaaacgacagggcccctggaggagagcaggaggcccttcctgtcctgtctggtgacagcaggaggcccacgaggcgacccagcatctgatgtgacattggaagaggacatttccttaggccccccaggaatggaagctgcagaagagggttgtggctgacttggacttggggtcaggtggtgcttccgggcccacctgtcgcctgcctgtttctgagctccaggcctgcacccttccctcctccgaggcttgggcagagctgggcactggggaccacatacatctagtgacccccccc

SEQ ID NO: 207966 - DNA, 289 bp, Homo sapiens
gtagccaccccccccttttcactttgggctcctgaaaagaggttcccctgttgtgccacatgtgtactcattgtttgctgcattgtgggggcagtccaggggccttgaagaggggccaaggtgccaaaggggcactctcaggcctcaaggaagtacatgtttactgatatgatactgtctcttcctccaggaaggaagccttccctgatctccccactgcatgcccactatgataccagtttaggtcccctctttatggccatctgtggcatcagtgtgaatcctctta

SEQ ID NO: 207967 - DNA, 534 bp, Homo sapiens
ccaaggactgtgacagcccttcctgacttccagatctacctttttaggcaccctttcagtttcttctctctgttctccaccctactctgcaaagaatattgctgagcttgtttggtgggaaggaagaacaaagaaaacaaaagaacttgagaatcagattattttccaagctctgacaactataaattatcttcacccatttaggtgccactgtggctgctttttaaaataaatgattactcacctttgaattgtggtcagagatattataagttttacatgcttgcgctcacttaggaagtctatcaaaaagaaagggaggcaccaccattaaagtcttcccagcaagctttaagagattcacaccggctgggcgtggtggctcacgcctgtaatcccagcactttgggaggccaaggtgggtgaatcacgaggtcaggagttcaagatcagcctggccaacatagtgaaaccctgtctctactaaaaataataataataaaaaaattagctgggcatggtggcgggtgcctg

SEQ ID NO: 207968 - DNA, 568 bp, Homo sapiens
caaagctgaggcaaggcaagcctcttaggaaggtgcaaagggcatgaggctggggttgcagaactgcctgggaatactactgtattgaagcctgtggaaagctgtccctactcttgtcatgcaaggtctggccttgaaccatctcaaatccaaaagtggcttctggggggctctatagagaattaatcctaacaggaaccctgcaaagcaggcatggttgtcactgctatattacagatgggaagctctaaacacaggctgctctgcccaaggccatcctggttagaaagtttcagggcccaaactccagcctcggtctcggtatctcaaagtctccgcctgtgaccagcactctgcctgctttccagggtgccatgggcacccagaggacggacccttttccatttttaaaagaatggaacaaacgctcttaataccaagcttccccaggccttggctgggataaaacaaccccatttattcctgaatcggagcttttgcttgagtttgggcgactttcaagagggaaagtgaactgaggccaggggaactcagcttgctgccttcc

SEQ ID NO: 207969 - DNA, 568 bp, Homo sapiens
tgactggtgacgaaacaagttgtgagcggcaaaactgagacctattttggacatgttaagtatgagatgaccattagacttcaagtcaagatgtcgggtgggcaatcataattataagtctgccatttgggggcaagttggggctgaaggtataaatctaatatttaaaactatggaactaaaagatatctcctaggtgttggggcagagagaaaagagaatagggctgaaaacagccctaaggcgtgccaacattaagaggtagggaagtctattcacctcactagagagaccagtgaggcatcccagaagccaagtgaaagtattttcagtaggagacagtgatcccctaagttaaagctgctgatgagtaagttaaggattgagaagtaaccattggatttggtgactttgataaaggtagcttcagtggagtgatgaaaacaaaaaaattggtgtacagtgatccctcctactccacagtttcattttctggggtttcagttatctgcagtcaaccagagtccgaaaaatattaaatgaaaaattcaagaaataatccgtaagt

SEQ ID NO: 207970 - DNA, 646 bp, Homo sapiens
caaaaaaaaaaaaaaaaagtttaccaaaaaatgcatagaattaattagtgatgatatcaagtttgcatgatacaatataaatagataaaagttgttttcctatatgccaccaacaataaagagttagactttagtaattaaaaacacactaccatctacaacagcatcaaaaaatctttaaaaagttaaactcatagagagtggaatgatggctaccagagtctgggaggtgaggagggagggaatggggagttgttaatcaaagggtacaaagtttcggctagacaggaggaataagttttgagatctactgcacagcagaatgactattgtcaataataatgtatatcttataacttaggaagtagacttcgaatgtcttaccttaaaagtgataggtaagtgaggtgatgaatatgttaattagcttgatttaatcattccacattgtatcgtataaatgtatacaattataatttgtcaattaaaaataaaataaataaataaaaatgaaaagatcagaagaattttttaaatagcaccaaaaaagtggaatacttaggtataagtcaaataaaatatgtacaggtcccgtatgtggaactaaaaatcaaacacctaagtaaatggacagatagtccatatt

SEQ ID NO: 207971 - DNA, 534 bp, Homo sapiens
tccaatcattaatcaaagatcccctgaaaataattctaatttaaatacaaattactagatgtataaataaaataacaagtcacataatataaatttaagtacttaaaggaaaataggcctttgcattactaattttgatgaattgaatattaattaaaaagatgaaaatacctaagacattaaaatacactgacattgtacagagtaaaatccatagctctttttatggcatacaaggttcttatgatcaatcttgccctgtaaagctttatttctcatatttccttttcttacattatcttctcacatattaacagtaaactcacatgctgtctgaactctctctggtttcttgttccttcatgctcagcccacgcttcccttctttggaataatcctcccttctcagcatcccctgcttgtggtcctcccattctttttttttttctttttttttcttttttttaagacagagtctcactctgttgcccaggctggagtgcagtggtgcaaacgtggctcgctgcaacttct

SEQ ID NO: 207972 - DNA, 411 bp, Homo sapiens
accttggagacgagccaattgattaagaggttatgtgctttgcccatggccaaacatataggaaagtgcaatgagttgattccagagtatgagttcttaaactaagacatatattattttcctagctacaattaaatgtgtctgctaataactacctgggaaaatttagcatcaaattttctaacactaatatctccaaacatttaaaatgataaaagaaaataaccatccaataagggaactctgttacatggtagcatactttataattttctgatggccttatcatgaagcacttatactccagaatgattcttgcactggcataacagatggtcctctaaaattttcagaccaaattatcttgttcaaaactgaacttgctcatttaagatgattcaagtcttgtgt

SEQ ID NO: 207973 - DNA, 139 bp, Homo sapiens
agctacctaccttaggtgatgctgagtgcttcccacagcatcgcttccatcaaaactgatcagtggtttcaggtgttgtcaacctgctctgtccttcaaaagttttcctcaaaatttcacctacggctttagcatcgct

SEQ ID NO: 207974 - DNA, 515 bp, Homo sapiens
tgagaggcacacactgcaatgcaaatcctccacgatagtccacaggatgtactgggagaaactggaaggccacaggagaaacgtttgctcacgaaaacacaggcatttcatgtgcctggagcacgggatgaagaattccttagactttgagtgccaagctagtgcttggactttcttctaaaggtcatgggtgagcccttggggaatgtggagaccactccggcctgcgatggagaaggaaattgtgccagaagctgggaagtcaaagttaaccctccaggctagatctagggaaagacttgtcagctgtttcttcacttccatgaccttggaaaatccgctgtctccaccagacactgatccttggcacagccactatttgatacacttaactctgctcaggattttagatctcaacccaggaaatgagctacagtctcaccccagtgcttgaaataggtgtgcaaacaattcacatattataaatacgttgacttgggccgggtgtggtggct

SEQ ID NO: 207975 - DNA, 615 bp, Homo sapiens
tttttgcttctgttgcctgaattttttatgtgtgttaagaaataattgccaaagccaagatcaaaaagtttttctcccgacttatttctagaagttctttagtttcaggtcacatttaaacctttaatccattttgagctgatttttgtatatggtgttaaaaaaggggggccaatttcattcctttgtatgtggatatccagttttcccagcaccatttgtggaatagactatctttttcctattgtgtcttactggtgtccttgttgaaggtcagttgataaatgtgtgggtttatttctgggctccctattctgatccattggtctatgcatgtggttgtatactaatatcatactgttaagatactataactttgtaatataatttgaaatcaggaaatgtaattcctccaactttattttcctttctcaagactgcttttgctactcatggtcttttgtggtttcatacaaattctagaatgggtttttctatttttgtgaaaaatgtctgaaattttcatagaaattgcattcaatctgtagattactttttgtagtatggacattttaataatattaatgttttccaatccatgaacatagagtatct

SEQ ID NO: 207976 - DNA, 403 bp, Homo sapiens
gtctaaaaaggaaggaggaagggaataagagtaaaatgtgtttatgtttgcttgcatatgcataaaaaactctggaaggaacagaaataatttataataatggatatatataagcggggtagtatggtaaccagacaagtaggaacaggggtgggtgggaaatttttactgttaaacccttactaattatattcttttatttctggaccatacgaatctataatcttttcagaatttgaatttaaaaacacatattttttcttcagagtaaaaatttttactgacatagctcaaccaaaattggggtattttactgactatgaagatgcatggtttctccagtttgtgcccatttcacaaaggatattccaataacgctgctcaaggctgacatccaacagga

SEQ ID NO: 207977 - DNA, 415 bp, Homo sapiens
ctctcaactcatatttggtccattactataaattcatagtgggcttctctgcctctacttttccttctccagactatcttgcacatcaccattaaattaaacacagctttcattataatgtagcacaataaagaacttttcaatggtttcctattgtatagaggagaaaaactttatctctactttttacaggatatctctattaaactgtgatcctcatattcttttgaacatacttttacttttctaagagtatgcctttgcttttagcagtttaaccttctttgagtttcaagtccctaagtaatagttattaccgtagatctagatatttatgtaccaagcattatctatagactacatatatgcacaactaccttgtgtattttgactgagggagtaaagttttgatact

SEQ ID NO: 207978 - DNA, 435 bp, Homo sapiens
aagcatcagccccacctttcatctttatgtctccaaagacctgcacagtgtctggctcatgagaggtagttaagaaatatttattaaggtgatgaatgaaccaagcaatatacaaacaatatacatattcttttctttgtggtggtgtggagaagaaagggagaagtaataagttccactttctggagtggaagggttctagtgggacaatagaagattgtatgacctccagaaccatcttaagagtgattttaggattagctactaagggccaggcacaatggcacacacctatagtcccagctagttagaggctgaggcaggagcattgcttgaacccagaagttaaaggttgtagtacactgtgattgcatctatgaatagccactgcactccacctgggcaacatagcaagaacctgtctctcaaaaaaaa

SEQ ID NO: 207979 - DNA, 571 bp, Homo sapiens
gacacaggccagtatacaagagtcaattgatttcctctagaccagcaatgaggaactgcaatttgaagttaacaaacaataccatttacaatatcaccaagaaaaccataaaacttagatatacctctaacaaaatatgtacaggttctgttaatatggaaacctcaaaaactgataaaagaaatcaaagtggagctaaataaatagagaaatactccatcttcatggaatggaagactcaatactgttaagatgtcagttcttcccaacttgatcaatagatccagtgcaatcccaatcaaaatcctagaaagctgttttacaaatatcaacacaatactgaaaaagaataaaattggaagactcactctacctgatttcagcacttactgtaaagctacagttatcaagacagcatggtattggcgaaagaattggccccataggtcgatggagctgataaatagacctacacaaatatggtcagctgatctttgataaaggtacaagggcattcagcggagaaaggacaagtggtgctggaagaatttaaatatttgtgtgtatatgc

SEQ ID NO: 207980 - DNA, 163 bp, Homo sapiens
tcagctagctgcattcaagaaaatatatttgaatccaattcctgcctttacttatgtctttcactaagtagaacttgacttaccaggttccaagttggattgtagtctaaggcacaatatctgcacttgaggaaaattgatgtttctgccaaaaaatgaacta

SEQ ID NO: 207981 - DNA, 360 bp, Homo sapiens
  misc_feature (7)..(7): n is a, c, g, or t
actctanacgatccccttcgcggtatcataatgaatgaacagatggaaaaatcttacaaaaaaattatacgaatttgaaaatgaaaagcacaatattcaaaatgaaaaattcactgttgaatttgaagctgcagtgccacatacatgccactgcacatcagcctggtggtagaacaagaacctgtttttaaaaattcacaatttatcaacagattgctaatagcaaaagaaagggtcagtgaacattaaatcaacttaaaataatccaaatgaacacaagggaagcctgggcaacatagtgaaaccctaactctaaaaaaaaacaaaattagctaggctgatggtacacgcctgtatagt

SEQ ID NO: 207982 - DNA, 731 bp, Homo sapiens
tgagattgcaccattgcactccagcctaggcaacaagagcgaaactccatctcaaaaacaaaaaagaaccattgagaggcaatgcctttccccagatgtctacttttttatttcttccttagcccctggtttctagcatagggatttgctcacttaaactttcattggtcctagagctagcaaagttcacattaaaatgattataaggggcctggcgcagtggctcatgcctgtaatcctagcactttgggaggctgaggtgggtggattgcttgaggtcaggagtttgataccagcctggccaacatggcaaaaccccgtctgtactaaaaatacaaaaattagccgggcatagtggcaggcgcctgtaatcccagctactcgggaggctgaggcacgagaattccttgaacccaaggggtggaggttgcagtgagccgagatcgtgccactgcactccagcctgggtgacagcaaaactctgtctaaaatatatatatatatgtgtatgtatgtatatatgtatgactataggtcagttctctatgaaatgtgcatgctgtgctttcacagatccagggactgtaagttatccctaggtagacacttctttatcagataggcagttggttggctagtctcaacttttgtttttttctggtacgtaatgtgtttggtatagacctttgggcctcagagactccagaggacatagttcaggctctcaagct

SEQ ID NO: 207983 - DNA, 418 bp, Homo sapiens
tcctagttcagcatctggctgagctaaataatgaaatgctcccataatacccctcggcacttggctttattaaaacacgttggcacttttaggattgttacaaacctgtgttactatcctgatagctttccaccaagtccttggatcactgaaaaaataaatcattggctgtgggagtcttggagctaaaatggtcctgcagggcatctcagctaactgaaatttgtgaatcctccacctggcctcactccacacaccgatgagggaaactcactgccttctaaggcagcctgttccttgtttggattcagctcagtctcagtcaggcacaacaagaacttatatcctcccctggcactagggatgaagtaatgcctcaggccccactctgccctcagggagttcacagtctggaaga

SEQ ID NO: 207984 - DNA, 387 bp, Homo sapiens
attgcagccatcccccgccagctgccccattctctgtaccctgctctgctgttttcttttgtccacagcacatcaccctttaacatacagtgtcatttattggttagttttgtatgttgtttattgtgtgtctccaccactagggtgcaagtcctatgagggaagcagttcctgtctattttgtctgctgatgtatcccaggtgcttagcacagagtaagcacccaagggtacctgtgggaccaaaatgaataagcagtctggggggggcagtgaggaggggctagctgggagtgagatggggtcctgggactgctcagctgtggggctgggttaatgagtggggtctgtgtgggcagtgattggtaggactgggaggatcaatggt

SEQ ID NO: 207985 - DNA, 513 bp, Homo sapiens
aagttgatcctgagctccttggaggacggtggaacatgctgacaccacaaacagagttgaaaaataggggtctcatgtgcatcccttttgtcctgcttggtttcggtgtgggtggaagtgtgctctccatggaccgcaatccttgaaaattctggcttcagttttgctcaccagatatcacccctctcctcaccatgcctgtcttcccaggagcactatttcaatgagaagctgggagctcagaagctgagcgggggatgtatcactcttaggtgaaagaagggggaagaaaaaccagaaaaggtcctctttgccccaagtgctttgcatgcattaaatctaaggagacaggtgtctttaaatctggattcttaaatcaatcacttgctgccaacatgcttccgtgttcaaagtcagttaccatgcgatgcttctgaaaatagacctgtgctgaccaatcatgactcttatataagatttagtactgacttaagcctgcaccagccaggaatg

SEQ ID NO: 207986 - DNA, 1043 bp, Homo sapiens
gaggatgcactctgagagcccgggctccctaaggtatgagagttctaaccagcaggtgtagacttttcaggagtgaggaatgaggcaggcattccaaacctggagcttcatcaccttttgtttcatctcaagacaattctgaggggctgttttggagcgtgtctggaaggtgaacgttgaagaagagtgtgggctttgatgtgactcagatgagatctttcatggggaggcaggaattcaatgcccagaatctgggctggtgtctttgaggtcagtaggttgcctctttgtatccaagtccattgttactaaattggaggctggagattctaaatggcttccagaccatctctctgattctctttgggagattgggtctgaaaaagacaatgtcagtatttttgggaaattctagaaagtctgcttggaaacctgggaagacctcttgcctagtgcctaaatattcaatgtgcagctctagccatgtagatgcttggtaggtatagagctgggttttcatttatatcagcaaaacctatgtcagagttgaaaaagtagtcaagacaaagtgtcttggtcgcaggccggggaacatcttaaaagcaaacttctagcctgatgactcttggcaatgagtgttgggtcctggctaaagtgccttgaatgcagcatgaggccaatccatgaatccaacttccaatggagaaatgttaatattttttcagtttgaatcaatcagggtgaaattaccttgctattggtttgcttactttttattatttcatataaaatctaagacaaaatacattaaatgcttattgatatatgtatttattcttcacctggctcataatatttgcctaattttaaactttcttctattttgtaggtttcaacttatttcattgtaagatattgttaaatctaatacgggcattgtcacttttacaaataattttattttatttcatgtatttcctattcactttttacatttaaattatggaccatttcatcatataaaaagctccatttctatttta

SEQ ID NO: 207987 - DNA, 370 bp, Homo sapiens
atcacctcttacagttcccacctgtcaacgctgttgcactggggattagattccaagatacgaactttggggaacacatttaaaccacagcacccctgatgtttcttggtagtaattttccagccactgacttccacccagctctttctttggcaatgaattgccacttgcccatgctgtgtttggagttgagcctaatttctctcccctactgcaaaaccttgttgcactgcttcctgtacctaccatggtggtcctgataaagccttcctcacagtactttaaaagtaacattaaataattttttctttaacctagggcagaagcatcctcaacagtccctggtccagatacacaatgaaggaggttt

SEQ ID NO: 207988 - DNA, 476 bp, Homo sapiens
aaacagcttatagtgcatatgtgattcattttatgtaaagtcctaaaattatctaaattaaaagtatctatattctatagctgtgcatgtgtgttatgcacacacaagaatatacacatctgcattttatatagatacaagtatattgaaaggatgatacattcttatacagatgtagagcttaggatttctttatcaatataagatagaaactgcgaaagcatgaaaatgaaattaagcatacttcctttattcacttatcacccgttttcagaattagttgccctatgggtaggtaccttttaaattatattgtacatctttcaattaaatatcgggaggttgaaaattaagtgacaattctaatatttctagtggaagacctgaagctgcactattaaaaagctagtaaatggaaggggaaggatatttctttatccatggagttaattacacaagcagtacactatgtaagt

SEQ ID NO: 207989 - DNA, 803 bp, Homo sapiens
tcagtggtataaggagtctgatgagtgagtagaaagaagatgagttaggtaggaaatttgagagaaatggtagatgcttgaaatggttgaaggaaatgagatatggcccacctcaaaaagagaacatgaatttgtggtagtaccaacatgtaaatgcaatgtagctggtgtagaagctgaaaacagctcaaataatccaattggaatgggtattgggaaaagagtagctgaaaggatgcacagtgaagactgggctaaataaacaaggaagtcaagccagatgagtgggaggaaaacaaaacaaaacccagatactttgctttctgaagtttccacttcagtgttcactagaactccctctagaagcctagcccaaaaggccttcctcaacatcagacttgcttgatcttcatcctaccaaattccaacaggatatagtcggtgccatctgggacgatggatggacaatctcactcactaatgtgttctcccaacaagaagggagctataacagagcaggcaaggtttctttgttatttttcctcctgcccaacattgtatatgagcgtgtgtacatgcaagcactcacaaacagtcgacacatcccaggtcatcaagcatgggctggacagaagatgagttcaattttccaaagcaaagggtctggtaaacagactccacaatgcagggttcatgccttgggtagggttggaatcacatgtggcctctatgaggatgactctggacgagttttagtgagggttgccaggccactacaggaacctaccctcccttgctcactc

SEQ ID NO: 207990 - DNA, 762 bp, Homo sapiens
tgtttctttatttcataggtcctgagatctagaggctctgtactcaaggagcttcacttgaggagcctcatctccacctagacctgatttagctgatgaaatcctggtcctcagatctaatcctgatgttaaaataggctgagacttctgggggccttgggggaaggtgaatgtcttttgcatgtgtgagaaatgtaaataatttatggctagagaggagagtgtggtagacttaaaatggctgcaaattccttgtggctcctcccattgaatctggactggctttagtcactgcttgactaacagaatacagtatatgtgatgttgtagaattttagtcacaagatcacaaaaaaccttgatcttctgccagggactttttgaatgcacctgccatgctgtgaggaagtccaggtaaccacatggagaaccacacagagacagaatttgagatccccagctggcagccctagtggagctcctagctgacacccaacaccaatttgccagtaatgaagataattcattctggaagtggatactcagttccagtggaggcatcgggtgacgctgtgtagcgcagaaatgagccatccccacccaaattgcagacttatgagtaaaaataaattactgttttgagctactgttttagagtggtttgttatgcagcataaataaccataacgttccttaacctagcaactccacatctatatgtctaccttaaataaactcttgtgaataaaaaatatgaatgag

SEQ ID NO: 207991 - DNA, 478 bp, Homo sapiens
tttttcattctgtccttccaaaaaaaaaatcatacaaaaaaaataggagatcaagggggaaaaaaaaaagagggcatggaaaaaccagcctctggtataggctttcagggtatattggtgagcaaacttttcctagagctgtttctggttatcaggtgtggtacaggttgcagggaggtggggatggggatgactagggtcacagcaggcaataactagggttattggcacccggttggtgtttggtgcctgctgtgtaacttgctgggtgttgggaatctgtatatggcatatgccatgtgcacagtgggatgtgtttaaaatgtgggagacaggagctgtatggaaatcattattttcaaatgcggtcatggcttttaggttgtgaatttttgttcctttccaaaaccggtttagatgagcagctttgctttttagtgagattgagttaatcttatatctttatgttctaaaaaaa

SEQ ID NO: 207992 - DNA, 475 bp, Homo sapiens
ctggctgatgttgggataattttgaagcttattaccttacatattagcaatctgaagtctcttattcacagatgtggcaagtgataaaccagctttgtatgttttctcccaaataatttctagaaacttaagtggcccttcacctgagcccatgttttaggctgacatggaacattaattatcaacctttggatagtgtccagttgcctgtggacatggtttaatgactgtttcgtagatgcctgttcatgccctgttggtcagtcattactcagctattttcctgagtgtctgttcgggagggatagagcagggagccagctagacgcgattccggagacaggccccaccgtgcggtaaactgcacttcctcacttagcacagcgagcaggagagggaagagctgactatggggacagggcagccaagtgttaggagatttgaggagacagcaggaagcctgcagagggagagg

SEQ ID NO: 207993 - DNA, 597 bp, Homo sapiens
atacttaacttagttcatatatattttagtgcccatcctctaattgaactttttaataagcaacatcattcctcgtccatctatattttgcatcaaatgcgtcacaccttatgaaggtgtctaaatttgttcttactatgagaatctaaaattgtcttgcttctaaaacctggtttgaagatctaacagaaaaagactgattttaggaagctgtatgttattcataaaatcattatgtaacagtcttcatttcagagcttccttcagctgatgtgtttatacaaaggagctctgctaaaacaagctgattagaataagagggcgcctatgatgtcaaacatccccacagacctgactcaccccacctgacagcaacggcagccagcaattctgacctggttaatgagagcaaaacagggccaagcacttggtagcagctccagcccagtctctgtagctcaggctgttggttccagatccatggacggcaaactctagaggaagcccatgtgcggctggctaggtataggccaaggccagcactgaggcagaagcctgggcttgctccctggaccataatcaaatcaggggcattcc

SEQ ID NO: 207994 - DNA, 394 bp, Homo sapiens
tctaccccgctaatacctttattcttcttgagtgataccaggagaggaaagcaaaggatgacacagaaaattctgataaaagaaggtgacagcaataaggctaaataaactgttcagctagaacctctcaagttgaaatcagaaattttctcctgatgtattgtataatatcagtgtcctcatttgttattacagcattagctactaattgtctcccattgtctatttacctccttcttccttttagcaatagacccatcctcccttgcagttttaggaagcccagcttgataccgcacttcccaaactcccatatggctaggagtcaccaggtgatgacattttagaaagcagaatgtgagcaaaaatgatgtgcccaacttcctagtcacat

SEQ ID NO: 207995 - DNA, 340 bp, Homo sapiens
aggaatcaagaatatacacggtccctgagcaaaggcaggactgacatgaagcaagagccatgtcctacatattgcccacaaaccagaagaatggtcccacgtttggacttgtatgatcaactgggtgccagtcactcctcccaagcagaggaacaagcgagagccaaatgtcactgcttatatttgagaagagtggaaaaccttcatgaaatgagaacaaggagtacagattgctcacaacagttttcactgtactaatagccatgtatccagcttctgtagactatcgcaagcctttataatagagcccgaagttaacatcatgctgcatagatgatag

SEQ ID NO: 207996 - DNA, 219 bp, Homo sapiens
tctgtttctattggaataagagacaagtgcttgaaaagcagaggagagtcaatacacaggccacatcttctctcactccctccttcctcctcatagctgtgagccaccccagtccctgtacctgcttccttggctggcatcatctaagaaatcatctcttccacagtttcctgcaagggcatcaccccaagggaagctgaacacatgcaacatctgccc

SEQ ID NO: 207997 - DNA, 1224 bp, Homo sapiens
acaaatataaattatgaactatcattctcctcacttcagagaaggatctgaggcagagaggctaagcaacttgttcaaggtcatagaggtagtaactggcagaactgggatttgaacccaggcagtttagcctcagaatccacactattcactgctatgccatactgactgcctgcaaggtctgattggtctcccagcccacagcaggcctcagggagtggttgctgaataaatgagcgaaggaaggaataggcaaatgaatgaatgaaagtgagcaaaagcagagtgagctcccaggtgcaaggcaaggaccttagagagcctgcaccatgcaaatgagtctgacgtgagtctccttgttgctgaagcagctccgctgtccacagccctggggaaagtcaggcgatcagaggagactagcaggtgccattggcctccacccactacagatgctcatctcttgagcctcctgagatgttcatctcccagccccctgcctcccccagccctgaatgctgcaggattagacataggcccctggggagctgatccctcctaaggacaaggcttgcggatctcagggactggagggggaaggtccccaggctggagagccaagtttaatcctggcatggcattgactggctgggtgaacttgaatgagtccctgcccctctctgtgcacaggtgccctccagctccatattctgagattcaccacatgctcagctgccctcatggatgggtgcaggtgagctgtgggtcctatagccatgggcaaaagggacctgtccctagagggaaagcggaaaacgagaatgaatcccacctactactcactgcaagtctgctgtacgccaagcatttcaacatgaacaatttctactccttgcagcaatcccactgggcacggtggcaggtgaggagggccttagattcagctaaaggaggctaaaagccagggtccaacccaggcccatccaacttcaaaactccctactcttgtgacaagagccaagaagtggaacaacccaagggtccatcgacaggtgaacggacagacagaatgtggtctagccacacaatggagcagcactccgcctgaacaaagaaggggatccagccacatgctgcagcatggatgaaccatgaggacactatgctaagtgaaataagccaaatattgtacacttccacttatatatggtatctaaaatagtcaaa

SEQ ID NO: 207998 - DNA, 665 bp, Homo sapiens
gcaaccagaaagttttaaggtctttcaagtcgtataaaatggacctgcagaaacgttggaatgttctcaggatgcaaagttggagctgaaatgtgatatcaaacagttgcaaaaaatgtatagcaaccatgccttgaggtcaaacctggtaccgagatctgcaacaaaaagcttcaagacacatagtttgttgggcttgtcccacatggtcgcataatctgctcatgtgtgaatttcacaaacgactcgtattgctctgctagtttggtattgaggattttctcatactcctcccaaatcttctcttcatagtttgagagacgtgtacatattgttctagcttgccggagggccaaggtgggctggtccatcttcacccaggagaaacctgcacactgggtgctgggtgctgaggactgaggctggctttcctaagcacaagctgccctctgattaagaacaacttctaaatgtgtccacctctgataatgattctattatatgttgaaaaatgtgtttcggagttggaaggtcctctggcggccaggcggggcaggctgctgcagggtcgcggtggggtttgcgtctgaaacgccggcggtggctcggcgtcccagggcctggggcccggagccgggcggggaagcggggagtggcgcggccgc

SEQ ID NO: 207999 - DNA, 779 bp, Homo sapiens
tgagtcagtcacattactcagggggttccattcatgctaaaataacaccttgtaagtcacatggaaagaagctgcagactgaacaaacatgctgagcagttttactagtgaagatcaacatgggaaagttagcaagtctttgtttttcccatccttatcttttatcagtaaataaacatgagttcttgatattctttttcctgtggagcccctcgtttggacaatactatagtctcattttaaggtacaaaattcagtgcctgcttagaggattacagcatggagtaatcatattcacaccagagatgaaaggccagttagtagtagttccaggggtttttgctgttcccttgctcagtttctctagacttctttccttttgctatacaattgcagtgtaaacaaccttagggaaattataatgtttagactcaaagtaagaagaaataaagatggaccactagagaattgtagtaatctatttttaaattgatattgtgtctcatttttgtataacttttgaaataaaagtagattatgtcttaaaattgtaagtttacagtttgataactgaaaaacatttttaaaaaggcaatttttaatacaaaggtagataatttaggaagacagataaataaaatgaagaaagtaagttacttgtgatctcaccagtctttttagatacgcatctatatttatgtcacacatatctgttttatttatgtatttatgcacctttaattaaattaaaattatattgtttttaattttacatttgc

SEQ ID NO: 208000 - DNA, 342 bp, Homo sapiens
ctgaaacaggaatggggcaaagagaaaggagagccaggagcatttaaaaatcagcatctgggccaggcaagatggctcacgcctgtgatcccagcattttgggaggccgaggcgggtggatcatgaggtcaggagatcgagaccatcctggctaacacggtgaaaccccgtctctactgaaaatacaaaaaattagccaggcatggtggcaggtgcctgtagtcccagctactcgggaagctgaggcagaagaatggcatgaacctgggaggtggaggttgcagtgagccaagatcatgccactgcactccagcctgggcgacagagcgagactccatctca

SEQ ID NO: 208001 - DNA, 252 bp, Homo sapiens
gcaggtgaagtttgggattccatccacccctcaccagattttatcctcacccttatctgaacttattccttctcacactctatgtcccaggattaaatctcaagatgatgaaggaataccccctcatgacatgaagcacctgctcatctgggaagctaattcaatgtaaattcaaggggacctaagaacaggactgctagtgtctccatggttaggctgcaggacaatgaaacactagatgtcatttttttt

SEQ ID NO: 208002 - DNA, 432 bp, Homo sapiens
agcacttttacattattgtctagataaagagatgccactcttctacaaattggtacttacgaatttattttgaggatctgttcggctttagtccacaaaccaatatgccacaaacttttaattctttatcccaaaaagggggctacaatgcatagatgatttaccagtcgccctcatgctatgtagcatgtgctcatacgtcatgtcgaaagtaccagaaactggaaaaggaatcaattcctttttttcttggcttggaacagggagaagcaaaaactggtagaaaagtctgacatcacctcttgggcctgaccctccatagccacaaaacaagttggccaggaatccaggtagaatctgcaaaagcagactccaggtctcacactggcctggcaataaagtctttaggatgttaatagaggttgagtgaaa

SEQ ID NO: 208003 - DNA, 195 bp, Homo sapiens
tgtaaagaatagtaaattataaatttgggagatggtaatcttcaaacataacatcatcaatttttagatctttctttgtgtctaaacatctgtagagctacactgttccttttaaaagattcttaagttcccgacttcaaagaaataatgaagatgtatctatcaaagtgtggttttcttaaactgttgttttgt

SEQ ID NO: 208004 - DNA, 447 bp, Homo sapiens
caggtttattttgattttgtttcttcttgagtcagctttggtagtttgtgtctttctaggaatttgtcagcttcaattaatttatttgatttgtcggcacgtggtttttcatggtattgtaggtaaagccggatactccttcgtttttcctgtaaagtcagtagtgatgtctcctctttcattcctggttttagtaatttgagtcttctctctttgtttcttgttgtatagtctagctaaaggttcttcatacttctggaatcttcacaagaaaaaggaaaagtttttcaatgttgggtcttttcagagaacaacttttggtttcatttattatctctgtgatttttctctgttgagtttgtttctgctctcatgctttattatttccttccatttgctttaggtttgtttgggtttttttgtttttgtttttgttttttttgagac

SEQ ID NO: 208005 - DNA, 180 bp, Homo sapiens
taaataatgtgacatcttaatgtgtactgtctaatcgttccttctttcttttttttaaaacttgaaaatgtgtcagtgacttctgtgtatatttacctcattcttgtaaattcctcaaaatgtccaaagagtaaaaatataatttaagtttatttgtagatatctgtacttttaattttt

SEQ ID NO: 208006 - DNA, 176 bp, Homo sapiens
tacggtactttgttacagtggtcctagcaaaccaacacacaggaattgttcactgcctccaaatacctatatatctataacctatatccacagaacacagataaaaagcttcatctcccagccttccttgcagttgtggtcatgtgaccaagttgtagccataggatgcaaatgga

SEQ ID NO: 208007 - DNA, 327 bp, Homo sapiens
agccagacaggccaggccacacctgctagagcttccaacccagtggtcccacttctacctgaactctgcaggcaggtgcaaccccgtgtttactcaggaagtaaacagacaacaacagattagggctgacctagcaaggatacaacctatctgtcaactgaggttcctgtctgagggagagccccatggacaagaacactcaacaaaagaaacatgggcacagagacagtaatcagagagggctcctccaagacccaggagcaggctagaatctaagccagtcaactgatcccaccttatactgtaatcaaacccccaaggttatca

SEQ ID NO: 208008 - DNA, 505 bp, Homo sapiens
cagaaaaccaccaaccagtattctgatttaggttacatgttatggagcataatctcttcacatttgatatcctgtggttctcattttttaatactcaatttcttgtttcaagattaaaatttcagatatgtgtgatgattctaacatcagtgaataaatgtccagaatattaaagccccccacagctatatgatcagataatagactacatgaaataattttcaagaacctaaactagaattttaaaaatatatatatcaggtttcaatccaaaggaagtaagagatcaaatagatcagacatttcaacaatactaattagttgtgttgactcttatgaggcctcacaaaagcatttggcaactttcaggtaagtattactcaataccactttaaagtcctcagtacttcagttaaaaatgccaacagatgaatttagtgataacaaagtttaagtgtttatgttgcttgtaattttctcattcataataaattaatttttaata

SEQ ID NO: 208009 - DNA, 228 bp, Homo sapiens
aggttagattcttgctgagaaaaggaatcagtattgtctgttaaagccacatgagtgcttctttgttattttagcattgattttactgctgattcaaatattgagttggtttttctccttaacagttaaatctctgaatatgtacttgcttacattttgaatatgcaaatcagttacagattgtattctttacaaaaagaggaaagctgtaaacttctgatatctttt

SEQ ID NO: 208010 - DNA, 363 bp, Homo sapiens
gttctaagtgctggggatgaaaagatgaataagcaggacaagacgctgcctttgtgggtttacgtctttgtgaaaatccacaggagctggaccagtacttgtaagggaatttctaaacaagcctgattctactcggtgtcaagattagaatagatgggtgtagtaggacagtttggccaattagacttgaggtcttctctaggcttcactgtttccccacctcttaaagctggggcttcaattacatttttctttaaaaaaaaaaattgttcttttagaaaaattaaactaccaatactgatttttgccagtagatggcagacaactgcatttgtgtgtccaatgagcgggtcaagtttttaa

SEQ ID NO: 208011 - DNA, 160 bp, Homo sapiens
ctctttgtttttgcccctgctttgtcctgctaggtgaggcctttatctttctaaaattttctcctgctggctttcatgtcttgagtaaactttactggaaaaaccctcacagacatttaccatctgggtgtaatgagactcctatgtgcctacgtctagc

SEQ ID NO: 208012 - DNA, 365 bp, Homo sapiens
aaatgatctcagcaactacaggttgaaatgttaatcaggatagcgatttgactgagtttttaaaattatatagtcacccctcggtatctgtgggggattggttccaaaacccaccaaggatacctaaatccatggatgctcaactccctggcaaaaaacggcataatatttgcatataaagtgtgcacatcctgccatatactttaaatcatctctagattacttataatacctaacacaatgtaagtgatgtgtaaatagttgttacactgtattgttttgatttgtattatttttattattgtattgttattttttattttttctgaatatttttttatcagaggttggtgtgagagcgttgg

SEQ ID NO: 208013 - DNA, 251 bp, Homo sapiens
acagggcgaagactctgctccccttcggttattctgaactcttaataatccagtccctggctgggaatttttcctgaacccctctaccacatccaggtagatggtctgtgagtattggatagaagccctagtctcaaccgtaacccctccatgtccataaagatgatgccctcttttttcctgagagttcccatctcagttgtctctctgggctaacataataattcatttagacaagtgggaagagagac

SEQ ID NO: 208014 - DNA, 932 bp, Homo sapiens
tatcagactgaggctgaatgaaatccaccagtccaccttaaagacagctatcctgggaatgtgggcaacgtcccacttgcccactgctatagcttatagcaccttacactcacctcttcctacagattatttttgagtaacagcgtgaccatgttgtgcatttagccaagcaaacctttctagcttaggtgaatgagagggagcggccaacgtataaaacaaaatagtaagttcataaaaattacagtgcacaatagtctcagataaaatattaattgttaaacagaattccctgtatgtgacatgttctctttcctaataattttcagttatttcaaactttttactcaagttttttcaagcctccaattaaaggtgctgagctgcaccagtctctgtgacccccagctccaaccttcttcactacaattttgggggtactagcacatgccaggtacagtactcaattataaatatatgatttgtgtatatcgtgtgtgtgtaaaacacttcattttccccatggaaaaatttatccctcaccaccaccctataaagtagagtttgttacctccactttatagatgaaacaacaaggttccaagaagatgttgcataatattctacagatgaaataattaggaaatcaggccgggtgaggtggctcacgcctgtaatcccagcactttgggaggccaaggtgggcggatcactaggtcaggagttcaagaccatcctggctaacacagtgaaaccccgtctctactaaaaatacaaaaaattagccaggcgtgatggcaggcagctgtagtcccagctactcgggaggctgaggcaggagaatctcatgtacgtgggaggcagaggttgcggtgagctgagatcttgccactgcactccagcctgggcaacagagtgagactccatctaaa

SEQ ID NO: 208015 - DNA, 600 bp, Homo sapiens
ggcctgcagcttgtttaaccattcacctgttaaaagacacctgggctgcgtccagattttagttgttacaaataaatgttgctctcaacagtcctgagcaggtttttgttgaatataagttttcatttctctgatataaatgcccaagagtacaacttctgggtcatagggtagttacgtattcagctttattaaaaagtgcctgttttccagagtggccatacagtggtttttgtttgttcttttaaatgacttaacaatggaaggaaagacgcttctgcatggcctggcatagaaagcccatggagagccgccctgtgggtggggaagcgggtgacgggagccccactgcttaccagaaacccgagtgaaactgcgtctttccagtcccaagattctccttttttgctaaaggcatcagaagagatgaaagcatttctaccacccacatttcggggacactcctagcttttactttagagttgggagagaggtttggttttcattgtcatttaaatcctgttgggtttcagcagagcctgatctttagggccctgggtgcagctgttgtctggagatgcagatcactgtctgctgaaa

SEQ ID NO: 208016 - DNA, 767 bp, Homo sapiens
gggcatcttttctatggctttttgtttgtttttcttttaagaatggccccacactgaaccatggtagagctattagtttgtagggccccagatggcataaactcgagaagggattgtccacggaaatcaccagcagacttcagcccgaagctgagttcaggaagtccagctgtcactgttgggaaacatctaggagtcttccttggatccataagaagctcttcccctaaaggcagcacagctaactctactctctacctgccacaactcagtcaagaattggcacctgtagccatctgggtaagcctcgatgcttctttcagggatgtgacacaaatggcaactcggagctatttgttactgcttgtctgtcaagattgtagccaggttaatgggtcattttccttctctccagactccaccactgactgatttcagaagaggtagagaactccaaactgtcccagcaggtttgctttagacaacagagcacagcccacatggccctacctgttcagaaagtcatgttagatcaacaaaccacttccattctgagtgcacttttataggttttatgctttagcatgtccgggagatgagttaattaacaatataaacattatgtgagtaaatggaaggtccaaactttaagtttttcttataaaaatattggagctattcatttaagaatttgctcaaaagggaacataacgccaaaaggaaaatgcatgtaggtataggaatttctcagtttagtagggccaggg

SEQ ID NO: 208017 - DNA, 297 bp, Homo sapiens
agtgccttcaagataatatccacaccctttgcatgccacacaaacttctctacaacctggacggactttatccaccctatctttccagtgtccccaatttacctatatcaggatgcctctactagagacagaccagaatacttatctcccccttcataacttacccatttttccacatttatatatttttcatacaatttatctgtctagaatatagctctatactcatttttactgttcttagccattttgcaaagcccagcttccagttagccttttccaaaagtcttgtaagac

SEQ ID NO: 208018 - DNA, 515 bp, Homo sapiens
ttcagtctttcctggcttttcatgaccttaagtgaatactaatcaattgttttgtgtagggaatgtttgagttttctcacaattaaattgaggttttgagtttttggcaagaaaaccacaaaagtgatactgtgtcctcattgcatcatgtcagggagtacatgaggttgatgttttattattggtgatgttaaccttgatcacttgattaaggtatgtctgccaagtttctgcattgtaaagttactagtttcttctttggaagtgatttaaaatcttgtggaaatattttgagcaatggtaatatcctgttttcatcaaactttcaaccactaatttttgcatccattagtggatcttgcctgcaatttattgtagtatttccaagttgatgattttctgtcattttttccctacatttactagtaggagtttgttaattaaattctgtaaggaaaagctgttcctcctcatttatgtatgtatttataaatacaggtcatttttattttatt

SEQ ID NO: 208019 - DNA, 526 bp, Homo sapiens
ctttcatccagttttattgttttaaagaacttttttctttaaaattactgtagatgaacaaaacattggcaagtttcaaggttctgtgtctaattttggatcccatccaaatctacaattgctgcagataatcaatagcagacatatagtagagcaatggaacttattaccatattaacatgacatctttaccccactgttctgaaagaatttaaaaccatactaatgcagttatgacagtgaatgcaattcacaatctgccattgaggtttgtaattacatcgttttaaagcagtcctaaattatgcagtgggaggaatacactgatttaatcccaactcagtgaaatcagaaaccaagcaaaattggtgggacagaaagagcataaggaagatgagagaatttgacgacgtgtcttgctgggatttatgtgctttacagatgtttaattacattccaatagtatatacagatttaattttttttaaccttgagataatttatagtaaaaaaaaatgctgaatta

SEQ ID NO: 208020 - DNA, 380 bp, Homo sapiens
ccgatagcttaatagtggtttgtgtatgggacacttctgtaatgaataatttttttaaattaatatatgttacttttgtcactttaaaaaatgcttaagactagggctgggcatgctggcttacacctgtaatcctagcgctttgggagattgaggtcagaggactgcttgagcccaggagttcaagaccagcctgggaatgtggcaagactccatctctacaaaacatcaaaaaattagccaggtgtggtggcacactcccgtagccccagctatttgggaggctgaggtgggaggattactgagaccagaagttcaagactatcctgggcaatgtagtgagactttgtctttgcaaaataaataaacaaataaaaatg

SEQ ID NO: 208021 - DNA, 258 bp, Homo sapiens
atagttggcaatggcaacattaaaataacaacgaaataatggtattaacttttagatagatgctgttacctgctaaattctctgagcctaaatctgcccagtaaaaaaaacaaaaaacaacaacaaacgacatgaagatactaagatcttgtaattagaaggcttgagggattgaaaagctattaactttctcatgacatgattggttattgtatacattctacctaaagtgggcatacatcccacacatcctaaagt

SEQ ID NO: 208022 - DNA, 481 bp, Homo sapiens
tatttctccagcaagtttcatatttattttattgtatgccattttatatccttgagcatagtcataactaataacagctttaaaatccttgtcagtcagttgtgttggcacccacctacagtccgagctacttggcaggctgaagtgaaaggaccaccagagtctaggagctcgaggctgcagtgagttaagattatgcctgtaaatggtcactgcactccagcctgggtgacacagtgagactcctgcctcaaaacaaaacaaaacaaaacaaaacaaaacacacacacacacacacacacaaacaaaaaaactttttttttttgattttctaattactatatctgggtcatcccatagtgtcccttggttgccttttcttgagtatacatcaaagtttccagtttctttttatttatatctggtaattttggattgtattctacatcttgtgaatgatactttttagaggctatggatt

SEQ ID NO: 208023 - DNA, 325 bp, Homo sapiens
ttagatcagttgactgatcatgctgtccattttaagtatgtccttactgattttttgcttgctgtatctgtccatttctgatagaaggctattaaaatttccagctacaatagtggattcatctttttttcctagcagttatatcaatttttgcctcacatagtttgttgctctgtcgttaggcacatgcacattagggattgttatatcttcttggagaattgactcttattatgtaatatgcctcttcatccctaataattttccttgctgtgaggtctcttctgtctcaagtgattataggtactctggctttgttttgatt

SEQ ID NO: 208024 - DNA, 221 bp, Homo sapiens
taggaattactgaaaattggccggaccaccaactggtctgtgatctgcctttggcctattcagactttttttagagggaagggaggcagatgcttccctcaccaccaaatcacatgttgggaagccccaagagtactgcatatagaggttatggtcatctacaaaatggtagagtgtcatctctgtccctggctggatgtttgccaaattgcaaaaattag

SEQ ID NO: 208025 - DNA, 169 bp, Homo sapiens
ctcccacctgagtcactgggattataggctgagccaccactagtgttttgacagacttttttgaatacctagagcttccctccaccatcccccaaaaaagagtagacagaaaggaggacaaccaccttctcccagtctttgcagaatggctgtgttgggggacactgtg

SEQ ID NO: 208026 - DNA, 881 bp, Homo sapiens
ggtccgagacagaatggtacctacagtgcaggctatgtttctgtgggaatggaaaagaggactttagaaagtgaacctgaagaactcttatttctaagggaatccagtcaagcttgagaaaatgaaatattcttgtgtgtagtgattcagctcaggatattgaagtcccttttaaaaatcttattttcacctgtaaaaatagaataaaaattaatggcaagcctgcgccaggtgcctgcccctcctaagcactttacacgcacagctcattcaacctcacgtgtcgggagcatcagggagctcaccagtctcttgaggatcacaggccaattgcttgtccttcccgacccaagccccaccccacagtgtcttgctctcttctgattttacaggttttttggcagtaatacacatgggagtgaaattgaaatcctccctattattttccctcttttcctggaaagccgttttttgccctcacaatcattcattacttctctaactagggggaagtactacaagctgtcctcaggtactgcccctacgtgtgtttccctgggatggggccttgctagaggtgattctgctgccccagcattgggaagcaggaccagtgcatgtgccccatgcagccacggtacatggaagctgtcacttgagccatcagaccggctcagcccatgtgaccggagctctgaagaggcacacacgcatgccccgcacaggctgttagcacttgtcgcctcgctgccctggtccagactacccttgcttgcgtcagtcaaaactgttgtaactactttgagtcttttctgcatgattgctctttgagagaactttaacaagggaattaaatttaaaatattcaaataaatattttg

SEQ ID NO: 208027 - DNA, 460 bp, Homo sapiens
tgcaaagcactgaggtcaagatgtgggcataggagagaagcacctgcagctcccacctcctggtggtgggcacctactattcatccattgccatagcctatgtggcctacagggctgacctgcccctagacttccacgtcatgggcaatgtggtatatgccattctcacacctgttctcaaccctgtcatctacaaactgaggaacaaggatgtcaaagcagccatcaccaagattgcatgtccccaggagccaaagaatgctaggaaaccctgattcaaagaaataacttcatcttctctcataaacatcaataacatagagggaaaagtggaaaatttagaaagcccagtagttagaacactcattctcaaaatattgtcctaggtagtcctccattataataaaatgataatttttttcttaattcatagaaaaaagagtaggatttttaaattcaa

SEQ ID NO: 208028 - DNA, 322 bp, Homo sapiens
cagaaatgtgatgcccacatggaataagacttggctcaaatattgactacgccccgaagctttgcctgaccactgccgccatccatccacctccagttggaagcacctcagagctaattgaaatgatggggtcccaggtttatggacaagcactgacacatttgctgtagagaactactaatgcaaatattccaaaccacaccaagaacagcaagatgtttctaaaatatttggagttatggtagtctcacttttatttgttgcatatttattaacttaaaattaaatatgctaataaacctttccacatcttataactcaa

SEQ ID NO: 208029 - DNA, 416 bp, Homo sapiens
gcaagctttggcatttctctgaacaccggcggtgagggggtggggggagagggtagctgagtattgattggcccagtgacccctgtctcctcctcctctcttccaactctaattgcaatcctgaatgctgttctcctgcagcttgtcaagcactttgccaggatgggtggctttgaaaattgtcctgttggactccagggtgggtctgcaagatgacagagcagctttagtttaaggtgtctgaaaggttttgttttgtttgtttgttttgttttgtttttccccagcaccatggtactggcaattgtttgaagaaggtcctaaatatgcctgggtttgggagtctcggcttctactgggaatgatacaagaggtcaaggctacttgtaatgaataaatcctgttctctgccacga

SEQ ID NO: 208030 - DNA, 538 bp, Homo sapiens
agagaactatcatgccatccagtaatcccactactggacatttactcaaaggaaatgaaatcaatataccaaaaagatacctgcactcctgtttatcacagcactactcacaataacaaagatatggaatcaacctaagtgtccattaatggaagatacgataaaggaaatgtggtatatatagattacatggaatactattcagccataaaaaataataaaatcatgtctttcaaagcaacattgatggaactggaggtcatcaagttaagtaaaatgagccagacactgcgggtcagataccacatgttctcactcaatgtggaagctaaatgatgtgtacacatggacatagagaggggaatggtggacagtggggacttggaggtgaggcagtggggagggatggataattggaagttatgtaatgggcacactgtgtgttatttgggtgacggatacactaacagccatgacttgaccattaccctatctatgcatgtcataaaattgcacttgtgccctataaatttataaa

SEQ ID NO: 208031 - DNA, 944 bp, Homo sapiens
gaattgaacaatgagaacacatggacacaggaaggggaacatcacactctggggactgttgtggggtggggggaggcgcgagggatagcattaggagatatacctaatgctaaacgacgagttaatgggtgtagcacaccaacatggcacatgtatacatatgtaacaaacctgcaggttgtgcacatgtaccctaaaacttaaagtataataacaataataataataataggaatctaaaaaaaaaaacaatttaaataatgtcacctaagattttttacaattagcaagtgctggggattcaatccagggagtctgacatccagagccaatactttactacatgaaacagccctaaaaagagcagagaatctgtcttcacagattttcaaagagtaaggaaacatggttaggcctagtggtcagggaatgctttgtagatgcagtggggtgtggaaagaggccatgaagaagaaagaggatttgaaagaagagagaggaatgaagaaagacttctaataaatatgcttgctacgatcaattctgtgtcctcccttttctataaaatatgatccttggcccctataatttcttgactctaaatgtttgaaagagtgaatcagcattatcatggaacaatatgtgctgatgggtatagtctccccctttgattggtactttgcaagtttcacaaataactaaccacctgagaacttgtctcccttgaactgaattccattttaattttgttcaccttcttgattctcttctttttgtgtcaaaattgtacttttgcaaagatgatttcaaaagtgttttctttctgatttagtgcggccagttttcaacattcggtctgaaattgaggagttgctgtatgaaaagtgaatttatttgaatggtaaagtttcctgtgaacagaaataaagtattgtttcactctg

SEQ ID NO: 208032 - DNA, 224 bp, Homo sapiens
tttgcaagtattttcactcactctgggttgccttattactgttgatagtgccttctatttttctttacctatttatttatagaggtgggtcttcttatgttgcccaggctggagtccagtggcatgatcataactcactgtagcctcaaactcctgggttcaagggatcctcccacctcagcctcctaaatagctgggaccactggcatgcaccaccatgaatg

SEQ ID NO: 208033 - DNA, 326 bp, Homo sapiens
gcctggcatggtggcacatgcctgtattccctactcaggaggctgagacaggaggatcacctgagcccaggagtttgatgctgcagtgagctatgattacaccactgcactccagcccgggggacacagcgagaccctgtctcaaaaaacaagagaatgaagcatcctgcaggagccctggctcgatgcctggtagccactataaataaagaagaaccagcaggctgtgtggatgcaaggcccagtgctcccctgttctctgaggaggggggcattaagcaccctggggccccacgatgggcagcaagagtttgccgagggaggaa

SEQ ID NO: 208034 - DNA, 184 bp, Homo sapiens
taatagacttccctaagcagcagttactaagggagctgtgttaacaaaacagtagaggggtttttgtcttggctcatctaccagtatttcgattccatgtctgcccttaaattgggttgggtaatattccctctgcctctgggagtcacagatcatcaacaggtgggaagggacggagagatca

SEQ ID NO: 208035 - DNA, 229 bp, Homo sapiens
tctggttttacacaaaaccaggtggggtgtgagtaggtcattgccctaaccctcagagtcacttttttcccccactctcaccccagacatgccagggaaactccaaagctcctcagagacagctcctaaagggattaccaggcccagttctccaacctgtacaactgccagccccattccaggtcctgtgatttcaggcaagggctcttctcttggatcccatggtcca

SEQ ID NO: 208036 - DNA, 187 bp, Homo sapiens
ttttcatggtacctttggggaattggaagtcaatatttataaaaattgaactcagtattctaaaagaagatagaggggagaaattcatatgtaataaataagaaatcattgagatgctggagaaattaggtgtaagaaaggctaaaagaaaaagaaaactcagatttcaggggagaaaatagagtac

SEQ ID NO: 208037 - DNA, 360 bp, Homo sapiens
aagagaatggggttaagccatctaaactcccagccagaacgcactctctggtaacaccgatgtgcctaataccacgtggttttttcctcacccattttatacggggaataactttttaaaaatctctttgccatagcataatagtcatcactggttaaggaaagacgcataaagagatgttaagcaggatacaatcgcaaggcatctcaccataaaatgagacgtgcttattaatgacacaggcaaacagcactaggaatggacaagtccacattaggtgcctcctgagatggtgtactgagaaggacacactttacttctgtgatattcctgacaaaaatgcataacctggccaggcat

SEQ ID NO: 208038 - DNA, 372 bp, Homo sapiens
accttatcaagaaaaatggaatggtgccaagaactatattagagttgtaaaaggaaacctaagtatggaacattctaaccaagaagtatggctgtaaaaagatggaggaaaaaagaagagaagatacagtagggctgaagaagggttctctttttgttttatagcattcaaagtcttcattatgttaaggggttaaataaagacctggtaaagaaagcacagaggatgaaagtcccatgtgagatagaggggaataaatccagtacacaggagtcagactgccctggagaccccatcgtgcctcattctctggcacggtggggtagataatcaccataatagatgagtttaaagctagaggacacaggagtt

SEQ ID NO: 208039 - DNA, 326 bp, Homo sapiens
tcttatgtaactaaatcttgtgagcagagctgggcagcaggttgctccagggtttctctagtctcatcttagaacaagtcttggtcctgcctttccaaggctcctcctcatagtgataaaatgcctgccaaccctccagcttctcttccctttaggttcaggtctggtagcaaagccttgctttcttggtcctgggggtcttttacattttacttctttaagtcgaatcatggactgatcctgaaactacccatcacactacaagaactgaatgtgggaaagcaatagaactccaagtaaaaattgatgactgtttcttgttgttg

SEQ ID NO: 208040 - DNA, 572 bp, Homo sapiens
ttgcagctgaggtgacctagaggatccctcttctcccctgacagtctactgtattgaaacctcaagcacacttttatagtcttaacaaaatccatcaaaagtcataggcttctggagacagattattaccttcccagaaggtaatctttttaatgtaaatagactgtcaaagggtaaaatttaaaaatattaataagatatccaacagattttgctttagaatgtccgtgtccctccattttagtgtatttttcccacatagagaagatactgtacctaatttgtgtttgcaagagtataaaataatatagctttttttatgcagagtggaaaaaactgttgtgaagctaataactttaaacttgtatctggaaagctgagacctgatagattatatatcaaattggtatacaacttatttggtaacatatataggttgagtttcaaagtattgtagctacatcagaagataaataacaaaggaaggatatgtatttgtgaaaccagaatttcatgaactctagaaaaggaagaggagcaatcactttgcacaacaaagaatctttattcat

SEQ ID NO: 208041 - DNA, 194 bp, Homo sapiens
gtcatgtcaaaatttcatcatgaatatgtgacaagtacaaaacataagttttaatcattaattaacaggaatgtgtatgtctgtacacatctctaaagtacatgtgtatacacacacacacacacacacactttagagatgtttatgtgagcaacttagacatctgtgctgatagtttaaaactcctgtctacc

SEQ ID NO: 208042 - DNA, 617 bp, Homo sapiens
caggggaggaggaagcggctggccgctgaggggcggcggggcccggagcgggggacgcgcagggcccggcggtgggcgggcgggtcggcgctgccccgtgggctcgctggggagccacggcggagacccccgccctcaactgaggaaaagacaatttctctctgattcagaatcctgaaaatgtgatctcccttaaaaagaggacagtgctgctgtgagtttgacgaagtggacatcacctgcagtcagtccagagctgcccagtcttgaatataatcatggccaaaccttatgaatttaactggcagaaggaagttccctcctttttgcaagaaggaacagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctac

SEQ ID NO: 208043 - DNA, 561 bp, Homo sapiens
caggggaggaggaagcggctggccgctgaggggcggcggggcccggagcgggggacgcgcagggcccggcggtgggcgggcgggtcggcgctgccccgtgggctcgctggggagccacggcggagacccccgccctcaactgagaggacagtgctgctgtgagtttgacgaagtggacatcacctgcagtcagtccagagctgcccagtcttgaatataatcatggccaaaccttatgaatttaactggcagaaggaagttccctcctttttgcaagaaggaacagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctac

SEQ ID NO: 208044 - DNA, 464 bp, Homo sapiens
taaaattgcagatagaattaaaaacttgcttatctatttttagtagagggaaaaacctaaataagtttaattctagtaagttgctgactctacacaacaacttcctttcagtcttcagataatggaaactttgtggatttatgcacagcacccaaaccccagagatctgccccaacagaaagattgccaacaaaatgtttgtcttaatacttgaacaaatttttctcaaacttacattgtatatttttctccaccagtttgctaaatgtccacaaggttaatacccgcccagccaaatgaaaagaccactgggatcaggtgcggtggctcacacctgttatctgttccagctacttggggaggctgaggtgggaggatcgctgtagcctgggaaatcgaggccgcagtgagctatgatcaagccactgcactccagcctggccaacagcgcaagagcctgctct

SEQ ID NO: 208045 - DNA, 306 bp, Homo sapiens
tatcagatgctaagtagggaaacgtatttaataaaatttaaaaatttcagatatactgtcaacggaaaattaagatgagaaaacagaatgtacaatatcattggatcgttaaaaagacagacaagcattgaggcacaggctataggacatcaatacattgagaaagtctggtagtttatttattctgttacattacaacatgatcatatgttaccattacttttcttttagttgctatcttgattttcttttttgaatatatttcataatcattttaacactgttcatacattaacttaaaaaata

SEQ ID NO: 208046 - DNA, 489 bp, Homo sapiens
ggccgtggttgtacttctgactccatccatgacaggcaaactgtcatgtgggagttcagtcagggtggtggggaaaattacagaggagaagttttaagataaagttataggaaatagacacaaaccttcttggaaggctggtacccacaggatccccattccttgtaaaggtcgtgcactgacacgcatcctgagggccagttccacgtccagtgcctctcgcctttacttccacgtcaggctactgtttccctatcgagggccttccttcctattctgtgatcaaatggttcactgcagttctagagatggagaagccaggagagagaagctgagccatttgttccaagttaagctagagccagggttggaatccagaaccctatcatgaaaaatacagcgttagattaacatttttgaactgcttaattgcccatttttgaactgcttaattgccaaataaattttgagatctcgtaaggctgggtc

SEQ ID NO: 208047 - DNA, 403 bp, Homo sapiens
cacttttttctcaccattgattttcttagtgacacttttcactataagaaatattctatttttagctcattttaatattttaattttaatttatcataaaatgctttaaagccactctatagagaatattaaaacctgtgaacctactcccaggatgtttttcctaattgtcccttgtgggagagataaactatacaccaatgcattattccttgtgttcatttactattgtaagctctgaaggtagggactgtgtctgtcttttaatcaccatggcatcctggtactgagcacctggcaaatatgtgtatgtaaatggaggtatgaataaataaccaatttatacatgattaagaaatatttttttcctatccctggacactttttttttttttacagtgtt

SEQ ID NO: 208048 - DNA, 429 bp, Homo sapiens
aatgcccctgaaaacactatccttacttcctctgtttaccaggtagaaagtttgaggattctattttgtttctcatactctgtgtctactgtggtcaatcaaaaaaatctactgaagttaccgggctttgaaattacattcagaaaaaagcaagctggactgtgggataggtatttatcaatgaaatgctcccaaggacactaatgaggttttagaaaagaggaagccacttgctgagacattgccttcacggccaagagtctttactagccaattccatagcactcttcctatgaattataatttagaaaggcagatcccacccaattctagaaatataagttcaaataggccctaagaatctggtgaactccatttaaaaaatgatttgtctctgcaaaagaaaaaagaaaaagatttaactgactg

SEQ ID NO: 208049 - DNA, 373 bp, Homo sapiens
tatattttttaaatctctgttggctgaagacctagaagtatctggtgcttagtattataaatgacttagaatataaagcattctaagatggtacaggtgctcttccttgtacttctcactcaacatatgaacttgtctggcttttctttttttttctttttctttttctttttttttttttttttttgaggcggagtttcactcttgttgcccaggctagaaggttgtagtgagccgagatcggaccactgcactccagcctgggcaagaaagcgagactttgtctcaaaaataataacaataataataataattttatctctaaatgttgaaggcattgttccattgttttctactttccagtattgctaat

SEQ ID NO: 208050 - DNA, 390 bp, Homo sapiens
aagctgttggatgagattttttttttaagttcctaactgttctacatagacattaaaacatccattacagcagacctagaaaccgtccttctgtccttgacatttcctccttcctcacttgttcctttgcaacaggaagccagctatttgccttagttcctagctctctgttcactgcacctcaggggtgcttccttttacggcaggatccccctagataaaaggaaaattataaacactcatccttagaaatttggaagggaatatatatacagcctaaggagtgcaaaaggctctgcacttcattcagctatcgctgctcagggactctaagtacaaaaataaagatgaactggctggaaagtataataaagggagctgaattacagg

SEQ ID NO: 208051 - DNA, 653 bp, Homo sapiens
cccctttttggcttagtgactttttttcttcctggttgtttctatgtaaatgtaacaatttccttgaaatgatgaatgaacccacatctccagtgttttcctcttgtactggacagagtggaggaaactggaattgcctgtttttgtggcagaggaggtagatggggatggaaatgaatttccttttaaagcaatgaattctttttttttttgtttttttctgagatggcgtatagctctgtcacccaggctggagtacagtggtgctatctcagctcactgcaacctccgcctcccgggttcaagtgattctcctgcctcagcctcccaagtagctgggattacaggcgcccaccaccacacccagctactttttgtatttttagtagagatggggcttcactgtgttggccaggctggtgttgaactcctgacctcatgattcgcccgcctcggcctcccaaagttctgggcttacaagcatgagccaccgcacccggcctaaaccaatgaattctttctcggctttctctccagccaaagcagaacagctatacctatgcctcagttgtttttcatgatcccatgtcgaagctgcggaaatagatggtctggttgttgagtgacaagttatttattcccttcctttattc

SEQ ID NO: 208052 - DNA, 622 bp, Homo sapiens
tctgggattaggacttcaacatatctttttttaggggatatatagttcaacccataatggagatcaaaggctgaaggatttgcagcaagcagatccgggagttatgtgggtaacttggaagacctgccaaaacagtggtcttgttaattctacagggaaagccatctgaactccaagacttcataaaaccgtatttgtatgtattgtattggtgaagacttcggtggcaagtcatggaaattaacttaaataagtttaggttgcaaacgatggaaactcaattccagctggtttatacaaaataataagaaaagaaattcggccgggcgcagtagctcacacctgtaatcccagcactttcggaagatgaggcgggtggatcacttgaggtcaggagtttgagaacagcctggccaacatggtgaaaccccatctctactaaaactacaaaaattagtcgggtgtggtggtgggcacctgtaatcccagctactcaggaggctgaggtaagagaattgcttgaaccctggaggtggaggttgcagtgagccgagattgcaccactgcactccagtgtgggcaaaagagcaagagaggaagacatcatctcaaaaaaaaaaaa

SEQ ID NO: 208053 - DNA, 359 bp, Homo sapiens
ggagctcctgtgtgccagggcagcaatatagcaggtcaaataggaagtgtgtctaccaaggcccctcagtggcacataagccagccagaggcagaggcagcagcacactctgcctggggacctggtcatgttgagttgcgaaggtcatgaccttccagggtttggccttggagccacagagcagtccgtttagccccaggccactccccaggtaagatggcactatctgtaaggacctccaaggcaggggttccagagttctttcatgaagaaacactgtttaactattttgggtgtgcacagaaagaaatacgatacatgtaaatatgctattttaaaggtaaaataaccgtagtatt

SEQ ID NO: 208054 - DNA, 275 bp, Homo sapiens
gcggccccaggcttcccggcccgccactcccgctgccacccaaaggcgctgcgtgccggcggcttggtggagtttcgtcgaggcccggcaggcttgggccaggagatccagcggccgggcggggtcccggctgagagaggccgatgccgccgtcagtcaccgagatgggggtaatcactttgatcaacatgacgaaggacaatttaccttaagccagcagaagcaggggaccctttggggagcaggaggccaataaaaagttcagaggttaaaaa

SEQ ID NO: 208055 - DNA, 360 bp, Homo sapiens
gcggccccaggcttcccggcccgccactcccgctgccacccaaaggcgctgcgtgccggcggcttggtggagtttcgtcgaggcccggcaggcttgggccaggagatccagcggccgggcggggtcccggctgagagaggccgatgccgccgtcagtcaccgagatgggggtaatcactttgatcaacatgacgaaggacacttggaaactgaacaagcatcacttgacaagcctacagaatccataagatggatcattgcttaatttcgggtcttagccagttagatttaccttaagccagcagaagcaggggaccctttggggagcaggaggccaataaaaagttcagaggttaaaaa

SEQ ID NO: 208056 - DNA, 542 bp, Homo sapiens
aacggagttttgcacataaccatacaatccagtcagacttaattcctgagaaattaacataaatatattataaactaagcctaatgaattataattctgttcattatgatttcggtactaattgagtttaaataatagctgatataaaagttataattcaaacttttttgtatgtaacgtaaaatatgtactatataaacaagaatactgaataaaattcagtgatcattgtacctgtattactcaacgtccctccaggaaaatagaaatgatttcaggtattcatatcaaaggaaattttagcaagaaactggttatataagtgatagaggaactataaaggtaatgtaacatagaaattagagacagcagcagtcactatcatccctagactagaaaaaataaaggtaggaagtggtattatcagagcccagggactgtagtcacacaaaaaagctggaaccacaagtttttccagcagaaactggaatcatgaaagagatgaaacccaaggcagagggaactgatgaagaaataccttg

SEQ ID NO: 208057 - DNA, 351 bp, Homo sapiens
tttgccagtagatggtttatgggttttatagctttattttgaagtgaaagttatatatcatatagctttattataaaagaaaaatgataaactatattttctttttagccagtgttctttggagtgaattttagtagaattttgaaaacttatttgagaaaattaaattatttttaatccataacatttattgagtacctaccatgttcgggttcaatgctaagcttattacatgcattatgtcatttaactgtgacactagcactttaatctgaatgagcaatctgaggcttagagaggttaattaacttgccagtgtcaagatctagcctgatgaaactaagcttagaa

SEQ ID NO: 208058 - DNA, 167 bp, Homo sapiens
ccaaaacctccagctagcaaaaagtggggggaaatgtgactaagaaataaagtactgttgttgcaggttaaagtaaaacaaccagtggctccagttatctttccatgggtcttgggcagacttttcatgtagttatcagtttggtccaactgacttgggtggaagcc

SEQ ID NO: 208059 - DNA, 443 bp, Homo sapiens
cctctgttggtcagattcatcagagtggaagcagaatgacacattcattcaatttatcagcagctaaggtggtagaggggagtctctcattcctacaggtcttgctgaatgtaccaggaatgcatgaccctgatagctctctcccttggttttattttttttttctttctttctttcgagacagagtttcactgtgtcacctaggctggactacagtggcacaatctgagctcactgcaacctctgcctcccaggttcaagtgattctcttgcctcagcctcctaagtagctgggattataagggacacaccaccaggctcggctaatttttgtatttttagtagagatggggtttcgccacgttggccaaactggtctcaaactcctgacctcaagtgattgacctgcctcggcctcccaaagtgctgggattacaggcgtg

SEQ ID NO: 208060 - DNA, 544 bp, Homo sapiens
agttctcctgcctcagcctcccaagtagctgggattagaggcatgcgccaccatgcccggttttgtatttttagtagagacagggtttctccatgttggtcaggctggtcttgaactcccaacctcaggtgatctgcccgcctcagcctcccaaagtgctgggattataagcgtgagccaccgtcccccgctttctttgcctttttaaagtcttgtctgggctgggctcacgcctgtaatcctagctctctggtaggccaaggtgggaggactgcttgaggacaggagagcagcctggccaacatagtgagaccccatctatttaaacaaaattttatttattttttttcttttttgagatggattctgggctagatcgcagatttgggatcgcagattgggggctggatcggggatttggggatgggtggggggcggtgaaaaggtgaaagggagttgccgcagctcagaagccgatggttgggtgtctgagaagattacaggcgtgtgccatcatgcccagctaatttttgtatttttagta

SEQ ID NO: 208061 - DNA, 652 bp, Homo sapiens
ctagttgttattttagagtttcattgccaagacatttttttcaaaaattcaaataaaggggcaggcgtggtggctcacacctataatctcagaactttgggaagcctaggcaggtggatcagttgaggtcaggagttcgagaccagcatggccaacatgttgaaatcccatctctactaaaaatataaaaattagtcgggcatggaggcaggcgcttgtagtcctagctacctgggaggctaaggctcaagaatagcttgaatgtgggtggcagaggctgcagttagctgagatcgtaccactgcactccatcctgggtaacagagtgagattccacctcaaaaaaaaaagaaaagaaaattcaaataaaggttctcttattcacgcattgtttgagactgtagcttattcttagctttgtagattcttttatttttatttttttgagacagaggcttgcgctctggtgcaggctggagtgcagtagtgtgatgttgggtaactgcaagttttgccttctgggttcaagcgattctcctgcctcagcctcccaatagctgggaccacaggtgcgctccaccatgcctggttaattttgtttgtttgtttctttgtttttgagacagaatctagctctgtcacccaggctgga

SEQ ID NO: 208062 - DNA, 321 bp, Homo sapiens
tctgagttaaagggaagatgagcccaggtgggaactgtgctgtcccactctcatgcaacagtagggtttactggcatgtgtcttgggggagcagggggtggagcaatgggggacctgagggagcaaagtgttcttatcttatcttcttgtagctttgctctgcataaactctcctctgaagccatctggaaagaaggcccttctggcctctgctcagctagtggccaggggctgattctcaggggttctgaatgctccgtcagtcattccctggcagagattttgatagaaatacaagatatactttaattaaatgtgtac

SEQ ID NO: 208063 - DNA, 1041 bp, Homo sapiens
  misc_feature (800)..(800): n is a, c, g, or t
  misc_feature (804)..(804): n is a, c, g, or t
  misc_feature (807)..(807): n is a, c, g, or t
  misc_feature (809)..(809): n is a, c, g, or t
  misc_feature (813)..(816): n is a, c, g, or t
aacggctaggttcgaggctggggttaaatcggccgaggtcagcctaggctataaggtgtattttatcacctacagaccatatgcagactaaatacaacacttgtgcctgattctgaatggtatcttatatcaaaaggctcccttaattttagctcttgcttctcaagcttctctctcaacttatcagaactgcctatagtaaccaaaatggattcatgaagaaaaaaatatattttaggaaaacatgtgcaaaaagcatctaagcatctgttaacattaaaaccagaaggcagtatgtgctgcagagtacataagaagaggctttaaaatttagtaattcacaacatccacttagaagtattatagtaatcttttaaagtaacacaccacaatggtacacgctcttctgctgctgttgtctacttcctcctgcttccccgcgccgcgccgccatcatgagggaaatcgtgcacttgcaggccgggcagtgcggcaaccaaatcggcgccaagtttgggaggtgatcagcgatgagcacggatcgaccccacgggcacctaccacggggacagcgacctgcagctggaacgcatcaacgtgtactacaatgaggccacggcggcaagtacgtgccccgcgccgtgctcgtggatctggagcccggcacatggactccgtgcgctcggggccttcgggcagatcttccggcggaaacttcgttcggcagagtggtgctggaacaactgggcaaggggcactacacagaaggcgcgagctgtggactcgggctgatgtgtganaaangangntgannnntgtgactgctggacaggttccaggctgaaccaacccggtgggcggcggtcggaggtccccccacacagaaccgcagagaccaacggacctcaccttcgcggggcctccaacgtgaaacagggccaaacaccctagaccactaaacaagacatgtgtaactgtagacacaagaccctgggaccggcatggaaccccaacaaaaatacacacacaacaaagaatgcg

SEQ ID NO: 208064 - DNA, 322 bp, Homo sapiens
aagctcaatagtggatacacattattagtactccatatcctggattctcattatattgtgagtttttagcagtacagatactgatgccaaaaagatatgaggctgtgtctttaccacttgcatattctatggcttttcataagtaaatggttctttgattccaacattagtaaagtagggatattaatagtttctcatgggatacgaagattaattgagacaatatctataatgactgaatgagaaaatgctttacatttatcattgtacctggtacttagtatgcacacagtaagtggtagatgtttgctatcactatcag

SEQ ID NO: 208065 - DNA, 309 bp, Homo sapiens
tatgtagtagaacctcatgaaaatactagctctgttgataaaactagactgaaaaaagctttcaaagtcaacaacagtatgaggcagtgaaggacgtagaggagaagctgctgctgcagcctgtagctcctggaagcccgttttgtccatgatttagcaggaacgcattacctttccatgaggacactgcccacagaaaccaaggccattctttgaagacaaacatgtcttaatagcctttacattacgtaatagtgtaatacaaataataatttattattagtaatgtgaaattatttacaataccct

SEQ ID NO: 208066 - DNA, 235 bp, Homo sapiens
gattgtccttggagccaggtcatgggcacataaagaaagagttcttcatattttccagccacagacattatctttactcgtatttatttatatcttcctagcaaggcccttaggttccagttcaacacgcccaaggaataaaattcattagtgagttctcacatttgactttctccctctgaccatgaggctcttcttaccaggctaatgtttctttgattggatccctcatggt

SEQ ID NO: 208067 - DNA, 1862 bp, Homo sapiens
  misc_feature (36)..(36): n is a, c, g, or t
tcaggcgtgtaaaccagccggagcggcgcggcagcngcaggaccgccgtggcgcctagagtagcgacccggggggagcgcaggggcgacgctggctgcagggacccggtgacagcgtgagaggtactaggttttgacaagcttgcatcatgcgtgagtataagctagtcgttcttggctcaggaggcgttggaaagtcctgctttggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattctttgtggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttcttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgttatagtcgtgtgtacagtgggggtctacaacaagaagtgtatattttcaaaccaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataattacttgcca

SEQ ID NO: 208068 - DNA, 1317 bp, Homo sapiens
tctgggttaacccccccgagtaagggatatcgtcgaaccgcgccgtcggtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttcttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgttatagtcgtgtgtacagtgggggtctacaacaagaagtgtatattttcaaaccaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataattacttgcca

SEQ ID NO: 208069 - DNA, 1988 bp, Homo sapiens
  misc_feature (36)..(36): n is a, c, g, or t
tcaggcgtgtaaaccagccggagcggcgcggcagcngcaggaccgccgtggcgcctagagtagcgacccggggggagcgcaggggcgacgctggctgcagggacccggtgacagcgtgagaggtactaggttttgacaagcttgcatcatgcgtgagtataagctagtcgttcttggctcaggaggcgttggaaagtcctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattctttgtggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttcttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgttatagtcgtgtgtacagtgggggtctacaacaagaagtgtatattttcaaaccaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataattacttgcca

SEQ ID NO: 208070 - DNA, 187 bp, Homo sapiens
accaaaacaaaaaaaacacaaggtggtaccaagtttaatgtgctctgataaacaggctgaatcagagaacagctttggggaagtaagtgaaatgtcctttatctttccctaagaatgttctacaggtgctttgcagaaaagatagggggaaggagaggggacgagagttgggtactacgctttggca

SEQ ID NO: 208071 - DNA, 224 bp, Homo sapiens
atcccgacgttactcggactaccccgatgcatacaccacatgaaatatcctatcatctgtaggctcattcatttccctaacagcagtaatattaataattttcatgatttgagaagccttcgcttcaaagcgaaaagtcctaataatagaagaaccctccataaacctggagtgactatatggatgcgccccaccctaccacacattcgaagaacccgtataca

SEQ ID NO: 208072 - DNA, 423 bp, Homo sapiens
caaaaataaagtagaagtggactttgcaaaaccttgtgaatataaagtgaagtcctaggcctaaaatatggcagaaagttgcttattaaaggaccttcgtctctcggcatattgaaatgatgtcagagtatgcaattataaatacgattgtcatatttaccatgggaagatatctatagtactttgctgggctgggttacagaaatatgtgtaatataacaccacttctactaaaatatgtgctaagtatgcaaagaaaagaattctagaagggtagacatcaatattaatggtggttattgctaggtgatagactacaggaaaactttgcctttctctatacattttctggcatttgaaagattttttccaataaccgtatattatttctaaaattaataaaacaaaataaagatatttcaa

SEQ ID NO: 208073 - DNA, 423 bp, Homo sapiens
tcttgctctctactttgaaaacacagttgatgccatctgaaacgatctcctccacttggatctctctgcccgtatttacctgtatctccaatatctcctgctactcaagtatcttctttttattaaaactttcatatcgttggctaggcgcggtggctcacgcctgtaatcccagcactttggaagtctgaggcggacggatcgtgaagtcaggagattgagaccatcctggctaacatggtgaaaccccatctctactaaaaaatagaaaaaattagccgggtgcggtggcgggcggctatagtcgcagctactcgggaggctgaggcaggagaatggtgtgaacccgggaggtggagcttgcagtgagccaaggctgcgccactgcactccagcctgggtaacacagcgagactccatttc

SEQ ID NO: 208074 - DNA, 558 bp, Homo sapiens
gtttaaagacatcaaatagtaagttttaatttttccagctattactattaattctaagttttttttctctgatatgtcttctttgatgtttcttaaaaatcaagatttataaagagatagagaaggccattagtatatctctcaatgtcacaaaattaacctagccactgtaaagttaacctgtatccacaatataagtgacaaatggcagataatatctttaggaaaagtattaaatagtgcacactacttccatcaaagtatagtgttcgaggcaagtttaggtaatggtgcatttctaataaacagtctttaaaagatattagcatttctgttatttatgagaggctttcagtgtatttttcacatatgtattattagggcagtgtagaaatattattgtgatgtattaatgggctgacctgaggtaaacaataactacatccatgcgtgcatcatacatgcatacaaacttactcattttctttttaagcagactagtagttaagttccaagagagaaaggattctatatcatgaaatgccctgtacgtttttg

SEQ ID NO: 208075 - DNA, 212 bp, Homo sapiens
aaacaaactaaaaggggtaacaggtataggctgtagctaccttgagcacacttagtactattctctttaaatgtccaaattcaagatgtttttgtcctactgatataaataatagagaaacaatgtacgtttcaccttttggtttatattaagctagtttcttcccatgttcctgactatctttgagcctaaaacatgtgctcaggtctagg

SEQ ID NO: 208076 - DNA, 619 bp, Homo sapiens
aagaataataaatttcctaaaatatgaaattagatgtccttgtttataatttaaatttaatcatttaaaagttttaaaagtttctcttagaaattgtttataattttttatcctaaactttttgtaaatcttgtaataaactgtaaaatactagaaatgttaaatatttatcgtattatcaggttcaactttagtgcatgatgtgatggctaaagctgtatgtataaattttattcattttcagaaaatattaaggtacaagtagatatagaaataaaactttcatattcattataataatctgtcaatcacttgttctgtaccaacattagtttaatcaagaggactttttaaaatgcagcttcagtctttcttcctgaaggaagaagcaaagttttatgagagagaagagtaagtagtataaggaatacctgactggatgcctaaaggtctatatttttttatcccagtgctgccacttacggaacttggataagtcagttaacttttatgagtctgtttactcatctgtaggatgagtaatgatctacctcccaaattattttctgaataatgtaatgaatttgaaaacaatttctaattggcaagcacttgtaaa

SEQ ID NO: 208077 - DNA, 372 bp, Homo sapiens
gatcagtttaaaacattttcactcaccccaaaagaaacgctgtatccatgagcagtttcctgccatttcctcctcccactaagccctgacaatctactttttttgagatagagtctctgtcacaggctggagtgcagtggcacaatcccggcccaccgcaacctccgcctcccgggttcaagcaattctcccgcctcccgagtgctgggatataggcttgagccacctcgcccggcctctttgcagtatatttttaaatcaggtagtgtgaggcttctagctttgttctttttgctcagtattgctctggctatttggggtcttctgtggttccatatgaatttcagggtttttttttttcctgtttctgtg

SEQ ID NO: 208078 - DNA, 827 bp, Homo sapiens
ttttgatcatctatttcttcaggggtttttattgttgaaataaaacttgggggtaaaatatttgtatacaactattaatcttcattgtccaatatggtagctactagctgtatgtggctctattgagaacttgaaatgtggagcatctgaaccagatgtgctacaagagtaagatacacaccagattacaaaagacttgattaaaaaatgcaaaatatcccattactaacaagaaggtaaaatagctcattaataatttttatattaactagtgaatattttggatctattgggttaagaaaatatatcaaatttaatttcacttgtttttctttactttttgttaatgtaactactagaaaatttaaagtttcctatgtggcatgtgtttgtagcttgcattacatgtctctggggcagcctctctctaaacccatttgaccaggagcagccaacaaggtttccatctgctggaatccatatttagagtcaaaggtcagtcagtttaattccacacatgggatttttccctcaccccctcctccttacctgttccctggacctccttatcggatcttgttcaggttttgggcactgcactattgattgatccctcagtggctgctggttggctctttgtcccaccttcaccatcatctggtctttctgggactcctcagcaggctcctctgggtgggctagccctaatgtgagtgatcctcacagttctgacccctcctccacctctctcccctctgctcctcttccctggtttgggactcagattcacattgaaccttttttaactggcagggcaagcctctgtg

SEQ ID NO: 208079 - DNA, 167 bp, Homo sapiens
cctgggtggtgaggagctagttttcaaatccttctaagacttgtattttgagctgtgtatgtgcaccccaatttttggttgtatcagacattttcccatatgtatttgtcataagtgaaaaataaaataaaaaattaaaaaaggtttgagccctggcgtgagaatct

SEQ ID NO: 208080 - DNA, 107 bp, Homo sapiens
tgcccttctgactgaatttgtagtgcatttttcttgtggaaagagcttgagtggagattctttgtttagtaccaacaatattaagacttgttggtgctctgtattga

SEQ ID NO: 208081 - DNA, 322 bp, Homo sapiens
taaggactgaggacagcacccaagatactcatgagggttccgctcccgacccaaacacctatttggccccacctccaccatgagggtcacatttcaacatgagatctggagaggcccaacagcaaaccacagcacgtgccttccctctgtggtgctctaccagcttgaggcgaggcaccgggtgcagcccatacatgggggtgaataccagggggtggggaccactgggggtcagttcagaagctgcctgccacagtacctcatggtttttttttttttgtatttcagaatcccaataaaaataacaagtatcttcattttt

SEQ ID NO: 208082 - DNA, 458 bp, Homo sapiens
tctggaaagcaatgtggcaatatacatattaggtgccgtacaagcatgtgttccctttggcacggtaatttccctttcaacaatatatccggagcaaaaaatcagaagtacatcaaagacttgtgcacaacaatggttatcacagaaaatttgtaaagtgaaaaactagaaataaaattataaaaaagattcaaaaaataacagcaatgttatggtaaagtaaaactgatgttggccaggcgtgatggctcacacccgtaatcccaacacttcgggaagccaaagagggaggatcatttgagcccaggagttcaagaccagcctagcaacatagcaagacccccatctctactaaaaatacaaacattagccaggtgtggtggtgggtgcctgtaatcccagctactcgggaggcagagaatcacttgaacccaaaaggcagacaggtgcggcgtaga

SEQ ID NO: 208083 - DNA, 742 bp, Homo sapiens
  misc_feature (599)..(599): n is a, c, g, or t
  misc_feature (602)..(602): n is a, c, g, or t
  misc_feature (625)..(625): n is a, c, g, or t
  misc_feature (665)..(665): n is a, c, g, or t
  misc_feature (711)..(711): n is a, c, g, or t
  misc_feature (715)..(716): n is a, c, g, or t
  misc_feature (742)..(742): n is a, c, g, or t
ccgattatcctatagatcagtgtactttgtaatctccccaccttaagaaggttctttgtgatctcccccacccttaagaaggttctttgtaattctccccacccttgagaatgtactttgtgagatccaccccctgcccgcaaaacattgctcctaactccaccgcctaccccaaaacctataagaactaatgataatcccaccaccctttgctgactctcttttcggacttagcccgcctgcacccaggtgaaataaacagccttgttgctcacacaaagcctatttggtggtctcctcacatggacgtgcatgacattgggtgctgaaacccgggacaggaggactccttcgggagaccagtccccttcccctgtcctcgccctcactccttgaggagatccacctgcaacctcgggtcctcagaccaaccagcccaaggaacatctcatgaatttcaaattggctgaagactgatgctgcccgattgccttggaagcccccctagaccatcacagatgccgagcttcgggaactctcacagtggaggacaggaatgtcaggcctctgagcccaagctaagccatcatatcccctgnganctgcacgtatacatccagatggnctgaagcaactgaagatccacaaaagaaatgaaatagccntaatgatgacttcacattgtgattgttctgcccacctaatgactanaggnngggggatcctaaatcacctgagatgn

SEQ ID NO: 208084 - DNA, 776 bp, Homo sapiens
  misc_feature (633)..(633): n is a, c, g, or t
  misc_feature (636)..(636): n is a, c, g, or t
  misc_feature (659)..(659): n is a, c, g, or t
  misc_feature (699)..(699): n is a, c, g, or t
  misc_feature (745)..(745): n is a, c, g, or t
  misc_feature (749)..(750): n is a, c, g, or t
  misc_feature (776)..(776): n is a, c, g, or t
ccgattatcctatagatcagtgtactttgtaatctccccaccttaagaaggttctttgtgatctcccccacccttaagaaggttctttgtaattctccccacccttgagaatgtactttgtgagatccaccccctgcccgcaaaacattgctcctaactccaccgcctaccccaaaacctataagaactaatgataatcccaccaccctttgctgactctcttttcggacttagcccgcctgcacccaggtgaaataaacagccttgttgctcacacaaagcctatttggtggtctcctcacatggacgtgcatgacattgggtgctgaaacccgggacaggaggactccttcgggagaccagtccccttcccctgtcctcgccctcactccttgaggagatccacctgcaacctcgggtcctcagaccaaccagcccaaggaacatctcatgaatttcaaattggactgattccttcccagatcttcttgacttagcagctgaagactgatgctgcccgattgccttggaagcccccctagaccatcacagatgccgagcttcgggaactctcacagtggaggacaggaatgtcaggcctctgagcccaagctaagccatcatatcccctgnganctgcacgtatacatccagatggnctgaagcaactgaagatccacaaaagaaatgaaatagccntaatgatgacttcacattgtgattgttctgcccacctaatgactanaggnngggggatcctaaatcacctgagatgn

SEQ ID NO: 208085 - DNA, 658 bp, Homo sapiens
  misc_feature (515)..(515): n is a, c, g, or t
  misc_feature (518)..(518): n is a, c, g, or t
  misc_feature (541)..(541): n is a, c, g, or t
  misc_feature (581)..(581): n is a, c, g, or t
  misc_feature (627)..(627): n is a, c, g, or t
  misc_feature (631)..(632): n is a, c, g, or t
  misc_feature (658)..(658): n is a, c, g, or t
ccgattatcctatagatcagtgtactttgtaatctccccaccttaagaaggttctttgtgatctcccccacccttaagaaggttctttgtaattctccccacccttgagaatgtactttgtgagatccaccccctgcccgcaaaacattgctcctaactccaccgcctaccccaaaacctataagaactaatgataatcccaccaccctttgctgactctcttttcggacttagcccgcctgcacccaggtgaaataaacagccttgttgctcacacaaagcctatttggtggtctcctcacatggacgtgcatgacattgggtgctgaaacccgggacaggaggactccttcgggagaccagtccccttcccctgtcctcgccctcactccttgaggagatccacctgcaacctcgggtcctcagaccaaccagcccaaggaacatctcatgaatttcaaattggacaggaatgtcaggcctctgagcccaagctaagccatcatatcccctgnganctgcacgtatacatccagatggnctgaagcaactgaagatccacaaaagaaatgaaatagccntaatgatgacttcacattgtgattgttctgcccacctaatgactanaggnngggggatcctaaatcacctgagatgn

SEQ ID NO: 208086 - DNA, 985 bp, Homo sapiens
tgaggtggctcaagcctgtaattcccagcactttgcgaggctgaggcagaggatcgcttgagttcgggagtttgagaccagcctgagcaacaaagtcagaccccatctctataaaaagtgttaaaaatagctgggtgtggtggtgcgtgcctgcagtcccagctactaaggagctgaggcaggaggatggcttgggcccgggagttcaaggttacagtgagctatgatcgtgccattgtactccaatccgggtgacagagcacgaacctatctctaaaaaaacaaacaaaaaaagcatgataatttcatcctatgttaaaaaataaagaatgctaatgtctggcaccacatgatgtatgcattccttatcaaaaaagcattatcttgcatgccatagaaatataattgtaagtaagaaacactataccattattgctgtagaaagaaaatcagtatttttttttctttctactcctgtagaaactaaattaaatgaaatccagttgcatactatttatgggcagaaatcgttgctcatcctggtaagcaagctagtttggagggttttcctcttgtaattatggctgtcatttctcgtggtcttaaatccagttggatctaagaagtgtgggtgagcgcctgggagctccacagtgctccaagattcttaatgtgtcaacgaatggaaacctctcacagtcaggattcaacatctctaaaagaggccataccctttctttctactctgttaagctcactttcgacacctaataatttcatctagtcaaaatgtgcaatagtttttgttcaaatttacttcttctaatagtatctgtaattctgttgacatgacagatgtataaatgattctgccagtaaataatttcattcctagcgtacgtgttgacattccatttaagtccaacaatccatttaagggggtttgagacttctttcttgagaattattagaggaaatgaataag

SEQ ID NO: 208087 - DNA, 245 bp, Homo sapiens
tctccactggaggcatatctcctctggaggctgtataagtaggggctaggctgggctgacatccgtgtaaggatgggtttccatgtgccagcttctttcaacaacaaggaaaagatccttattgttcgcttaatgcaagatttggctcactcctgtccagcacttagtagaggccaaactagttgtcattcttgaaagactcttgagagtttctaatgaagacatctaagtaaactgttatgttg

SEQ ID NO: 208088 - DNA, 350 bp, Homo sapiens
atggtggaatgtcatcagttaaggtggggcagggccttttcacttcttttgtgattcttcagttacttcaggccatctgggcgtatacgtacaagtcacaggggatgcgatggcttggcttgggctcagaggcctgacacaaggattgttcatctttgtttactgactttggcaaagatctatattatctttaaagcgaaacctaaatgaagaatgcttttgatcttaagatattgttaggttttgaagggaagacgagagttaaagaatgacacacaggtcgggcgctgtggctcacgcctgtaatcccagcactttgggaggccgaggcgggtgcatcacctgaggtc

SEQ ID NO: 208089 - DNA, 331 bp, Homo sapiens
ctggcttttttccttgtcttttatttctcaagcgctggtaatatacaaggccctataaaaacatgtacttggtgcaatcccacataacagtgaacctgagatggcccatctgatgtttttacatgggagccccagatttagggaggccactaagctgaagtagatgtcagggagagagaggattcaccacatttatgtattcacgctgcagaccgagctgggcgttctctgcggccagtctgaaatggcacataatgacagtcctcctccttgtcaccaaaacaatcggtggttcacatgactgacttggggtgacagcagagggaagggt

SEQ ID NO: 208090 - DNA, 728 bp, Homo sapiens
agtaaaaaaaggaccagaggctgcagatgggaaatctgtctgcaacaaatcagactgagtaccagtggagtcttcgtttgcaactttgtgacttagctccagcctctgaatggttgccgtccacaatcaaccagactgattgcaggcttagtcagtcttcatttgcacagaagtataactttgtaacttcaccgtagcctctgattggttgcctttaccaatcagatgtttgcacaggagtgtgacctttgtaacttcagcctctggttggctgctttctgcaaccaatcagactgattgagggctaccacttcatttacatgaagtatgcatgaagtggccaatgggaaacttctggggggtatttggaccaaagaagattctgtattgggggctcttgagtagctgctcaggctgctcccacactgtggagtgtacttttgttttcaatacatccctgctttccttcttttgttgcttcattctttctttgctttgctgggcgttttgttcaactctgttcaaaacgccaggaatctggacaacttgcagttacgaccttctactggtgacagaatgtttcaaagcttgattttggtgatggattcagaactccgtaaatttactaaacattgtgcacatgaaatggggaaattttatggtgtgtaaactatatctcaatacgtctgttaaaggaaaaaaaagtaaaactcgcctttgccagttat

SEQ ID NO: 208091 - DNA, 311 bp, Homo sapiens
aaattaccatttcaatcttactgcttgttatttgtctgttaagagtctctctttatttctggtctaatctaggagggttatatgtttccaggaatttatccatctcctctaggtgttctagtttgtgcacataaaggtgttcatagtaacctttaattatcttttgtacttctgtggtttcggttgacatatctcctgtttcatttctaattgagctatttggatcttctctcttcttttcttggttaatcttgctaatggtctatcagttttatttatcttttcaaagaaccagtttttgttttatttac

SEQ ID NO: 208092 - DNA, 134 bp, Homo sapiens
gagtttggccggggcagttggaagagagccggggctgccgagtggcccaactccaggggaaaaccatctccctgctggctcccccatctgctgaaagctacccccactcaataaaacctcacactcattctcca

SEQ ID NO: 208093 - DNA, 632 bp, Homo sapiens
ttggactgctgttctgttattctctagggaaatggtgtgattcctgcttggaaaactggcagctgatgcaattgtgggctcttgacttagcttagctaacctttctctataggaagctgggctgttagctctattcatggattcattcaacaaacactccatcgatatttattatgtatcaggtactgtgctagggtgagacagtgccaatagcacatggcttgttaagacaacttttccaaaacttggaaatgaagcaaaaggatgactgcaagtttatcacttagtattggggcacaggcctgccccaaagtatttaattctgtaggagcatgtatcttcacttggcttattatttcctattgattagggcccagactaaaagttacatgttaacttatagattttcattctgtagatatagaaatgtttttgtctagtagaaacaataactcagtgctaactgttttatggctctacaggacattaatcagtcttatttatgtttacacacttacttcatcatcattttccccactaactttataaacatctgtttctcaaatgctctgagatgtcattagcatcttccttttctttcattcatttagttaagtagttgacatgtgctt

SEQ ID NO: 208094 - DNA, 261 bp, Homo sapiens
tgaggtgttcaagggtaatgtttttatttctttatctcccaaagcatctagaacataagtatgtggttagaaaatatctgaccatttttggccgggcgcagtggctcacgcctgtaatcccagcactttgggaggccgaggcgggtggatcacgaggtcaggagattgagaccatcctggctaacacggtgaaacccccatctctactaaaaatacaaaaaattagccgggcgtggtggcgggcgcctgtagtcccagcta

SEQ ID NO: 208095 - DNA, 219 bp, Homo sapiens
ttactcctctttgttactaggaggcatcagagatacatattttgttgattatagttataaaaatgcgataatcttgaatatgaataaatttgcttccttgttcaaggggctacctcttggatgaaatagctatttcatgaaacttctttcgagaataacatggtcctcccaaaaagtctattttagaaacaaaaatgatgttgaattctaactaactcc

SEQ ID NO: 208096 - DNA, 176 bp, Homo sapiens
accaagccctgtactaagcaataaagattttatatttaaggaatttatagactaatgcaaggcaaaagcatttcaaccaaactacaaggcatcataactgccacaataggggttcattcgagattctatggatggagacactggctgctccaaatgttcatggtaagtgagtactg

SEQ ID NO: 208097 - DNA, 766 bp, Homo sapiens
ttggtttccttttattacatcactcactgctgtagattttatgtatatttcacttaatcgtcataataacctcgtgaggtaagttgtgttttctaattttacatggggtttgaagagataatttgtacaaagttagtatatggcaaactgggatttgcattcctgtctgtttgactccaaagccactgtttagactgtgtcttttaacccactttctatcatcagtcctaactggttcttcctgctggggcttcatctttttgttcttgaatctgattttatagtttgttttctctttcctaaattaaacagacatcctagttctctctctttctctttcatccccactttctttctcttttcccttcttgctctgtctccttcctattgcactgactcatgcatgtgcacttattatttggtgctaagaaattcttattacttgttatcttccattgaaatgcttatagaaacctgcccttggctcaccctgaagttttaggtagttctctttgactcttgtttttatgttgttaatggagaaattactagatctggggttataaagaggaaagaattaaaaagaaataagaaaatagtcatgaatggccccaactaacactagtctttaaaagacactcttcctatcttcagtctgtaagtggttgctgtcaagaagggaaagtctatctccctaatgatccttgcttctttgtctgtatttcaggattggagacttggtttcctgggtttcttttcaaactta

SEQ ID NO: 208098 - DNA, 715 bp, Homo sapiens
tagaaactcaaataaaagcaattgagaactttaaactaaatttgttgcaattttgtcttttgacacataggattttcctcctgacacttatagacaattgtagaataaatggcctccctctgcctccattttctatttccattcattttcagtgttcttagctttttctttctacatgcccaccacttagatttcattgttcttccatctgaaagctttgcttatggccttttctatcattttctcttctaccttaacttctagagttattatgttacctaggacaagagatatgacttctcactgcctcagttcctcatctgtaaatggtgctgtgtagcagggcctgctgtaagggctaaggggtaatgcacacaaagtgcttggcacaatgctacacacagtaggtgctcaaaatgtgatagcaagctgggcacgatggctcacgcctgtaattccagcactttgggaggccagggagggcagatcacttgaggtcaggagttcaagaccagcctgggcaatatggtgaaaccccatctccactaaaataacaaaaaattagccagacatggtggcgtgcacttgtactcccagctactcaggaggctgaggcagaagaatcacttgaacctgggaggcggaggctacagtgagccaagatcatgccactgcactccagcctgggcaacagagcgagactctatcttaaatt

SEQ ID NO: 208099 - DNA, 655 bp, Homo sapiens
tagaaactcaaataaaagcaattgagaactttaaactaaatttgttgcaattttgtcttttgacacataggattttcctcctgacacttatagacaattgtagaataaatggcctccctctgcctccattttctatttccattcattttcagtgttcttagctttttctttctacatgcccaccacttagatttcattgttcttccatctgaaagctttgcttatggccttttctatcattttctcttctaccttaacttctagagttattatgttacctaggacaagagatatgacttctcactgcctcagttcctcatctgtaaatggtgctgtgtagcagggcctgctgtaagggctaaggggtaatgcacacaaagtgcttggcacaatgctacacacagtaggtgctcaaaatgtgatagcaagctgggcacgatggctcacgcctgtaattccagcactttgggaggccagggagggcagatcacttgaggtcaggagttcaagaccagcctgggcaatatggtgaaaccccatctccactaaaataacaaaaaattagccagaccatcatggcatgccagcctgtaatcctggcactatgggagactgaggttaggagaattgcttgaaaccaggagccgcgaggttg

SEQ ID NO: 208100 - DNA, 332 bp, Homo sapiens
tcatgaccagattgggagagccagcacctaacatatgtgggataggactgaattattaagcatgatattgtctgatgacccaaactgcccatgtcatttgtttccagaaacgaggaccaataattctctcacactggcatttgtggtggtagaacaagtcctttaatatgtccaggaagggagccattgcccagtggtccatatatcgtacggcatcccccgtttaagcccaaggtaggagtcccgtcctaaattctttagcctctaggagcctaaatttccttatctgcaaaatggagattaataaaacttaccttgcaggacctttgtga

SEQ ID NO: 208101 - DNA, 264 bp, Homo sapiens
gctgaggcatgagaatcgcttgagcctggaaggtggaggcttcagtgagccgagagcatgccactgcactccagcctaagcgacagagccagattcgtccccctaccccccaaaaaggggtcatggttcagacctccattgtaggcccacccccttgctttactagctgagggaccttgcctaaattctttagcctctaggagcctaaatttccttatctgcaaaatggagattaataaaacttaccttgcaggacctttgtga

SEQ ID NO: 208102 - DNA, 747 bp, Homo sapiens
gatttcataaaatttccagctgaaaaaatagattcacgtacccaagtcgttccaagcatacttaaaagttttacggtaatcgaatcgtgtatatttttaaattttattttaaattaaagttaggattatgaattcagttcctaaattagcctcatttcacttctgcatttcaagtgggacaagttattaccatattggacaatgcagtctagtgaagtagaggatagtggaaagtcagacttaaaaagttgtttagaaccagctctggaaggccttggatgtcagattaaaggactgagattttacccttgagtcaggcagaataatggatggtttttgaactaaggagtgacacaaggttgtgcttatgactagaaggaggccactaggtggccagctggtgagtcaggacacccttcagttgctttgacttcagccctgtggattcaaagtctgatttttgtcagcgctctagagcagtctcaccaaaagtgtggtccacaaggcagtgccagtctgtaagccctttgttacacatccatgtcaaggcatttacagaaagtaagaatttagaaacttatagcagtttaacagactaattttatttctgtgggtctaataaaaatttgagggattgtactttgcatattctttatttccctttttttgtttgttttttgtgttcgagatgggagtctttttctgcactccagcctgggcgacaaagcaagactccatctcaaaaaa

SEQ ID NO: 208103 - DNA, 1005 bp, Homo sapiens
gatttcataaaatttccagctgaaaaaatagattcacgtacccaagtcgttccaagcatacttaaaagttttacggtaatcgaatcgtgtatatttttaaattttattttaaattaaagttaggattatgaattcagttcctaaattagcctcatttcacttctgcatttcaagtgggacaagttattaccatattggacaatgcagtctagtgaagtagaggatagtggaaagtcagacttaaaaagttgtttagaaccagctctggaaggccttggatgtcagattaaaggactgagattttacccttgagtcaggcagaataatggatggtttttgaactaaggagtgacacaaggttgtgcttatgactagaaggaggccactaggtggccagctggtgagtcaggacacccttcagttgctttgacttcagccctgtggattcaaagtctgatttttgtcagcgctctagagcagtctcaccaaaagtgtggtccacaaggcagtgccagtctgtaagccctttgttacacatccatgtcaaggcatttacagaaagtaagaatttagaaacttatagcagtttaacagactaattttatttctgtgggtctaataaaaatttgagggattgtactttgcatattctttatttccctttttttgtttgttttttgtgttcgagatgggagtctttttctgtcgccaggctggagtgcagtggtgcagtctcggctcactgcaacctctgcctcctgggttcaagcgattctcctgcctcagcctcccaaatagctgggattacaggtgtgcaccaccacatccagctaatttttgtattttcagtagagacggggtttcaccatgttggccaggatggtcttcattgcctgaccttgtgatccgcctgcctcagcctcccaaagtgctgggattacaggcgtaagccaccgtgcccggcccttttttcctttttagtttatttttttcttttttgagaca

SEQ ID NO: 208104 - DNA, 425 bp, Homo sapiens
ccaggagttttaggctacggtgagccatcatcacaccactgtactcctgtactctagcctgggcagcctcgttctttagagtaagacactgtctctttaaaaaaaaaaaaaaagaaaaaagaaaaaaagaaaaggcttttagtgaatatatttttagggtagcaagtgtaatttttataaattgcattatttgaatctaataaataccctcaaagctgaagtcgaattctgattttgattgaaaatattttttacttaaaggaagagggatagaataaatgacacgattaaggaaaagacttcttgtataaggccggggttttttaaatgattttttgaatagttagatggacaatacggaattaaaaaggtggtgtaaaaagttatacggggctgggcacagtgactcacgcctgcaatcccag

SEQ ID NO: 208105 - DNA, 388 bp, Homo sapiens
ccaggagttttaggctacggtgagccatcatcacaccactgtactcctgtactctagcctgggcagcctcgttctttagagtaagacactgtctctttaaaaaaaaaaaaaaagaaaaaagaaaaaaagaaaaggcttttagtgaatatatttttagggtagcaagtgtaatttttataaattgcattatttgaatctaataaataccctcaaagctgaagtcgaattctgattttgattgaaaatattttttacttaaaggaagagggatagaataaatgacacgattaaggaaaagacttcttgtataaggccggggttttttaaatgatttttgcaagttagttgataccgcaatacaagccagagtacgatcactgccgtcgta

SEQ ID NO: 208106 - DNA, 253 bp, Homo sapiens
agctttcttgatttccttgaaagccatgtcctgttcttttccccaaaggaggggctctttttctcccactttggttgcctcatataaaggctttgctaggagcgagtagttaggaatccatatgtggcaaaaagcagctgcccctaggaattcccacacttgccaccttgtgtctggctgaggaatgctacagacaatctcttttcactcctgtccaagctcacactgcccttgggagacataaaagccaaga

SEQ ID NO: 208107 - DNA, 279 bp, Homo sapiens
gtagacgagtcagaaaataaagtggaggagatatttcatcaaatactccagactgtgcctggaatagctacattctcatctaggccacaagctgttcaaggaggaaaagctttaatgtgggttctttgtcctttgagcaaaaaggaagagaaggcatatcgagaaactcaagagacccaggaaagagaccctttgaacaaagaccatggaaatgataaggaatcaaatgttctgcatcagtaattttaatacggaaaaatatgcctctgagagaaagta

SEQ ID NO: 208108 - DNA, 217 bp, Homo sapiens
tgatagaaaaattgagtgtttttcccccaaaatatcagggtgggggattaatttttaagattctttctcattgtgtcacttttattttgttatgataatttccacttgatttctttttccattttcttttttcccattgccaaaaatagtttattaaagttaaagagctgtggaaatggacttcttggcaatagattgacaaagaatttttaaaaag

SEQ ID NO: 208109 - DNA, 344 bp, Homo sapiens
ctggggagggtgtacatatatataaaatgtaatatagaacagatacatattttgtgtgtcaatatatatacacagatacatttggccttcttctgataagatcttttaaagataagctaatatgtgtgaaagaaaagctaatgcttgtgtttgctccagagaatattaggacatttgtttttttctcctactatgtttgctatagtttctctatgactctcatgttcattaagaaatgaaagaaatggtatctctgggtatttctgcaggatcataaatctagaagtcatgtgttgaaaaagacttatttctcaaagtagaagcatgagtaccttaaccttatt

SEQ ID NO: 208110 - DNA, 412 bp, Homo sapiens
ctttctcttcacgtagactttgtcaagaggtgccattttttaatttaacctccttctttaaccaccatggattggcctcatttggcctaagccagtccaagtcaagaggtttgatttaggaactagaacccaaagtctggagtgaatctttctctctagtgaataaaactctaagacatcaaactttagaactatcaacagccatgtttgccatcacagatgtggaggaacagatgcagttcatctgccaaaaagagtcctggtctgatggcatttgaatcctgacctcccactgttcctgaagaccaagcaggcacacttctgcccttggattttataccccagtatcctcaaaattctcattttgttcaagttaatgagcattgggtacttttatcacttgtgaccaaga

SEQ ID NO: 208111 - DNA, 546 bp, Homo sapiens
ggattacatatatgtgccaccgcgcccagctgaatttgtatgtttcataaaaatctgaacaattactatttttctgtaccccttgctccctcttcccatttgcacatatattaggctgtctgatgctgtcacacagctcactgataactgtttttgaaaattattttgttctctgttttattttggataatatatatcgctgtcttcaagttcactgatctttccttctgcaatgtctaatttgccattcatctcatccactgttttttcaccttagtgattatatttttcatctttagaagtatgatttgggtctttacaaaatatcatccattggagttagagctgaaaaaaagaaaaaataaaaatatcatctctgcctcccaaagtgctgggattacaggcgtgagccactaagcccagcccaatctctgttttttaattaggatattcagactatttacatttgatgtgattattcatatagttaggattgagtctacaaaccctgcaacgtgttgtatattgcctcccggaatcctcgga

SEQ ID NO: 208112 - DNA, 165 bp, Homo sapiens
ttgtcctgtgaaggcattagaacctcctggaagatgccaaaatatctttgagtatagatgtctccaggatgttagtgccaaggctccagagaactctccactgcatcagcctttagcttgaatgcctgctgtcaactcccgtggacaccatcacagatcttagga

SEQ ID NO: 208113 - DNA, 337 bp, Homo sapiens
tcatttcaacatataaccaatgttattaacaagataacttacattctttctttcgtactaagttttcaaaatttggtgtttatacttggagcacatctcattaaggactgggagcatttaaagagctcaagagccacatgcaactagtgacgagagtatcggacagcgcagtcctagactctagagtaatgaatgagctctctagatgtccggggggtggtatcatgggtgtgtggtgtatgtaaaagaaactcttgaaattgctaactcaaatggctgcagaggctaggcaagtaacaataaaagatgacctgacatagggactaggacccactgg

SEQ ID NO: 208114 - DNA, 283 bp, Homo sapiens
cacattgtgtaccaagatatttggtttgtcaacagagacaaaagtattaaccaacaaacatactttatttacaaagtaaaagcatccaaatatgacttgacttggctttttggcagattgttctttgttcttgagttagtgttggcgacacataactatctttaggtatttgaagggttaatacaatggaaaattttaattttcttttgttaaaaataatgcttaaaattttttgaagtcttcatggtgtttttatgatgtgcctgggaaaatctcagatact

SEQ ID NO: 208115 - DNA, 384 bp, Homo sapiens
agggaggcagcaaatggttcaaaactaatctacaaaaaccattcccagtaaaatgaggaaggtttagtgggcacttagtcttatcttcacaatgtaggaattactgttaacactgattccatagtgtatagttcagcaataaaatctaggcaacattaagaaagaggccaggtgtgatagctcatccctataatctctgcactttgagaggccacggtgggcggatcacttgagcccaggaggcagacgttgcagtgatccaaggtcatgccattggactccagcctgggcgacacgagcaaaactccatctcaaaaaaaaaaagttgagtgtaggtggaatatacctgataaacatataatgcaaggccagtacctcacatgg

SEQ ID NO: 208116 - DNA, 293 bp, Homo sapiens
atttacacaaaaaataatgtttaaaataatactcaaggccaaagaaagttgatctcaggtgaaaagtctgcaatgagagaagaaatgaagatgaaaagaagtgcatcttttgattaaaataacagcatattacagtgtaaaacataagtagatatacttattgagttagaatgatggaattcccgtgcgtaacctcaactacatataaattgaaaggaggctagttgctcaaagttttaaattttttatatttccaagtggaaagcaaatgtattacaatcctgtatggcacg

SEQ ID NO: 208117 - DNA, 606 bp, Homo sapiens
cctctgttactactggttacccttttgttttcctaagccttcactcacacctttgtaaataatatattttaataaattttactccttgaattggcataattcgagtgtgtcttttcaggttgggagcttgactaataatggacaaataagattagcagagacaactattacggattaggattaaaaacctctgttacctagttctgtagattaaagtcaaagatgaatgtcttcaaactttgtgcaaaagaacttcacttggttatttttaatgtgtttggtctttcttgccctatgaggcctctaaaaacagtcatggcagtgaccagaaacaactgttaaaatcatcaactagcaaaaaaatccaagaaagaagggatcttcacagtttgaccccccgatttaataggcaaacttgtatctattccaaggctacatgatctctttgtgttgtctcactaccaaagatgatcaagattatcagtaggaacatgaggttattggcaataactagggctactgcctatctccacgcagggatgatttccagtggctgctgttccactgcattctccttgacagagtgggtattcattcctagcacgt

SEQ ID NO: 208118 - DNA, 229 bp, Homo sapiens
ccacagcaaacacgcagaccagaatatcccccatcggtttgtctaatatccaccactagagacactataaatccctacacatttcccacaaaacagacctgtgattagcaacatcacacctcacaggctcttagtgaatggactttccccgtgtggcaaagcgtgacatgatttaaacaaagtccctgatcgctagaaacagatgtttgtaatgtgcgcagcaggcaga

SEQ ID NO: 208119 - DNA, 201 bp, Homo sapiens
ctggtgttgggcagctgtgagacccctccttgccccatctctgtcttctaggctcttctgagaaccagtgtcctttgagatctcagatgggatttagaggagggttccacccagaccactttccacaaatttcacttctgcatttcatctggtagggtgtggttttcaactagaagcccaaatgaggaagaaaaaaattca

SEQ ID NO: 208120 - DNA, 215 bp, Homo sapiens
atttttcaggtggaggagggcaaataaggtttgcttcatttgtatgaccttgatttttttcctttgagtgggaagaaaggttatctactttgggcagatatgagagaactaagagtgtgaagaggtttggaacagctgctctgggggctgcaacagtcaacaaaggatgaacataagcatcgctgagcagcattaagattctgctaagtaggtgg

SEQ ID NO: 208121 - DNA, 377 bp, Homo sapiens
ggcatgatcatagctcactgcagcctttaactcctgatctcaagagatactcccacatcagcgctccagcagctgggactatacacgcaagcccagcaaatctgagattcttaagagttaagtactctcactacctgtacttcctcacacccactttatctaccaataaatatattgaaactctacattgaaactcctcttcaatgacttccttggtgctaaatccaaagaacataacatttatccttctactactcaacctactcttttatttcctctgtagactccacccttccccactattgacaatgatacaattagaaaattaccttttgtcaactattatttatttcaggctagactcatcagtgaatgct

SEQ ID NO: 208122 - DNA, 270 bp, Homo sapiens
gttttcaagacatattaaaaactacagtaatgaagacaatatcatattggaataaagatggacaagcaaattggaaatagattcttacatatggagtcgatttgggtcaaaggtgccagttcaatgggagaagtgatagtcttttaagcaaatagtattggaacaattggatagccatatagaaaaaaatgaactttaacccttatgtcacactattcataaaagaaaaaaaaaaaacacagatgatatacccaaacatagagctaaaat

SEQ ID NO: 208123 - DNA, 413 bp, Homo sapiens
ctcatcagctgctgaatggataaacaaaatgtggcatagccataacatggaatattattcagctctgaaaaggaatgaagtgctgacacatgctataacatggatgaaccatgaaaacattatgctaagtgaaaaacgccaggcacagaaggccacatagtgtatgattccatttatttgaaatgtccagaattgacaaattcgtagacacatgcattcaaggagtggttgctggctggtggggatggggaggcgtctgatgcatcattggatcagggtctctgggcgggaaccaactacctaccaggtaaagtgaggtcagctcctccccctttgctggtgagcccagtatcactgagtgacctgcctaggccctcagatagggcagagcagggctctgcttaaatggactg

SEQ ID NO: 208124 - DNA, 382 bp, Homo sapiens
ggccccagtcatacccccttcctgtttttgcctttcagagataaccaggggatgtgaattttttcaaattctcaagcatctcgttagacttttgctggatatatatagatccctaagcacgcaaaatattatttccgtattttatactagattactgcattttcttttgtaaacatttttcccgctcaatgttgtttaagttgtattctgagccatatcactgctctagttgaattcattttcactgctgtaatctcttgcatgaatggactacagtggtcccttttcctattgaaggacttttggttgctttccaatttcctgctatcatgaactatgctgctgtaagtgtaactgtacacctgatatttctctatatatt

SEQ ID NO: 208125 - DNA, 223 bp, Homo sapiens
catgcatttttataatttaaaatatttcatgttacacatgagcaatgttcagatttaagttttaagccaagtttactttttcctaagttgtatttatgccaaggctttcttacaaaaatatatcttatgtgtataaattggacaaacttacagtagtatttctaatgttcaatttgagatgggaaaacataaacctattctgaataaagatatttgtcaaggt

SEQ ID NO: 208126 - DNA, 449 bp, Homo sapiens
agatgaaagagtgattcgtttatggttaaagttggctcattgtttcatagcaactgttgtaatagccaccagccctcaaataattatgatgtacttacaactttataaatgatctgttacttcattgactcggcaactttgcaaggtaaacaatggaattcttcttcttatagaaataaagaaatggagcttgaggaaagtcaggtagcttgccacaagtcatatacctgaaaacgatcagggtggagagttcaacctctgttggtcttccttcctcaaaaagagccaaaaggcaaaaactatctattaatatgtttcctatatgttttcaaaatttcttatgttgtatgtaagcaatcaggaccacaacgtgaatagataatatcaaaatcaaacacaggagtgaatgtgcaaataaagggaaaaaaagtattctagaaaacaccagc

SEQ ID NO: 208127 - DNA, 473 bp, Homo sapiens
tagccaaaaggtggaaacaaccgaaatgtccatcaacagatgaacggatgaacagattgtggtatatacataaaactgagtatgtattcagccatgaaaaggaatgaagtactcatacacaatacaatgtagataaatctcaaaacactacgcgctaagtgaaagaagtcagacatgaaaggtcacatattgtacgattccatctaatgaaatatccaaaagaagtaaatctaaaaacacaaagcagatcggtggttgcaaaggactggcagaagagggcaaggggagtaactgcttaatgggtagcaggtttactttgggactagatacaggttgttatgggtgcacacattgtgaatgcagcaaacgccactcgagtgttcgcttaaaaatgattaattttgtcacgtgaatttcatatcaatttaaaaaaatctggctgggcgcagtggctcacacctgtaatcccaaca

SEQ ID NO: 208128 - DNA, 1175 bp, Homo sapiens
  misc_feature (1)..(1): n is a, c, g, or t
  misc_feature (3)..(3): n is a, c, g, or t
  misc_feature (1174)..(1174): n is a, c, g, or t
ngntagggcctgaacttcagctctcaaaaacctcttagcttcaagtttgttctcatagtcattaatggactctgcagggcagtgccgtattgtggggtgggggtgggggaggaattagtgtgatttttttcaggcagagagagcccctccattagtcacacagaccactgagaccctgcccgcccataagagtcataaagctgtttgcaccatgtcacatgtaaaatgaccatcatcaacaccaaagcaggaaaaggggtgaagccaaaagctgagcaggttggactggttatgtggctgatacatagtgtcttgccgctgccaagattttcatcccagctccttgatgctctgccaagatttcaaggtgaagatcccagcggaggaatgaggaactctgcacgataagttggagcatgcctgcagaggccacaggcagtgcggccatacccgcaaggctgagttggcagttttggggtgcaagaacaaacctcaacttctagcctgcaggactagcccaggctggagaatctgaaagccatgctgggagagatctaacccagaggcctttgatattggcttctagtcaagttcaagtccagtactttctcctccattcactgcagtagttcctgaggtctggcttccatcatgagatggggagtgaccaaagaaaatggcatctatactggcctcctgggggctgccacctgcagcaatctcccctagacacaaatgtgtagggcgcgtgcagcttctcaatcttcagacatacctccagggcaaaggaagggaaagaaaaaggaatgtctttcctagtcaaggaagtagaagtagagggttttgtgtgtgtgtgcttccttttttaaatcttcattgattcatgtaatgaaaagcaaaggagtctctagcccagaggttctcaactacaggcaaatttgtccctcagggccatctggcaatatctggagacatttttgattgatgaaagtggatacggcatgttatgaatccagtcggtagaggtcagggaggctactgaacatccaaaatgggccaggtgcagtggctcacacctgtaatcccagcactttgggggaggctgaggcgggaggatcacttgaggccaggatttcaagaacagccggagccacacagcaagaccctatttctnc

SEQ ID NO: 208129 - DNA, 496 bp, Homo sapiens
aggtgatccaccagcctcagcctcccagagtgctggaattacaggcgtgagccactggacctggcccataatagagctttataaataagaagactcaccctatcctcactgccaagaccatgcccttaggattaattggggggaaaaacatgcaaacgtggaatatctttacatccacaaagacctgccatttgttagacattggcttttgcaggagtgaattagatttttggctccaggtttctgtcaggagtcttagttaatatctaggtctgtgtctgcatgggtctttagataaagtagtcactcagttactcttatcataataccatgtttcgacttttggcttcgtgcttatttccatctgttatttccttatttgctatttattcctttcttgtctcatattccccatgagaacagagacctcactgtcttgctcaccatcaaatacccatggaagacacatatttaatatttgttgataaaagtatcc

SEQ ID NO: 208130 - DNA, 691 bp, Homo sapiens
aaaaaacaaacctttgaatcaatgtgtaaacattctgcaattctaccttatattctaccctcacacttcctagtattaatatgaactgtatgtttggaaacatttgtgccctgtcaaatggtgttgacattcttaactctggtcgtaggtccttttaggaatgtctgtagccttttgattggaatggagtggctaaaataagacaaaaatctctaatagtttttgaatgataaattactacctcgttactttgtatagactggaatctgcacagaaatgtgtattcatcagcccttattttttgtaaatcttttctctaattacttgatgattaatttcatatttttccttttgaacattacatgctgcttattactaagatttttttctccagatgacctattctacctgttagttcaccaagtcagtcatatgttgccggttgccaagtggcaaaattatcacagatatcaaactcagaaaatgtcaggtaacaacagcagtaactgctttccaacctgcagtggtggactgggagtgggaagtgaaagttctgttcacaattgtatcagtaactgttttgggaaaaataatattttttcaagttatgctatcaacagtactaaattgttaggatagtaattttccatggcattgtttagaacctattttatgcccaattttgagatct

SEQ ID NO: 208131 - DNA, 324 bp, Homo sapiens
attaaaaaaaaattaggcatggtggcatacacctgtaatcccagctgcttgggtggctcaggcacaagaacttgaacccaggaagtggaggttacagtgggctaaggtcacaccactggactctggcctgagcaacagagcgagactctgtctcaaaaaaacacaaaaaaagttgggcgtggtggtacctgcttttagtcctagttatttggaggctaaggtgtgaggcaggaggattgcttgagcccaggagtttgaggctgcattgagctatgatgataccactgcatttcagctaggataacagagtgagaccctgtcgag

SEQ ID NO: 208132 - DNA, 459 bp, Homo sapiens
  misc_feature (398)..(398): n is a, c, g, or t
cagtaccggctttgaataccaggttaaataccaggatggacaaatgaatgaatcctcccaccatggttaacgttagtcaagccttagttgaggccttgtaaccatgtatagagactctgaagcttaggattaagaacactggggagtgggctaactgcccattgtgtggccagcactataccaggactgggtgaggtgaagaaagatagcaaaaaaaacccccacgatacatagttcctcactacaaagaatctttactatagctggggagatgagacttatagaagaatattgagagaacactctgagcaaagatataatcaggtatgcagttgtatgctatgaggtaaaatgtggattgagaaaaagtacgtggtaatatctgtgggcctgactcnatcagagaatgtttcatgaaggaggtcagacttgagttggcctctgaagaatagctgtgat

SEQ ID NO: 208133 - DNA, 740 bp, Homo sapiens
gattgctgcggtcgttctagaggatccctttcttgccacgactcgtgtacagaggagtcccaagtaagaactaaacccgttctcctggaagatgataacaggttgacctatttgtacccatctgggctgtctggagaattggaccaatgacaatccccagcagcaatccttgattggcataactggaaaaccagaaactggtactcattatgagattttctgttagcaacacactaactcattcattctgtagccacgaaagatgtggttgtactcctggtattaacactacatacaatgaatccaagggtgaggtattaagtgtatttctaacataattagaaaatccctattccttttctttttggagtaatgcttctccctcttttcaaaggttgaaatttccttggaccccaacaagtgtgtctggaatacagtattctggagaagaggtaaaactgagcaaggttaactcttagccatgaggaaaagctatgctccccgtttccatggaaacagatgttagactaacaataacgtgaatgaactattttgagtagtcatttgaaggcttgctagctcaggaattcaggggagtcagctagccctataccctgcttagatctgtatctatagacacatacaaagcaaggcatctctgcaatacgaacacagcaatcaacataagaagtcagttcttgctgcccctgtagcccactggcctccttgatgtgctgtga

SEQ ID NO: 208134 - DNA, 756 bp, Homo sapiens
tcccccgggctgcaggaattggcacgagggttgtgttatagagacagggtcttgctctgccacccaggctggagtgcagttgaagcaggatattcctctgaccccttcgtgggtcttgcggctgcggtgcctcacttacttagcccacggctctcaactcctcgcgggagggggggcgcgagtgaatgaggcgggaactggagtgctggaagccacgaactccagtcacccaggcctgctgcgctccaccctttatgggagggtgcgtgggggtgagcagatgctggagccggagcgagcgcttttggtcgccggtaggagcgaactccatgcaggccctgcggctgtgtctaggggatgcccgcgacccctgaagacccacagcctgtcttacaacctgtcatggttgtgaaaagttttgagagaacgtctgcacagtgtctaacggtgtctggtatatagtgtgcactcaaatggtaaccagtttagttgcgatagttggtctacccctccaggtgttaacctctgcagctccgtttcccttctagaccctatttctgggccatcgactcccaccaattaggcaggaaaatactgtttgcctccatctggcccaaggctgtattcctggagtttatgtgagaacctaactcctttctcagctccaactgtaaccctctccccaccttcacaccaaaatcatttacattaccctgggtaccacaattgcgtggtggtgcatccccgtctctttct

SEQ ID NO: 208135 - DNA, 688 bp, Homo sapiens
tcccccgggctgcaggaattggcacgagggttgtgttatagagacagggtcttgctctgccacccaggctggagtgcagttgaagcaggatattcctctgaccccttcgtgggtcttgcggctgcggtgcctcacttacttagcccacggctctcaactcctcgcgggagggggggcgcgagtgaatgaggcgggaactggagtgctggaagccacgaactccagtcacccaggcctgctgcgctccaccctttatgggagggtgcgtgggggtgagcagatgctggagccggagcgagcgcttttggtcgccggtaggagcgaactccatgcaggccctgcggctgtgtctaggggatgcccgcgacccctgaagacccacagcctgtcttacaacctgtcatggttgtgaaaagttttgagagaacgtctgcacagtgtctaacggtgttaacctctgcagctccgtttcccttctagaccctatttctgggccatcgactcccaccaattaggcaggaaaatactgtttgcctccatctggcccaaggctgtattcctggagtttatgtgagaacctaactcctttctcagctccaactgtaaccctctccccaccttcacaccaaaatcatttacattaccctgggtaccacaattgcgtggtggtgcatccccgtctctttct

SEQ ID NO: 208136 - DNA, 185 bp, Homo sapiens
ggggaattccagttaaaggaacaactggagcacaagcttggtgctagaaaaagaaggaagtgtgtagctacaattcatgaaagatgggcaaaaggggagtattagaatataaaactggaaagtatttcctggggaaagccagataagcaggaccttgaatgcaaagctaaatcatttgaattata

SEQ ID NO: 208137 - DNA, 240 bp, Homo sapiens
atcttccgtgcccattgcagggacagttaaaaatttgttgcaagagcgccttgcctctagcccgaactatgaatttttcctgcagatactgagatgatcatatttttctctgttaaccagggaatatggtgcattacatgaaaagattttctgctgttgaaatgcccttgccttcctgggataatcaattgcatttattttctttcttttttttttgttttgttttttgagacagagtct

SEQ ID NO: 208138 - DNA, 132 bp, Homo sapiens
tggtgaaaatagacttgggcataatgcattaaagcctggcagcacttagtcatatcagagcttaggaggagaagatgtgtgaggttttattattaggagcataggccttcagtgactattgcataagggatc

SEQ ID NO: 208139 - DNA, 300 bp, Homo sapiens
tttctccatgttgatcaggctggtctcgaactcctgaactcaggtgatccgcccacctcagcctcccaaagtgctgggattacaggtgtgagccaccacacctggccctcaatttctttttaagagattttatctccatctttggttttcattaactgtgcatggatagcttccagatcttagctacagttgaatgtgtcttacaagctttagctgtgcattgtacatttctactctaccaagatctctcataagcctctcaaattcaaaatgttcaaagttaatttatctctggtcctc

SEQ ID NO: 208140 - DNA, 407 bp, Homo sapiens
tatttgtgggatgaatgaatcagtgaatgaatgaatatatatacctttaggatctcccagtaacttgaaacctttaggcaagaaggggaagaccctagtagagctctggtctctctccagccctcagtccctctttcctccttactgcctcaccctcttctcaggtccagtccagccctattccaccagaaaccatacctaagctgagaagcagtgcaacaggtgcttgatgccaggatgttacaattcccaggccactaggtacagaattctgcagggtgctaatttttaaatttagcatcctgatatctcacaaacagaagaggtcagagaaaggttaggactaaatatactacttaacctagataacagtactgattcagaaacagtagctcatttgctctgag

SEQ ID NO: 208141 - DNA, 574 bp, Homo sapiens
ttccagtccagaagaaaaaacagtagccacttatacaactataatacaaagcggtgtgtataaattaaatccttaggagatatataaagtagtagaagagttaaaaggagggagatattactttcgggggagattcaaaaaagactttaaagaaattagaaaatggcatttaaataagatttagacggcagaaatgtaggtagaggcattccaggaaaagatatagatgggaaagatgtcacagagaatgtaatgtaagtactctggattgcctggagggaggggttcagataaaggcagtgtgagaaataatgaaatgataaattggatgagattacagacaaatctgaatgctggacaaagtggtctatattttcttgagtaatgtggaaccacagaacagacatatggtatatattctgaacagaggtatggtttctattcacagctatgctttagaaaaattaatatggcagagactggagcccaaaagagaaattacaaggcaatcataatagtccagagtatttagagtggtcacagtgagaatgcaagattgattatttaatttggg

SEQ ID NO: 208142 - DNA, 150 bp, Homo sapiens
cataccaatgatcctgagagtttttttctttgccccacacaaatcctaaccggaggttgcaaactggcagcttatactttaaatattttatctgcttgctttattgtctggtttaatcagaatactatatataatgaaatcagaatatcg

SEQ ID NO: 208143 - DNA, 1001 bp, Homo sapiens
ggaggaaatgatggagacactgcatggaactaaaaatacatactgatttgttcatagtaggaatataaaaaacacttgaagaattaaaaatacttcataagtacaccttcataagtacgatatatacacaaggtatatattgtctctgtcctttttttctctgttaaacttaaatcccagctaacaggctatgttcacagcagccaaatactgcataatgaggtcagtggatttttctttgagactgttccgcaagtttaagctcaggttgagagacacattaggcctggtgtactcctgtaatcatcattggcagtgattactgtttggtaatctaagcttcaactgaatccaacattcttgcctctgctgaaagataattcagaggtgaaagatgaattccataatgctgacacaaactggtggtattcatcatagtgcttattcactgaatgcccattctagcttgaattatatgtccacacactcagcagagccacaccaatattgtttacttaatttttttaagtctccattttaggagaagaaaatctaatgtctctttaatcgtatattttgaataatgtctattctccagtagtcacctgaaaaacacacacacacacacacacacacacttttcctggacctttttacagcagaataatttctcagcattattaattatgtttctgcgtaaaagacatttagggacttttatcctttgtttaattagttatcaaaataatcagtcacacagctatttaataatgggccactcttaacagacaggtgaaacagagtggttgtgttcaaaaaatatttctagttcactagtaacttactaactctctctctcttttttttttttttcttctttgagatggaatctcactctgccactcaggtgcagtggtatgatctcggctcactcgcaacctccgcctcccaaggttcaaacaatcctcccacctcggcctcttgagtatctaggaccacag

SEQ ID NO: 208144 - DNA, 239 bp, Homo sapiens
ttgcagtgagctgagatccacaacactgccctccaacctgggcgacagagtgaaactctgtctcaaaaaaaaagaggaagtcaaagaatttctttaaaagaaaaaaaaagagaggaaattcaaagagagggcaagacctgtatggattgctccttagttgggatatgttcacagagaccttagggcttaatctgtccatttaaaatagtcccactatctccattgacactttatatgaa

SEQ ID NO: 208145 - DNA, 377 bp, Homo sapiens
cagctatcagcaggcagtgagcccaaagaggttaaaaagttaagtctgtctgactcatcatggtgctgaattcttagcttcaacggagtcctggttctttactcctgcccttggaatctgctagagtaaatgtcggcctgacatatggttcacatttctgccatgcccagagatgtcacgtgggagcagctcttgatggtttcagggtaccaggccatatttgctgcacccttaatggtgctacctgtcttgcaaaaatcctgtggattattctataatccagaaaagccattcagagggattttacttaatttaacctaaatgagagatacttttaagagctgtgtaggtttgtccaatcacacctagaaattaac

SEQ ID NO: 208146 - DNA, 377 bp, Homo sapiens
ggcgtttggatgcggaattagtgcaggggtctttaccaggcactaagcaagagccctgagttaggaatatgacagaagaccagttgtcacaactgggaaacaagtccatggcctggccaacagccctgctaacttaatgttgagccccagaatatgaagccagtgattcttcaatccacttctctgtttcaggatgagtcctaaagaatgaaccaagatggatcccactatcctgggtgactgagagcctgtcaaaggtctccagttgtgtgagtggaaggcttaaggcttttgtgagtggaccaggcatggcctagtagtgtgctgttttgtggaaattcctcacgtatgaaaattttgcaaaagtgaggcatgat

SEQ ID NO: 208147 - DNA, 552 bp, Homo sapiens
atatttctctacacatgagaaaattgaagttgaaaaaaatgaaattagtctctcaaagccacacagaataagtgggacccaaacttatgcctatctgacactaaaattactcgataggcttttcactgtataatcttggatctctaagtgtcttttttaaagtttcaggaacattggaaaccaagtccgttattttataatcagaaaacacctcagtttttgcacactcaatgaaattatatcaatgactcttttactggtcaccttattccataggttaggctccaaacagctgacctccccaaatttttaaattaccaagcggcaaaactttcacatcatagaataataaaattttgtagttgaaagaaaactttcgtgttctacagattatgatttttagaagcagaaaaacgctttgaaaagaacagcagacatctgatcagaagatttacattgttttaccttttccatttattagctacttcatacatttataatcttaaacaaggcatttaatcactctgagtttctttcttctaatatataaag

SEQ ID NO: 208148 - DNA, 316 bp, Homo sapiens
gaaacatcaacggattgagctcctattatatccagggtctgggctgcacttaggcgttacagaagtgagcaagaaacccagtatctgttctcagcatttctgtaaacagcccaggcattttcaactttagtttcctattagaatcacccaggcactgaagtgtactaatgcagggccaaccccagagcaactgaatcagaatctctggggatgaagcctaagcatagaaattgttctaaaagctctccaggtgattctagtgaacagtcagggctgagaactgctagtctgttatagactcctgtcttgaccttcg

SEQ ID NO: 208149 - DNA, 599 bp, Homo sapiens
cttcaatcgaaacattttgttggctgagaatgtgcattttccccctctcaggggtaaggatttgcctcatctcattgtctagcttcctgttgagaagtgtggtgtgtgtattcacttaaactctgatgtcatattgaagcccattggtgggcagtttcagccaatcagatgcttcctgggtatccaagtaagaaagatatatagttctggaataacaggaaacttcacatttttcacatcctgttattctgggttttgtgacttgctgccttgccactatgaaggttagtagaaatttatgtatgtatttctttttgtagtatacaaaattgacaaaataaaaaatgacttgaattttcagagcactaagattagatctgtagagctgaaagacattcagatctcctatttaaaaatgttatgatgaagagaaattttatgttttgcatataaggaagctgaggcctatttaattccttttaaaaaatgcagcttaacccgtatttgttataggtggttatgtcagcctagatgctgctctcatttgagttgggatttcttcttaaataataaatattacaacaaatgtattctgtatg

SEQ ID NO: 208150 - DNA, 182 bp, Homo sapiens
gcacctggccagttatttagtttggaactctaggtctcctgaccccagcccactcctccttctggactgtactgttttcagttgactgtctctgggccgaacactgatataaatgagaaaaaaggtcttcagttgaggggctcagtcaagggacctaactcaccatcacaccgcactcatta

SEQ ID NO: 208151 - DNA, 441 bp, Homo sapiens
tcctctacagtttactctgtgattaacttccttctccctcaccccaaaatacagaagagtgaaatctctgaccagaaagttcctggcacctaccttgggttctgtgaaaaaataatggccctggttttcaatgctgccaaagttaagaaaagttttcaccccttcattttaaagcagccataaagtgccatgtgtttaaccgcaggaaaaaaagggtctttttaactattgagaagtagcttttcatatccccaccaggggaaggaaagagcgggaaccaggagactcgtgaggactgcaaagatggtcctccctgggtacttctgctgctctcttctctccagagctactttgtgattggcctgatggtcagacctataaaatcccacactgctaaaaatgctgtccttttcctagaaaagcccttttttaaaaaaaccc

SEQ ID NO: 208152 - DNA, 409 bp, Homo sapiens
agctctttgaagaatgcatttgtaactttgagaaggttgtctactttcttccaagaaaacgaagcacattaacagaacttaataacagatttccaattcaaggcaatgcgtgataatatctcaattactgatatcaaatgaagatgccatttctgaaatacattttatatgaaatttcactggaagtctgaaatgtcctaggatatttattatgaacgtttttccaggaaatattggcagaatccctatttttcaaaggaaatgtaagtgatttaatccaaatcttaaggcacttacaagtcttgcagggcagaataaatcatgcgcatactggactctaatgcaaaacagaaagatgaatgccagagaaaggtaggggtgtatccctgcagatagagtttcagaagag

SEQ ID NO: 208153 - DNA, 157 bp, Homo sapiens
aggcgtgagccaccatgcctggccttcaagaggcattttctactcattcaatatgaaaaatagctttattgtatctcttggaaacagtatatgttctcacaacttttataacctcccttgtagagtagagaaatattaatggcaaaattgactctct

SEQ ID NO: 208154 - DNA, 517 bp, Homo sapiens
acggatgtggtgagaaggacccggctgagggatggagcctcagttttcctggggaccacagcagggccccacaaggggtcgtatgtgcagaggattctgccatcttcctgggggtccctaggcccaggtcctgagggaggggctgtgaaggcctgaggacagcattcctgccctccctaaccacatcagggtcccgggccgacctgccgtcggttgtacccctccccaggcacagactgtgactacatccaagacttgtgcaggcccccagccccaccccgccttgaatgggggcttagggtgaccagtgagggaggcagtgtctgaacagggccctaaggagcgagttgacctcagttctagttggagagactggccagtggtcagtggagtctctcggtggtgggcaggcagggagatcctcagacacctcctgcccagcccaggcttcttcccagggaggtctgagggtggggtgacactggggaggcacagacgcaggcgtcctggacacctt

SEQ ID NO: 208155 - DNA, 253 bp, Homo sapiens
gggcagagctcacccgcatttggaatcattcacccttctaggaagatttaattataaacctcagctcaaatccttggcgtgcttacagctttccaggcacccagttaagtgctgtacatgcgatagcttattttaggggtcagcaaaggtttttctgaaaagggccagattgtcttcagctctgcaggcgttaagttccctatggcaactgttcaactgtgccttcttagctcgaaatcaactacaggtaacg

SEQ ID NO: 208156 - DNA, 177 bp, Homo sapiens
agctttgaaaatcattaagtatgaggtaagataatgtttgtattgcttagtaattttgcctcaggccacctgctgctgagtagaaaggctgcccatgccttcacgaatgtggctgtgctggaccattgcttgacagcgggttgtcatcttttcacacagaatctcatcttcgtcctc

SEQ ID NO: 208157 - DNA, 321 bp, Homo sapiens
gctgtgcaaacagcattcagtactaggagctgtgggttgcttatcaatggccaatcaagactttgaactttaaaattctgtaatcattgccaagtcctcaggcatatttggagtttctatttctttggcttctgtttctgtttgttggctcgttttatgaattttggtttgttttgtaatttataagggctctgagatccaggtaagcctattcccatagtgaagcaaaggaggtgctgtgtgtgtgttttaaaaagattttatcatggaagctttcagaaatacaaaaagtagtataaatccccatgacccaaccccaat

SEQ ID NO: 208158 - DNA, 312 bp, Homo sapiens
aaatgacggacattagtgtaaaaagcctgcataccagatacaaaaaagcataatctttgtgtaattttgagactggccaggagcctttcaaggaatttaaccaactcaatgaaagtgacatatggacaccatatgctaaggcagtaggaggtgaactgagggttaacttttacttcatgacataatcccagcatattcggaggccaaggcgtgtggatcacttgacatcaggagttcaagaccagcaaggccaacatggcgaaactccttctctactaaaaaatacaaaaatcagtcaggtgtggtggcacg

SEQ ID NO: 208159 - DNA, 176 bp, Homo sapiens
ccgtattcccgggtcgtaccacgcgtccggacatggagctgtccttggcagagaagaggggtcgatgacaagatagatggaaagcacctggaaattggcaggccctgagtgggcgctggacgtgtggggccgcgggccgaactgccccctcctggcctcatctcctggtgcgcccc

SEQ ID NO: 208160 - DNA, 131 bp, Homo sapiens
tatgcccagccagattttatttttctctgaaaagatggtacatttacatggttcaaaattcagatagggccaggcgtgagccctggagttcgagaccagcctgggcaaaagagagccctgtctctacttta

SEQ ID NO: 208161 - DNA, 1823 bp, Homo sapiens
ggctcgaggcaggaggtgggggacgtgatggaaacaccatggagaaactggtgtaggctcaagttcagacctcagacccaagtctcccactctgatctctttctactcctgagggacctcaaggacggagcccgcccctcctccttcctggcataagcatcaggtcagctgcagtggagaaaagggtcccttgtgcttgggaaaaaaagcaagcattcctacacgtcctgactctgccctttcccctcccctccactccatggctcacactgggggcctccgggtgcttgctcgtggcatcttggtcccactaccgccacagatgtcccttttgggagtaatcagtggccgtccagggccttgtctttggggaggcctgtggggccagctccaccctccaggagctgagcaagaatcaccctggctggtgggcctgtctgctcccctgagtgagactccccaggaggcttgagagtatctgaatcttggggcccatgcctgaagcccacaaactttctctgcctaccaagggcccctcaggaacgctgggtgaacaaatgcagagccaaggagttgcacagccagagtcccagtgtgctcagcccatcagtgtgtgatggaaacaggcccagagaggtcaggtgacctgcccagggccttccaggccccacacagctggaaccaggatccacagcccccagcccagagtgctggacaccacgcttcaggggaattggcgtgctgagctcacaccagagaggtcctgctagctgccagcctggggctcccccgcctgctgcccaccccttcaacaccgatagagggactcacaggcacgacggtgggaccttccactgcagacacaaagcacaccaccacctgaggtccagggttatgatttgaatcctaccaagtgcccatcaggcctttcccaggttgcggggaaaacaggaccccagcccccacacagtccctggccacctgctgctcctggagacttgtctccctgcctttaggaagggtttttgtgtgaaggtttttgcatgcactggtctgaacgcatgttcacagccctgcaaggtgggtttgattctcatccccatcttgcaggtgaaacaggttcccagagtctgagtagtttgccaaggccacacagccaggaaggggtgaaccaggactcaaacccaggtcctctgactgccactttctctctctggaggtcggtacccccagtcccttccctcttggtctgtcggagactcagcagagacaccaggtgaaggctcagtaagctcaggtgcatgatggagacctggggtcttgtcactgtcctgccacctcatccgctggctttgaaaccatccgtgctacttcaggcttccccagaggtgtctaacctggccccaaaactcagccaccccaccctagcctctgggggctgaggcaagggctcctcttttctccacacagaatgggcaccctctgggggcctaaggtaagaggtggtctatttctaaaaggcctggtgtctagttaagctctgggtatcttcttagctttgctttattgggggtctcattcagagaggagatttgacagcctctctgaagacacagaagtgaatggcaaagcgagaagaggctgtaccccccacctaccatgacttccttattaggcacatggggaatgtgaggcccagtgggtgaaaggggcctgaaggggcacagctgggacaagaacccagaactccagccccccagtccagggccctctactgcccaggctgtgcaaatggggctgggaccgaaagatggggacagtca

SEQ ID NO: 208162 - DNA, 170 bp, Homo sapiens
gagtgagctcttctgttagttcccttgaaagctggttgttaaaaaagagcttcgtacctcccctctcatgctactatgtgatctcagcacatgccagctccttttcgcctttatagattattgatctttgatactgaaaactattattgaaaaatattgcatcattgtgc

SEQ ID NO: 208163 - DNA, 695 bp, Homo sapiens
agcggagaggccgcttgcatgaccctgacatcggcagcgggagcggcggccagactctcttggaagtttaggatatttcacagttctgaatgttagccactgaaaatgccagtagatgatgaagcctctgaagatgacacggattcatttttctcaaacagcccaagaacctttattttccaataagagaatataacaatttctgtacactatggaagagtttgacttggtgaaaaccttacacaaaacttcatcttctgtaggatctgatgaaaattctcttcattctcttggactgaacttaaatactgatagaagtagtccccaccttagtacaaatggggtatcctctttctcagggaagaccagaccatctgtaattcaaggtacagttgaagtcctaacttctttaatgcaagagctacaaaacagtggaaagactgattcggaactttggaaaaactgtgagcatatacaggaggagataaaaaatttagtcaaattacagactagtagtgcttccttagcttcctgtgaaggaaattcttcaaacaaacaagtatcttcggaaagtcaaatgggtttttattctctaagcagtgagagaaatgaatctgttatccattatcctgaatccacagaacctgaaatacagcaagaaatgtccacgtcacaaccagactgcaatgtggata

SEQ ID NO: 208164 - DNA, 785 bp, Homo sapiens
agcggagaggccgcttgcatgaccctgacatcggcagcgggagcggcggccagactctcttggaagtttaggatatttcacagttctgaatgttagccactgaaaatgccagtagatgatgaagcctctgaagatgacacggattcatttttctcaaacagcccaagaacctttattttccaataagagaatataacaatttctgtacactatggaagagtttgacttggtgaaaaccttacacaaaacttcatcttctgtaggatctgatgaaaattctcttcattctcttggactgaacttaaatactgatagaagtagtccccaccttagtacaaatggggtatcctctttctcagggaagaccagaccatctgtaattcaaggtacagttgaagtcctaacttctttaatgcaagagctacaaaacagtggaaagactgattcggaactttggaaaaactgtgagaccaggtggttacagctattcaatttggtggaaaaacaatgccaagaacagatagttgcccagcaggagcagttccacaaccaaattcaacatatacaggaggagataaaaaatttagtcaaattacagactagtagtgcttccttagcttcctgtgaaggaaattcttcaaacaaacaagtatcttcggaaagtcaaatgggtttttattctctaagcagtgagagaaatgaatctgttatccattatcctgaatccacagaacctgaaatacagcaagaaatgtccacgtcacaaccagactgcaatgtggata

SEQ ID NO: 208165 - DNA, 741 bp, Homo sapiens
agcggagaggccgcttgcatgaccctgacatcggcagcgggagcggcggccagactctcttggaagtttaggatatttcacagttctgaatgttagccactgaaaatgccagtagatgatgaagcctctgaagatgacacggattcatttttctcaaacagcccaagaacctttattttccaataagagaatataacaatttctgtacactatggaagagtttgacttggtgaaaaccttacacaaaacttcatcttctgtaggatctgatgaaaattctcttcattctcttggactgaacttaaatactgatagggaagaccagaccatctgtaattcaaggtacagttgaagtcctaacttctttaatgcaagagctacaaaacagtggaaagactgattcggaactttggaaaaactgtgagaccaggtggttacagctattcaatttggtggaaaaacaatgccaagaacagatagttgcccagcaggagcagttccacaaccaaattcaacatatacaggaggagataaaaaatttagtcaaattacagactagtagtgcttccttagcttcctgtgaaggaaattcttcaaacaaacaagtatcttcggaaagtcaaatgggtttttattctctaagcagtgagagaaatgaatctgttatccattatcctgaatccacagaacctgaaatacagcaagaaatgtccacgtcacaaccagactgcaatgtggata

SEQ ID NO: 208166 - DNA, 349 bp, Homo sapiens
agatccctggggtaagaattgtggaggggtagttccccagaagaaaatcgaggtgttctcacaagaggaaggggtaatggatcttaaataaacaaaactatagatgtccacattttctatctataaatgtttagtgttactataacaattagaataattatttagttcatacactattcaatttgtatctcccttctgttgccctgttgccgttattttcttacagatagaatgaaaaatattaatctaggcagctctgtgaaacagtactgtccaaggaatataacgtgagccaggccgggtgtggtggctcatggctataatcccagcactttgggacgccgaggca

SEQ ID NO: 208167 - DNA, 248 bp, Homo sapiens
caactccacacaaaccgctggccatggccaatgtcttttctccatgggaagaacattataattagaggttgatttagggggcctagaatcagaacaaggaaggtgattggatgatgaaaatgcttaatgacatctggttacaatagctggccaaagacatggactagtgctattgctagaacacttagtctgccagccaagactttcctttgatattgtttttgcaagtattgctgcccttgtttttg

SEQ ID NO: 208168 - DNA, 480 bp, Homo sapiens
aagttaataagaaatagagccagacttctcaagaggctagaaccagaaattgaaaacccagcagggacgagacactaggaccaataatcagaaagccattgagatccaacgtagctgctctcagactctttcttggagccatttggtctttctgtgtgtcagttgcatagaaagccacacggtcctacaaactggctttctccttgtccgagccagtaagggatcagctccataatagtgtcagagtttgcaattccttcgttcaagcaataagcagagagtgactgccatccataccctgatcgacacctgcaggtgtctatgacccaggcagatgtcatttaggtgggacagggaaggccacagcattcactgacaagtcagaatacagttccccaaattcctttgaagactttcctgtctttcaaaacttactgttaattgtcaatgtaataaacagaataatgctgtcttcacaaa

SEQ ID NO: 208169 - DNA, 379 bp, Homo sapiens
tcaataaattaagttttctgtgtgatctttagttcattttcttaacagtaccaaatcaataaggaagaaaagtctaattccataaatggtgttggcataattggtaagcttttgggaagaaaacttaattttgatcatcacttcatagtacttaccaaaacaaattccagtttagttaaagatatttaaatgtttttttgaaaatcagccagcctgttttttgaaaaattagattactggctatcctggctaggaaggactttccaaatttaaagtgttaggaaaaatcacattaaaataaggatagactttattaagtatatttaatttctgcatttccaaaaggcaaagaagaaaagtttgcagaaaatatggcaaa

SEQ ID NO: 208170 - DNA, 554 bp, Homo sapiens
gcccttaagtattactctgtcattaactcactagggaacctaaactcttatcttctaatcagggctattatatcaattaaacgaaacatgatatgcaagtacttagccaagtgcctagcacagagtaatggtctcaataaattctggtgatacaacataggattagtcaccattattattaattgctatatgatagaatgggcattactaaaatataattagttcatattctggaaagatcagacaaatatatgtattcaaatgagttttttatttgaattgtatttatttgatttcagttaagggggtttatttgtttctggggaaagcattgcaaaagacaaaattattgcttgaagagcgagcatctgttgcagaggaactttaagatggcaaaggaaacacaactagaaggacgttggcatcactgaaagcctagaggaagactctgaggtctggaaaaggaagaaacaaaagcctgcactgcctgagtcaaagagacagaggaaaaaagaagggagaaggaggtcatattagtgaagcagagttggtgc

SEQ ID NO: 208171 - DNA, 209 bp, Homo sapiens
tcctgccaaaagtgacgctatatggcactgccactcagtcttcgcaacccagtgagatagtgttactgttgagaaaaccagggctcaacgaggagcctaggaaaagctgatgtagaattcatactcctacgtgagagttgccattttctttttgcttttctttttttttttttttttttgagacacggtcttgctttgtcgcccgggct

SEQ ID NO: 208172 - DNA, 263 bp, Homo sapiens
actttcattatagtgactaagttactttatgaaccttatctgaaagtaccataattaacactgattattcccacacattagcaagtattctgagcatagtccacagataattgcaaacctgacaggttctcattgcattttcatagtgcagttcctacttatatgcattatcaacttagacaaactacaggagcttaataatgaaatttcatctaggaattttaagtttaggctgcatttaatccagattagcagttaaccta

SEQ ID NO: 208173 - DNA, 299 bp, Homo sapiens
ccccaaaaattctatcctccttttctgatttttttgttagccagtataattaacacatcataaagattacttaaatatcttggttttaaaaatttgtctctcccactagaatgtaagcttctgtaagcaggaattttgtatattttgtttactggtatttctccagtgcctggaaaagttcctgccatgtagttagcactcaatatttgccaattaaatgaattaaagcatcaattatagacctcagtttgcccttggatattttacaactttgtaacaaatttcaagaacttttcttt

SEQ ID NO: 208174 - DNA, 526 bp, Homo sapiens
gcgttttttcacgtagattggaaataatatgccagtaacgcttattgaatcaaattgtgtctttgaagctgactggctaaaaaagttgtgaaatctttcatgttgatttttaaagtaatgttcttttcacaaattttccagtctgttactaaccttgattaaaatgctattataggagttatgaaaagacatcattttcacggtggaatttggagtaagcgtgcaagatatttaattattttagtattagttggagggttttgtgattgaactttcatcaagcgaatttaagcatttatattctatatgtatgtttgtgggttttgctttggaaaaattgagcatattgcaaaatagttgtaattttagaaaaagaaaacaggtcaaatgtttcagtgaggtttgtgttatttagttgtttaaaaggtaagataaagacatggttaaattgataaaatcttatctttcaagatttttattatttttctaatagtcaggtaattaaaaccttgttacctaaccaaat

SEQ ID NO: 208175 - DNA, 790 bp, Homo sapiens
gggcacccacctggtcggtgtcacatgctgcttcggccccagcgtcccctccaggtcccggcgccggccgcagtccccagagccgtccccagcgcaggcccggccgccccacccgcggcccgcccctggccgcccgacgggagggagggatcgggttctcctaggaagtttcaggtcattcaacatttattcaaccaaaaatactaagtcagctctatacaaactaatggaaggatacagctatgcaaatatagaacactaaagtgttacatgacagatgtatgagcatattcaccagtaattgtgaactaacaagacctgcattgtctgataaaaccgacatctcatagaaacccaatgacatgctacacagtctaaaattttcatctgcaaaataacgacgcagacacgacttgcccttctgtcagtaaagcacagattacgagaagtcaacttttctggattgaggcaataattgggcatcaagagtccacagtgacaactgaggctggcagtcaaatgtcacaccagttaggaatgactttccttgcccagtgctctcctcagggcacccttgacctctccgttcctcaggctgtaaatcagggggttaagtgttgggttgaaaaaactgtaaaatagaaaaaagaccttttgctgctcctcaggatggcgggacttgggggccatgtacatgatgatggcactgccaaagaagagtcccaccacgcagaggtgggaggagcaggtggagaaggcctttctgcggccctccccagactggatcctc

SEQ ID NO: 208176 - DNA, 338 bp, Homo sapiens
accgttgggcccatgagtaaaagcaagttgaatacattggtgcagaagcttcatgacttccttgcacactcatcagaagaatgtgaagaaacaagttctcctccacgacttgcaatgaatcaaaacacagaggggaagagtgctggattcagagcccacctcaggggaagacaggaccctctccaagatggtttccctagaagctactacctctccctggagggtggagatatttgctggtcaaagcaagaaggccctctgcagatgctgacaccttgatattggacttcccagattccagaactctgagaaataaatttctattttaaataaaaaac

SEQ ID NO: 208177 - DNA, 264 bp, Homo sapiens
cagaactgggaagaaaggaccctgaaaagttagctggttccaagtgaccctccaagaggggaagagtgctggattcagagcccacctcaggggaagacaggaccctctccaagatggtttccctagaagctactacctctccctggagggtggagatatttgctggtcaaagcaagaaggccctctgcagatgctgacaccttgatattggacttcccagattccagaactctgagaaataaatttctattttaaataaaaaac

SEQ ID NO: 208178 - DNA, 530 bp, Homo sapiens
caatcatctagtccgacatttcattttatatgtggggaaaccaatgtgcagaggaattaagtgacttctctaaggtcatgcagtgagtaggtggtaaattgggagaggaacccataattttgtgaaatatatatttggtctttgtccccatttcttggcgtacagtttctaaaactctaggaatccccagagtgataagagtatcttttgtatgttctgtggtttgaatgtgtcccccaaagttcatgagttggaaacttaatctccaatgtaacagtgttgaaaggtgggacctctaagaggtgattaggtcatgaaaactctgacttaatgcatggattaatggtgttgtctcaggagtggatttgttatgtggagattgggttagttacaaaagcaagtttgtccctctctcatcctctcacctttcaccatgcagcaagaaggccctctgcagatgctgacaccttgatattggacttcccagattccagaactctgagaaataaatttctattttaaataaaaaa

SEQ ID NO: 208179 - DNA, 549 bp, Homo sapiens
gcgcacgggccaggccgcgggctgtcccagggagccccgagggcgcggtgcgcgggcgcaggtcgggcgcaggcggggtgacccggggaaggggcgcgcacagagacagagggagccagccgggccccacggtgtcctcggacgcctccgaaatctccctgcgtgtttgtttcttcggagcttcaccggagcctgactctggaaccggcctgtctgcctgctgcagtctgtcattcaacatttattcaaccaaaaatactaagtcagctctatacaaactaatggaaggatacagctatgcaaatatagaacactaaagtgttacatgacagatgtatgagaggggaagagtgctggattcagagcccacctcaggggaagacaggaccctctccaagatggtttccctagaagctactacctctccctggagggtggagatatttgctggtcaaagcaagaaggccctctgcagatgctgacaccttgatattggacttcccagattccagaactctgagaaataaatttctattttaaataaaaaac

SEQ ID NO: 208180 - DNA, 649 bp, Homo sapiens
aaattagagctttggggaacagatttgctttattgtcaaggattgcctatagctgtacattcctttgaaattcaggtttcactcagatgacaaaatgatggtttggtaggcctaggaggatgtgtactttccaaactggagaaaatctaggttgtggtattaatcttaaaagcaccccaatgttagacacagctgcctgcctgacatgtgcctcaggtttatcctacatgtttacaaagctcagttgtaaatctgagtattaatgagaagatgttccatgaaagattttcaacaaataattaataatgcattcagttaaccataaaggcatttcaaggaaaaactcagactttgaagacaaatgatttgaataaatggataaaaataagcttaggggcttttgcagattcatcactcaactctcttacttcattatccacataaatacagcattattcagatgcattttaaccttcaaataactcatacttcttattgctgtttttatcataaaccttgagtaaggtagcctcttaaactatttatatacctaacatagataaaataaaaattaaaaagaaggaaaaacaaaaggaacttggttgggaatatgtaagaactttttgccatacatctttgaggtaatgac

SEQ ID NO: 208181 - DNA, 632 bp, Homo sapiens
tctactactttcttgcttagaatagtcagatatctttgagtactgaagcatatgttagtctaagtacaaataattgtcacacagttacaccaacctgaacaatgacggcaatcttgtctggcagagaggagatatacatatatgtaagaaagaagaaggcaaaaatagctaggtggtatcatgcctcaacagtgctcccagttctcatgatttccatttgtctcaatgactgagatatctaaagcaatggaaaagaagctaaacccttactagtcatttctgcatgcccaaaagaattttccatctcatgttactaatatctgagtaactgctcattttgtttgttttaattcagtcaagggcaacaacagcaaggtaaatgcacttaacacctgttaacatctgcagtaaaatggctttcaaggaaacagacaagatctccatttctaaaacaatgacctataaaaatgtaaagcaggtctgcagcatgctcaatcagctatgaaaagcaaacaccagctttaccacccagtgaagggctatctaacaggtctagggactacctcaacagctccactgttattaattcatttatttcaactacaaaaagttctaagggaaattgagcctac

SEQ ID NO: 208182 - DNA, 470 bp, Homo sapiens
tgtgctgagtctcacctgaaaccagcaagtctcagagccttacccaaggccttcaatgtagtacctgggtatcacttctggttttccaggacccaaagtctcttcaggtagcctgtaatgaatgccgtcgggatgaatgctgaaggacttttcttccaggtggtgggttctcttctggcccaagatgtgtctaaaaatgtcatctggcagtgcccagcgatctctctgtaccatgctccctctacagggattgggggaggagtggcacctgcgattcaggactgttttttaaatcactccagtgcctctttcagcaatatgaaggtaaaaccagaatggacaaatggccaaatagctggaaaagaagaagaagaaagaaagaaggaagaggtggaggaagaggagaaggagaaggaggagcagggaagaagaaagatgaagaataaaaaaagaaaagggtttaatgtaaa

SEQ ID NO: 208183 - DNA, 469 bp, Homo sapiens
agtagttatcacattttgaacctttgctctttcatttttggtctgaatatggtcatttttctgctagggagatgaagtgattacttaagtcagtaatcagccgtagtgaatcagctacaagaaaatgagaccaatctcaagtgctcaagactcagaatataaactatttagagagtagaattcagctggccgcggtggctcatgcctgttatcccagcactttaggaggccaaggtgggcggatcacgaggtcaggagttcaagactagcctgaccaacatggtgaaaccctgtctctactaaaaatacaaaaattagctgggcgtggtggcatgcacctgcaatcccagctactcggcgggggggctgaggcaggagaattgcttgaacctgggaggtgaaggttgcagtgagccgagatcatgccactgcactccagcctgggggacagagcgagactccatctcac

SEQ ID NO: 208184 - DNA, 503 bp, Homo sapiens
atatctccccagtctaccctcacctccctaatccctggtaatcaccaatctactgtgattctatgagtctgactcttttagattccacattaagtaatatcatggggtatttctttcagtgcgttgcttattttacttaacataatgacctccaggttcaaccgtgttgtcacgaaagcaggaatttccttcttttcattttacattcttctgttgacggacatttagaatgatcctgtatcttggttattgtgattaatgctgcagtgaacacaggagtgcagataccacttcaagaaacaaattcttcttccgttggatatatatccagcagtaggatgctgaatcatatggtagttctattttgaattttttgaggagcctccatgttattttccataatagccgaactaatttacattctcacaatcagcgtgcaagggttcccttttcttttttcttttttaagacagagtttcattctgtcaccaggctggagtgca

SEQ ID NO: 208185 - DNA, 592 bp, Homo sapiens
attagatgtgagccatcactcctggtctccatgcttctctaagtcagggtcttgctatgtggcccaggctggagtgcagtggtacaaccatgctcactataacctcaaactccttgtctcaagcaattctcccacctcagtgccccccagttagctaggactacaagcatgtgtcaccatggccagcgatttttttctttttggcagagatgtggtctcgcagtgttgcccaggctggtcttgaactcctggcccaaaatgatactctcaccttggcctcctaaagtgctaggattccaggcatgaggcacagtgcccagcctattccatgctgatgtgacaagcatttctaagctcaatagaagggctatatataccaatccaagcaattacattttgcataacctaaaatcctctatagtcctatctaaaaggtctctttgttagccttgaaaggacagagaccgtatttgttcctaaataccataattttaatatgttagtatctggtgagttataactctaatttataaaacactgcaagcacccttcactataaaaaattgatgcaccaaagaagctagatggaaac

SEQ ID NO: 208186 - DNA, 253 bp, Homo sapiens
gtactgacatgttcataacagcttaattcataaccaccccagactggagacaagactaatgtctatcaactggtgaatggataaacacattgtagtactgtgtgcccatacaacagaatgagctgctcatatgtgcaacatgaatttccagaagcattatgctgcatgcaatgcacatgctgtgtgactccgcttctacgaactctacaacagggaagatggacgtggtggaacacatcaggacagtgtctgt

SEQ ID NO: 208187 - DNA, 546 bp, Homo sapiens
ttgcggtcatatgttgaacgtcgcctaacgaaggaaaagctaccagccataaaatcagggtctaatgggcaggctatcaagtgagaggccataagaagctaaagcaggaacgattcctatcagaggtagtaactgttcccttcacgtgatctacaactttcccaggaaaaaaattaaaagacatgaatctgctccaagttatgatgatcactgtggcgctgcagacgggagccattgcatggttaaggcgggtgcccttcaaggacagaaattctgtcccagattctagagatatgagaacaatatcttcccaggctggatgtagtggctcacgcctgtaatcccagcactttgggaggtcgaggcgggtggatcacaaggtcaggggttcgagaccagcctgaccaacatggtgaaacgctgtctctactaaaaatacaaaaattagctgggcgtggtggtgggcacctgtaatcccagctactcaggaggctgaggcaggagaattgcttgagcccgggaggcagaggttgcagtgagctgaga

SEQ ID NO: 208188 - DNA, 163 bp, Homo sapiens
gtcaaaatcagagtagtaataaaaaatatccagcatcactgctggcctgacatttaatagttctggttagctcattctagctttggattctcatactatcatgggagaaccaagaacaacaggagttccacttccatttgaataagatgtcatcattttccat

SEQ ID NO: 208189 - DNA, 273 bp, Homo sapiens
cagctccagagtatctgaactacagtgtgaacccagcctgattctgtcccctgatgcaccgtgcacactcctgtctgttccttttccatttcttctctcatcttttctttccccttccctgtggcttttctcccagacttatcaactttaatttaatgcccttctagcatcagtgccacccatcgaagtacttagttccatctggttgatgaactgaccagtcatgatgtgcatatactatttccatcttcagctgtccttagctgcctttgt

SEQ ID NO: 208190 - DNA, 419 bp, Homo sapiens
  misc_feature (17)..(17): n is a, c, g, or t
  misc_feature (51)..(51): n is a, c, g, or t
gaacgatttcaccgagngatgctaacaacagcacagagagatcaccatctntccatggttttgagaagaaaggcagaaaagcattagacacatgaaataagatttgtactgggcactctcaagaaacagttaagatacaacttgacatgaaatggtggccaggaaataaaatgttcgcctgagtggatttcaattcagtcactccaggaacacagggactgtgtctgccttgctcaccaccgagtctccagcaccaaaaacagtgcctgaacatagcgggcagtcaagaaaagcttgtctgttcattcaacaaatgcctatcgatgccaatgactgccaaggactgcgttaaggtacttactctcagaggttgacagtccttggtggagacaaacaataaacaagtaaatggacaaaca

SEQ ID NO: 208191 - DNA, 260 bp, Homo sapiens
ataatcagagtgtgtttaatctgtctcctcccacactggaagctccaggaacacagggactgtgtctgccttgctcaccaccgagtctccagcaccaaaaacagtgcctgaacatagcgggcagtcaagaaaagcttgtctgttcattcaacaaatgcctatcgatgccaatgactgccaaggactgcgttaaggtacttactctcagaggttgacagtccttggtggagacaaacaataaacaagtaaatggacaaaca

SEQ ID NO: 208192 - DNA, 743 bp, Homo sapiens
gccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaatctattccctatgaattcatggcataataggtgttaaaaagaaaaattaaggacctctgggctaccagaatcatctgcaatgtgaggaatgtgactcatgagatctatcctggggccacaacgctggggggaggcaagactttctgatggccacggatagtctttccacgaagcgcattttgtattaagagggggatatagcagacagtcgaatgtggggcaagaagttccgacagcggttctcgtagaccacgaaagacgga

SEQ ID NO: 208193 - DNA, 137 bp, Homo sapiens
cctacgctgctcacaaatggtgatgctctagaatgcttcctgcaaatattacagaaattcttccataaagaagtttaatcaagtccttgttcttcctttggtttgtacaggaaaagtaggataaagagaaatgatag

SEQ ID NO: 208194 - DNA, 437 bp, Homo sapiens
aacatgatgatataaatgtgccctttatttatagtgcaacctctttcaaacctgatacagagaccaggatatacacaacatctaagaagacaaaatgggaatcactagagacagaactgagcttaagctaagagctcaatcaaagctgacccaacagatacacaggggccaagttggtagctgagggtattttactatttctagctaatattagaactctggtaaaataatacaaactttggacataggagaaagattataaaacacaagaggaaaaaataaagagcaaaggattatcaatatctttgaaaacggagcccctctttgttcagaaaacagaaggattcaaatgttcttatgtagcacgtacaagagcctccacaaaagtccatatctcaaattctaacagacccaaaaagaggaaaacgagttcagaa

SEQ ID NO: 208195 - DNA, 439 bp, Homo sapiens
gaaacccattagcagtcactccgcattctcaccttcccccatttcctcccaaccactaagtgattttctgtctctatggatttgcatattctggacattttatagaaatggaatcatgcaatatatgatcttttgtgtctggtgtctttcaatgaacaatattgtcagtcttcatccacactgaagcttgtatcagtagtgagtgcttcctttttatggcggcatactaatccattggatggctatccgacatttgttttatctatgcatcaattgcagtgagcctggaggtggaagactctggtttttttagtgagcccttcaagaaggtacacatcctggtgagaggatgaagacaccggagttcactgaaaggccaggctaatgaaatgatgagctgcccccatctgagttttgtattagaaaaattagaggcaga

SEQ ID NO: 208196 - DNA, 740 bp, Homo sapiens
tctgtgttccatctagtttattggtaaaagtgaatacaagtcaaggctttacaagtattttgctcagatgtgcagaaaggactagctctcctgcttgaaacagtgaaggaaagcgcagccagccccttgggctgaggctgactctcggtgtttctttggagagcgttgcttagtaacagttgcaggggacacgcacagacagggggatgaaagaaggatgcaggagatgagggagggtgcatttgttttctagcatgccccacgagtgggagcagtgggaaaaatctttagatcttttaaccaccaaaatcatgccggcttactgcaatcaacaatctaaagtaaaataaagaaatcaagaaattaagtgaaaagtcaatctcaatcctacttccccgaagtaatgatcattaatagttggggcaatagtttgccccattttataggagagtaacatggaggcaataggtaaggaagcgtttttctggggtcctaagagacacccactgggaaatcgggattggggggtacttaaggctatgctgctcaggggtcctgagaagagggcagtgcagggagctgggaacagggagagggggctggttcctgtgcgcaagtggcatctgttgcctattatcaggagcagaaatcctagcacttctgctcactgagtctcgtaactggagttgccaggggcaacagcacagtcaagcccgggctactccactttactcatacta

SEQ ID NO: 208197 - DNA, 535 bp, Homo sapiens
gggtacatacccagaggaatataaatcattctaccataaagacacatgcatgcaaatgtccactgcagcactattcacaatagcaaagatacagaatcaacctaagtgcccatcagtaacagattggataaagaaaatatggtacacatacaccatggaatagtatgcagccataagaaacaatgagatcatgtctcaggaacatggatagagctggaggctattatccttagcaaactaattcaggaacagaaaaccaaataccacaggttctcagttgtgagtgggagctaaatgatgagaactcatgaacacaatgaagggaacagacactagggtctacttgagggtggaggatgggaagagggagaggagcagaaaaagtacctattggtgatgaagtactctgtacaacaaacccgtgacaagagtttccctatataacaaaccttcacatatacccctgaacctaaaagtttttttaattgtaaataaatggatcattaaaaaaaattttaataataaaattgtctta

SEQ ID NO: 208198 - DNA, 396 bp, Homo sapiens
gattgatgggtcaaaagatgaaaacaggtgtaatttgtcagatattgctacattctcctctctgggggctgtaccattttgcattccctcagcaatgtgtgagaacacgtgtctccacagccttaaccacaaaatgcttgtcaaacttaaggctctttgccaatatgatgaatgagaaatgagtgtttctgttttgttgtatgtttatcttatgagtaaggttacacatttttttcataggtctaagggccatctccccttttctttctataaactgtgtacatcttttgttcatttttctgtcatgtgattggtctttttcctttcagagaatttctaaattagagagattaagcctttttctctaaattgcaaatggtttcctttcttcgtttt

SEQ ID NO: 208199 - DNA, 480 bp, Homo sapiens
gaaagggttatctttgatctttacctcctccaactcctctagtcactatcagtgtccccaaatcctccctcaaatgcacacgcacagtctaagtagaaataacacatttgcctgtaagtggggaccttctctgggtcacggctgcctcaaaagattttcctttagagaaaccccaggcccctggtgtgcaccgtagccacactgtttcatagcccattttttaaagctgtatgttttgaatattttcgcatgtcaagaaatagtcaatacaatacaatgtattaatgatgcagtagtatttagccatcaaagtataccataatttactgatatcatggtcccccgtaattagacatttgcctgtttccaatttttcaaataatccttggatgcacactttgtggtaaaatttctaacatgtctaacacattctttttttttttagaaagatgactcgactgtagaattgacgggtaaaag

SEQ ID NO: 208200 - DNA, 276 bp, Homo sapiens
ttgttgctatagtcttcccttttagaactgttttgctgtagtcataggttttggtatgctttgtttaaattttcattagtttcaagaattttaaaaaatttttaaatttcttcattcacttatgaagaaacactctcccttagttttcttccatcttcttggctctccttattttgctttgtatcttgactatactttctttgtctcaactttaactattgttatttcttttagatttattccaatcatccttttccctctacatattcttcatta

SEQ ID NO: 208201 - DNA, 484 bp, Homo sapiens
tcccatgtcagccatctccagggctcttcccgagaagagggcagtccccgccaagggtgttgcctctcaaacctgccaaactacaaaccctcttggtacctccacacatccctggagtcggctttggggaacactgtgttccatgtctaagtggagtcccgggcctctcccctccagtgtcgcctgtgccagctggacacgaagcagcagatcagtcatgaaaatggctgctcagctccgatctgcccttccttccgcaggactcagggacgcacagctccccagggctggtcacccaaacaacagcattcctttctcctcggcctctccccaggctgcttgggagagaaaacttccctcatcctcctccgcacacactaaatgccctgccggtatcttctttccagtgactgtggccccaggtcgtcacacatggccagacacagctgaatctcaggctagatcatgttggcactgcttccac

SEQ ID NO: 208202 - DNA, 207 bp, Homo sapiens
acctcagactgtactttcctgctcatcctgccttgttctatctctttatcatccctcctactatagccctgagtggcaccatccaagagcaccatggtttctctcctcctcaagcccttttacacttgtaacagaccacatgtccaacctggccataaaacaaaactgagttcctggatccacccagtccataagctccagctgtta

SEQ ID NO: 208203 - DNA, 274 bp, Homo sapiens
aagtgtgataagggtaaatcagtacttgtattaattcacagctacatgattatttggtgataatttttatttccttatttattctacttgaataatcagttctgggatttgctgtgacttgtgttacatttttttctcatggggttattgtctttttcttattgctttttgggcattcattacttattttggatactaatacttcatatcttataaataccttctgttctacagacgttgaataaagaaaactggaatttcaaaagtttgtgaa

SEQ ID NO: 208204 - DNA, 732 bp, Homo sapiens
actaatgagtatttcttttttaaaacaaacatcctagaacaaacatccacaagaactataggcccctcaaagtggttactttaagaagttatgcagttagtatgtataatactgccaaaacagactaggtatagtggctaatgcctgtaatcccaatgttttgggaggctgaggtgggaggattgcttgaggacaggaatttaagaccgacctgggcaacacagcgagacccaaacgctacaaaaaatttaaaaagagtaatttaaaaataccaatacataaaacgtattacagttgaacatcccttacctgaaatgcttgggaccagaagtgttttgatcttgggtttttttttttttttttaaattttggagtatctgcattatatatatttatcagttgagcatcctcaatcccaaaatccaaaatgctccaatgagcatttcctctgagcatcatgttggtgctcagaaagtttccggttttgcagcatttcagatttctcattttcagattaggaatactcaacctgtgtaactccccagttagtgtgacttcaacttttttcccaacagacttgctggcacaatgaagcacaacagtcctgaagcctagtctaaaaagccccgttaatacactactaagttttggggacttctagttccagcaatttggcagactgtgcagagaaaccactcttgttaaggaacacatatatatgctagatattaa

SEQ ID NO: 208205 - DNA, 481 bp, Homo sapiens
  misc_feature (3)..(3): n is a, c, g, or t
agnttgaggcaggagaatcacttgaacctgggagccgggtttgcagtgagccgagatcatgccactgcactccagcctgggtgacacagtgagactccgtctcaaaacaaaacaaaaaacaaaaaagatgaaattatcatttgatataaccaatagcagagagatacctgtactctgattccttcttcgtttatgcagtcaatccttgttatttgtggattttgtattcatgaattttcctactcactaaagcttatttgtaacccgcaaatcagtccaaaggtagtcctttcgtggtcatttctggacattcacagagcagtgaaaaatgcagtttgctcagtgtacacatttccagccactgtgaaacaaggtgactgatttcttgtttcagccctcatactgtaaacaaatgacctttatgtggtctatttagcattacatttttttttttttgtatttttgtgcctttgctggtgac

SEQ ID NO: 208206 - DNA, 463 bp, Homo sapiens
agattttgggcgttatcatgaacagaatgagagccctttgggcatgaggaagactgggcagtctgagaggagctagcaatgtgtcaatcaatcagtcaacaaattaactaactaattattttggggaatccaactaagcatgctcatcgggcaaccttaaaatgaatatgttaagaaacaagaaaggctggggaaaaaacaatcatctatgctttcatctcaagaagtcaggaatagacaaataaattaagcatgtggtagatcacatgtatcggttagtaaataccaaatataataaatttatgatattgggtatcatccatgtaccaattctgtccaaattgatctactgatacaatgtaatcctaataaaatttcaacaggacttgtatgaaaattgacaggctgactctaaaattgatatggaaatgtgaaggaccaacgataatcaagacattctgaa

SEQ ID NO: 208207 - DNA, 690 bp, Homo sapiens
gtaagaatgggtaacataatatattgggggtttgtgttataaatgaggctattttcttatgtttagtattttgtaattttagtagagatggggtttcaccatgttggccaggatggtctcgatctcctgacctcatgatccgcccgcctcggcctcccaaagtgctgggattacaggcatgagccaccgtgcccggtacaccagcgatctttgttagtcacaaaatgctaattttttcaatgatcatcatcagattttatgtttgttgttcaaaatgtcgtcttaaggcagtgaagcaatagaagttgtagattactcttcatgaacacatctaattcaagctttctccttcaatgaatatttgtttcctttttttttaagtcttacattttacaaaatttatcttaggtcatattttgcagtgattttttaagcaaacaaatagaaatccccagtcatctctgtagatttgtcatcctgaaaagaaatgtctctctgcttgggtccagatgacagagaaggtggaactgtaagtgtcagggagtataagtgttgcttctttatgtgactttgaaggactcataaacatcagagatctgactttccagttcctttacatttttatgtttaaattgcacgttaacttcttttgtttctccttgtgtttgggcattgcaggattctgatagt

SEQ ID NO: 208208 - DNA, 186 bp, Homo sapiens
gacaccgggtgctaacgtccggtgtcgagaaggaaaacctacccagctgactaataagtgcaaatgcattctctttgaaaatatctaaccacttttgtgacttaaattctatttgtagtttcttttagtttccaggcaactaaatgtcattaataagagaaaacttgacactaatttgcactccat

SEQ ID NO: 208209 - DNA, 555 bp, Homo sapiens
tagatgaaaggtttgtgctccttgtcctctttcagtttttgatattggtatagaaatacacaattacagaataaagaatctcagaatagattcagacaaatgggaattcaattatgataaacatgaggaataagctttcattagtgggggatgatgtaatttatatggagaaatatagatccttcacatattcaaatgttcacatgaactaaagatttaaatataaaaacttgaaactataaaaatattgagagaaaatacaggaaatataatctcaatgtgggaaaagacttcccagaagctgtaaaggaaaacaaatgtcatttttagctcatctgattgcaaaaataaaatacaatacatatataatatctgggattgttgaagatgcagcaaaatggatgcacccaaacagtataataggaatgcgtattgccacatttttataaataatctgtcatctcttacagttaaaatgcaatggcccttgacacagttattcccacttacaggaatatatcctatacgaagcactactaccttgtctctactaaa

SEQ ID NO: 208210 - DNA, 626 bp, Homo sapiens
tactcaaatagaacaaaaacacattccagagtttattctgcttcagtttattcataccatttccctcagcttccttatcacattagtgtagaaatgcaaaaatggtatacatgtatatcctactatctcattaaaactgttactgtttatagcataatgaaacagtggcttagttattcagtgcttactatgtactgtgtgccagagactgggctaggaattatgaaactgaggtttaggatgatgaggggcaaagttgggaagcatttattttaagatgttttcaattcttttgccccatcttctggtaatgtggtttttcctgataacccattcaagcatattttagttatattcatttttaatatgcttttataatttgctacaaactttctgctattcttaaacagaggctactgaattgaactcagggatcttaaagtcccttagaacctcaagattctattaaccttttggggatatctctagcctcactctgaccctgttatttacagtgtacagaagactcaggagatggctgaacagggtctgatgtagtcatgtcctgggccttgtttcctgtaaaagtctcactgttcgtttattttttgtcatttttctcccag

SEQ ID NO: 208211 - DNA, 441 bp, Homo sapiens
ccatttccacagatttggaaggcccgctgagccattcaacatttgctcccaacaggggtgattagttcatgtaatgctagcattaagcaaaagactctgcctgaaacgtcctctggcccagctccggtgctggagtgacctagttagctgtgtgtcccaggctcagccctccccctgggtagcttctcggtttttttttttttctctgcacctctccctgcacccttagctggttttaaaaaaatctgtccctctctccatcagcctgggcaagagtggcttctcactgcatggaggtctgcaggcagcctgtggcttttctttgattcaacatgcttttctttttggaaaattccttgtctttctgctttgtttcttattgaaactcatgttttgatttgatgactcaaggaacttacttacagtgtctaaccatcatga

SEQ ID NO: 208212 - DNA, 938 bp, Homo sapiens
catggggctggcgtcgaggccagctctgcctcccatgggtgggccgccttaggctcctcctctgcaaaatagggagctgttgcaggacatttcagagctactataaggactgaaggaggccccggggaaaagagctcttgatatattaaggcactgcttagtagtgactatgcttactttgcgagcagggaaaccgaggcctgggtaggacagaggggggcacatgtgtttactgccctctccgcccccgactttggtgccatcagcctccacccctgctgcgcccgtcagaatttggcttccacgttctgctcccggaccctcccagcctaacctgtggatcctgccacacaaagatgggcttacctgggagatcttcagttttaagaactctcagccaggcatggtgggaggctgaagcgggtggatcacctgaggtcaggagttcgagaccagcctggccaacatggtgaaaccccgtctctactaaaaatacaaaaattagctgggcatggtggcatgcgcctgtaatcccagctactcaggaggctgaggcaggagaatcgcttgaagctggaaggccgctatttcagtgagccaagctcacaccattgcactccagcctgggcgacagagcgagactctgtttcaaaaaaaaacaaaaaacaactctcttccttgctaggcatgttgaccttgtataagggcaccctttgaggtccaatccaggttgaggcaggagaatggcatgaacccgggaggcagagcttgcagtgagccgagatcgcgccactgcactccagcctgggtgacagagcgagactgtctcaaaaacaaaaacaaaaatgtccgctcagtccactcttccctgattgaaggacaaatcgcattctaagtttagcgtctaaatgaagcgtttcccagacagagtgaccttc

SEQ ID NO: 208213 - DNA, 248 bp, Homo sapiens
gggaacgtagtcactaaattccaaggcatttagaaaagaaaatttctttatttcgtatgaaagtgcgataagggataggactctggagtagacagatgagaaaagagaattctaacatatttctttaattctgtctgcaaaactatatggaacatataaaactggaaggtgctaatgtaaagattgaacaggaggaggtgggtggtaagaagtactataaaaggaactaaaggtgaaaatatagcatt

SEQ ID NO: 208214 - DNA, 886 bp, Homo sapiens
actgtggggtttcagaagaggaaaagatactgaatatcaataaaacataagccattcaaaatatgcctatcctcatttgtgtagtggtgagtaaaaaagaaaaaaaccatgcctacttctcaatttggcaaatgttgatgagattgacaatccccttcctgataacctacatattgagcgcatttttttccccaggacttcaatccatatggggaaaatgggtaacacaaaagaaaacaaagcagaaagagattcttccaaccttggtgcctgggaagcttctcaacctctcacaatctaagctctaaggcactctttcaggaagtttactattattgggtttatgtttctctaagtatacaggtggagcttctaaatgcctctcatgtataccacttcctgggtatacatgggccttcagagagctatcagtttgctgggcctgggtcccaagttttcagagagctatcaggttgctgttgctttccattgtcttgacccaacccgaggaacaatttagctcaacagttgcagaaaattacagcactcaatgtgctggtgtggtgatctgagcctgattaagtttgaatctgacaacactgctattcaccagctattgcccttaagggagtaacttgacatcaggtttctcatcaacaaagtggagtcaatgctggtcccacctcaaggggttgtttcccagcttgaatgataagggagttaacatgcatccaatgcaatgtatagtgtttttattttattttttattttttctcctgatggagacaatatgcataatactgtgagtcttgggcagacatccaggaaaatctggttgggaaagacctagagaattctgattaaaagaaagaattaatgattttca

SEQ ID NO: 208215 - DNA, 604 bp, Homo sapiens
attttctttatctttaatttaaaatatactataaaactctaaaaatatttagatttgatatagcatgtaagtcaaaaattgagagttgagaaaattatcttgatcctgcctttggattttaaaaacagtttcactgagatatcattcacatttgagagagttcaaccatttaaaatgtacaactgagtatctattagtatattcacagcattttcatcaccctgaaaagcaaccccacatctcctaggcatgactgcagccttcctccatgtccctccacctacccctgttgtaggcaaccaccatctatctacttttgtctccatatatttacctgttctgtatatttcgtatacatagcgttatacaatatgtagtcctttgtgactggctttttcacttagcataatgctttcagaattcatgcatgttttagcacacatgagtagtttatttcttcttatagttaaatgatgtactattccatggctatactggttttccattcattcatcagttgatggacctttaagttagtttccactttttagctattatgaacaatgctgctgcgaacattcacttacaggttattatgtggaca

SEQ ID NO: 208216 - DNA, 498 bp, Homo sapiens
tctcctacctcattacctctaacacatttactggaactcaaagtacgaaaaccacagctttatttttataaagacaaaaggaacattaacattaatcatggactggtgcaacgattactttgtcctaacagaacgctttctatgtgaatgtttcaaaatattttataaacaaaacctctgtggtacaaagtaagagaagtgtgaatattacaccaatttttgaaatgcttattccttgcatttgacatttacaaatcttcacctatattctgggcatctgtgtgcatggcttatcttccctgacaggctgaaaacaccgtgaaggcaaggcgtgcatcttggcatttgtatgtgcagtctggggtctctggcacacacaaggcagccatgagctacttctacaaggctgtgaaattcaattttaggaagctgatctgaacacaggacaagccacattcttcaacactagctgaatcaaatgaaaggtgatattttgtt

SEQ ID NO: 208217 - DNA, 897 bp, Homo sapiens
caatgaatgagccaccttagcaggagcagatttttcccaggaagctgctgcctcttcctgaggcagaaaatggattactaaggctcaaaactaaaagagatgccagcctgggtgacagagtgagacgccgtctcaaaaaaaaaaaaaaaagacctaataagtaccacattgagtcacccctggttgctctgggcgacagagcaagactccgtctctaaataaataaataaataaaattaaatgcttgacctttacgtcaaattaaactggctagctttaaatagatttttttcagattacatgctcactctagaaaaaagagatgtgtgacaaaatacagagtgaaagtatacttcttccctttctattttttgagaagcacaatatagcatcctggtaagtgagcaggctctggaaccaaactggattgaaactgtggcttgggtacttactagccatgaactggaacaatttatctgttttaatttccttctatgtaaaatagggataaaaactatagtaattagagctgtagtgagcattaaatgagttaattaatgcatctaatgtaattagagcagtgcttatcacatagttggtgctcaatgaatactattattaaactccatgtatgtggatacacagagacacaaaataaaggcaattacaaatatgttagaaaaagtattccaaaactccttatggctgtaaaagcagcattacatattgaggtttgaatggctgcctgttccattgtacaacacactgaaactgctacagctaggtctcaagtaacctggtcctttgttctttaacatctgaagagtactttggcacaggtctttggaaaggctccttctcccatcatcagtatgtactgcattatttaaaattacc

SEQ ID NO: 208218 - DNA, 362 bp, Homo sapiens
ttaagtttcgtcatgtgttttgtctttagtaggggggcagtagaaccaggaataggagactagagaaaaggagtcacagccaggcatgttggctcacacctataatcccagcactttgggaggccgaggcgggggtggatcatgaggtcaggagttcaagaccagcctggccaagatgatgaaaccccatctctattaaaaatacaaaaattagccaggcatggtggcgggtgcctgtaagcccagctactcgggagactgaggcagagaattgcttgaacccgggtggcagagcttgcagtgagccaagatcaccccactgcacttccagcttgggtgacagagccagactctgtctcaaa

SEQ ID NO: 208219 - DNA, 228 bp, Homo sapiens
gaagcctttcaacagactttgcatctcattgaccacagttctgtcatatgccaatgcctagttcctggcaagaaggaggagtccaagactgatttgtgtcctggagctggagattttttccttgagcatttgggaagctagatacctaaacaaaactgttttttggttatcagggaagagaaagggtggagaagaatggatattcaagaaagttaccgttgacagccg

SEQ ID NO: 208220 - DNA, 603 bp, Homo sapiens
cagggtggtaaatccttgattcttagtgcttgctggctttttagagtgacatgaactcaagaattttaaatgtaggttttaaattcaattcagtcaattcactttgaagcccacattctcgttaaggtcaggaattgccctatcaaatttttttttttttaatttttaaaatttttcgtagagacagggtttcgccgtgttgccaaggctggtcttgaactgctgggctcatgcagtttgtccgcctcgggctcctaaagtgttgagattacaggtgtgagctgccgcacccggtccagtttggtttctgtgtccttttgatgtacacttcgtctttttgaagtttttaaactttattttgaggtagttttagatttacagaaaagttgtaaagatagtacagggattttcctgtataccattcacccaacttcccttaatctttctgtaactgtggtaactgtggtgaatttctcaaaagtaagcagttgacaccgctacagtattgttaaatgtggactttattcatattccacctgtttttctgctaatgtccttttcctgttctagaaaccatccgaggaacccagattgtatttagtt

SEQ ID NO: 208221 - DNA, 618 bp, Homo sapiens
cttgcagatcaagatttctgttagagagaaaagagaagagaagggaaaaaggaagaagagagggagagaaagagaaaaggagcaagatttagctctagacttgagccaatctgttacattaagcaattttaatctcagtaggtctgttttctcatctgtaatttgggcacaatcctgacttcatggtgctccagtgagctttgggaataatccatgttagcactcatagcgtggaatcaccaacattttttgagtgcttactatgtcctaggccctgttctaggtgcttttcatggattcattaaaaaaatcatgaatttggcacacgtattatcctcctcttagaatgaggaaattgagatacagagcagtttgtaagaacttatgtgtaagtccacacagctaatgaactggggttctaaccaaggtaatccggttaagagcccatgctctttgctgcaaatccatgtccttaaccacactgtactgttaccttaataggagaaatatgaagctattgtgtgatcaattctgtcagtactattattccatgtcacttttattaaaaatgagaaaaagaaattgctatcaaataaatatatcatgtttagtagacaa

SEQ ID NO: 208222 - DNA, 438 bp, Homo sapiens
tgtgggaccttaggtaaatctgttacattactaggcttcagtttgcaggcttgaattgcaagatgggcgtgctggattcaatgatctccaaagcccttaccagtccccaaattctcattatacacatttgagaaatgctttgaagaaaacagggccgggtgcggtggctcatgcctgtaatcctagcactttcggaggccaaggcaggtggatcacaaggtgtcaggagttcgagaccagcctggccaacatagtgaaaccccaactccactaaaaatacaaaaattagctgggcatggtgatacatgcctgtagtcccagctactgctgaggctgaggcaggagaaccgcttgaacccaggaggtggaggttgcggtgagccaagatcatgccactgcactccagcttgggcaacagagtgagactttctctcaaaa

SEQ ID NO: 208223 - DNA, 536 bp, Homo sapiens
tattcgtccatttgtatatcttctctggccaaatgtctattcatgtcatttattcattttaaaattgggctatttggggttgtctttttattattgagttgtaagcgttattctgtatataagtcccttatcagtacatgatttaaaatgtctttcccattctgtgggttgtcattccactttcttgatggtgtgttttgaagcacaaacattttgtgaaactttaattccaatctattgtgttgctgtgcttttggtgtatctgagaagtcattgtctaatcagaggtcataaagacttactcctgttcttccttctaagtgttttatagttttcttgcttacagttaggtctcagatttactttgaatgaacttttgtatgtgatgtgagataggggtccacattcactcttttgcatgtgactatccagttgttccagcaccatttgttgaaaagactatgctttgcccattgaaccgtcttggcccctttgttgaaaattaattggccataaatataagggtttatttctga

SEQ ID NO: 208224 - DNA, 423 bp, Homo sapiens
ggtgtggttctttttattttgtagggctatgaagtacctcctgctcatgagaaaaatgagatggtaagtttgccactgactaaagattagactggtaagaactgactttccatccaggacacaattttcctttagagttggccataaaactttcattccagaggtgcccaccctacacctggaggataggagcattcttatctctgaagacccggggacacagaatgcacctgaacaagcaggccttgccaggtttcccccagtttattaccattagatcatacccttggtcttccggccacacttctgcatgactgtccataaaaatgcacagttgtctctgtttctttgggtcttcatttctgaaggctcccatgtcacataaaacatattaaataaatgtgtatgtttttctcttaaaaa

SEQ ID NO: 208225 - DNA, 571 bp, Homo sapiens
tatctgcaatggctcttttctcatactgcaaccctctccaagcctcccttctaaaaagatggaggacttcatcagaagtcacaaaggaacaatttttgttcagaaataaaaaacaagtcagaaggctgaatctcatcttacaactatgttctggtccccttctatgtttatatttcccctccattttttttgatattggttctgcatagccatctgtaaagcatattcccctggacttcatgcttcccagaacattacacacaaactgtgcatatgtttttcctaaacttagtgatcacatttgtaggactggtggaaggagagtgggggacgggaaaaatttcctcctttcttacgcacagaaatcaatcagcaatttcacttctgtgagtaagaagtggagaaaggaagaaaggagaaagaaaagaaggtaggtagaaagcattctcacttctatatactgtattaagtagccaacataaagctagaaacgaatcaagctgaattcatttttactctattctcacaatgctgttatcttgtctctaacctagggcatccacttccttca

SEQ ID NO: 208226 - DNA, 415 bp, Homo sapiens
actcttgttgtgcctgtgaataaccactccactctaacctaggaagcatagtgagaccatgtctcttaaaaaaaatgtaggaaagatattgcatgggctgcattaaggcctttaatgtggtagctttatttcacaagtaagggaagccttggaagatcagattatctttattgggttatgcagttattgaatggtggagaggagcctaaagcacatctttttagtgcaatgttctttaataattattactagtcttactagaaatggaaagacttatggtggttcattttccaatttagaatccttgtcttgtcatttcagcaggtgtcgctttaaaaaaaaaaccagaatcctcatctgattgggtttaaatattggtagggttcttgaggactgagagggcaaaggaaaggga

SEQ ID NO: 208227 - DNA, 396 bp, Homo sapiens
ataaagtcttactcagtgacttaaagtcacactgtgctttcttttctctgacttctgcaagcctaaaatactccagcccttaactgtgctctatgtcagcattcttggtacgtggtttgcagagatacctgctggccagtgatcccaaaagtccatgaccttgtctgatttgtaattttgttgatggtgtcatgggttagtctgatggagaagagtgaaagaaactaactagttctttacttgctgtccctggcatggttattctcaggaaattgttttagcatgttacttcttcatgaaaaatatctttgcaagaaataaacaagtttatttgggctactaatagaagtaaaggagatagaagatgatttgaaaagtgataagaaatcttagacc

SEQ ID NO: 208228 - DNA, 347 bp, Homo sapiens
gcccctgcctgccctctggtgtagaaggtgaagaacagtgatgagaatcaacatttggttaagttttgtgatactcaaagagtttaaaaatgaaaaagataaaggaagatagattattagtagaccttgtatgacacaaaatgattatatgtcactttttaatgaattttaaagtctcatatccatttctaagtgcattacatattgaatttaatattacttgaattttctctactgttcatacagatttttctctctgcatttaaatgtggcagtggattttgatacccttttgactatgacataaaacagtcctttatatcacaaattaaaaattttttatttat

SEQ ID NO: 208229 - DNA, 454 bp, Homo sapiens
aaaatttccatttggttcttctttatatcttctatttctttcctgagattttctgtttcttcgctgactttgtaatttttgtttgtttcaagtgtgttagtaattgctcattagttagtaattgcatttttatggtggttgctttaaaatctctggcagataattgtaacatctttgttatttcagtgttaccgtccatagattgtctttttaaattcaagttgagatttttcttgttcttagcatgatgagtgattttcaatttcttaaacctggacattttcggttttatagtaagcctctggatcttaaatgttgttttagctgacttccactgacactcttccagcagagggaggacagtactggacagttactggcaagtgggaaaagcagtccaagctccttttagaaaggaagtaaggggagaggagctcctcgttacttctgggtt

SEQ ID NO: 208230 - DNA, 354 bp, Homo sapiens
tttaagtgtgatttatgaggattaagaagatttcatatctgaagagtggaaatttatacatatgtacctaggtctagatagcataagctctggtttccctcagttacttaaatacagatgtaaaatcattgtatgaatatattaaataaaatttaggttgtaccctctgttacttcctattaaattttttttattggctcatctggtaaaatatcataaacactacgtaatttttctgacattgaatatgtagaaaaaaattataaaactgagttttcagtgatctatggttgacttaaaattaaagatgctgttattttagtgatataaatggcaaatgtgaaatttagaaaa

SEQ ID NO: 208231 - DNA, 778 bp, Homo sapiens
ggtctgttcaggttttctattcctgattctatcttgataggctgtgtgttttcaggaatttatccattttctctaggtttttcagtttgtcggcatatatttattcatagtctctgatgatctcttctgtttctgcagtatcacttgtagtgtttccttttttatttctgatttcgtatatttgtttcttctatcttagttattctagctagaggtttataatgtttaaggaaaaccaacttttcattatcttttgtgctttttattctctacttcatttatttctgctgtaatctttattatttcttttcttgtgttaattttgagtttggtttgtgcttgcttttctagctccttgtggtgcattgttagattgttcatttgtaatctttctgctgttttgatgtagttatttattaccacaaacttcccttttagcactgcttttacatatctcacaggttttgataaattgcatttccattcttatttgtttcaaggcgttaaaagaaatttctgttttaatctcttcattgactcagttgtcattcaggagcatgctgtttaatttccatgtatttgtatagtttccagagttacttttgttactgacttttagttttattctattgtctgaaaagatacttggtatgattttgatttttaaaaatttgttgagccgggcacagtgactcatgtctgtaatctcagcactttggaaagccaaggtgggtggatcacctgaggtcaggaatttgacaccagcctggccaacata

SEQ ID NO: 208232 - DNA, 523 bp, Homo sapiens
cttcctcacttcatttgggtctctgttgatatggtacttctctgatgacttcatctaatataacaacccatcctgtgcctcttgtattagtctgttctcacgctgctaataaagacatgtctgagactgggtaatttataaaggaaagaggtttaattgactcacgttctacatggctgggcagacctcaccgtcatggtagaagacaaggaagagcaaaaccacatcttacatggcagcaggcaaagagaacgagagccaagcaaaagcggaagccccttataaaaccatcagatcttgtgagacttattcaccatcaagagaacagtatggggggaccgccccatgattcaattatctctcagtgagttccgtgtgggaattatgggagctacaattcaagatgaggtttgggtggggacacagccaaaccatatcatctctcaatccctgtcatcaatccctgtcatctctcaatctctttaccctgctttactttccttcatagtttttatatacttcg

SEQ ID NO: 208233 - DNA, 473 bp, Homo sapiens
ttctttattttttatatgaaaacttgacttctttcgatcaggaagagaacatcctggatggatcataacatctctaaggagagtttccttgtgttgcctttacaaattggttacttcaaccttataagaaaaatgaagcttactgagtattaagctccattacatactgattcttctacccttgaacacacaaacagatcttgttgcatagctgctataatcactgtgttttatttatttatggttattttttacttatgtttgttttccaaagatatttccatgtattgatgtagtgcacagacatgtcacttttagtggccatatgatatgttcatgtagtaagctcccctcccctttttgccagtcctgtccccacatttgatgaggcatttgggctgtttccgagttattactgttacaaagctgctatgaacatcttcatacagatgggttacctgcccatctccctt

SEQ ID NO: 208234 - DNA, 431 bp, Homo sapiens
ggtgcatatccactgctggctcagtccaccccttgggctgcacagctctattcaggcctagctgccaggaagattactaggtatcattgtcaactcaggctctgtgcccagtaaacctggaaatgtctggatattcttccttgccagcatatagtcataaatctatttggggaagaacttgccatttcatcaaagtctgtacatgtatagcagggttcttcctcctagtgacctgtgacctagtaacccagccacctatgggttcttccatctgtggcttccttacctgaaaagtgcttcaggtctaggaactgagaaagggattgtgatgtgtcattggagccagtgcggttccattcgtgccttatttggttataggcgttaagcagcattcttgttagatgcccatctattttgcctataggggtgtt

SEQ ID NO: 208235 - DNA, 303 bp, Homo sapiens
gtggtaactagcagagtcaagccctacagctgggaaattgtatttgatttccaaagtaatctttccagataaagccatgcaaatcccaggatttgggactttcagagtcatctatattatttaatctgtctagtaataaatctcatttggcccgaggttcgggtctgaacagcatcgttctctttcgtcactactctgtgactcattactttcacgagcacagccaatgtttttccttccttaataaagtgttccaaaacagtatgctagatggaaaaatattggcatatgtcagaaggtcac

SEQ ID NO: 208236 - DNA, 838 bp, Homo sapiens
  misc_feature (13)..(13): n is a, c, g, or t
ggcagtgtctgcntgggatggccttccctgcacgcgcgcgtttaacaccatgcaccccagctctaaagaaggaagactttcaagggaaagatggtaacttatgtctacatgtcccaaatcctcccagtgggatttcattccctagcgtggtggatcacccaatgccagaagaaagagcttcgaaatatgaaaattacttttcagcctcagaaagactgtctttgaaaagagagttgagttggtatagaggccgaagaccaagaactgcttttactcaaaaccagattgaagtgttagaaaatgtctttagagtaaactgctatcctggtatcgatattagagaagacttagctcaaaaattgaatctagaggaagacagaatccagatttggtttcaaaatcggcgtgcaaaactgaaaaggtcccatagagaatcacagtttctaatggcgaaaaaaaatttcaacacaaatctgctggaatagatagaaaactaaacaagtgaaattatcttctaattgcagagcatgaagaatcagtggaaatattaagtgttaaaatgtgatgttttctttcctgcatttaatctgaatattgtcattttttctgaaaatatattgtaaatactattatagcatggtacatatttgggcacttttagttatagtaaagaccttttatatatattttaataaacattttcagaaaagattgctattttttaagtaagccaaattaatctaataaattagtttgttaaaatcaatagactcatgactaagtgattccacaagctggattctaattataaagtatttcaagtaaaataatctgaaga

SEQ ID NO: 208237 - DNA, 1245 bp, Homo sapiens
ccacatttgtgcatcacttctttagagaaagttaagtctgtgttctgcttaggagagataacactttttgtccctgtaggtggcccccctggtgtagccattagttgctaattacttgcaaacaaataaacaattaactccttaagctgctggctgggcaagtgttcattgacatgctaaaactttctaagacaggattttaattagtgacgttctaaatccagcccccttgtcagcggagctataaggtgaactgcaggaagatcccagccctatacacgtggggcagagccagcagaggccagagctgttgctctgtgcagaccacgagaggatgtctcccagccttcaggaaggcgctcagctcggggaaaacaaaccctcaacttgctccttttcaattgagagaatcttaggactggaccagaagaaagactgtgttccattaatgaaaccccacaggccctgggcagacacctgcagctcatcagggaaagatggtaacttatgtctacatgtcccaaatcctcccagtgggatttcattccctagcgtggtggatcacccaatgccagaagaaagagcttcgaaatatgaaaattacttttcagcctcagaaagactgtctttgaaaagagagttgagttggtatagaggccgaagaccaagaactgcttttactcaaaaccagattgaagtgttagaaaatgtctttagagtaaactgctatcctggtatcgatattagagaagacttagctcaaaaattgaatctagaggaagacagaatccagatttggtttcaaaatcggcgtgcaaaactgaaaaggtcccatagagaatcacagtttctaatggcgaaaaaaaatttcaacacaaatctgctggaatagatagaaaactaaacaagtgaaattatcttctaattgcagagcatgaagaatcagtggaaatattaagtgttaaaatgtgatgttttctttcctgcatttaatctgaatattgtcattttttctgaaaatatattgtaaatactattatagcatggtacatatttgggcacttttagttatagtaaagaccttttatatatattttaataaacattttcagaaaagattgctattttttaagtaagccaaattaatctaataaattagtttgttaaaatcaatagactcatgactaagtgattccacaagctggattctaattataaagtatttcaagtaaaataatctgaaga

SEQ ID NO: 208238 - DNA, 1043 bp, Homo sapiens
ccacatttgtgcatcacttctttagagaaagttaagtctgtgttctgcttaggagagataacactttttgtccctgtaggtggcccccctggtgtagccattagttgctaattacttgcaaacaaataaacaattaactccttaagctgctggctgggcaagtgttcattgacatgctaaaactttctaagacaggattttaattagtgacgttctaaatccagcccccttgtcagcggagctataaggtgaactgcaggaagatcccagccctatacacgtggggcagagccagcagaggccagagctgttgctctgtgcagaccacgagaggatgtctcccagccttcaggaaggcgctcagctcggggaaaacaaaccctcaacttgctccttttcaattgagagaatcttaggactggaccagaagaaagactgtgttccattaatgaaaccccacaggccctgggcagacacctgcagctcatcagggaaagatggtaacttatgtctacatgtcccaaatcctcccagtgggatttcattccctagcgtggtggatcacccaatgccagaagaaagagcttcgaaatatgaaaattacttttcagcctcagaaagactgtctttgaaaagagagttgagttggtatagaggccgaagaccaagaactgcttttactcaaaaccagattgaagtgttagaaaatgtctttagagtaaactgctatcctggtatcgatattagagaagacttagctcaaaaattgaatctagaggaagacagaatccagatttggtttcaaaatcggcgtgcaaaactgaaaaggtcccatagagaatcacagtttctaatggcgaaaaaaaatttcaacacaaatctgctggaatagatagaccacattggatgatttaacattacgaatggtgtttaacttaatatctccagcacttaccagggtactagacacagaataggtaatgaaaatgcgaagaggctgggcacagtggctcacacctaaatcccagcactttgggaggacc

SEQ ID NO: 208239 - DNA, 620 bp, Homo sapiens
ccttcataactaaaaatatgcttggcgagaatagaaattcatctcccaatttcacaagccaggtgctccttgaccatgagagagctgaaaggaatgtgaatgtaaatcttctgttcctttttttttttaatgtatagatcatgtatacaataaggtagattatcaaacatgtacagcagaaggctcatttcagatcagaagttctacattcagtgagggtggtagaaatgaaaacattttattcattttgcatgttgcctatattttctaattttaaaaatacacatattgcttctttctgtattaataaaagcttattttaaatgaccgtactaatacagtttgtactgtggttaaaatatacatgaccttgaccatgagagagctaaatcttctgttccaaccgcctcattttgcagaggacaacgtcaaggctctggcctgtggaatctgatggctctgcctgaggggaggggtgttgacaacacacaagacagttggagttgtgtagccttcagaaagccctgtgtgctcatggcctgagttttcttagctaaagtttttgaagttgaaaaaacagccacaagccaaggtcacaagtagagagaggtttttttgtt

SEQ ID NO: 208240 - DNA, 192 bp, Homo sapiens
gacttgtggctttcttgaaatcagtgagatcaagaacccgccaattccggacacaatgttttacgaattgtgtgttagtaggagttgctccttacaactgctatttcacaaacatttattccttgatataacctgccaccactagaattgcagtcactgattcaccaaaaataaatcaatcatgtcgttttt

SEQ ID NO: 208241 - DNA, 302 bp, Homo sapiens
cctcagaatccttctctgagtatgtcaagcagtccctaccagaaatgaaacctgtgccattccaaacctgtagtaattattctgatgtttacatgtgttctataaggaaaggactgtgaatcatgactgctctttgtagtgcccatacttattaccatatgaaaaaaaaacgaatttgaatggtgactggaagcctttttgaaggacccaggatcatcatagaaaaccttattgagaccctgtagatttatcgaaaaaatggtaagcttgacacaccaccaagtgttgtagaggatgtagat

SEQ ID NO: 208242 - DNA, 164 bp, Homo sapiens
tactgacctgagctaatcatggcaaccctatatccgttactggggactggttcaggaataagttcactactcaatttgggacaatgagacatgagaggagtagactgaatgttagaaaataaaccacagcatgccctacaccacacttggcatctctcacaaag

SEQ ID NO: 208243 - DNA, 251 bp, Homo sapiens
actgagcagccacaccagcggcagaaccaccaggaggcagcccaggaagcttgacagctgcaggtgctctagaggggatgctccatcaccatcggaaaccacagtgcatctcttgagcatgtggtcatggacgctgtgacactgtgacccactgtgcgggtcaccagccaggtttcttcctgttggacattctcatgccagccctgaagttgtgacctccctaaggaagagtctagaactcagtgatgtca

SEQ ID NO: 208244 - DNA, 539 bp, Homo sapiens
aagcccagcttgagttctagaatctttaggtcatagagatctctcccttgtctgaaatcggcctcagcattgtatcttttaatgtatttaaatcttattattttgaagggtattactagtggctttatatccatcactattatgcttacagcagacagtcaatcaacactgatacttgaaatcaaaagcagaagtctgtcaataaatctgttctcttaatcaacaattcaaagcaggaatgaacattcaaaacaggaaaaggattctaaacctcctatcagcagccagacatgactatagtctaggtgctgctattaagtgtgcaaaagaattccatttgtccttattttattttatttttattttgtgagatggagtcttgctctgtcacccaggctggagtacagtggtgtgatctcggctcactgcaacctccgcctcccaggttcaagcgattctcctgcctcagcctctcaagtagctgagattacagacgtgtgtcaccatgccctgttaatttttgtttgttcgttccattt

SEQ ID NO: 208245 - DNA, 611 bp, Homo sapiens
ggagtgaattctctctccggcttcagattgctgggagtatcctcagcctgttatgaaggagactcttttagacctgatttactctccagccagcctgaggtaagtctgtagccaaagagagggttagtactttactctgcaaaaattccttatgtcacctctattgccttgcattgtcatgagggcatgtgactttttcaatattgttctttcatgctaattacacacccatgtaaaatgggagtagctccctgctctcttcaacctgatcacttctgtcttcctatgagcaaatgactggagtctaattctgtaaaccaggtgtctgcaggtacactgcaggtgaagctagcagtacaaaccactaccacttacatttggttgtgagatgggaattttgcatcttatttctcttccttaaaattgattggcatagaattctataaaaaccatttgtcacatacccagttggagggtaaatttgcatagatccttcagtaagggttttatgctatttttttttatatcccgggactggaatatttaaagtatttccattttgcatgacatttgaagcactatgactactcttttgcatgtaattttttgtt

SEQ ID NO: 208246 - DNA, 676 bp, Homo sapiens
gatagccaataacctcccatatagttgatgagaacataatctgataaatcttttagaaggaaatccaggcacacatgttaaaggaaagttgtgcatacccttcttctgggaatctatcctaaggaaatggtgagacaaacacaaacacatatataaaaaaaaattcatttgtgtagcttataattagtgaaaaagtgaaaaaaagctaactgcttattagtaaataaatggttacataagtttcagagactcaaaatacaggtataatataatcttatttgttaaaaaattcaaatatgtatacatgtatagaaaacatgtggaaagatgaaaagcctacatatctaaaggggaggaggggctgaagggagagagagagcttgaggtatatcacttctcaatgtgaagaatatgagtaattttcaccttgctccttctttctgtactgtctgaaaatttcccaagatcatgcattacaaattatatgcagaaaaagtaatgatatttggagaaaaaaaacacaagatttttctagcttaacgttctatttctaatcacagcagccaaggacattttgtgaaaagcatgctcacattactttaagttacgtagtagaaatatttctaatttcatctatttatttgttaatttagcttaaatggtattctgtaattac

SEQ ID NO: 208247 - DNA, 412 bp, Homo sapiens
atttagtggctttgtgataagaaaggggaaatgcaaaacttctcttgtaagactcgtggtgtgagctggtcctgaagttcttgatcattttgttagcacccaaactggtttgtcaacaaactttgagagtcaaaagcttgagagacatgcacatcaaagaccatgacaaaaagggaagaaaagcaacaacagcacagaagaccctctggccctctgcaggctgggttacagccttctcttcaccattgcatttagattatagccattgcaacagtacaatgatgctcctacaccctgtacagctgtatcatccaccagattgtcagcttactgagggcagggccagactaccccacagctggtctgtctctcacatatagcaggaactcaataaatatttgttgcactgaaa

SEQ ID NO: 208248 - DNA, 260 bp, Homo sapiens
ttttccccataccatgatgttcatgccaatagattcacaatctagttttggtgtgagatagagacagagatatatagaatcatacaccactataatctcaaagttgggaagattttttgacatcatatagttcagccctcttttggatactgaatattttgtatatcataaaaatgaaaaaataatttatatcagaaaagcttcagcaacaggaattccatacttgtcatgttggatgaatggacgtgggtgaaacttta

SEQ ID NO: 208249 - DNA, 385 bp, Homo sapiens
cttgtctatgtctatgtctgtctacgtctatgtctatgtctaaggtctaggtctaggtctatgtctagtctatgtctatgtctctagctctagctctagctctatctctacctctatctcctgttagttctgtccctctaagagaaccctgactaatacaggatctgaatttaggaatcaataacaaaaacaattttgggaaactcataaatatgtgtaaagtaaataaaatagtcttaaataaccaagggattaaagaagaaaccaaagagaaattagaaaatactttgagatgaatgaaaatgaagacacacttacaaaaaaatgaaaaaaaaatatgtggagtgcagctaaaacagtgcttggaggaaagtttatagttata

SEQ ID NO: 208250 - DNA, 246 bp, Homo sapiens
aaaggagggctggagggcaggttaaagaaaactggagatgcaaaaaggctgggctttgctggcatttccccctgcagtctcctctcctggctgctggccacatgctcagaactgagtctgctggccccagagtaaactgtctcatctctgggcctcattttcccatctgtgactgcaactgcagatgacccctctccccgggtgcgccattgccctgggaggcaaaaaagcatgagccaacccaga

SEQ ID NO: 208251 - DNA, 545 bp, Homo sapiens
ccatcctctagggtcccagcactccaaagtctaattcagctcccggcccggacccccttctcccagtgggagacgagtgctatgatgagcttgcctttcagaccatgatcatttgccacagaaccttaacaggattactatacagctgaggggaaaatggctttgaagactacgtaacaacttgggaaaagtacttataataaaatattaagtggaaacaagaaaacaaaatgtctatgtatcaggatggccatgtatgatcatactggggaaagcttggaaagaagcacagagtggttaggataatgtgtacttggtaggtttccctctgtgttctaaaattttctgcatggtttgctatgttttgatttttgaacttgaaagtctattattcaaactaaaagttacaatgaaattgaccaaaagaccaaactcatctcaacagggtaatagccaagaatataccccacatcattgcccctaaaagggactatcttggtgacccactacctaccacccacgcatcttgcaaaaaaaacaaaaaa

SEQ ID NO: 208252 - DNA, 614 bp, Homo sapiens
ctattttggggtctaaaaggtccttttcattttatctttctttctgttaatgtggtgtgccatatttactgatttgcatatattaaaccatccttgcatccatgggatgaatctgactttgtcattgtaaatgatcttttaaatgtgctcctggattcagtttactagtatcttgttgagaatttttacatctatgttcatcaggaatattggcctatagttttctttttgttgttgttgagtccttatccagttttgaaatcaacataaatctggcctgataaaatgagtttggaagttttccttcctcttcaattttctggaatagtttgagaagcactggtagtagttcttctttagaactaattaagcagtgaagttatcagatccttggtttttctttgattcgagactttttattatttttatttttattttttagctgcaccaaaggcatatcctagctttattaaaggtcctgcgccacagagtcaacataaaaacacaaaaagtctcatcggtttaataacaatgaagaaccccaaaaatggaaaacgaagggggcaggggaagagacctgctcatggcactgagcctggccacagggtccgctg

SEQ ID NO: 208253 - DNA, 202 bp, Homo sapiens
gattttaatgagaccccaagtttacagatttctctgtatcactcactcaaaagtggactttttcttttctagatgattttcacaaagaaagaaaaatgtactttgaaaggagcaaagtgcttaaaacaaggagtgcaccacaaaatcgttcaggggccgcctgctgtggttagctggctgctggttcacacgtgagcccaga

SEQ ID NO: 208254 - DNA, 290 bp, Homo sapiens
gagctacctggaaacatagatgtccattctcccctttagcttcttccagcctccattcctcttggctgtgtcctagtccagtcctccacccagattgggctgaggtgacacagacatccacccagaaggctgtacagattgataaccgattgattcattcaaagggtcttgctctgtcacccaggctggagtgcagtggcacaatcatggctcactgcagcctcaacctccaagctcaagtgatcctcccgagtagctgggatcacaggcatgcgccagcacacctagct

SEQ ID NO: 208255 - DNA, 500 bp, Homo sapiens
aaagcatgccactgagggaaaaccagaagacataatagtctggaaaattagcaacctacctaattgaattaaaagaaaaacttgaatgagattttaaagtatattttaaaaataatttgaaagataaaagaataaaagccacaaagagcagagcattatgaaacaggctgaggtatcgttgataagaatccattaggatgtgtagaaatgagaaaatagggctaggcgtggtggttcacgcctgtaatcccagcactttgggaggccaaggtggtggatcacctgaggtcaggagtttgagaccagcctcgccaacatggtgaaaccttgtctctattaaaaatacaaaaattagctgggcatggtggtgtgcacctgtaatcccagctacttgggaggctgaggcatgagaatcacttgaacctgggaggcagaggttgcagtgagctgagatcatgccattgcactccagcctgcatgatagagcaagagttggtcta

SEQ ID NO: 208256 - DNA, 624 bp, Homo sapiens
gcctccacttctcaccatgtcttctcacaagactttcaggattaagtgattcctggccaagaaacaaaaggaaaatcttcccattccgcagtggatttagatgaaaactggtaataaaatcaggtacaactccaaaaggagacattggaaaagaaccaagctgagtctgtaaggaattgcacatgagatggcacacatatttatgctgtctcaaggtcacaatcatgttaccatatcaagctgaaaatgtcaccactgtctggagagttgaacatgttttattgggaatatattttttctctctgaatctcttatgaacgtgttggttgactgcattcagtaataaatatatgagacctttcatttcaaaaaatacgaaaaaaaaaagaagaaaaattaaaacaaaaaggactgggcatggtggctcatgcctataatcccagctctttgggaagctaaggcaagaggattccttgaggccaggagttcaagacaagcctgggcaacatagtgagactctgtcactacaaaaaactttaagagccagatgtggtggcacacacctgtagtcctaggtactcagtagactcaggcaggaggactgcttgagcccaggagtttaag

SEQ ID NO: 208257 - DNA, 234 bp, Homo sapiens
cacatattttgccatatgggagaatcggaagtcttccaaagatttccctggaaatcttgtactttctgtactaacatcattgaaactctaatgcctaccagtaagtcattcatcaactgtgtttgaataatatgatttccagcacattttctataaagaagaaaagacattattacaaaaggaaattcaaacaaaagtgtgaacatttctaattatcagcaaaataaatacatt

SEQ ID NO: 208258 - DNA, 184 bp, Homo sapiens
agtggctaatggaataggaaagatgctcaacctcaccagtaaaggaaaaggcaaattaaaatgctaatgagctattttggggggatttcattacacttatagaaatataaagataagacatgtagaaatatgttcacagtagcattgcatgcaatggcaaaataccagaaaccacccagatggc

SEQ ID NO: 208259 - DNA, 336 bp, Homo sapiens
tatatttacccaacccagttgagctttgtagtctgaaaagtcaacctaaaatatcctatttctctctacggccacctgctcttcacgttatatcattctgaaattagttgttgaatatattttctcgcaaaaaaagttaggactaaacatcacctaatattccactcatagttcaagaaatactcaattgtaagagatcaatacacattcctggaaattgtcacaccacaccctaactcttaacatgagagaagatacttttaagctaatatttttgagctaacactaatatagaaaataaaaactctctgtggtcatgccccaaatgtttctgaa

SEQ ID NO: 208260 - DNA, 251 bp, Homo sapiens
tcccctatgagacagatatttgtgataccagtttacaaggtaaaaatgagggatctaatgaagagaaatccagaatgacagctttctagaatagtctagaaagtgaatgacctaaattagtacaagaagttttttagcccaagaaatatttcttcaagaaaaagaactggctgagcacagtggctcatgcctataatctcagtactctgggaggctgaggtgggaggatggtctgagcctaggagttcaag

SEQ ID NO: 208261 - DNA, 241 bp, Homo sapiens
tgcttagcctgattggtgcccgcagtgtagtaaatggccaataaatgctgttatcgtactggaccttctgattattttccttttgcctcccgtccctgcctcagctcacacacttcagattcagtaatacttgctgaatgattaattttaaaaccagactgagaggggatgaaggaggtctataaactcagggaggagagagagagagaaaaatgcagatttcttcttaaaatcccaccct

SEQ ID NO: 208262 - DNA, 272 bp, Homo sapiens
gatgatcgcagtggtggtggtgatgataatagtgaaggtgatgtctcaagggagattgtatgagactcctatagggtagaacctactctgaaagaactcacctcaattaagcttgattggagtaaaagccaaggctagacacctaagcttcagagggacagagaagctactctaagtaagagaggatagggagttgattttcctgggtgaggatggagagtctagtgggaagagggtcagaaatgaggcctcaaaagacaaataactttggg

SEQ ID NO: 208263 - DNA, 551 bp, Homo sapiens
ttctcattgttcagctcccacttatgagtgagaacatgcagtgtttggttttctgttcttgtgatagtttgctgagaatgatggtttccagcttcatccatgtccctgcaaaggacatgaactcatccttttttatggctgcatagtattccatggtgtatatgtgccacattttctttatccagtctatcattgatgggcattaggattggttccaagtctttgctattgtgaatagtgctgcaataaacatacatgtacatgtgtgaaaggctctttcaaatacgagacttgacatctggtagaacaaataattaatggtgtccggaggtagttaaaaagggagggatggaagacaagcttcaactccagtgccaaccccaactgagcaccacgaccatccctgggtccccgtagctatcactgcataatatccaccatgcattacaggctttggaggtagcaccagcatctctagggcagccagtcatttctctagaatggtgtagaacaacagcaccaggacgaagggggatggacgcggggccgcg

SEQ ID NO: 208264 - DNA, 322 bp, Homo sapiens
cctgtatctttggatacggaaacaggcgtgaacgttgctgaacgtggaccctgtagtgagtaagagctgtttgttagtgactgaaggtcgtggtgtgttgtctgtaggaaagtgtcttactattccacatccctcatttgcatgtggggaacagacagccatggaagaaaagagatttgcccaaactaaaatagggggagccacagccaagacaagaactggcctggtcactggtctctaccgctttggatcattgctatctctgagcatggacaagttgactgtagagagctttaaaggctaaaaatataattggtatatt

SEQ ID NO: 208265 - DNA, 939 bp, Homo sapiens
taagcaaacccttaaagtgggagcaagcaggatcaaaaccataatttggattgatgacagactgcaaaaagtacattggaggaagatatgagtaggaaggtttttgaaatcatgtcaatgaatgggaagagagaaatgggagaatagcttgagaagttcaaggtcaagggctgctttgtcgagtacaaaggactcgagcatatttgaaatgaaaggtaataactgatctactcttatggagcaaccgagtttcctgatagagatgtttatctgggggaaaaaggcataagtcaatcttcttggagagaatgggatcagaaactgacatattgctacagaggttacaaaagctgtagtcagagggcttcagtgttctggatatattaaaggacaaggtcagatacccaagtgggaccgtgagtgattaatggcagcagtccactgacagcaccagtaggaaggcgctaatgaaaagatctctaaatatcagtaaggggttagctgccattaataatacaactttatagctttactattttttcttttattgttgaaatagtgagggcacgtatttttctaattgtgtttattacaaagaaaacagacccgaagaacttaaatgacttctccaaggtccaccacggttttcatagccaggtgcgccgattaaacccgctctggggccccactcagggcctctcaacctcccccaacacgcttccttcttcccaacctgatgagcagcgcggcggctgtgccccggaaccccgcaaccccggggacccacgtcccccccaggcccacctacgcccgaaccccgggaataccccaccaccgtcccaactcccacaccgccatattccctcatgtacagtgactcccgcggaccgcacaccgccccccaccaccgcgcagacagcggccgcacgcacacccccc

SEQ ID NO: 208266 - DNA, 339 bp, Homo sapiens
acctggcacatagtaagttctcagttcctggtgactccccttgcccttcctgttcagatggtttctagggcctccgctgccctggaaacctgcgacaatgctgcggcagtacaggtaaaaccgttcccccagccctgtctctgagtgctgccaccatcacagaaactgggctcagcaaaaagaaagctaaagaacttaaaacctttgtttgtatcttctaatgctgtgaaggggattcacgcaataagaatatgtcttttaaaatttccctttttccctcttccacttccccaagatgccacagctgcatcagaaccaacgtcttcaatgctccccctc

SEQ ID NO: 208267 - DNA, 496 bp, Homo sapiens
atttttagcaagtttctgctaatgatgcttacgacggtggcctcttcactggtcttaacaaccactgttcaacagcctttcacagacagaaatccatctgcataacaaggaaaggtgaacgactatctccagtaataaatctgatttacaactcaagccatccactaaaacagaagcatgaattaaataaggagagcctgtgatattaagtacaggaggaaattagtaataaatattaaaatctaatttcttggaatatttggagctaacctaattggcagaatgggcaaatgacaatgaggaagggggagaaaatgaaacatgcccctgaatctggggcatattaaatccataatctagatgaatggcaaaggccagccaagagctgtggccatgaagcagttgaaacatgattaaagtgtgaactggaatcttaatggcagatgtaattgaacagccttgagttttatgagagttaaacaaataatattatcta

SEQ ID NO: 208268 - DNA, 723 bp, Homo sapiens
ccaatggaccccgtgctgtgccctcctctctgctcatgttacctgcctataggactcttaacctggcaaagctgcccgtcaaagtgccttctcagggaccttgaggtccctttagcactaaattttatgatggcattaagagaacactgtgctgtccataacttagtgaaaatatcacacatctgtcctggaaaaggctgaaccagctctattattatcctatgatgttctctagtatatcacacttagaggaagtacatgatttcttgccactgttgccttttcttacttcagagagcttactaatgccctttgagacaaattgctgctggtggtagagctcgcttcatttatttatgtaactcagaaaatctgtgctgagttacttagtcatatcttcatccagcttgccagtcttatctgagaaaaagtacttgcttcatcgttctggattccatgaaaaccaccatatatcataattcaacagaggtaaagtgtctctattttctcttaaatggagaatgcttgctgatatgattgggtgctatttcaggctagtctccacatgtccgaaaaaatatccagggacagtgtaatgtagatagaatgcaagccccaagttcttgacatctgacagccccatgtaatttggggggtcaatttaaaaatgacagcttactcataggatctttattattattccaaattagcaagcattaatat

SEQ ID NO: 208269 - DNA, 603 bp, Homo sapiens
ggataaatagctaatgcatgtggggcttaatacctaggtgatggtttgataggtgcagcaaaccaccgtgacacgattacctatgtcacaaacctgcacatcctccacatgtatcctggaatttaaaataaaattaaaaatatatatggagagaatgatatttaagacaaaaagatgttctttctacctatttagattgtttaatcttcaattagcgtgtttggaaaagcacataagcatgatgatatgaggtgctgaagtaaacatgtagataaatataactaaactctaaaaatgccacctcctccacaaaaatcttcatcagcaccctagaaagaggtgtgattcttttcacttgcaatccattacatgttcaaacatgtaagcaatagtcacctaggctctgagcctcattcattgagtatgagggcaccattttaaaataaatttgggtggaacagagtcatagtccatacacttacagttcattcattgattaattcatgcattgaacaaatatctagtaagtgcataccctgagccaagtcctatcttagatgctaagaacactatagtgaacaaggtacagtccctgccctgata

SEQ ID NO: 208270 - DNA, 251 bp, Homo sapiens
tgtgaagtttgatagcacaataaataaaacactgaaaactgtagatgttacttataaaacactggcactcagataaattgggtttggtcaagaagacagtgaagcatatccctgttgggccagaggctgttatcgttttgctctgaattcaaaacctgatatgtctccaaatttgcttagggttgttatcctggaaaatagaatctgatagaaggtgggcactggtaccaagtgcaaggtggaggtgatca

SEQ ID NO: 208271 - DNA, 426 bp, Homo sapiens
tagagccatttttctttctaaaatcctcccagtttgtcaaaaggcagattaggggtagggaagctgaaatgagatttcaacagcctcatgggtttgtagagtaaacaaacaaacaaacaaaaaatgtgatttcagtacttgttaatgatgtgtagtactccattcaggtcttagaatatgaccatacaggctacatcctatgaataaaggtcaacagatcaacctgcaaagggattgaagccgagttttgagttatttaataactgatactagattaaattatttctgagttgatcctctaggtttatgccttctctagaagaaagtaaatctcctaaggctgaatttttgaatatatttttatttagacaattcagtgctcaatagaaaattaacaggattttatggagtaaaatcacatgatat

SEQ ID NO: 208272 - DNA, 563 bp, Homo sapiens
gatattccatattcatggatagaaagactcaatgttgtcaagatgtcagttcatcccaacttgatttatagattcaatgcaacctcaatcagaacctcagccagttattgtgtaggtattaacaaacttattttaaagtttatgtggagagaaaagaatacctagaattgccaacacaatattaaagaagatgaacaaagtcagaggactcataccaactgactttaagactaccttactacaaagttacagtaatcaagacagagtgatattggtaaaacagtagacaaatagattattggaacagaatagagagcccagcaatagactcatataagtatagtcaactgattatgacaaagaaacaaagacaatacaatgggcaaaggtagtctttttaatacatggtgcaggaacaacggaatattcaaaaacaaaaaaagaacctgtgacacatatcttatgccttttatacaaattaactcaaaagggagcataggactaaatgtaaagcacaaaactataaattcctagacagtaacatattagaaaatctacatggt

SEQ ID NO: 208273 - DNA, 365 bp, Homo sapiens
tctgtttttaccttaaatataaacagattgaacagataatcaaaagccaaagatttagactgacttgttttttgaaaaatctagctacttggctgggcacggtggctcatgcctgtaatcctagcactttgggaggccgaggtgggtggattgcaaggtgaggagattgagaccatcctggttaacacggtctctactaaaaaaattagctgggcgtggtggtgggcgcctatagtcccagctactcgggaggctgagacaggagaatggcgtgaacccgggaggcggggcttgcagtgagccgagatcgcgtcactgcacttcagcctgggtgacagagctagactccatctcaaaaaaaaaaa

SEQ ID NO: 208274 - DNA, 563 bp, Homo sapiens
gtgggtgccgacattgggcactagagaagatgaaagtagtaagagatcataggctgaaactgttaaactcccaaagtacagggatatttaatgcacttgctgtcagctgcaccttgaacttcccattatgccaacagctgtgaagactgagcccccgtgaacccctgaagggccgtggcgggggtagacttgctttcgatgtttccaggggagcctctgctggaggtgaagacctacactcagatccttccaggcaccactgggcatggaaagatacttgttcagggtcagaggagtagccaccctctcccaagacaaaatccgtaagaccctgagaaaaggaggcaggagagaaacacaaatgcttcaaattcatttttaaaggctttttcaaggtcaaggctaggttgtgtcccagtcaagcacatgtaagtagacctcacgttgccttaagtagacctcacgttgccttatgatctggtgagcgtagaaggctctccattcactagctttgtaaaagaaacaaaatgtgctgttcttgactttctccttataatcctcac

SEQ ID NO: 208275 - DNA, 390 bp, Homo sapiens
tgatttcagtgcgcagctggggttcaggtgcacagagctgggcaggacgtaaggtacccagagcgggaaagctgccttctcagcatggacatggttggaggcccggggctgaagccgcccaactggcctcaggagacccggtgtccccggtcacagctgagcgcggggctgtgcagcgccttccacatgagcagcatctcgtagggcgcgaagcggtgcactagcagcaactcgcggtacatgcaggggtcgaaggaggactgctgtgcgccaggcaagctgcacgccgaagggccaggatgccctcgtggccgctgggcgccaggccggcgcgctccaagacacatgcccatgtaggcgtcgtcgatggggaagagcggggtgtggcgg

SEQ ID NO: 208276 - DNA, 350 bp, Homo sapiens
aagtcacatcttacatggtggcagacaagggagcttgtgtaggggaacttccctttataaaaccatcagatctcatgagacttattcactatcatgagaatagcatgggaaagacctgcccccattattcaatgacctcccactgagtccctcccatgacacgtgggaattatgggagctacagttcaagatgagatttgggtggggacacagacaaaccatatcaccaaggcttggtgaagtagcaaagaaagaggctttcttcaagaggagattgctgactgtcttagttaacaaatccagcataccctgcggtgccaggaaaaatgtaaagcaaatgtatgtgaagg

SEQ ID NO: 208277 - DNA, 284 bp, Homo sapiens
aggctgtgggagcagtgtggccagatcttttctagggaaaccagaaatctttttttttcttttgagacagagtctcactttgtcgcccaggctggagtgcaatgatgcaatctccactcactgcaacctctgtctcccaggttcaagcaattatcgtggttcagcctctcgagtagctgggattacaggtgcgtgccaccacacctgactcatttttgtattttaagtggaggcagggtttcaccatgttggccaggttggtctcatcctgacctcaagtgatc

SEQ ID NO: 208278 - DNA, 350 bp, Homo sapiens
gaaatagtatttacagatgtaattaaagtgtcttgagatgagattatcctggaggtaggggctggactgaggagccaaatccaatgactggcatctttagaagagaagggaaaacagacccagagacccagagggagggccatgtgaagatgaaggcagacgttggagttctgcacccccaagcccaaaacaccaaagactgccagcaccccgcagaagtctggagaagggcgtggaatgaattctccttcaagccttcagaatgaaccaaccctgccaacaccttgatttttagacttttgaccttctcaactgtgagagaataaatttctgttgctttaagccaccaa

SEQ ID NO: 208279 - DNA, 585 bp, Homo sapiens
atttctcagactgacagacacttagggaaaatagaaaaggacccatgctgaatatcgggggttggtttcccccaatacatgtgtaaaatatacagtggtcagatggtgatgagtgccacggacaaagttaagcagggaatggaaggaaggaatgctggcaagagaagctggtttaaataaggtggctaggtgggccttcctggaataagccacgctgccacatgaggaagagcactcaaggcagagaacacaagtgcaaaggccctgaagcgggctgtgctggctgtgtttgaaggccaaataggaggccgggatggctggaggggagtgagggatggtggtagatgaggtcggggtgggtgatggaccagatcgatagggccatgtaaggccagccattggatggccatgggcttttaggctgagatgggaaggttttgaatggagcatgatctgactcatctttgaaagggatttctatcattctggctgttgtgtggagcagagactgtaggggagaagatcttctcccctgaaactcttgttactgagtcacagagatcaacaagattaaaaaggtgatca

SEQ ID NO: 208280 - DNA, 451 bp, Homo sapiens
aacggattctagtctttgtcttctctacttcaaaacagtagttccctatatttcaacagactgtgtatgtgctagacaaaatgagtaatcctggattaaaatctttccttttcattggcctacagtgtcatagacagaataatcttttaaatgtgaccaggtgcaatggctcacacctgtaatcccggcactttaggaggccaaggtaggcagattatttgagcccaggagttcgagaacagcctgggcaacaaggcaaaaccctatctctacaaaaatacaaaacaatagccaggcgtggtggcctgtgcccacaatctcagctacttgggaggctgaagtgggaggatttcctgagcccaggaggttgaggctgcagagaactgagattgtatcactgtactccaacctgggtgacagagcaacaccctgtctccaaaataaataaata

SEQ ID NO: 208281 - DNA, 573 bp, Homo sapiens
cctgcctgcatatttattggcagactttctctctaggctgttggctcaagagcaaagcctgcatttttgaagtcatagccatatctccagaacctagtacagtgtcgggcacacacttgatgctcagtaagaatggactgaatgaatgaatcattacctatctcatccaaatatgaaatggcaataaagggctcgaccatattgtcttctcctttgttctttcactaaacacatctgacacaaggcgtcgtaactgagaattactaactctacctagttttattctcctaattagatcggatgctgcctaaggagaggatctctattttctatttttaaaaattccttcttgcagcactgtaaccacagtaaagtacaaacctgattattttctatgatttgcagcatacatcacataaagaggtattataggaaaaaacaactttttggccaggcgtggtggctcacgcctgtaatcccatctatttgggaggctgaagctggaggatcacttgaacctgggaggcggaggttgcagtaagcagagatcgtaccactgcactccagcctggg

SEQ ID NO: 208282 - DNA, 313 bp, Homo sapiens
atactgctaaccaagtatattgtaagggtttaagtaataagtattgggaacagagagtgggagtataaatgtagggagcctttttaattctgaaaatataggttttgctataagaataaattgctgtttgctaccttctgtatttctaggtttagtgatagggcagtaggaaagatacgacattcaattaagacaaaaggcattttatggaaaaaatggtaaataaatgccaggttatatataaaaaattgaagagtgggaaactcactggagtaggatgtcagggaagaatttttggagttgggaattatat

SEQ ID NO: 208283 - DNA, 235 bp, Homo sapiens
gattataggcgtgagccatcatgcctggccaatttttttttttttttgtagagttggggtgttgcccaggttgatctcgagctcctgggctcaagcaatcctcctgtcttggcctctcaaggtgctggaatttcaggaatgagccactttggcctaaatttttacagcttatttccaagatgatttgaaatagtttataacattaaaacactatgaaaggatggctaaagatgat

SEQ ID NO: 208284 - DNA, 677 bp, Homo sapiens
gagtaagggaagaggagaggaaggggagccggaccgttactacccagatagtagcctggatgtaatgggtttgctagaagagtgcatgttaaccagtgcctgctgtcgatctcttgcctctgttcttaccaccaacaaaacactagaaagactcaacttgcttcaaaatcacttgggcaatgatggagttgcaaaacttcttgagagcttgatcagcccagattgtgtacttaaggtagttgggcttccattaactggcctgaacacacaaacccagcagttgctgatgactgtaaaggaaagaaaacccagtttgatctttctgtctgaaacttggtctttaaaggaaggcagagaaattggtgtgacacctgcttctcagccaggttcaataatacctaattctaatttggattacatgtttttcaaatttcccagaatgtctgcagccatgagaacgtcaaatacagcatctaggcaacccctttgatcatgttgtacgtaaacagtatttattataaattactaccgtgactgggatgcaagagaattaggactataattttcctatttgatgtgtgtgtgtgtgtgtgtgtgtgtgtgtgtgtgtgtgtgtgtgacctagatccagtcgaaccattagaaattcactacactgtctcaagagtattaaaagg

SEQ ID NO: 208285 - DNA, 667 bp, Homo sapiens
gcaggaatgcagctgctatgtggtggtttgagacatcccaactgcatgttggtgaatattgggctagaagagtgcatgttaaccagtgcctgctgtcgatctcttgcctctgttcttaccaccaacaaaacactagaaagactcaacttgcttcaaaatcacttgggcaatgatggagttgcaaaacttcttgagagcttgatcagcccagattgtgtacttaaggtagttgggcttccattaactggcctgaacacacaaacccagcagttgctgatgactgtaaaggaaagaaaacccagtttgatctttctgtctgaaacttggtctttaaaggaaggcagagaaattggtgtgacacctgcttctcagccaggttcaataatacctaattctaatttggattacatgtttttcaaatttcccagaatgtctgcagccatgagaacgtcaaatacagcatctaggcaacccctttgatcatgttgtacgtaaacagtatttattataaattactaccgtgactgggatgcaagagaattaggactataattttcctatttgatgtgtgtgtgtgtgtgtgtgtgtgtgtgtgtgtgtgtgtgtgtgacctagatccagtcgaaccattagaaattcactacactgtctcaagagtattaaaagg

SEQ ID NO: 208286 - DNA, 552 bp, Homo sapiens
agagactgtttagcctgtgttcccagtaaagccaaaacagattcaacagattctagctctccccctctccatccttgtttccctgaaggtagaggaccatgtccaactccctcccctactggaggcagcctcatgatttcccttcaggcttaggcctatttattatcttctcttccaaaacatcccttccattcactgctatctaattctacccttaagcatttcagtatttaatattaaaaaaaaaaaattggtcgggtgcggcggctcaggcctgtaatctcagcacattgggaggccaaggtgggtggatcacaaggtcaggagattgagaccagcttggccaacatggtgaaaccccatctctactaaaaatacaaaaattagctgggcgtggtagagcacgcatgtagtcccagctacttgggaagctgaggcaggagaaccgcttgtacctgggaggtggaggttgcagtgagccaagatcgcgccactgcactccagcctgggtgacacagcgagactgtctcaaaaaaaaaaaaaaaaaagaaa

SEQ ID NO: 208287 - DNA, 810 bp, Homo sapiens
cctagaccattcgtgatggctcgacgggcccagatactgtagtgatgaaccctgtgtcgtatctgtatcctaagagatcggcgcaatgacttactgccttggattctcagatgataacaagaatggaccgagggggacgcatgcgtactgatcccacctcccagatggcattccctgggtcattcactggaagtctatcaaacagagagtccactcgtacctcgatgtcagtgtatcctgacccccaatacaagcatttgcctacaggtcctcactctatcagttatacctatttggctgaacccattctttgggcttctcccatatggttccctgcatggtgtaccttgcctccctctctaggacctttgagtataataaatcctttaatttcatttacctctccaagtataattcccacagctatgttggagtgatccttgaggaccccacagggagacttactccctcccccatttaccacacagagagttatagatgataagctgattattggtggttgttgccatcagcagtcaaagaaaagagaatgcccagggttttttgtttgtttgtttgtttcagaggatagagaagaaaggcattttgagtttcatgggacaagagtcatttgaaatgactctataaatagtgtgtcttaccatatgtgatatattcagtgattaagaaaaactaaacctaaatctgatcaagactctagctccaactgccagtttgcaggacatacaaagaactaggcacatattctaaatgatgtgatggggatacaaccagcaaaatccagaatgt

SEQ ID NO: 208288 - DNA, 916 bp, Homo sapiens
gatcacttgagcccagacggcagaggttgcagtcagcccagatcgtgccactacactctagcctcggtgacagagcaagactctgtctcaaaaacaaaagcaaaaatctatcctctggattcagggaatttcaaggcaaattagtgatagtacattttttaaaactttgtattttccttgtgcctcaacatccccacaaacaggccgtgaacactctgccctggcaaccagatgcaccagtatgataaggctggtccctgccacaagttccccttcataaccttccctggcagtgccctagtgaaatttaacgaaatcacctcatgccttttgtttgtgtatcctgacccccaatacaagcatttgcctacaggtcctcactctatcagttatacctatttggctgaacccattctttgggcttctcccatatggttccctgcatggtgtaccttgcctccctctctaggacctttgagtataataaatcctttaatttcatttacctctccaagtataattcccacagctatgttggagtgatccttgaggaccccacagggagacttactccctcccccatttaccacacagagagttatagatgataagctgattattggtggttgttgccatcagcagtcaaagaaaagagaatgcccagggttttttgtttgtttgtttgtttcagaggatagagaagaaaggcattttgagtttcatgggacaagagtcatttgaaatgactctataaatagtgtgtcttaccatatgtgatatattcagtgattaagaaaaactaaacctaaatctgatcaagactctagctccaactgccagtttgcaggacatacaaagaactaggcacatattctaaatgatgtgatggggatacaaccagcaaaatccagaatgt

SEQ ID NO: 208289 - DNA, 376 bp, Homo sapiens
ttgtccagggtcccattcagatagcacaccctttcactcttaaaagtgacccaagtttggatgacatattacacatcaccttagttataagcacactaataaaagtttacatgtagctaagaaattaatacactaccagtagcagctattcacagtgcatttgcattttccttttatgagtgctatattctagttcttagcctccttaaaacacaaacatgcttctattctgcctactttgccctctaacccctctacccatgaccatttttaacaataatctctgcttctgtttttttcaccccgggaaactcatctaatttcttaacctcaaagaaaatctctatgcaaatcattcacaaatttcttctcagaa

SEQ ID NO: 208290 - DNA, 357 bp, Homo sapiens
ctgtttgcagagaatgtccagcctatcctgtgtcactctactcccaagggaagcctggctccacccttgatggctttcacttggcttggtgctagactactcttggacacatttttcccaagctgggatgagaacccaacctctattgatgtcactatagactctgatctgtgagtgtatttgtgaatgtgagggagatagaaaatcaccactgggcttcccttttccctgctcagctgacttctgcatccacatgccctctcctctattctcatgcattttgtgaggtggtttgtgaaagccagtgtgaagtctgaggtgtttaccattgctggaggggacgttgtgggtaacaga

SEQ ID NO: 208291 - DNA, 412 bp, Homo sapiens
tcgtggtgcacacctggtagtcccagccactctgaggcaggaggactgcttgtgcccggaagttcgaggctgcagtgtagctgtgattgtgctactgcactccagcctgggcaacagataaaggaaactccatctcttttaaaaaaaaaagtggtctgggattacaggtgtgagccaccacgtccggccaatttttctcatttctatgcctcctatattaaggtctgtgttggcacagatgagtaactgccatgttctaggtcagttatacccaagcacttctggtggtttaaaatgtgattctgtaacttttttatttttatttttttgagataatttcactcttgttgcccaggctggagtgcaatggcgtgatcgctgctcaccgcaacctccgccttccaggttcaag

SEQ ID NO: 208292 - DNA, 187 bp, Homo sapiens
gccatctgacagtacttagaagatagaagagggaggttatctatgccattgcccagacaacagaccagggtccatctttccaatgatgtgttaacagcagggtgcatcttcagcagattgaattagtgcttcctttgactgttttttcatatcactaatgaagaccagagagactccctaattgaat

SEQ ID NO: 208293 - DNA, 838 bp, Homo sapiens
tgcagtcatcaccacagtaacttccctaacactcattttaacatccattcaccttaaatgtgtcagttgcatcaagaaatagaaatgggatggtatatgctatgtgatcacaaccacaaccattttttttttctttttgaggcggagtctcactctgttgcccaggctggggtgcagtggcatgatcttgactcactgcaacctctgcctcctggcagaaccctcctgggttcaagcaattctcctgtttcagcctcttgagtagctgggaccacaggcatgcaccaccacacctggctaatttttgtatttttagtagagacagggtttaaccatgttggccaggctcgtctcgaactcctgacctcatgtgatccacctgtcttggcctccgaaagtgctgggattacaggtgtgaaatcataggcctggcctatgatttcttttaatcaaaaaagaaaaaataaaaggcattagcaatggaaacagacgtacgtcacttcatggtccttcctttactgcactgtgtagatattatggtttttacaaattgaagatttgtggcaatgctattcactttgtctctgtgccagcattttttagaaataaaagtattttttaaatttagttatgtgttttttagacataatgctattacacacttaatataatataatcacacttttatatgcattgggaaaccaaattgtgtgacttgcattattgctatatttgctttattgtgatggtctggaaccgaaccagtagtatctccgaggtatgcctgtatatggaattgtgggcaattgctccttttcctttcttgggctttcagtat

SEQ ID NO: 208294 - DNA, 372 bp, Homo sapiens
  misc_feature (78)..(78): n is a, c, g, or t
  misc_feature (100)..(100): n is a, c, g, or t
cctctttttcaacatttataccccagtcccttcacgatctcatccagtctcatagttctattttttctgtatttattnattatttatttatttatttatntatttatttttgagacttggtctcactctgtcgcctaggctgtgatcgcaccactgcactccaacctggttgacagagcaagaccccacttaaaaaagacatttaagctaggtaagaagggaagtgaaggctgggcacggtggctcacacctgtaatcccagcactttgggaggccgaagcaggaggatcacttgaggtcaggagttcaagaccagcctggccatcatggtgaaaccccatctctactaaaaatacaaaaattagctgggcc

SEQ ID NO: 208295 - DNA, 753 bp, Homo sapiens
gaccctggttccttttggcttactgctctgccagtcccgggacatgttttctgtccttatggtctaaggtagcagcattcacaaaccaagcagcaggatggaggaagggaggaaaaggagggacaaaggctaatcctcctcagaaaggttcctgtaagttgcaaattgatgcctacctctcattggcaggaacttagccctgtggtctcagcagctgtaagggaggctgggaaatgcagtcttttttctggattgccatgtgccatgctcacattctcctgctttacaagatgggaaaaagagtgtaggaggctcttcattgaatttgtcactttcagacaatgtctattatctgtgttcctggacaggtaagctcctgagagagggactttgctgtgttccttccaggagtcttagcatctagagcagcacctggcatgtagctggtgcttgattgtcgttgaatatgttttcatcccattatccacatccttcagcttgccagctcttacctttctgattccaatttggccatcctttcctctaggacagtggttctcattaattgtgcaccgtgacaaccagtcagaaatgcatatttttggttcccaccccagacctatggaactagaacctctgggggtgacctagcagtctgggtctcagtatgctttatatacagcgatctgtattttaagcaaccctgaaaggatcctgatgcctgtttaagcttcagaaccactgctcagactt

SEQ ID NO: 208296 - DNA, 997 bp, Homo sapiens
atgtgtcttctgagctgttctttttctttttatactttccttgaggactgggatgaaagtaggattctccaggaaaaatttatgtttgtttgtatcaggcttctacaggcacttaagatcaagggccatttccaactaaattcttttattgtttgttattccacacaaaattgttcataattgtcaaaacttgaaagtgaccatgatgtccctcaaattttttcttatatgaattttctgtgttctggtccttttttttttctgttaggttgttggtcttttattacagatttaaagcagtttttcacatatcatatgctatagatgctgttcatatttttctctgatgcataaggagactgttacattgtatagggtgttcacatattatctgtgaacacatattgctcatatttttctccaagactatcattgcaactaaattcttggctggaagatttggagaccactcaggcagtgtgaatttagactcctaactgatgggagggctgccttgttgctagagttcccaagagatgctcttgctcccaaatattttgtgccatgattcaagataggtaatttcccttgtagcccactgatggaaatgaggtgaccctgcttatttctaattattcctgccactaaggatgtgttcctttgggccctcaactacacagaatagtcttgttagaccctcgctaccttgggaaaaccttaagttttacataatcttccatgaactttgtgagatttcaaaaagcaatgttccagttcactcaatttaacaaatgtccttagggttaaagcctgacctagtgctccactaacttatcttagttcatacctttacttattccctggtttaagtattccttgcatttttgcaagtcataggaacatatcaaaagatatttttgtattatatccaacatttttcgttgtttttagtgaggggatcagtttggactcctaggctgccatagtgacagaaatt

SEQ ID NO: 208297 - DNA, 340 bp, Homo sapiens
atctttctttacacacacacacacacacacacacacacacacacacacacacgaaaacctcggagatattgtgggtttggttccagaccactgcaataaagtgaatgaatattgtaatagagttacacgaattttctggtttcctagtgcatataaaagttatgtttacattatactatagtctattaagtatgcaacagaattacatctgaaaaacaaaatgcatactttattagcaaatactttattactaaaaagtgttaacaattatctgagtcttcagtgacttaatatctttttgatgttgatgacttttccaaataaaggttttcactcctca

SEQ ID NO: 208298 - DNA, 493 bp, Homo sapiens
aaccacattgaaagaatattgcaataggactcgagcagctgatcatggaattaagtgactttaattttcaaccctaggactctgtgattctatgtacacagaattcgaatcttaagtagagtgtccttgtgaaacccctacaactttgattgaaaatatatactgaattaaaatctgtatggtaataagtttctttttagtgaacaggaaacatgccaaagtatatcttaacattcagttgtagataattatgtgagctgattttgtgtcaatgaatctgaagttctgatttggtattagaaaatcatacgacaccccaagctttctcctaggaagttgtcttttccatttttagcatttcatttggttgtctgtcatcacctataacacacacgtgcatacacatacaaatgctgctataattaacattttgggttcctttatcattttttaaacctcaaactttttgttatgtaatgcacacttatttgaa

SEQ ID NO: 208299 - DNA, 245 bp, Homo sapiens
taaaacatagctataacaaacaggacatctaccctggcataaactacagattgacacaactaaaatagtctttaatctgcaaatctttattcctcacttcagccaccaagctgtagcattatgctttctcaactcggttgcttctcttagtttcaaataaaaaggtctaaaatggtggcagacagatgaagagcagtatagagttcagggattgacttgcagatggaggtatgttttgatataat

SEQ ID NO: 208300 - DNA, 201 bp, Homo sapiens
gttcaggtaaaatttggaagccaggtataaataactttacatgtattccttttaggttatgtttctcttattttcttagtctcctacatacgtgattgctatgtaatggcttgtgccttagcttatgtgattccgtctgtcacttacttgttcacatgattgactcctactcattaagactcacccaaggaagtccacatt

SEQ ID NO: 208301 - DNA, 249 bp, Homo sapiens
gagctcgttaggcagtgtgttcacatcttaagtggaaaagacacgttcatcgggtttatagatgcaagtaaactaagttctgggtgttgagaaaaaaatggaaatttaaataagaaatttaattcaaacaagagtaacagaaactggtaaaaggaatgaacaggtaaatgaggcaaaagccagatatctttacaaggaagtaaaagactatgtttattttccattttttctcaccacacgctgaagagg

SEQ ID NO: 208302 - DNA, 256 bp, Homo sapiens
ttcaaaagatatctttaagacattagcaattaagactatcaggacatcaataggatttaagccaagtggtcaatattaacatcaacagtggtaagtcgtattgattgtatgtgcccttgatatggtgtgatcgcagtagcagtttacctctgtggccttccacccaaaaactcattaccccagtctagccattagaaaaatatcagtcaaatctcaattgacagtctacaaaatacctgaccagtactcttgaaaa

SEQ ID NO: 208303 - DNA, 615 bp, Homo sapiens
gcatagctataaatgggtgtcttcctctaggcctctggaagagcaggacctcccccagactgtgactgggaagagtttgggatggttacagagtaagttcagaattctcactggaaccaagttaggtggaacattttcttgtctgtagccaacaacagtagtcctgtagtttgccacctgaatgagggcctgccttctaaacagaattatcttcaatcttgggctttagcagagtttcacaactcccttcctggatctcagaactctcttaaaggcacttttttttttttttttttgagacggagtcttgctctgtcacacagactggagtgcagtggcgaatgcagtggcacgatcttgactcactgcaacctccggctcccaggttcaagtgattctcctgcctcagcctcccgagtagctgggattacaggtgcccaccaccacccagctaaattttgtgtttttagtagagattgggtttcaccaggttggctaggctggtcttgaacttttgacctcaggtgatccacccacctcagcctcccaaattgttgggattacaggtgtaagccaatgtgcctggccaaaggcacttatttttgagatggggtc

SEQ ID NO: 208304 - DNA, 396 bp, Homo sapiens
cacatttttatttatttgttcatttactgcacacccacgctgtgccaggccctgggctgctttctggggacgcagctgcaagcatgactcagtgcctctctcaggagctctcgcacatcctccggcagcaccctcctcctcccagcctggagccttggctgttaatgaaaattcttcatcacctcctgcttctccagagctgcctgagcaggcaccacctcccctgggaccctgcagagctccttcaaggcattagaaaatgccctaggcttgggagctggtgccctaggtttgaggggaccttaggaaagatcctaggccttagtttccctacctgtcatgggagaggtcagcctggctgagctctgagattcttctgttttctaacctccaagc

SEQ ID NO: 208305 - DNA, 184 bp, Homo sapiens
catccccctgtattgtagcacaaagtctggtgtatattaggaactcaataaatatttattgaataaacgaaggaatggaaagaacggtggtaaaatgtacctaaaggaactgaactaacctgttgagaggaatttttaactatttataatcctgcttaaactagttagctaactttaaaaatgc

SEQ ID NO: 208306 - DNA, 481 bp, Homo sapiens
ggagcagttgagctcaggagtcggagaccagcctgtgcaacctgggagaactttctacaaaataaaaaaattagcggagcatggtggcacacacctgtaatcccagctacggggcggggcggcgagtggggagcaggctggacaatggagtgagatcctgtcttaaaacacaaaataaaagcagctctcactcaagctcctgactgctgccttgtcctaattttcttctgagcatttgtcactgtatgtgtgtgtgtatgtgtgtatgtgtatatatatatgtgtgtgtgtatatgtgtatgtgtgtatatatgtgtgtgtttatatttaaatgtaagtttataaagaaatgtttacatgtaatgtgttatatttatagacatgtttatatgaatgcataaaatttgtatttatgtaaacttataaatatgtatatacattatatataaatggaataaaaaacataaataacatatcctat

SEQ ID NO: 208307 - DNA, 695 bp, Homo sapiens
atagcaagaccctgtctctacaaaaataaacaaaaaacagaaagaaagaaacagtctacttagagttaatattgtaccactttatgtaaaatgttgaagcctgacaactgcatagttccatttactgctcctgctttatgttatagtttaaaatatatagaacctctatatatgttataaattccacagcacaaggttttaatttttgctttaaactatcatatgcatttttaagttaagaagaataatagtttttaaatatttactgtttctaatgctcttgattccttttgaagatacaggtttccaaatggtatcattccacttcagcctacagaacatcttttaatatttcttatagtccacattggctggctgtgtaaaaagggtgtgttagaaacacatttttagcattttttttaattggacaatgtcagattcctggaggatattttcactggatgtcaagttctagattgctagttttgtctctcagtcctttaaagatgtggtttcgtctctactaaaaatgcaaaaaaattagccgggtgtggtgcgggcgcctgtagtcccagctactcgggaggctgaggcaggagaatggcgtgaacccgggaggcggagcttgcagtgagctgagatcggccactgcactccagcctgggcgaaagatgcagctccgtctcaaaaaaaaa

SEQ ID NO: 208308 - DNA, 742 bp, Homo sapiens
accgccgagcaagagtgtgcctaggtgtagattaagccttcgattcgccgtcccgcttttccacacccgctctgctgaccttaaaatccccgcatcgcgcccttcacccgaggtaaatacggacctcgccatgtgggtaaaactcgctctgagaccagtccctgtcccctgccattcgcgtcttcttcccgcataaaaccctttcctgacccctcctcccgccccgcgctttttaaagtcctcacctgcgaggtggattcccgtcctgagcgcctcccagcctctccgtcgtcggccctggagcgcagcgccgcagaccgcgtcctccgcctggtcctaggctcctgcagaccctaccctgtcctaaggcgccgtcgccccccacctccctcctcctcgtgccgggccctgctgctccccaggcctccccttcgcagtcaccgcttcccctgcgcccgcgttggggaggtgcccggggcctgtcctgtgacacccggtgttcttgcctgcccagctccacccgctggaaaatgtgctcctccaggatccaggtgtcttactccaaaccctcctgtgaatgtgtgggccaaagggatcaggaaacagagaggggctgagagtgaattacaaaaactgagaggaaagaatgaaggaaacccataaacacatggcaaagtagaggatgggtcgggattcgcagagacgggaagagcgaaagaaggatccaggcgcggtggctcac

SEQ ID NO: 208309 - DNA, 380 bp, Homo sapiens
agtcaaggacggcatctatatagtgggtgtggggaacagcagcaacatgagagtggtcacatagaaaggggctgattgactaagaaaatattttgaggataatgaaagccaagttactcactgtcagaaaatggagttacaattatgaaattatcgaacgaaccctgtggtattagactggaattggggatatcagtgtgaactcatggtgaaacttggcaaaaacaaaaacaaggccgggcgtggtggctcacacgtgtagtcccagcactttgggaggccacggctggcggatcacgaggtcaggagatcgagaccatcctggctaacatggtgaaagcctgtctctactaaaaatacacaatatttagccaggcgtg

SEQ ID NO: 208310 - DNA, 334 bp, Homo sapiens
acaggctgtagaggaagcatggctggggaggccatacgaaacttacaatcagggtgaaaggcaaaggggaagcaagcacatcttcacatgttgacaggagagagacagagcaaaggaggaagtgtcacacactttcaaaccatcatatatgagaacacactcactatctcgagaccagcaagggggagatccgcccccatgatcaaataacctcccaccaggtacctcctccaacaatgagaattacaattcaacctgagatttgagtgggaacacagagccaaaccatatcatagccagactatattatatatatgtgatttatgaagcttaa

SEQ ID NO: 208311 - DNA, 573 bp, Homo sapiens
acatggatattatcctaatgttattgaggctcagaaagctaaataacttgctcagggttacagctagtaagtggtaaaaccaagatttgatctttgtctctaaaaatatgaagagaaggaggttaagatacttaaaatcaagggtaggcagatgacattgtaactctaatacaaggtaatctgtgacagtggtagctaatgtttattgagtatctgtcattactggcattgtgctcgacagtttgtttggtttacctctgtttacttctgtagagtataaagtgagtgaagggttcagtgtgagataaagtggggcagtggtttgaagccttgaatgcacagtagaatgctgttgaaggttttaaagtagagaaatagcacagtcagatttgtatttttagaaagtccttgctgtttagtgagtttggtttagaatgaagtgggcttggaaggtggtgatcatcttgaaggctgttaaattcaccctgaagatggttgatccccttgaaggctatcctaatgagaggtgctgaagctttcagttacagtagatggtagtgaaaaagatgtggg

SEQ ID NO: 208312 - DNA, 582 bp, Homo sapiens
ctgcagtgagccaagatcacaccactgcactccagcctgggggaaagagtgagactccatctcaaataataataattttaaaatttttgctaatttgatttttttaatggttatttaattttattttgtatttcccttactcccaatgaagctgagcttctttcctatgattaggaatttgcgtttctttttctgtgaactgcctgttcatcttctgtcaattttttattggtgactttaatctttcatattgatttataggacccctttagaatcaatattaaaaacatttatacaatgcaacatcaaattatcattctcagccaggagcggtggtgtgcacctgtagtcccagctatttggaaggatcacctgagcctaggagttcaagtccagcctgggcaacacagcaagaaccccatctcttagggggggaaaaaaataggcccagtgcagtagctcatgccagtaatcctggcactttgtgaggctcaggtggcaggtgggagatttacttgaggctaggagttcaagaccagtatagacaacacagtgagactcgatctctccaaaaaatttaaa

SEQ ID NO: 208313 - DNA, 370 bp, Homo sapiens
cttacatagacatgcatggagtacagatttttcaaaggacatgcagaaacatggagaaaagcacaacatggggaaaagctcaatctcttaagtacaagagaatcacaaaaccattaccgaagcttcagcagaggtgaatctgaggtttgtgaaaaactcttaaagacaggaagtctgccagttcggccgagctccactggaccttctgttctcatctggctctcactctcctcctcccttcccaaacaccacagggctacagggacgtgctggctctgcacgcagacacatctgtgtctaagcctgggacactaagaaggttactttatttctctgagccctggtatcctcatcagcaaacctgggtaaa

SEQ ID NO: 208314 - DNA, 393 bp, Homo sapiens
cacgtggcagtgagacaggcggagggatgtggggaccccgggtggcctgctgggcatccaccatgtggcccactctgtgctgagtggtccctaatgctcctgctcatctgtgactggggcctgaggaccctcctctgctctgcccaggcctccagccctcagggagctgcggtccagatggagcctcacgtccttcctggtgttttgtcctgtcctgtgatgctgctgagccaaggtggttcctttccttgaacagttgagatataatttacatgccactaaatctgcctgttctaggcatgaaatgaagtagatttcagtatatttacaaacgtgcagtgattcagcacaatacgttcagaacagagaaacctatgcactgacagggtactg

SEQ ID NO: 208315 - DNA, 346 bp, Homo sapiens
tagtgttatttctgtctctgtcattcttttacacaccaggttttactttacttaaaaattaaaagaccctcgaagaagtgatgtgacccactgtaaagaaacaaacagttaacagaatgagggaccaagcctggatgttggactcatcagatgaagatttaaaataactgtgataaatatctgtgaaaagacaggaaatttcagcagagaaatggaagctatacatttttaaaagccaaatggaagtggaaatgaaaaacaggatatcaaagatgaattctttcactggacttattgccacactgggcacaagagaaaggagtcaggttcaaaagaaaccatctac

SEQ ID NO: 208316 - DNA, 447 bp, Homo sapiens
agttggagggggccctaaataagggggacaggaagagccgggacactcaatagctgcctgaagttgcttttttagttttggggaatcattaccttttggattgcctgatatgactgctaaaagagcttggttgattgtccagtgcatgcaaaggtctagtaagaaggccatgcccttgtgcaaaagcagtttcaggattaaaggagtctcagtgcttcagaatgcacttgagcggggtgcaggctaaagatggctagaaagctaggggagacaaggagtcccttattcccctccttcctttagaatggcccaaggtagacaggaagacaatgggagcatcccccaactgttttcccttcttggttccctgagcctcggcatctgttaaaaggtgctactcttggatgcaggcatgtccctcaggcatggatctagagaagctaagtg

SEQ ID NO: 208317 - DNA, 178 bp, Homo sapiens
aatttgtgtatgtgtatgctgcatgtttgtgtgcattgatgtttttgtgttgtgtatggcatgcatgtatgtgtatgttgcatgtgtgtgcatgtatctctgttgcaggtgtatcctgtgtctatacacatttgtgtgttgtgtgagcatgtatttatgtgtgttgcatgtgtgtgca

SEQ ID NO: 208318 - DNA, 373 bp, Homo sapiens
aaagtactgaaagaaaaaatgttaaattaatgtattaaaaaaactctaaatatgaaaaataattactttttgaaaaaacaaaaactgagaaattcatcacctgtggacttatactactggaaatgctaaaagaacttttttaggcaaaagaaaaatgaaactagatagaacgaagtcatacaaatgataaatatcttgtgggtattattttgcccattgtctgtctcttgaaaatgcaattgcctgtttaaaataaaaataataactctatgttgtagagtttataacatacatagaagtaaactataagacaacaatggcccaaaggacaggagcaaaaatatagacataaaccattgtaagcttcttgtac

SEQ ID NO: 208319 - DNA, 387 bp, Homo sapiens
ctaagcggtatcataaaaaatgataaatttattacctgaggtacaccaatttttctgcaagcttctaggaaatttggcaggtttcgcctgcatttcgccattgttaatttaggctgaaatgaggaaaagaaaatgtgttactagagaagttttgtttctgggacagggtctcactgccacccaggctggagtgcagtggcgcaagcctggctcgctgtatcattgacctcccaggctcaggtgattctcgtgcctcagcctcccgagtagctgggattacaggtgcccgccaccacacctggctaatttttgtattattagtagagacggggtttctccatgttcgtcaggctggtctcgaactcccgacctgaggtgatccgccca

SEQ ID NO: 208320 - DNA, 465 bp, Homo sapiens
gctcatcttcagagagtctgttttagttgtgtttcctaggatctgcatctgcctcttcgcgtgtaactttggtagcccttgtgcaggtcttggagtctccagtgactttttgtcttctagttttgctgaatatgggatttctgcctcattcccccccactatgtctccctatcactttgcataatttctaggaggaggaaggggaagattcggtcaaatattgctgcagttcttatactataatcatattgctttgtaatataaatttcccccactttttccattataaagatagctgtaggccagatgtggtggctcatgtctataatcccagcgcttgaacccggaaggtggagattgcagtgagttgagattgcaccactgcactccagcctggacggcgacagagccacgcactgtctcaaaaacataaaaataaataaataaatgaatgtttcatctttt

SEQ ID NO: 208321 - DNA, 674 bp, Homo sapiens
tctcctcatggtgcacagcagctggaagacattcactcctcgacttccacgctcctaagcatatgctggggaaacccacatccccgggccctggttcccctcgccctccccaaacacagagcatgctaactcctgattttgcatcgttctgggaaacccttccaacccctggatccaccaaccagcctcggcccacggacagcacagccggatggcccagccccaactctgtaccttgaactgcacaacctgggacagttatgcagctcactcctccttccgcatctttaaccagacaggagctccccgagcaggcgatatctcagtgctaggctgagacactgccctgtggaggaagcctggccagggagggatgaaccaggggcctgggcagaggagcccccatcctctactggcaggaagccatggctctcgaggggaggagtcctgggctctggtccttggcaggggagggtccagctcacaggagagtctggatagatagggctttggattcagatgcactgggcagtcctctgaggccacctgacaatgtaccaaatgtggctgtaagaatcctcgtcctcaaaggagacactgatgggtaggcagacatgagtaacacacagggctttccagagcacggggagggcaccagccacctttccacttct

SEQ ID NO: 208322 - DNA, 359 bp, Homo sapiens
tttggaaaatttggcaaaaatttaggggcaagagctgtgtgattagagtctttttttgggtagcggaaatatctccttgataaccctcaatatctcatgtagataaactacttattattcttacttaaaagctggttgaactgatgatatcttttaaagcaatatctgaacctactaaaatggtttctttttccttggtattactaaatatgcattacagtgttaccaaatgaatccttggcttttcctagcagcctgtgttttgtgatgaaggccacaggaatgtgttcaagagttcctgtaccttttcaattaaaatgagttgctaattgcatcggtgcttgtagaggaaaccatta

SEQ ID NO: 208323 - DNA, 550 bp, Homo sapiens
aagattagacgaccttctgggaaatggtaatctggtacaaaacaaatgtaactagaaagagtgagagacgacatggaatgcaacctgtatgtactattatagttttgtgaactttgaattggatttctgaaataaagcagctcacttttgcattatctggaacctgtccaaaatgaaacaccaacgacctgtgattcctcaaggccacacaaaagcccagctctaatgatgaacaataacctccattcttcctgtttcttagcctactgtcactgatggctttttaaatggctgcaaaagtgacaattacccaactctcagagaaaaaaaaaaatgtactgccaaatcaagggtgtagctagctcatttatacagattaaaaatatcaatattctttaccactatttttcatcttgccctatagatatagaatcacccaaaagctagcggcccaaaaaaaattacatcattttttagtattttcatggtacaaaattgttctcatatggctggtaatctgaaagatggcttatatttaaaaagaacttca

SEQ ID NO: 208324 - DNA, 523 bp, Homo sapiens
atgcccggccagagataactggtctgatggtttcaatttgcattgcagttagaagctggggaagacatcccagtaaaagctgagaggttggaggcagagcatcggctgtggggtcatagagaggaggcaccatctgggtcttttgggagtggcacagtgtgccttggtggccactgagatgtgaggaggcctgtcatccggctagtgacatggccagacagtgtactactgtgaacttcaactgtgataactgattagaaaacatggaagaagtcagtttctcgatcccccagccaccaattcagagtctattgtttattgcagaacaaaaaagatagacacacattgagaaataaggaaggcaaggacgcccgcgtgcacacagatttgtggggtttggggagtgtgcatgaggaaaactggctaacgtgatttctggagggactttgtcacctaggattagcgtcagccatgagtaagacaggccccacgtcacagtggcttcaacaggctggaaggttat

SEQ ID NO: 208325 - DNA, 312 bp, Homo sapiens
tcgttaaatggtgttttacagattgcaggtttgtggcaaccctgtgttgagcaagtctgtcaattccatttgtccaacagcatgtgcttactttgtgtctctgtcacatttttgataactctcagaatatttcagactttttcattattattattatatgtgtaatatagtgacaatgtaattattatataacggtgatctgtgatcaatgatctttgatattactgtgctaattgttttggagtgccatgaactgcatccatataaaaaacactgagtgaacttaatcaataaatgttgcatgtgttctga

SEQ ID NO: 208326 - DNA, 218 bp, Homo sapiens
ctcattagtaaaaatgttgcttagggagatctaggtcatcggcagattttaaataacaatttctgtgtactgggatacctcagaggtattgcaggtttgccatcagaccactgcagtaaagggaatattgcagtaaagtgagtcacataaatttgttggtgttctcaaaaaaatagtttctggatttaatataagacgcacctccttatctcttcata

SEQ ID NO: 208327 - DNA, 399 bp, Homo sapiens
aaactggcttgggtggggtggagagtgaaggtgttcgtaggtagatgggcatggtccaagggggtagaatatccaccctgcaaggtgccagaggggaccccgaatgaggccatggccttgagaacaagagagagatgggattgaggatgcatggggagggattggccttagacatgaagagggacgcttcctctctcagagtcccatcagtgcggaggccaagctggggcgccatctggtggtaggggaagaaaatgagactccttacaaggcctctgcttttcttggtggtacttgaggccagctttcattggttgtgcagggagggttgggagcaggccggaggttaggtgagagggcttcaggtggaattgttgagagtaggaacaacttttccgg

SEQ ID NO: 208328 - DNA, 367 bp, Homo sapiens
catgacgtggaaattcaggctgtgacatcaaaacgtcaccccccaggagagcgagtctattctgtgccattctgactccagtcagccttattggttccagccagtttcagccagtcagccagttttgttgcaagcagagagaattataacaagctgtttcttcgtctgtcttcttgcaaggcaagctcaaggattcttgttaaccccatggggcaaattttcactattaacattgtcttctttcggcttccacaatacgtagttactctctgcatctctgctgttgtctctctgcctactcattctcctcggttaaatcctggagttcctcaaaactcaaacccaaaaatatttgatgactaataaa

SEQ ID NO: 208329 - DNA, 245 bp, Homo sapiens
tccagaaagctgatccttaaggacctgagttaagagaggcttgtgaaaaagaaaacatgttaaagaggcagagaataaggagggaaaggaaagatttcagataagtcatagtgaatgactgtcacttacctgaaagcttcaaagaagaggaagaccagaaatgtaagaaatctgtgggaaaatacagccttaattctgacactgttaacaatccgaaaacccagcttgggcgaaagtcttttaca

SEQ ID NO: 208330 - DNA, 214 bp, Homo sapiens
tgtgtgtgtctgaggctcctatctccccaccaaaagagagacagggaagcacggggctttaaagctgggcactgggggcagattgcccaagatcccacaaattaaccatgcaaccttgtgtaaacagatcacctcaccgcatgccagttttcttatgaggggaacactagcattataccacacagagatctcagtgaggagccaacaggtggaa

SEQ ID NO: 208331 - DNA, 375 bp, Homo sapiens
caggcggatcacttgagctcaggagtttgagaccagcctgggcaacatggcaaaaccccgtctctactaaaaacacaaaaattagccaagcgtggtggtgcacacctgtagttccagctatttgggaggctgagacaagaggatcacttgagcctggtaggttgaggctgcagtgagccaagattgcaccactgcactccagcctgggcaacagagtgagtctccgtctcaaaagaaaagaaagaaacaggttctgggtaggccttttgttagctgcagctttagaataaaatggttttctttttcttacaggggtcagacaccataggataaaatgttaataccgtgcttctgctgacatctctctgtttacta

SEQ ID NO: 208332 - DNA, 343 bp, Homo sapiens
gacagaaaaagggtcagatcctataggttcagctcaactgtcacaaactgaacatactcatggaatttccactcaaattaagaactagaaaatccctggccctcttagaggctccttcgtatcccttccagtcactaccaaccacccaccccccagggtgaaccctgtgcccacttcttacagcacatattagtcttgtttggaatcaaccagcctgtgctcttctgtgtctggtttcttttaccaacattatgttctcaagattcacctgtgttgtgcggcattacagtttgttgtcattgctgtgtagcattctcttttgtgactacaccacgacacagtg

SEQ ID NO: 208333 - DNA, 386 bp, Homo sapiens
cacagttttgctgggatttactacgttttaccacttggctgcatccttaaacaatacaacttagatctgtccaattgtaagcctgacagaaacagcaccacacgcgacgcgccctccttgcctagcaccctgtgttagacgccgtagtcggccgcaggtgggggatgcacagctgtggcttattcattctcatggctgtgctgcgttctgctgggatagatcacacttcctcaatatgtcaagtaataccatgcatggttcttactctctttcttccactcagcattacatctggaatacttccatatcagcaaatactctgcatgctattccctaagtggaagcacaatatcctaatcaccattcccctagggacactgaggttg

SEQ ID NO: 208334 - DNA, 428 bp, Homo sapiens
tatatatgtgtgattaaataattaaaaatattggaataaaaacaaatgtgtgtgtatgtatgtgtgcgcacacatatacatggtttgtatatatatgcatatgttatacatatatgtatgtattatatttatatatgtatgtattatacatatgtaatatgtgtttgtgtgtgtatgtgtatatgtatacatttggtttttattccacacatttggtttttttaaaccacacatttggtttttattccaatattttaaatcatttgccttatactgtagaattattactttgctaacttttgtttcagtgatttatatgagtccttatatagcaggatatatttgtaattttttttctaattcagtttcttgaacaattatttaatactagttttgttttaataaacttaatattttgagcgaatgca

SEQ ID NO: 208335 - DNA, 360 bp, Homo sapiens
tccaaaaaattaggataactaagataattctatttcctcctgatctgctctgtagactgtcactgatgtatggagatggctctgaaatagtgaggaagggaaggtacatctcagcttttgatagtagagtcaccgtaattttttaaaattgggtttatgcatgtcaagctctcagtactgagaagtaatatggctgtaactgatagatatatttcctgagtttctcttagtttatagaaatcacacacacacagagacagacagacagacacacacacgttaaaagaaaatgtgttcaactttctctctcaagaactaattgcctttggtccataatctataatggcttcataacaactg

SEQ ID NO: 208336 - DNA, 239 bp, Homo sapiens
catttggggaatcttccacatgaatagcagcacagtagcaccgacaactaataaagtaactcacaaagacagaactggggccaaatcaggccaaactgggccaaggaaaaagaacttatttactgagcattttctatgtgctctacccagaaacaggtgtcaagaagaacacagaagtgttaagaaatggtccttaaaaggcccaaggcacatatccttcctgagttttctctagatac

SEQ ID NO: 208337 - DNA, 591 bp, Homo sapiens
ctgtctactcttagcatactaaaaaaggacattcccaagctggtccatacctctccagtctcatcccttaccgtcccccaccatcttatatacatcccacacctcagcagtcagacaaaacctcaaagtttcctttacccacaatattatttttacatcttgaaccctttgcacatgttgtcccgtcttcctggaatacctttctgctcccttttccagacatcacctcttccaagaagcttccctaatgctttagtctaagttatacatactcacaggaatctgtttttactgctattatagaagtatcaccccaggttcttattatctatatgttccctgcactacacagtatactacttgaataggaattggattttctgtgtctgtaaccctgggcatctagcataatacctgctatataatgggtactcaatatgatgctgaatgaattttacttttcaaaaccaactccttcatgtgtaccatgccttacctcttctataacttttccatcactatcctaacctctccttttatttctttcagcttttttttttttcgggacggagtctcgttctgtcgcccagg

SEQ ID NO: 208338 - DNA, 216 bp, Homo sapiens
agaatttggtcttaccaaattgtgtaaatctttaaaattgtgtatttggcttaatattatagaatctgattgatttaatctaccttgtttcatttagtatgttgacattttcttgagaaatttgttatgccaaatgattaacataataatattttaagtttagatatgattttgaatttacattttcaaatgcaactttgtgtctgtggccttttt

SEQ ID NO: 208339 - DNA, 374 bp, Homo sapiens
tcactgagacaacagttaccgtgacaaccgagcccgagaaccggagccttaccatcaaacttccgaaacggaagccagagaaaaaggtggaatggacaagtgacactgtggacaatgaacgcatgcgccgccgctcatcaaaatgctgctctatttatgaaaaatcccgggcctttggcgagagctccacggaaagtgatgaggaggaagaagagggctgtggtcatacacactgtgtacgtggccaccgcaaaggatggcgtcctgcaaccctgggaccgacccccaccacccctccccggcctcctgacccttcctagacccacgcagggccaatgcagcactaaattcctctttcccccaccatgcctgaa

SEQ ID NO: 208340 - DNA, 542 bp, Homo sapiens
ggaaagaagcaaagatgtttcacttttcctttgtattgcctgtggagactttgtaaggatgtgatacctggagctaatgcagccattttgtgaccatggggaaactgctggcacattgatgactggcaggttagaaagatggaaagaaccttggctctgatgatttgttaagcaactttattaactaacctggaacttctttactcctggaatgctttttacataatgcagcttaagtcactttttgatgcatttatctagatatttctgaagctcgcacctaaaagtaattcaactgatatcatataaacaatcataatttttaaaatattagcggttaacaaatatactcatggagtctcagagttgggagggaccttaaaggtcatcgagtctaatcccctgcttatgttatccaaattaaaaatttgatgcacaatctatagtcactgttgtgcattagatgttgtgatagtaggcttacactgaccttctgaaattattgtcacaatgactaaataaatggtatattattaataaga

SEQ ID NO: 208341 - DNA, 485 bp, Homo sapiens
atcatccaggataaagatgatattataccagaaggagtggggaataagctgaggaataggaaagtggcatggtaagtgtttgaggtcattgagaccagcctggcaaaacatccagcaacactctccaggcctagggaagggctgataagaagtgttccctgaaggaaggagctgctatggtttgaatgttcccccaaaatacatgttgaaacttaatcaccagtgtgacactattaagagatgaggccttttggaggtggttaagtcatgagggcagaggcctcatggaagggattagggccattacaaaagggcttcagggagtgagttagttttcttccattcccctgtggggacacagcaacaaggtgctatcttgaaatcagagattggaccctcaccaggcagtgaacctgcagatggcaccttgatcttggacttcccagcctccagaactcatgtgagcaataaatttctgttcctta

SEQ ID NO: 208342 - DNA, 208 bp, Homo sapiens
aattagagaaggtaattatttacaagttttttaagaatacaagttagcgaccgggtgcagtgaattctaattaatatatgtagctacaattactagaaacaataagggggaaaatctatatgaaaatatacaaggaaggtaagaaaaaggaatatatgaaaaagaaatatacaaaggaagctaaggaaaagctataagacgtgaggat

SEQ ID NO: 208343 - DNA, 690 bp, Homo sapiens
tacacagttatacacagaaaaggcctgaggctgcctattggtgaggagggaaggaagggaaccactatctctctggaaccattggcccttgaaccaccagcttgtgtacagagaggacactgtgctgtgtgtcagaaacaagcacggtcatctactccccagtcatagctgaagagaagagacactgccaggagtggggctaagaaacagccaaggaccagacgcagtggctcatgcctgtaatcccagcattttgggaggccgaggcaggtggatcacttgaggtcaggagttcgagaccagcctggccaacatggtgaaaccctgtctctactaaaaatacataagttagccaggcatggtggcaggcgcctgtaatcccagctactcaggaggctgaggcaggagaattgcttgaacccaggaggcagaggttgcagtgagccaagatcacaccactgcactccagcctgggcgacagagcaagactccatctcaaaaaaagaaaaaaaaagaaaagaaaaagaaagaaacagccaaggaccaaggaccagtgtccgttccctcagccactcaatttccaagacctagtcttccttccccaagccaaaaactcccatctttggggggacccaaacttgccccgagtccagaagggaaaagggtgagctactcctcatctaactgtgt

SEQ ID NO: 208344 - DNA, 412 bp, Homo sapiens
cccctgcgcctcacccggaacatccacagtgtgggactgctgcgtctcacccactgcacctgccgtgcaggatccctgagtctcacccgccgcacccgccgtgcgggatccctgagtctcacccgccgcacccgccgcacctgccgcatccgccatgcgggacccctgcgtctcacccaccgcacccgctgtgcgggatccctgtgtctcacccgccgcacccggctcatgggagttgggagcagctgtgcctgttaagcaccagtatttaaaacagcacaccagatcaggtgcggtggctcacacctgtcatcccaacactttgggaggccgaggcgggtggatcacctgaggtcagaagttcgagaccagcctggccatcatggtgaaaccccattgctactaaaaatac

SEQ ID NO: 208345 - DNA, 129 bp, Homo sapiens
accatgcctacctgagaagggaattttctagtcttcatattcttccctagtcttgacattgatttggaacagacagctagaaagaggagagaaaaacagagtatatatttatgaatataaaatcttgag

SEQ ID NO: 208346 - DNA, 363 bp, Homo sapiens
gtgctagatggctaattactggagttgaatagctgtacagagcaagttcagagtgtgaaagtgtgactttaaaagtgaattaaggccaggtgccgtggctcacgcctgtaatcccagcactttgggaggccgaggtgggcagaacacgaggtcaggagatcgagaccaacctggccaacatggtgaaaccccatctctactaaaaatacaaaaattagctgggcatggcggcgcgtgcctgtaatcccagctacttgggaggctgaggcaggagaatcacttgaaccagggagttggaggttgcagtgagccaagatcatgccattacactctagcctggcgacagagcacgactccatctca

SEQ ID NO: 208347 - DNA, 399 bp, Homo sapiens
aggcgaccagcccatgggcacggccagtcgagagcagcccctgaaggcgagcctagatcccgggaccagggtcagcttggtatttgaggggcgcggggaaggagagaggtccccggagctcgcccgggacaacagggcccccggaggcggcggtgaggactgtgcctgcctcactctgcagcccctattggggccactggggaaaaggcccagcagcgaaaccaactagtccaagccaggcaaggaaccgtcctagacggctggtgggaacaaccgcgcagctgctgtggaaaaagcccggcggttcctcaaaccacgagccctggagtctccataaaacccagcaactccactcctaggtgtctgcgcgcccaagagaaataaaaatgtttgtccaca

SEQ ID NO: 208348 - DNA, 580 bp, Homo sapiens
ataagggattaatatctggattatgcagaaaattcctaaaactcaacaatgaaaaaaacgagctgattcaaacattggcagaagacttcaataaatacttcttcaaggaagacatagaaacagccaataagcacatgaaaagccgctcaatatcactactcaattaggaaaatgtaaagcaaaaccacaggataccacttcacacctgagaggatggctaccatcaaaaaccagaaaggatggctgaacgcggtggcgcacggtggctcacgcctggctttatgtagcattcttaaagtcactagggagatggcaggtgaagtaaaggcagatttccaaaatcactaattttttttagttttttgtcacttaacctttcttgcatatacttctttccacagctcattttcttacttgtatattaataaagctaactcatcttcctgaatatacatgattttatatgagaagagcaggaagcttaggcttggttagctaaaactaagatattgctgcccactaatcacacagggataaaactaatagactgttaagattgtcagtactcaataggaagtat

SEQ ID NO: 208349 - DNA, 382 bp, Homo sapiens
agcacttttttttttgttaagtagcaggagtttaaggtttcaaggcaatgtggaaaattgagaataccagaaaatgaatccaaacaaaattagggtatcccaaattctaaaaatctatgactcatattgtgaattgttgggaggagtagagctgccctaggcagctgcaggttgtgcattgcagagctccaggtggcaccattcgcttagagtgcagtgtgactagagtcctgagtagagcaaatactatctgaagggaccagaattccccccacgttccttcaacctaggttactttgtgcatcattttcagaaaagttcctgcttttgaaatataagaatggcctcaagccatcaaagtggatttaagagtataactacg

SEQ ID NO: 208350 - DNA, 175 bp, Homo sapiens
caagacttcaattaaattgacctaaggaacatgtataaacattctttcccaaaacagaatatgcattatttgtaactgcacatgaaactggaattttactaagataggtcatattttggacaagacagaacaagtctcagcaaatttaaaaggattccatcatacaatgtatatt

SEQ ID NO: 208351 - DNA, 319 bp, Homo sapiens
gcagatagaacgccatgcctctccccaggtggcctccctcaccctgacaatgtaaaaaaacagctcatctttacaagcaggggacaaagacaagactagaaatcctccctcccagacaaatgtgtatttgacttcttcctctactctttatttacttaactgtatgtaaaatcagatttattgagctgaatgcataactgatggctcctctttccctcctgcctgctcttgcccctttatgcatatttgtgtggtgttgttttttgagaaagggtcatgtgtgtctgtgtatatgtgtgttttttggtttttattttgt

SEQ ID NO: 208352 - DNA, 632 bp, Homo sapiens
gccaaccgtcccggccctttgcttcagtgggtgcctgagtctgcccagactttaggttttgaaagcctgagccccaaaggaaagggtcaaacactcccagagagctggggtcccccatgcctaaatgcctcttccaagtcctgccacctgagcagggagggagactggcccactgccttaggggtgaggcagttttcttttatttttgagacagagtttcgctcttgttgcccagactggagtgcagtggcacgatctcagctcaccacaacctccgcttcctgggtccaagtgattcacctgcctcagcctcttgagtagctgggattacagacacacgctatcatgcccggctaattttgtatttttggtagagatggggtttcaccattattggccaggctggtcttgaactcctgacctcgtgatccacctgcctcagcctcccaacgtgctgggattacaggcgtgggccaccacgctgagccagcagttttcattatttcagaagcagtggcgctggtccctctaatgagaacagatgagggaggttcttaaaactcaaatgccaacaggggtgaggagttaacagagaagagggaaggaagcacacacagccccccttgtctccc

SEQ ID NO: 208353 - DNA, 573 bp, Homo sapiens
gaagaattcaagttcacgagggactgagcaatatcagagtcataaaattcagaggcaaagagacccacctgtctcttccctgcttaagacttcgtgttgaagctgctggcatcttccttggggaaattgccctcaggaaagggataaagttaagcctttgtttatatcacccaaacatttagaggctttaaaaagatggtaaagtttatttattagcctgtttatgataattggccaaaatagttggaatactatttgctcaaatgattttatgatagattttaagatgtctgcgattttattttgcatggatgatagctgggacagcagacacccatcaaagcgttactaataaaaatgaataaaaataggtctcttgatgtttgacattttctattaaagaagactttcaaggaaaagatcatcataaactttcagaggccaggagaggggagcctaacctttctttagtgtgtaccacgtgtcacatactctatacgtgatttttcagtcccaacagtgcttgcttttctgatgttacaaatgagaacacaggttgaggcaggtcacggt

SEQ ID NO: 208354 - DNA, 590 bp, Homo sapiens
taaaagagttttaattgagcaatgaacaatttgtgaactgggcagcccccagaatcacagcacattccgagatattccagaggtgcctcgttaaagacaaagttcttgactgtaaaatctaggaaaacaagcaagtcttaaatctcaggggagtatgaaataaaatattttaaagaaacaaggattttgcttgttttgagaacaaggttttaacaagagaaggggtttatctgttccaacctaccatgcacttaacagcagttatttcatcaaatgttcttccttttgaatttgaaattaaaatgtagctagaaaataatttgtaaaatggtacttttgggacacagaggctaatgaaagtattttgtataatatatgcactgcttaagcaggcatatgtaaagtatgtatatccatttttggggcagaacgcagtggctcatgcccccaattccagcactttgcgaggccaaggcaggcagattacttgaggtcaggagttcaagaccagcctggccaacaaggcaaaaaaaccctgtctctacaataatataaaaattagccaggcagggtggtatgcacctgtaatc

SEQ ID NO: 208355 - DNA, 1656 bp, Homo sapiens
  misc_feature (659)..(659): n is a, c, g, or t
cgccgctgcgctggtaagcctgtgttttggttcgctatggcccgtactaagcagactgctcgcaagtcgaccggcggcaaggccccgaggaagcagctggccaccaaggcggcccgcaagagcgcgccggccacgggcggggtgaagaagccgcaccgctaccggcccggcaccgtagccctgcgggagatccggcgctaccagaagtccacggagctgctgatccgcaagctgcccttccagcggctggtacgcgagatcgcgcaggactttaagacggacctgcgcttccagagctcggccgtgatggcgctgcaggaggccagcgaggcctacctggtggggctgttcgaagacacgaacctgtgcgccatccacgccaagcgcgtgaccattatgcccaaggacatccagctggcccgccgcatccgtggagagcgggcttaagaagtggcggttcggccggaggttccatcgtatccaaaaggctcttttcagagccacccacatcagcacttggaagaagctgtaccgcttgccctccgtgctcctccggcattagagcggggaaggcacttccgcttaggctcccaacaaaacggggtcgggtccccctgctgcggtgccgtcttgagctttgccgacttcggccaattggnctatccgcactggccgggctgcggacgctttcctgggcgccggctcgcgggctttggcggtccggctccccccgcgcgtgaccggggccctgcgtggcgggggggccggggcaggagagacggggcgtcgggcacgaggccaggggtcactagggggacgctcagggctcgcggtcctgagcgcggctggcctttgcggaagtggagcgccacacgcccgtgcttcgcgcccaaaccggcctcacccggcgcggccatccggctagggagggaaatgaccacctcggcctcgccggggttctgcggacaaacgtggggagaactgcgctggggctgccgttcagtccccgcgccacctccactagcacagtggtaacccccatatcctgcccctaagccaaaattcccgggggcacggggtgtgggcggaattttgtgaatctgggctttatcgagccgttccctgtccatgtccacagaaggagattcactattccagtgaaggcactcggtcctcttagaagctgcatggtatgtctggattttctgtccagactcagtagttcctttacgttgttttcgtcggacatgtgggcagacgctggtgcccgagttcagatccttgggaagacagtagatcagacaggaagaacgtgggcctccgttgggcaaatgaagctcttcgccttaggaaatcgtgacaggaggccacagaggtgatctctacagtctctgggagctgggaagtccaaggcctcttagtgggaaagtgaggcagggtcttgcagagcccactctacacacggccagatacaaatggctgtagaggtcttagataacaccttctcggtcatttatttgcacctcagaagaagccagggcttcggttttctgtttgtttcatcacagttgacaggttaaaagcattcactgcagcgatctatgagaattaagaggggagaaggggaaatggaataaaacttcgttttgtaaagct

SEQ ID NO: 208356 - DNA, 580 bp, Homo sapiens
gatctggctttttttttaataggaaagttttaaacataagaaagtagaaataagagtagaattagctagtttcaacaattaccagcttaaggccaatttaatttgttctaaaccgccccctgctttttccttcccctatccatattattttgaagtgaatcttgacatcatatcatttcatccataaatatttcattatgtatctctacaaaataacactttaaaaaacacatgcaacactgctgtcgcccttttctcctcaaagcaaaacacaaagtccagtttctccttaagatcatttagagctgggcatcgtaacttgcctataatctcaactctttgggaggccgaggtgggaaaatctcttgaaggcagaagtttgagaccagcctaggcagcaaagtgtgagaccccctctctacagaaaaattaaaggatcagccaggtgtgaaacgcctgtagtcccagctacttgtgaggctgaggcaggagcatctcttgagcccaggagtttgaggttacagtgagctgatcgcactactgcactccaaccttggtgacagagcaagattgttttctc

SEQ ID NO: 208357 - DNA, 371 bp, Homo sapiens
aaaaacaaaagtgggaacgatataactgatcttacagaaataaaaagtgtgataaaagaatactatgaataactgtataccaacaaattatataacctagataagatggacgaattcacaaaatactaatacagaccaaaacagaaattgaaattatgagcagacccataacaagtagaaagtttgaatcagtaaccaaaaaccttccaatgaagaaaatgctacacagatggcgtcactgttgaattataccaaacacttgaagaattcacaccaatccctctcaaactcttccaaaaaacagaggagaaaaaactttgcaatacattctatgaggccagtattacatggattccaaagccagacaaata

SEQ ID NO: 208358 - DNA, 643 bp, Homo sapiens
ccttccaccaggtctccctctcaacacctggggattacaattcgggttgagatttaggtgggaacacaaagcctaaccatatcagggggcaagggttggcagtgacttgtgatgaagagagttgaggttggggactggaagggcataaaggtgataaagccccagttgaaggaaaggcacattatattatttatgccagaagaaggttttcaagatcagtccagaaccaggacttggcagaaatagttagaagcccctaatttctgtgttgggtttcaccatcattcacaatttttaaccacatgaggtaattggactatgcctcagttaacttttacttacttaactcaaaacctgagctaggccagacacggtggctcacgcctgtaatcccagcagtttgggaggccaaggcaggcagatcacctgaagccaggtattcaagaccagcctggcctacatggcgaaactccatctttactaaaaatacaaaaaattaaccaggcacggttgcgcttgcctgtagtcccagctattcgggaggtggaggcaagagaattcgcttgaacctgggaggcggaggttgcagtgagcagagatcgtgccattgcactccagcctgggcgacagagcaagactccgt

SEQ ID NO: 208359 - DNA, 564 bp, Homo sapiens
ctccacattccgggttcaagcaattcttctgcctcagcctcctgagtagctgggactacaggcacacaccaccatgcccagctaatttttgtatttttagtaaagatggggtttcaccatgttggccaggatggtctctatctcttgacttcatgatctgcccgcctcagcctcccaaagtgctgggattacaggcttgagccaccacacctggccccaggtcatacttttaatcaaaatgagaaaaaagattgacttcactggagtgcttatgtcttgttttatattcaagttttaaatttatgttcttgagattattacatcttgagttacttgataataccacggttgaaatccatgttgttgaatccttcaaccccttgaggactgagaattccctttaattatctgtctgaatcattaaatacttgtaaatcaagagttcaatttagaaatgttatacttgatacattttttaaagctggataaattaacctattaaacaaaattatctcttcttcaaaaaaaaggcatcacttcccccacaaatgtgtaatttaggaa

SEQ ID NO: 208360 - DNA, 162 bp, Homo sapiens
cactttagtttaatgatgaaatctttgttcatatagattaaaaaaccccagacagtggtggaactcgatgtcactcaacttccaatttagtgcttccactaaggttttctttaaaaaaaaaatgctttgtaggttttctgtatcctctgttgtttgatttat

SEQ ID NO: 208361 - DNA, 621 bp, Homo sapiens
gattgcttgagtccaggagttcaaggtggtagtgtgctgtgattacacctgtgagtagccactacactccagcctgggcaacataccaagaccccatctctttaagaaaaaaaattttagggcaaggaatgtcattatataatgataaaggaatcaattcagcaagaaaatacaacaattgtcaatatatatggacccaacagtagagcacccagacatacaaaacaaatattattagatccaaaaagagagatagattccagcacagtgtcatttgcggatttccgtaccctatgctccgcattgaacagatcatctagacagaaaatcaacaacaaaaaacccacattggctttaaagtgccttttagtccaaatggacctaacagacatttccagaacttttcatccaaccattgcatggtacacattagctgcttcatcacatggaagataatctaggagagatcagatgttaggccacaaaacaagtctcaacaaatgtaaaataattgaaattgtatcaagtattttttctaacaataataaaataaaactagaaatcagtaacaaggggagcttttgaaattgtacaaattcatgaaaattaacattctcctga

SEQ ID NO: 208362 - DNA, 695 bp, Homo sapiens
caaggctctccaagctccagaattcctatactgtttcctgaacctttgttgtcaccgtttcccaaactacttttctttttgtcaatcctgaccctttccctctcctactacagatgttggtcactcgaatactcgcagcacacttctatgaatgaatctttgtctcagagattgctccccaaggaacccagtcagtgccatcggaaatcaaaacatttatttatttattttaaaaatatgtaaataaaatgattattttcaccattttaatgtacaagttagtgatcattacacatttaatacttgcatgaaaacatcacatttaccgcataaatatggacaactattatgcatctattataattaaaaataaaacatttataaatgagaacatactggaaatgtgtagtcatgatggtggcaccatcttatgtttttaaattaagaattttggagcaggaaatgttttctgtctgtacctaggtctttacatatcagaaaatttcataaaagaccagaataaaagtagccatacaaaatacaaccacaaaatatgtattaaatagcctaccaaaatgccacaatgtatcattataatcactattaaatatttattatgcaacagtatcatttatgcaataggattttttataaaccagcaatttgcactttgaaattcaatttcagtgaatcac

SEQ ID NO: 208363 - DNA, 685 bp, Homo sapiens
cgaaattcaagctccaaactctaagctccaagctccaagctccaagctccaagctccaaactcccgccggggtaactggaacccaatccgagggtcatggaggcatcccgaaggtttccggaagccgaggccttgagcccagagcaggctgctcattacctaagatatgtgaaagaggccaaagaagcaactaagaatggagacctggaagaagcatttaaacttttcaatttggcaaaggacatttttcccaatgaaaaagtgctgagcagaatccaaaaaatacaggaagccttggaggagttggcagaacagggagatgatgaatttacagatgtgtgcaactctggcttgctactttatcgagaactgcacaaccaactctttgagcaccagaaggaaggcatagctttcctctatagcctgtatagggatggaagaaaaggtggtatattggctgatgatatgggattagggaagactgttcaaatcattgctttcctttccggtatgtttgatgcatcacttgtgaatcatgtgctgctgatcatgccaaccaatcttattaacacatgggtaaaagaattcatcaagtggactccaggaatgagagtcaaaacctttcatggtcctagcaaggatgaacggaccagaaacctcaatcggattcagcaaaggaatggtg

SEQ ID NO: 208364 - DNA, 803 bp, Homo sapiens
cgaaattcaagctccaaactctaagctccaagctccaagctccaagctccaagctccaaactcccgccggggtaactggaacccaatccgagggtcatggaggcatcccgaaggtttccggaagccgaggccttgagcccagagcaggctgctcattacctaagggtcttgctgtgtcgcccagactggaattcagtggcctgatcatagttcactgcagcctcgaactcctgggctcaagcagtcctcctgccccagcctccctagtagctgggacttaagatatgtgaaagaggccaaagaagcaactaagaatggagacctggaagaagcatttaaacttttcaatttggcaaaggacatttttcccaatgaaaaagtgctgagcagaatccaaaaaatacaggaagccttggaggagttggcagaacagggagatgatgaatttacagatgtgtgcaactctggcttgctactttatcgagaactgcacaaccaactctttgagcaccagaaggaaggcatagctttcctctatagcctgtatagggatggaagaaaaggtggtatattggctgatgatatgggattagggaagactgttcaaatcattgctttcctttccggtatgtttgatgcatcacttgtgaatcatgtgctgctgatcatgccaaccaatcttattaacacatgggtaaaagaattcatcaagtggactccaggaatgagagtcaaaacctttcatggtcctagcaaggatgaacggaccagaaacctcaatcggattcagcaaaggaatggtg

SEQ ID NO: 208365 - DNA, 474 bp, Homo sapiens
agccaagattgcacctctgcactccagcctgggcgacagagcgagattccatctcaaaaaaaagatttattttatgacccaggttctggtaaatcttgctgaatcttctatgggcgaagaatgtgtaccctgctattgctgtgtgaagtctcctgtaaatgtcagttaggttccattggtcgatgatggtgttcagttactgtattgtttgctgattttctttgctgtttttttcctgtaatggtctaagcttccgtatatcctgtttctttgtatattttatagttttttgttgagaacgttgcattttaagtgttacaatgtaatgaccctcaaaatgtgattctctcagtcacctgggattgctgggttttgcttgttgaggtctggagctctcggtttgttacttttccaaactatttttgcaaagcgtttcttccttgtgtttgtgtggtcactgaaatttctgtgtca

SEQ ID NO: 208366 - DNA, 216 bp, Homo sapiens
ggccacccatcgagatttttcatggaaagtgacaattttgttctcaaatgtatacagacatgcaaaggaactacaatggccaaagcagttttgaaaaagaagatcaaagatggaggaatcacactacctgttttcaagactgacttactatgaggctatagcatcaagaaagcatggattggctgggcacagtggctcacgcctgtaatcccagca

SEQ ID NO: 208367 - DNA, 506 bp, Homo sapiens
ggactctgaagactaatgacaggtggataaagacttctctgaagataagactgggattaggggacctgttaatatttctttcccatgttctccttcccagagcattaaactgtagtctttacaataatgttcactgagaaaccttaagactttatcagttgttattatctatgctaagtgatcaaggacattgtgaggtctacatccatacacacatgatactaagtttatccctttgattattatctctactgtcataaaaatcacattatttttattttgaatgaagtattgtcctctgaggcttgagttctggttgtgacagtcagaataagaaataaattgactactcatggctggaaaacaaatgcagaaagtagataggacaatgttctgaccaaatgaaactaattcatcataaagaaatggaacaattgggaaatacgaatttggatgatacttggaaaatcaggtaatctaaatttgtcatttatatataaataaca

SEQ ID NO: 208368 - DNA, 704 bp, Homo sapiens
ccacacctggtgaatttttaaaattttgcatagagacatagtcttgctgtgatgcccaggctggtcttgaactcctggccccaagcaatcctcccatgggcctcccaaagtactaggattacaggcgtgagccactgcacctcgccccaagttgctttcatttttaattcactcttaatttttcacctttttctagatagctagttcagaattattctagatatatacatcttagtaagtatggtgatttaaaattactttggacaactttaagtttactttttttaaaaaaggaattttcaagattgttaggtacctgcctgttttcaggggctttgatgacttattccaagaaaatggaattgtctgttgtgactggagtcatcactggattaagctgacaataaactactgttattcttcaagaaacatccatcttctgcacagaccaaagtagtgatttaatttgagtgcacagctcggttgtactttgtcttgggatgtgaaaagccagaaagaatgtcactcccatagtgatatcactcccacagaacaataaggataaagacagataatctacacaatttcaatttttttaacctactagacagctgagattgataacatctaggtagtctaaaattcaaggaaaaaaaataggcttttccatgtggagaagagaaataagcactggctcatgtggt

SEQ ID NO: 208369 - DNA, 976 bp, Homo sapiens
ttgaaattaaagggtgtctggatgccatgttaattttattgagcatgagaaagtatttgaagaaactgttgcacaacatatgatgaaattttgatttctctgaatctcagagtaatttaagatgggcaaatccaatgagttgatgtaacccatctacattttgtggctatttcatgtataaaatgaaaggctttagttatttctagaggagtcccatccaacactatttggcgactgttaatatgttataattattagacagtggaaaagcctttattgactaattgatttaacctcagtccaaagaacagtctctatacttgccctcatttactgataggctgctactagttaccatttgattgtcttgactttcgtcttcagttgaattggtgaaaacatcaacaaaaacaaaacccactgtgtcttaaaataaaatgttctgcattgtagtcaataaagggcttaagatgtaaaacaatgcattttctctctcaagatgtcctgtgttatactttacaattagttgtatcaacttcagattcattaaattttaacagctgtatttagttataatttttgtatcttacaacagtatatataaagactattattaatagacaaaagcaaacccacgtttttgacaagccagcatattgccaatgctcgtcaaagacatttatgtttcttttacattcatgacagctaaagtattaacttggaatttttttttttttttttgactggaaaatccctagttgtttgaattaactgaataaagtgcagggcgtaatagtgactggctgggggcactgggcctttgtgttttttttcattcctgtgtttggatactaatcaccctcgtatctgcagcctgaggtagtcaggtcattgtttcaatgctgcccttggaaagaagactttgacttaggtgctttgggatctaagtgtggtttgtgactatccccattattta

SEQ ID NO: 208370 - DNA, 561 bp, Homo sapiens
ttgaaattaaagggtgtctggatgccatgttaattttattgagcatgagaaagtatttgaagaaactgttgcacaacatatgatgaaattttgatttctctgaatctcagagtaatttaagatgggcaaatccaatgagttgatgtaacccatctacattttgtggctatttcatgtataaaatgaaaggctttagttatttctagaggagtcccatccaacactatttggcgactgttaatatgttataattattagacagtggaaaagcctttattgactaattgatttaacctcagtccaaagaacagtctctatacttgccctcatttactgataggctgctactagttaccatttgattgtcttgactttcgtcttcagttgaattggtgaaaacatcaacaaaaacaaaacccactgtgtcttaaaataaaatgttctgcattgtagtcaataaagggcttaagatgtaaacacacattatattaaaaaacactttgcgggcggaagcttattccttttattgagggttaatttttagtttggcactggcccgcg

SEQ ID NO: 208371 - DNA, 321 bp, Homo sapiens
gtcatctcagctcctcagggctgctggtctgagggcctgaagttcacccatgtgacctcctgggtgcaggatcctcacggtaggcttgacgttgatttcaataaggaaagcagaagcctctgcgtttgcatcctgaactttgcagcctaggaaaggaaatagtgcgcaggctggaggagctgggggtgggggcagcggagatagcaggaggggtacttgtgtaatcagattctttgattttgttagcctggctcatggcctattaattagattactctctctttcattcttgatttcacatccgtgtttgttcctgtatcc

SEQ ID NO: 208372 - DNA, 514 bp, Homo sapiens
attattttgggatgaagtacatcctatcctttcgtgtatgaatatctcttaggatgtttaaaaggctgctcaaattgaaggtttgcaacttttgtggcaacaccctgctttagtaggtgctcaaatgtcagtatgctcagcttttccccactagccaccttactcaggaaggaataatagaaaaagcattaaattgagctccccaaattgtttatgtacactagtgtgatcaaaatcacccgatacatatgataactctcaatgtcattctgcctaaaaacagtcaatgatcgaattagttgcagctatagatgctgtggtagcagaagtttttgtttagtgaattgccagctttcaatgaactgtgcaaggagcaactgtgtgaaaatagaagtcagtaatccccctgttcatctcttcacctctacctcattgtaaggaggatttgggttcttagattggttgaaagaatagaggttctgtgaataaaatagaagaggataattttctgttc

SEQ ID NO: 208373 - DNA, 460 bp, Homo sapiens
cctatctcctgcgtcagtgtttggttgaaaccctgcttattttgccgacttatataaatatctgcctggtggccataggcctgaatttgccacttacggtctagccatctggaccactttgccatgtgaaaaggactagagatcttttcagtgataaaatgtataaactaataatggtacatttacagtgaaattcttggtgactgctcagatgttagggattatttaggacagtagctgctcatctcctcagcatctacctgtaaggagggtgtcatgtgtaaagcgttgctgtgtgattatgctttcctactctggtcggcacccaggccgtcgggcggtgtctgctgatggcttaggaaggatgaggccacacactcagtcctgggaagtggagccctgggtttgtaactataacacgttggcacgtaccatgcaactctttcatcacctacaatga

SEQ ID NO: 208374 - DNA, 337 bp, Homo sapiens
aataggtgtttggtaaatgtgtggagtagacccataaaatgaggaagaaagagtaaggggcaatctcaaggcatcacagctagtaagtgacacaacaagagttaaaattgaggttgtgcttctgctagtcctggcctacttctgacacatcttcatatatttaatcttgcactaaaaaatgtataatgtcaaagccgtaaaactagcatctcttgctggttgcaacataaattgttaaagctctttcacaaagcaatttggcagtatgtgttgagtgctatgagaatggacatattctgaccccataatcctacttctgtaaagtggcctgaaatat

SEQ ID NO: 208375 - DNA, 729 bp, Homo sapiens
gcgccaggagccctgtaacatcagccatcgtcaaccccaccgtgttcttcaacatcaccgttgacggcaagcctttagacctgcgtctccttcaagctgtttgcagacaaggttccaaagccagcagaaaacttttgtgctctgagcactggagagaaaggatttggttataagagttcctgctttcacagaattattccagggtttatgtgtcagggtggtgacttcatacgccataatggcactggtggcaagtccatctatggggagaaatttgatgatgagaacttcatcctaaagcatacaggtcctggcatgttgtccatggcaaatgctggacccaatacaaatggttcccagtttttaatctgcactgccaagactgagtggttggatggcaagcttgtggtctttggcaaggtgaaggcatgaatattgtggaggccatggagtgctttgtgtccaggaatggcaagaccggccagaagatcaccattgctgactgtggacagctcttataagtttgacttgtgttttatcttaaccaccagaccattccttctgtagctcaggggagcaccctccaccccatttgctcccagtatcctagaatctttgtgtctcgctgcggttccctttgggttccatgttttccttgttcccttccatgcctagctggattgcagagttaagtttatgattatgaaataaaaactaaataacaaaata

SEQ ID NO: 208376 - DNA, 529 bp, Homo sapiens
ctcatttcagcactagctgaggtctggctatcagcctgtcacagagttaggagtatgtcatcacagtgatttttctttcccctcctccagcctatttgaaggaggccctgttatgtgttaccattagggtctttactaagcaatgtctagtttttttccttgaaaaacttgaaatgcgaatggctctctcaacatgcttctctttgtaacagccacattgtgaatattaatggcagtacttaagcaggtcgattgtgcactgagaatatgaaatatgcatgtcacttaaaaacaaatgattgtccatacagtgcttgggctgaattattctccctcaggttgtcacacctgatgcagagggaagctaaggcaatgcatctgtgccagactttatagatcccaaggtcaggatcaaaatgtgcagattcaggaagatgctttttcactaatgatttgttaccattaacttgacgcactgggtggatttatatagagaaaaatgttaataaaatgttcttcgagctacatt

SEQ ID NO: 208377 - DNA, 118 bp, Homo sapiens
aaagttgctagaagtttgtttttcttaaatgttaaaatagtttcatgattaagtctaaattacaagttgtggtcacctgcaacacatgtttatgaacactaaatctcaaaagataaaa

SEQ ID NO: 208378 - DNA, 274 bp, Homo sapiens
catggtggctgagattgggctgttttttttgtttgtttgttttgtttttttcatttctgtatctcctcctccaggaagccctccatgactccaggctgggtcagccctgtccctgtggattccccatcccagtcttgcacactctgggttgtcactctcaatgagtctgttcccatgctagactgtatgccccaggagggcaggcagatgctgtcatggtcagcactgggtccccagccctatgtctcagatgttcagaaaatatcttgaatgg

SEQ ID NO: 208379 - DNA, 181 bp, Homo sapiens
gtgatcacagtactgggtaacaagctgcctgcaaaccagtttctttttctggggaataagtgatgacaccctgtccccatggccagagtttgcaaaaccattgtaacttgtttgttagcaatatgtgacaacactacagtcatgccattaaagtattctacatgactctgtcttctggtgg

SEQ ID NO: 208380 - DNA, 434 bp, Homo sapiens
acatggacacattatcctggattatgtcggtgggcccttaaaggaaagaaggcagaagaggcagtgaaggagacttggctcaagaaaacgtaggaaaggtgaggccagtagaaagaatctatgtgctggccgggcgcggtggcctgtaatcacgcctgtaatcccagcactctgggaggctaaggtgggcggaccacgaggtcaagagattgagaccatcctggccaacacagtgaaacaccgtctctactaaaaatacaaaaaaaaaaaaaaaaaaaaaaattagctgggtgtcgtggcgcatgcctgtaatcccagctactcaggaggctaaggtaggagaatcacttgaaccggggaggcagaggttgcagtgagccgagatcgcgccattgccctccagcctgggcaacaagagcaaaactccgtctcga

SEQ ID NO: 208381 - DNA, 784 bp, Homo sapiens
gtataataatttataattgtaatgcatttttatagacaccatatgatctaatcttcacaaaaacctagtgaagtgacatttagctacatttcacaataagaatcctgaagctcaaaatttactgacctcaaataatccctagcactttgggaggctgaagcaggtggattgcttgagctcaggagttcaagaccagcctgggcaacatggcaaaaccttgctagaatagaatggaaaaattagctgggcgtggtggtgtgtgtctgtgatcccagctactcgggaggctgaggcgggagaatcgcttgaacctgggaggcggaggttgcagtgagccgagattggccattgcactccagcctgggtgacagagtgagactttgtctcgagtaaaaaaagagaatgtaaaaatcgaaagagatcgtgtaggaaatctcaacctaatgctgccggggaggaagtgcacctagaaagattaatgagaaacaatgaaaccagctaacatgaacgattggatgcccatcgccaaggagtatgatccactcaaagcgggcagcattgatggcaccgatgaagacccacacgacgcgcggtctggagggcaatgctggcacgatatgtccccaacaaaggtgtcataggagatcccctcctcaacctgtttgtggcagactaaacttgcagaccaaggcagacaattaaggagtcttttccgtatggtgacatcggcggtcggtggtcgggactggtccgggttttccaggctaaccttcttgaattaagg

SEQ ID NO: 208382 - DNA, 327 bp, Homo sapiens
agccattataaactccatccccaaaatacttttatcaccttatcttacatgtacaatcctggaaaagctgctcccttatttgctttcccacaaaaattctaattagatacacaaaatttcctaatgatttctaagagttgatgtctaatctgctttgttcaggtgtgaattcaagaataagtagcagccaactcaatgtgactattcatgtgcccctatgtataaataacttataatctgccaagtaacttatttcttcaatttgtgttatcatacccattctgtcttcacatgctatcatttagacactacctatctcaaaggcca

SEQ ID NO: 208383 - DNA, 772 bp, Homo sapiens
gcagaggcaatagggttgagaagaagagcagagatgagctgtttggggggaaatcaactggactctgggagtgtttggaagtgatgccagagggaggaggaatggtgacaggtaaccttgaggtccttggtttgggtgacagagtgaatgatagtgcagagatagggatggctcaaggagaagataatggccagtgaaatctgccagcttcgttcagtaaaccctgggcacaccctctcgggagaggatcagttggaaggtcttgtagacccctgtctggacttgggccaggcttccctttgctttcgcctgaatcagcacctgggagaagggcagctttccttccttcacctttcctctgcccagatttaaccagggaggtgaacctcttcatgtttcacatctataaagcgataaatcttcagccttccaatagccctaagagcaacccttccctctggcaatatccaccccgattcagcatactacagcccactgatggggtcctgaacagcagagaccctcaggggagagaggctttctcagtgccccctggagatcttatctagagagaggtctggaaattggatttgctgcctgaagctggctcagcagattcagtccttcttctcaggaaggactgatatctgccagaggccacccaggacttgctcagaaccttcagggaagggagagaaagctgcccagtgtccttgacccttgaagttctaagggagccagaagctgtccctcagctggattggactatagt

SEQ ID NO: 208384 - DNA, 350 bp, Homo sapiens
ccattcaatagcctcccagcagattaactttttgagtcaacctcaaaccaattccctaccttggctagatagaggctgagagaaaggtacatcattcactgaactgtgtggccatcgtcctggtttcagacatccttttttttgttccctccctctggcctgactgctctggcatcctgcatactactctgggttcctctgaactctaaagttcgaactctaagtaaattgccctgttttagctaaaacaaacaaaagcccggtggtcccttaagtcatctttccaaggaagggctcagaggatacataaactttaaaaatttgtttaatttttgtacagaggtaattca

SEQ ID NO: 208385 - DNA, 400 bp, Homo sapiens
agtcttcagcgctgggagaaggatgaggagttgggccagctgtccaccatctcacctgtgctctatgccaacattaattttcctaatctcaagcaagactacccagactggtcaagccgttgcaaacaaatcatgaagctctggagaaaggttccagcagctgacaaagccccctacctgcaaaaggccaaagataaccgggcagctcaccgcatcaacaaggtgcagaagcaggctgagagccagatcaacaagcagaccaaggtgggcgacatagcccgtaagactgaccgaccggccctacatctccgcattcccccgcagccaggggcactgggcagcccgccccccgctgctgccccccttttaatactcaccaataaattttacttcctgtcca

SEQ ID NO: 208386 - DNA, 508 bp, Homo sapiens
gaaaaaaagaaaacaaaaaacaaaacacccagtctatggtgttctgttacagcaacagaatatagacaagtgcatgatcctaataagtgtgaagtggtattttgtggtttttacttgtacttcctcaatggctaataatgttgagcatcttttcatgtgcgtattgtccatttgcatatcttctttggggaaatacatatcagatcctttgcccgttttttacattagttgtcttactgagttgtaataattctttttatattagatataagtgctttatcaggtatgattttcaatctgtgggtcctcttttcactttcttgatggcattcattgaagtgcaaaagcgtttaattctgatgtccactttatcttttgttgtgcttttggtgtcatatctgaacacaagtctttaaaggatgaatttgcttggtgaaacacctttcctttggataccaggttcataagattggacacagtcaacatttttttttttgatctcaatcac

SEQ ID NO: 208387 - DNA, 167 bp, Homo sapiens
ccaaagtattaggattacaggcgtgaaccactgtgtccagcctctgcaggagttttaagtacagtctgtcctcacctgtggctgtgttcccctttaaggtggtaaaggagcactgtgagatacagtatttcatagcacagttgtttcttgctatcccctggggactg

SEQ ID NO: 208388 - DNA, 604 bp, Homo sapiens
gtcccttctaggcagctctttcacatgatcacttcccggatctacaggcctgattcccagcagcttgcagtccaccaaaacaagaactgatttggccttgcctaggttatatgcccactactgagacagtccttgtggtcagagagatagctactctgcctgcccagaaggagatggcatgcctccccagagctggcagaattatggggtgggagggagacaggagaggtgggcagggcattgacatgagtcctatggactaaaacaaggagaaggaaaatttccaaaaggaaaattatgctgtcattaccagaaagtaggtgaatgcatgctgaggtgacagaaacaatagccactgtatgtagagaaagacagagtgataaaagatgagttatgtcttaatcctttggataagtttgcatactatcttggttcctataacatgcctagatccatgttttcaaagtgtgtgaaaaactgaatcactctggataggatatgataaaagaggagacaatgaatggaaaatacaggaggcatctcatgcatatatgattgtactcattcttgatataaaatatatttctcattgtgaaacacagtg

SEQ ID NO: 208389 - DNA, 927 bp, Homo sapiens
cggcacgaggcagatgaataaatgtattaaaccaatttcacaggcaagtttcccttgaaaaacaactccttgccataatcatcacattcattgagtgaccatctaccaaatgctttactcccatgatttcatgtaatattgacattcaccctacaaagtagatggtattacagtgtctgttttacaagtgagaaatccgaggaacaggaagtcaatttgccaagtgttgcacagctaaatcgagattccagagaatgtcacctcaaagcttctagtggggctgtcatgtaggttgtggtcgctttggataacaggagacgctaaggaaaatcagtactggttactgaggatggaagaggcgcagatatttcaccacaggcgacgaaaaccccacttttaggctggccacacaggagccccgaggaaactatgcgtccccttcctccccgcccccacactgccctggcctgggcggagcagcggccgcagtgtaactgctgttgcccagatcgaaccaagcccggtcccagtgacgagcagcgcctgcggggccagagcgtctgggagcctttcatgaccccaaagcccagggaggtccccgcaccatcggccccgcgccctagctcggtccgccgtcgagggtgcctggaagtcccctgcgggcgccggggagaaagcccggggcttagcctcctccatccccagccatctgtcaccgcctcctaggccccggctggagccccatgggcgcctcccgcgcctaccaaggagccagggagacaaggatcccggagacctctggggcgccctccagctgaggattccgccgcggctcccgcagccgcttctccccattcggtgcagcccacctggcccagctctcggccggtctccctcggaggtccgaaaagggagagggcgggccag

SEQ ID NO: 208390 - DNA, 203 bp, Homo sapiens
tgatttagggtaccccagatcctagcatctctgcccacccgcccaggcccctcttgagccagtcccttcctccacagcccacagggtgggggggttggtgggaagctccagaagggcgggtggatggcctcaggcccctgggaggctgcagtcagcagatcatcttgggtgcagcatggtcaagtctaggttggcccttacag

SEQ ID NO: 208391 - DNA, 600 bp, Homo sapiens
ggatccatctggttattgttgattcctctggtgtctactaagatccttattttcatctggctctggtccactgacgcagtccctattgtcatttccttgtccagccacatggcctccaggtcttcaggctcctgggtcactctgtcccttcttgggcctccaggaaatctgttcatggctgctgggagccctacctgtctggacacaccaggcaaccaggttgcattccccaccagggaagggcctggctctggattcttgctcctttcttcgactctactcagaaacacggctcaggatgcctctgcttttggattcctggagttcatctggggtttctcacatcccctgatgggtcttactcccttgcttcccctccactcccttcttcctccaaccatgagggtctcttgcaggttgggggtgaatgaaggtcgcatctgaaagggaaggctggctgagtgatcatgtatattttctaaaccaactggcaagtatcctaactttttttttttggaaaccttaaagccaagtattgacatctttgtccttatttctgaagtctgcttgccccaaagcatggaaggaaagggctgggag

SEQ ID NO: 208392 - DNA, 351 bp, Homo sapiens
tcaaacccatttggcaacctctagaaatgaatgtcaaattgtcacacaaactaatgcaaaactgcatttgtgctgtgtgccacatataccttctagccccctatttggaactgttttgtcctcatccagacataaagttttcatgttcatacactctgggagccctttcaatgctggcattgcggtggaaaactaacacattgtaaacctgagtaattgtcaggctttgagggcaggatttaacccatgctacgttcaaatcctggaagaaccagcattgtgaaaatccagtcacgtgtctctgtcctggtggtagaaatttttttttaaccactgtcatttatagatgaa

SEQ ID NO: 208393 - DNA, 496 bp, Homo sapiens
taccctccagcctgggggacagagcaagacttcatctcaaaaaaataaaaataaataaataaaaggtacttcagctgaggcagttcatgcagtagtgtatcattttggaatgtgggtaagcacccctgaatttacatggcctggaaattttttatatttgattttctcaaagtgcagtataacatactcatctccttgtgaacagaaatgtttgaggatgggttaaatgaactgtagaaagcatctcagaaaaaggtgttatgcaaggcataattattttccaagtgctatctgagcagctttcaccaatcaaagcttccttgaaatagagattacaatcaaagttcatctgtatactattgtgtttggagtacatgccaacattccaacttgaagttgctttgagggaaaagttcttcaaattcatcagtgttgtggggaaatgtgatttaaattctgattactggaagccttattacagaggaggtggcaagca

SEQ ID NO: 208394 - DNA, 262 bp, Homo sapiens
ttggggtcattctgaaagtaaatcattctgtgacttgtccaagtgatgactaaacagttgataaaatattgatactagttctttgcagaaatcatgttaagatttcttttgtaaaagacatcttaaacttttcttaaatttctattctcagataactgttaggtgattaatattgccttgttttagatattattggagaatggaatgaggcccagattcataaaattaatcattccaataaaactaaaaggttaatttttgt

SEQ ID NO: 208395 - DNA, 310 bp, Homo sapiens
ggttgcttgaggccaggagttcaagaccagcctgggcaactctgtctgtacaaaaaattagccaggcatggtggcacacgcctgtagtcccagctactgggaaggctgaggcagaagaattgcttgagtctaggaatttgaggcctcagtgagctatgatcacaccactgcactccagcctgggcaatagagcaagagtccgtctcaaaaaaattgtgttttaatcattctttataatattaacacaatagaatgtgaatcctgggaatttataagaaaaatgttcattttaaaatacattctctatgac

SEQ ID NO: 208396 - DNA, 277 bp, Homo sapiens
acacccttaatagctaactcataactgtagtacgtaaataggagctaatgtaaatgctaagcttctatagataaacaaataatatttgatgtatcacccttcagtgagccgcaaactgaaagaaagattatatgatcaatttaggcctgaaatccttagcgcactgttggtgggaatatagactggtacagccattatggaaaacagtatggaggttcccgaaaaaattaaaaatagaactgtcatacaacccagcaatccctcttttgggtataca

SEQ ID NO: 208397 - DNA, 313 bp, Homo sapiens
  misc_feature (7)..(7): n is a, c, g, or t
tgtaagncgtaagactccatctaaaaaaaaaaaaaattagccaggcatggtgcatgaacctttattcccagctacttgggaggctgaagtgggaggattgcttgggccaaggagtttgaggctgtagtgggctgtgatcatgccactgcactctaccctgggtgacagagacttgtctcaaaaaagagagaaaaaaaagaattagtattaaatttcaacacatttactaacaatagtagacattattgagtgttttctgtgtaccctttatctaagatttttccttgccttatctcatgtactccttacaaca

SEQ ID NO: 208398 - DNA, 120 bp, Homo sapiens
cggtaacgccacgtttaatgttttctgttttttctttagtcagctttggtgagttacatgttttctccttgagaattatttctcaattttattatatctaaggttttaaagtttattggc

SEQ ID NO: 208399 - DNA, 315 bp, Homo sapiens
tctatcccaaatgaattcaagggaaaaagaggtaatacaaagacactaataaaaacagaaacaatctgaatatgcattgatatggttaagctttgtgtcctcacccaaacctcatcctgaactgtaatccccaggtattgagggacagacttggtgggaggtgactggatcatgggggtggccccccatgctgttctcatgatagtgagtgagttctctccagacctgatggttttataagggcctctttctttcttctgaggattgcagaggatatagttatcaatctctagttgtcactttcctcttccactt

SEQ ID NO: 208400 - DNA, 185 bp, Homo sapiens
tgcatgcttattctatctctttcttttatccagaaatttaacttatgatcaaacatattaaagcagttattaaattctgacttatgatatccagatacatagcttgtactaaaaaaaaaagtattcaagttttaatttagtcagtatttaaacttctaatccactaggtgcaaaatctgcagatg

SEQ ID NO: 208401 - DNA, 292 bp, Homo sapiens
gtctcaaaaaaaaaaagaaaaagaaaaaagaaaatatcagcagattgaatcaatattgtatcaaagaatctagcaaatatcttagtactggtatttgggaatatcttaatactgggcaactatgaaggagaacatagtcatctccttcactacaaaaaagacatacggcaaaatccaacggctgagcaaatgctgctatctgctacacgggtgactccctaccacgctgccctgggcaacggccacagggaggcctgcctaagaaactcctcagacaggtgcacttgaccat

SEQ ID NO: 208402 - DNA, 234 bp, Homo sapiens
tcccccttggtggggtggctctgccgctgcgtcactttggtcacactgggcactgggaaggatgttctgcaggtgacctggtgatgctcaacatttcagtgacctgggaagggctgagggcgtgagagcggcaggtctgcccggcaggcagctggaggggacttcaactcatccttgccactcgcttgacgttcccaaacacaaggggccatcctattgggtgtttgctcaatt

SEQ ID NO: 208403 - DNA, 423 bp, Homo sapiens
cttagttataaggtagcgcccccgtccccaccccgtagtagaagttagagaaggatattaacagcctgtgctccttctgtgctccatgagcctcatctatactccccagtttcacattccttagagctctgtgaattcttgcttacctccccagcacagctgcaaggtcataagattgatacgtatatattacacaaccatgtattcccaaggatgtaagacatggagtaacaactgcctttcttctcgcttctgtaagtacgcttcctgcatcacgtaattcccaccactgattgtttaaaaggtggctgctctctttgttcggggctcagactttcctggacgctagtcctactgagccaggtgctcaccttaataaaggctctcctgaactctgttcagtctctcccatctctgattgtc

SEQ ID NO: 208404 - DNA, 354 bp, Homo sapiens
ataaggtctaaagtgcagttaacagtaatgtactaatgtcaatttcttggttttgctatagtactacagttatataagatgtcaccatttgaggaagttaggtaaagggtaaatgggagggattctttgtactatttttgtaacttcctgtgagtctataactattttgaaataaaaagtttaaaaacaagtctactgaacagaaaaaaagaatactttttttaaacgtttttgagacagggtctcactctgttgcccaggctggagcacagtactgtaatcacggctcacgacaacttcaaactcctgggtgcaagcaatcctctcacttcagcgtcccgagcagctggtact

SEQ ID NO: 208405 - DNA, 477 bp, Homo sapiens
ctgctcattggcctccaagaacttaaactaaaaatccctccccacgttttctcaagcgacctctccttcctactgccttacaaactgggccccggaggccctcgtgcgctcccgcaccgacggtgcagcacttcctggctccccctctccagcgcccagtgactcgctgctgagtcacctgtggccctgccctggggagagcttccaactgcgccagtccacttgagaatggaggcaggcacctccttggaagggaataattaactttcacgttgcctaatcctgcatttctggtgttaatctagtggtaggtttatagctgaagctttctacttaagccgggtttaaaaacacgtccacaaaaggatattttcttataaaaccagagttggcccggcgcagtggctcacgcctgtaatcccagcacttgttcgagacaaacctggcgaacatggtgaaaccccgtctctactttaa

SEQ ID NO: 208406 - DNA, 370 bp, Homo sapiens
tcccctggttaaagcacacccattcaaagtacatgataggccatagattttaatgttaacggagtatgaaaagttcactgcatatggtattcagattctacacgcaactagtcttataagaaaccaccacacctggctagcctgtggctttatcttgattcctttcaaatttaggtgaatgacattgatcctaatttcctggattctccctgaaagcgcagggttggaggctactctctaaagcagtgtaatgttaaggaggtgtcctgggtatggcaatcaaaccgagcaggaaggggtattattgtcaaggttaactaaagtgcatagaggaaaggaggaaagagggtagtgaaggttacagggaaat

SEQ ID NO: 208407 - DNA, 553 bp, Homo sapiens
aaggagggcaacgtgttagtgttgtttttgtgttcttataaagatacctgagactgggtaatttactaagaaaagagatttaattgactcatgtttctatgggctgtacaagaagaatggtgccagtctctacttctgctgagggcttcagggagtttacagtcatggtggaaggcaaagagggagtgggcctctcacatggtgtgagtggagggaggtgccacactcttttaaacaaccagcagttgcatgaactaccagagcgagaactcacttgttaccatggggatggcaccaagccattcatgaggcacctgcctccatgacccaaacacctcccatgaggccccacctcaaacaatggggattacattttaacatgagatttggaggggacgaacatccaaactatatccagcaacatatgacactctgacattcaaattatatgaagtttggattaagggaaataaaaatggaaggtagagaaatcagttgcttcctgagctttgtcgtttccctaacagccaaattttggttctaagaacattaa

SEQ ID NO: 208408 - DNA, 284 bp, Homo sapiens
gatggttgcctgtgatgcctggtggtgctcccacaaaggtgggttccagcttatgctcctcatcagctcacgtgcctgtgtctcatggtacttggttctagctgggatgtttttgttcctcgaggagtccaggtgtcctgtttttcactctctgggccatgtgattccagtgtgtttatctcaaataatgtgttctgttgcaaaagggaaagagctaacattaattggatggaattctcaagcctaacattgtactagccgttttacatgcattatctcattta

SEQ ID NO: 208409 - DNA, 444 bp, Homo sapiens
tcttagagaaccagaatggtcagagactctgatgatcccctggtccacacgtgactgagagttaataccttaggtcactgttctcagaacctggatatttatatgcacgtgcacctcagtgactgatccattctcagttttcaggtccattgctttcacatttgaaatagtcaaggagcatctttatgactggggctgagcttctgcattcatgtacagccctctgcctgccagcagtgccttgcatttgtgatcctacaaagagcctgtggacttaatggtttactgtatagggaaaggcttgactttgtgtcttctacttaagaagcttgaactttttaccaaatattcgtactccttttcctgaaaatactgatctaggctacagatccatctcttaaccatatttgaaaaattgaaataatatcttctgccataacttga

SEQ ID NO: 208410 - DNA, 311 bp, Homo sapiens
cattctcaggtgtctacttcttctatcccgattgactttagctcctcaagggcagaaactatatcatatactccatagtatttgttctaactccagcacagggccttgtacatagagggcactgattaatgaaataaacaagaaagaggataagttgatgggagaagtgtggacagatggatggatggatggatggacggacggacggacgagtttctaacatgcttaaccttttctcagagaataagctagttacctgagtgaggacttactacttatttaaaagctcccatatttatcagttaaaaaaa

SEQ ID NO: 208411 - DNA, 104 bp, Homo sapiens
taaaaagaaaaagacaatactaaatgttggcaatgatgtgaaacaactggaactcccacacactgctaatgggaaagcttctttgaccatttcttataaagtta

SEQ ID NO: 208412 - DNA, 407 bp, Homo sapiens
gacattggcgtaggcaaggatttcatgaccaggaacctaaaagcaaacgcaataaaaacaaagataaatttctgggacttaattaaactaaagaatttttgcaaggcaaaaaggaatagtcagcagagtaaacagacaacccacagaatgggaaagaatcttcacaatctatacatctgataaaggactaatatccagaatctacaatgaactcaaatcagcaagaaaaaaaaatcccatcaaaaagtgggctaaggacataaatagacagttctcaaaagaagatacacaaatggccaacagacataagaaaaaatgcttaacatcactaacgatcagggaaatgcaaatcaaaactgcaatgcgataccaccttactcctgcaagaatggccataatcaaaaaat

SEQ ID NO: 208413 - DNA, 561 bp, Homo sapiens
gaggagttcacatttatggtgagcccatgcaagaagaccctccgacaggtgcctgtcacccctgaggagtcactggttgcagcccgttctgaagtgtcattgagatagaaaccaagtcaaagccgtggcctagaaagagagtctgggcagaattctgcaagcagattctttatttgagaaacatggatgccacacctgaaaggcagtggccatttcggtaatcacctgaggcaagatcagaaaaaatctaaaagaattgcagagatgctgaccttgatgacttcaagctgctgaaccaagtcccagggaaatcaggattatagttgtttggctgtttcagacacacctgctggtcattcgccacctgaacccacaatcgggtatttggactcggcagtgagtcctgccacggaggcagctctgacgcgactggtggaggattagcacttcacgtgggaagaagcagcaggaaaggatgaaaatcttaagtagcaaagatcttgttttcgtctctagaactccagtaataaaggccagtggcaatgctctcgctagtaccag

SEQ ID NO: 208414 - DNA, 797 bp, Homo sapiens
ccgaggatcgcgtttaccacaggcttctcaccagatttctagattttcaaatagtggattctttctgtttaggttgatttttaatttgctatcatctaggattctgtgtagcctcttgtttcttttcccagagaatggagattattgttttctgtagatgttctactgtttagatttatatcatcaataaaagttgtcatagtagagtcataaagaatttaaactgtgcaggtgaaaaaaaatcattagatgtatagagattttcgttctcttaaaaacttattttagtttctcaatgtagttaggctgagatttgggtggctctgtggtttactgctgcaagtctgtggtgttagtacagctggtgtcgtactagggaggatgggaacacaaatgctgctgacttgggcagagtgtaagtctaggctgttggcgtaagatgcacctgttgtctagtgcctggttttatatctagaaaagcaaaaaggcctgtcatcctgagtctaactgttgctgaaactggattgctgaaagtgctcagttaagccggaaggatctgaaaaatatcttagatgtagtagcagggctgagtccaggaatgtcacataggatagcaagaagcagaaatgtaaatctgagaccaatgagggtctgaagttggagtaatcagaaagtatttaacctcaaaagcagttcctatatcactgaagaaaggagggactattttaaagtgtgctgggacagttttctatgcctatgtacaaaacatactggtcttctacttcacactaattaca

SEQ ID NO: 208415 - DNA, 165 bp, Homo sapiens
ccaaattctaatctgacattgaatgtcaggtgggatggaggccagggtttcagaatcaagctcagtgcctcccatctgctcacccatgagtcctcactggtatagtgtgcaggtaatcagtacttcagctgggcagaactgccttgggtaattgcttaaggggaa

SEQ ID NO: 208416 - DNA, 378 bp, Homo sapiens
tgcatggaaataatgccttttgttgaatcacatcgttttaaaatgcttgtatttgtttttttatgtaaagaattttggaagggacataaaaatagttaacatttttcatttggttcattttgtaaatagattcacattacaaatgttttagctaaattgcatggaagaactttaactatatatgtcagtcttgactgactaaatttaacatcccagtacaattatttaaaatgaattaattaccagattgaatgaactatgaaaggaaataatttgtggattttgcagagaaatattcactgattagactctgaaattgctaactcaataaataatccagtgattaaatctttaaataagtaaaaaattcttcatgct

SEQ ID NO: 208417 - DNA, 424 bp, Homo sapiens
atttggtcctggtatgacaaggtacagtggaaagaaaaagaggaacatgccagccagtccccttaatattactgcagcttctttatcatcacagcagcttacatgccgaaagaccgtcttaaattaggaccagaaagggaagggaacattattaagagccatattaagacagagcctgaggccgggcatggtagctcatggctgtaatctcagcactttgggaggctgaggcaggtggatcacttgagcccaggagtttcgcaccagactgggcaacatagcgagaccttgtctctaaaagacaaaacaaaaaaattagccaggtgtggtggcatgtgcctgtgttcccagctacttgaggggctgaggtgagagaatcccttgagccggggaggttgaggctgtggtgagctatgatctgcac

SEQ ID NO: 208418 - DNA, 307 bp, Homo sapiens
ctaccgtcaacactggggattacaatttgacatgagatttagtggggacacagatccaaaccatatcagtcactgatggacgaatacagtgtttatcttaagaaacaagagaaaaagaagagcatctgaaacccaaaccatatcagtcactgagacactcttctcttttaatataggcatttaatgctataaattttccttgaagtcttattttatctacatcctatatgttttgatatgttgtttttattttttattttattttatttgacctatagactctgaaatgctggccgggtgtggtgac

SEQ ID NO: 208419 - DNA, 437 bp, Homo sapiens
acctaacagatacaattcagcacggatatctaagaaacacagatctgtgatgatctgggagagtcgggctgaatgcaactggattttgcattacatttggaaaaaaatgtgaatcagtcactactggaactgcacaaactggccactgacaaaaatgacccccatttgtgtgacttcattgagacacattactgaatgaacaagtgaaggccatcaaagaattgggtgaccacgtgaccaacatgcacgagatgggagcgcccgaatctggcgtggcagaatacctctttgacaagcacaccctgggagacagtgataatgaaagctaagcctcaggctaatttccccatagccatagggtgacttaccttgtcaccaaggcagcgcatgtatgttggggtttcctttaccttttctataagttgttccaagacacc

SEQ ID NO: 208420 - DNA, 991 bp, Homo sapiens
ggttgcggggagccaagattgcgccactgcactccagcctggcgacagagtgagactctttctcagaaaaaaatatgataattaaaagttgagacgttcttcgccgagagtggtcggggtttcctgcttcaacagtgcttggacggaacccggcgctcgtcctgcaccccggccggccgcccatagccagccctccgtcacctcttcaccatgccctcggactgccccaaggcccccgccgcagctccagcgccgcgtagccaccactgccgctgccgccgcctctccttagtcgccggcatgacgaccgcgtctacctcgcaggtgcgccagaactaccaccaagactcagaggccgccatcaaccgccagatcaacctggagctctacgcctcctccatttacctgtgcgtggcttactactttgacagcgatgatgtggctttgaagaactttgccaaatactttcttcaccaatctcatgaggagagggaacatgctgagaaattgatgaagctgtagaaccaacgaggtggccgaatcttccttcaggatatcaagaaaccagactgtgcggggagaatgcgatgggagagcgggctgaatgcgatggattacatttggaaaaaattgtgcattttgcattacatttggaaaaaaatgtgaatcagtcactactggaactgcacaaactggccactgacaaaaatgacccccatttgtgtgacttcattgagacacattactgaatgaacaagtgaaggccatcaaagaattgggtgaccacgtgaccaacatgcacgagatgggagcgcccgaatctggcgtggcagaatacctctttgacaagcacaccctgggagacagtgataatgaaagctaagcctcaggctaatttccccatagccatagggtgacttaccttgtcaccaaggcagcgcatgtatgttggggtttcctttaccttttctataagttgttccaagacacc

SEQ ID NO: 208421 - DNA, 414 bp, Homo sapiens
tccttgatgccccgtggtcaagtccctaatgctttgtgtgatcttagataagtcaattaccatctctgagttacttcagctttcaaatgagggggttgaacaagatgctatgtgggggttctttccagttccagaattcagactccattttcaagttgtgatcgggcggcggatgcagcatgaataagaattcagactccattttcaagttgtgatcaggcggcggatgcagcatggataagaattcagactccattttcaagttgtgatgaggcggcggatgcagcatggataagaattcagactccattttcaagttgtgatgaggcggcggatgcagcatggataagaattcagactccattttcaagttgtgatgcggcggatgcagcatggataagaattcagactcca

SEQ ID NO: 208422 - DNA, 221 bp, Homo sapiens
  misc_feature (7)..(7): n is a, c, g, or t
  misc_feature (43)..(43): n is a, c, g, or t
tggaggnatgacaaaccagcaacagctggccggacccaaggcnggggcagactggacagccaggcttctggcctcacttgcctgtgatggactctcaagaaaccctgtgttgcttatacaaacttaaaacaagttgaagattttatacttctgaatttcaaaacattactaagctacagcaatcaaaacaatgtggtacggccaggtgcagtggctcacac

SEQ ID NO: 208423 - DNA, 514 bp, Homo sapiens
gtgagccacctcacccggctgtgttttcatttctttataaggcaggtgatgttggctttacatatacagtagtaatttaaaattatctttttttttaagccaaaaaaggaagtcagttttaaagaaaaatataaatagcttgtacttggatgtggttaaaaaaaaaacacacacacaaacgttggtattacagaaggtttctgacttaattatttaggacaatcatctgttttatggattctatgttaaggatcacttattgcatcattcccattaaatatgtagtatgattttctgaatggcaaattgtagaagggaatctaaaccaaagggtaagcggtgggtagcagagtttgtaaaggcctgtaaagtgctgcccaagagaacttcctgcagtgataactgttgagcactcgaaatgtggctagttcaactgaggaactgaattttaaactttatttgattctaataaaactttaagttaggtaaccatatctggctactagctactgtg

SEQ ID NO: 208424 - DNA, 1022 bp, Homo sapiens
ggtcaagctggtctcaatctcccgacctcaagtgatccacccacctcagcctcccaaagtattgggattataggcgtgagccgccgcacccggccagtttactcttatgtagtaagagtaggtcagccttcctggagtctgttaaggatggaagtgggctttcaaggccaggccatatccagtcaggcatgcctttgagtgcagcatacagttggaaggactagggcaagaatggggagaaggtataggagcagttcctttatcttagtgggtttccagttggccatgccaggagggaataaagtaactgaactctggaaaagctacagaatcctgctgcagggggtacatttgaggagaagccagaacattaaatgaaggtaagaaaatgcaagaaagaagaagcagcacaggtgaatcagagctccttcagcaacatctgacaggggctctcttttgggcatgaagctcagggttcatttttaaagtcatgctaaacagaaactgtgaattcaagccaggcgtgttggctcacacctgtaatcccattactttgggaggccaaggtgggaggattgctgtaaccccggagtttgagaccaccctgggtaacatagtgagactctaactctacaaaaaatttttaagcaggaggctctcttgagccccggagattgagggtgcagtgaaccacagttgtaccactgcactgcagcctgggcaacagagccagaaccctgactccaaaaaaaaaaaaaaaaagaaagaaattgtgaatcccctggaggtgcttgttagatgaatggagtccaagtcctgtctcatagagattctgatcaggtctcagatggactcgtggaatctgtatgttttcaaatgctctagatgagtcttatgcttgggtaattttgagaaatactctgctgctagattatattaatcctgttgggtgggactctatgtcggctggctccctaggggtccagtgagtaatgcatcgtgaatcacttggatcatggtca

SEQ ID NO: 208425 - DNA, 1078 bp, Homo sapiens
ggtcaagctggtctcaatctcccgacctcaagtgatccacccacctcagcctcccaaagtattgggattataggcgtgagccgccgcacccggccagtttactcttatgtagtaagagtaggtcagccttcctggagtctgttaaggatggaagtgggctttcaaggccaggccatatccagtcaggcatgcctttgagtgcagcatacagttggaaggactagggcaagaatggggagaaggtataggagcagttcctttatcttagtgggtttccagttggccatgccaggagggaataaagtaactgaactctggaaaagctacagaatcctgctgcagggggtacatttgaggagaagccagaacattaaatgaaggtaagaaaatgcaagaaagaagaagcagcacaggtgaatcagagctccttcagcaacatctgacaggggctctcttttgggcatgaagctcagggttcatttttaaagtcatgctaaacagaaactgtgaattcaagccaggcgtgttggctcacacctgtaatcccattactttgggaggccaaggtgggaggattgctgtaaccccggagtttgagaccaccctgggtaacatagtgagactctaactctacaaaaaatttttaaaaattagccaagtgtcgtggtgcatgtctgtggtcccagctactcgggaaactgaggcaggaggctctcttgagccccggagattgagggtgcagtgaaccacagttgtaccactgcactgcagcctgggcaacagagccagaaccctgactccaaaaaaaaaaaaaaaaagaaagaaattgtgaatcccctggaggtgcttgttagatgaatggagtccaagtcctgtctcatagagattctgatcaggtctcagatggactcgtggaatctgtatgttttcaaatgctctagatgagtcttatgcttgggtaattttgagaaatactctgctgctagattatattaatcctgttgggtgggactctatgtcggctggctccctaggggtccagtgagtaatgcatcgtgaatcacttggatcatggtca

SEQ ID NO: 208426 - DNA, 554 bp, Homo sapiens
cggccgcacagcttctcctggttccacacattaagatgccataacgacactgcgtatattgagctgagctgggtggaggaggaggtggtatcatgtgagctgagactgaaagatgaagaagcagcctccagagatgtcaggtaagggttagtgggagcaggacctgccccaggcagggacctatagggcaccaaatgtggatgcgtgaggagtaacgagaacccagtgtcgggagagagagcgggagtggccagcaaatagtaaatgatgtggggccttgtaggccatagtgaggagcttggattttattccaagtgtagtgggaagccgttgggggacaactagagaagtaataaaatctggcttatattttaaatgatcatctcatctcccacatggaaaatggattatcgaaggctacaggtagaagccagtgaccactttaagaggccattgtggtttaaatgtgagatactccagccccatctcagaggcagatggagagaatggactgattcgagctcgtaggatttgctgttgggtttgatggggca

SEQ ID NO: 208427 - DNA, 425 bp, Homo sapiens
acagaggggtcagaaaccactgggcaagatggggggaccttatctgtctggctttggaacccatcagtcttcccactcatggatcccaaattaagaacccctggactaagtcacctgaagagtttccagctctaaaaccatatgattataagatacggttatttgtcctcccacctccccccacgcccaagtgattcattcattccacattgatccaacatgaattccagctcctgctagctgggcatccttcatcaaggtcctccactgctgaagcctcagttgccttatctgtaaaatggggataatgatagtctcttccttaaaggattattaaaagtcttaaaggagatagtggatgttaagctctgaactcagtgccttcctgacatgtggaaagttcccaataaatgcttattagcctt

SEQ ID NO: 208428 - DNA, 1131 bp, Homo sapiens
cacctcctggatccgaccacttccttccatcctcttggcccctacccttatccctcctggaccccacctggaccaaggcaatcatctcctctctggcccacacgcctccaaatttctccaagcaaccagagtaatcacctcaaaagagaaatcctaccatggcacctgcttgcacaaaatgcttcaggggctccctgctgcaattgaagacccaagtcttaaattagacatagtaacactatgtgatctggttctgctttctccacccctagcctctcatttcatgcttcagcaatccccagctgtctgagttcatccatgatggctctcacctctgcctctgccttctacttgagtaactcctacccatccagtcacctcttctaggaacctccttggatattcccatgaaatttcacacctgcaccaccaaccccagctgcccatgcttccatgtcccaggcacctctctggccttctccttcctatgtatcattttagtgtctgtctgtgtgtttttcttaactctttgaactcccaagggcaaggatcatatttatcttcagtgtgtgtgtgtgtgtgtgtgtgtgtgtgtgtgtgtgtgtgtgtgtgtgtacttttatagatacaggatcatgctatgttgcttaggctggtcttgaacttctgagctcaagcaatcctcctgccttggcctcctaaactgctgagattacaagcattagccactgtgcctggccaatatttaaaaacctatcatcatgcctgacgcaaagtagatactcaataaatgttgagtaaagttacaggccacttactctctctgaaaacttctctcttcttccgactttccaagaagtgtacaccaattcacattccccccagtagtgtgaaacagtgcctattccactatcctcatgaacattgggtattcttaaatttcttcccctaatttgttagggaaaatttgtatttccttgttgtttttattgttgatctttggttattagtgaagttgaatgttttttcaaaaagtttttcagtcaattccatttcttttcctgtaaactcaattcaggtgacttacacacacttacctgttttgcttttactattaaagttttgggtgtg

SEQ ID NO: 208429 - DNA, 422 bp, Homo sapiens
tctatcacttccccatacaaaaacctttcccacagacacctggccttccaacctacttctaccagtgtagaagcttttgtgcatacttttaacccagacagttcatgtctaggaattctcccaagaaaataaccacgatcactttttttgactgaaaagaataaaatggatctcggggtttaaactgttgatcagaaaggttatcacaagttcagtattattttcctgttcaaccaacagtgcgtaagtggctcaaggtgagttctattttcatgctaccaataaaatccagtgcatttatatatattaacataatttataactttattttgtaattttataaattattttttaaatattacttcatgtttacgtgcattttataaaatttatatataaagttacattttatacataatgag

SEQ ID NO: 208430 - DNA, 389 bp, Homo sapiens
tgtcagctgtgcatggtgcatgtgtgtgagcagcagggactgctggggtgagtccgagtgcccattatatctggccaaggacaccccatgaggctggggagccctgtttggcctggggaccagtccagcttcctgccctcctttgggggaggtggactggtgaggctgggggctgtcctgcccctttgctccaggaaggaagtttggggtgggtctttctcctcctgcatgcttactgacgtccttccttcctgagtgtctgaaaacccttggggagccgggggtggggcacacacatcctagggctgggctggaaggcacccagccccccatgcttcacctctgatcctctgggcagcctttagacaggggaggaccctcgatctgca

SEQ ID NO: 208431 - DNA, 372 bp, Homo sapiens
gctctcttcattgaggaggcctagaagcataacatctcagtacctatgggcattcctagtactgtgatcttaagaagagccaaggttccttgaaataataaggagctgaagtgggagtttcttctgtttgattacatgactggggaaatgaaagtacaagatgatccttgactacccttttgctccagaaatgtaaggaatgctaagaaaacagacacttttcagaagaacacaggaatcagcttaaccagatttcttttggccagataagatggaatttgagattgaaaagaaatgattattgtaatgagttataatccattaaaaatatatatatgtccatgttttcatactaataaagatgaatgaatg

SEQ ID NO: 208432 - DNA, 367 bp, Homo sapiens
tgcacccagcagatgcactatgaatttcttataaaaattgatttgtatttcctcttttaaccaaggtttcttttgttaatctgtatacttttccaagaggccacgtagtttgtggtagaattcaaataggaaaaatacttaacatcccctccatctgtccttctactcattcctaaaaatagaagtcaacttttcagactaagatttttaaataaaaaatttgggaaattggtcaattacatatgctctggtagagatagctaataaccccctggataaagcacccagacatactgattttcccaggacagttcctgtttacgcttagtatcccagtgtaatcagtggtagtggcatctttcactgt

SEQ ID NO: 208433 - DNA, 403 bp, Homo sapiens
caactcccaaggtccttggccctattccattaagaggcttacctaactttctctcagtcactgtgaggcagagttcgaaccagagccagaactcctagtctagttctctaacccttactgtctcacactgacactacgtttgtttttggaaatacaatatctgtctgaatttatgctatctttttagttaacactctgcccttagtaaatatagaaaagtaatgtattcttcaaaagtaaggtatttaatcaaggcttagagaacttttttcctagacatttactttgcctaccctaggaggagtcactaatcaatattattgttattaaagtaataggattaatacaagacccactttactgatctttcactctgggccagggagtatgctaaaccctttac

SEQ ID NO: 208434 - DNA, 365 bp, Homo sapiens
gctgtgtctacaataataatcgtttacagcataaccaggggaggaatgactaacttctcttcttatctacaagataatgaatagcctatttaactttttttaaaaaaaatcaatgtttgcgttgatttttgtatggttacaatagcagccaaagagaaaagttgcatggtaaatttgaaattgctgactgatttttataaatattgaagttcaaggagtgctttaccattaatggtcatatttattggggaaaacagtattggggattgacatctgaactgagctcatagaacatgtagcatagaaatagaaggagacaaggaaaatgacattattcccatggtgcaaggtgatgtttagcaggg

SEQ ID NO: 208435 - DNA, 462 bp, Homo sapiens
catcacaatacatgaaacatgttctggttatcaataggtactagatacattaacatcaaggggaagatcttcattccagtaacgaagtctccattctcttttctcctgccactaaactgaactcaaagatggccttttttttttctggatacagtgaatattctcttagtttaaaagggattgtcttccttctggagggtagttcagagagaaaaagcaaggctaagaaggtgaggaggacaagtcttgggcaagtgtgacttagtgaggagaatcatacaaacagacatccatttcctaaagtgtgccagaagcctcttttatctgcatcaggatctctttaaagatgtccatcttgctgagataaaaatgtatacatgtacccaaacattacactgtgccctattaatttgtacaattattattcatcaattaaagatcaaataaaacattaaaaatgtc

SEQ ID NO: 208436 - DNA, 349 bp, Homo sapiens
ttaagtttatgtttagcccgtagggtatgaaaccaggatttgatttctactcttgagcccagcagtctttccatttaaccatgttgcatttattttgtaggacatggaagcctttcaagattttttgcctgcaaggggagtaaatgataaaactaggccctttttggacccaaatgctcccaaccagtactcacacaaattggctcaagttcatgaagtatttgtgtgtttaatctattgaaaagagattttgcttttgactttgctaataagtatgaatagtgtatgtaaacatatgaaagcaccttttataaagttggcacttattgtttccaagcctcctagaagc

SEQ ID NO: 208437 - DNA, 230 bp, Homo sapiens
actttattattagcccctgttcccaaatttaaaatgggtccctatttcagggatattaagttttcttttctttcttttctttttcccttccctttttttccttttcttttcccttcccttttttccttttctttttccttccctcttcccttacctttttccttccttcttcccttccctttttccttccctttttttcttttctttctttcttttttttcttttttttt

SEQ ID NO: 208438 - DNA, 603 bp, Homo sapiens
gaacactgttaattcagaaagtgagtcaagtcagtctgctgggaaatcacaagttttggccacattcatgctgttgaaataataaaatgtgtccatgtgctaacagtgcttatgggagctactgccttgtcttgggcttgttggcaaatgacgtaatacaaaccagggaaatgcaccagcgtaagcctattatactggtatttttcagtgccaattccaggtttaagagatcatggtggaaagaatacttcagagtgcatatctgagaacagaaacatcccaagatcaaaagtcacaaatgaacaattatagattgtaaggagtctgttgtgttttctcagtgttcttgaaaacacccagtctttactcctttttctaagtaaggttggccctttcagcttctgataattatatattgagccatgttgtgactaggttgtatggaatgctagagctcctgtttttactctcatggttttgattggagttgaagcctctctcgtctggcttctattggtggcatttactaattttctggcctggtaaatggcttgtggtagctaagaatgtttattccagttttttggagacagggtcacccat

SEQ ID NO: 208439 - DNA, 449 bp, Homo sapiens
ctccggtcaccctgccaaaagatccttgtgttgccacgtaggaatgggctgcttggggacccagcgagctcccagggcctttcccgctgcttcctctacccctgtatttcgctctgctctctaaattgactcaactccaggtaaggttggaaacttctctcgaaaactagaccttcagtttccccagtgggggtgtgtgctcgggggcggaggatcttcctttcccatttccactgttggggcactcacagtatttggggtgtctcccaggtcctgcagctgtctgcttccttcagagggtcggtgggtcctcttgggattcctggtttgttctggatctaaacttaatgatgtgagcctccacacactgctcaatccatctgagtcggagctgcaatctagtcctgactcccatctgccacgatgatccacgatgctcttttttcaaa

SEQ ID NO: 208440 - DNA, 359 bp, Homo sapiens
agatctgttctaggaggagtaggaagctctggttgtgagtgattgaagaccactgcactgttcagaagcagctgtcgcatcctcttccgttcagcacctgattattatgtagctttatttaatggtgcaaaataccaagtagagaacaaggaacataagggcaaaattaatggctggatagctgttgtggctacgtaattctgatctaaaattagtttagaaattacaattgaaaatgcaattgtgaaatatcattttgaaatactttaaaatgctgcctagcctactgaaatgtttctcagttgaggtacccatgtaaaatgtgtgcgtacacatggacacacaaacaggctaagaaa

SEQ ID NO: 208441 - DNA, 1271 bp, Homo sapiens
aaaaaatactgaattcaaaataatgaactggtcaaccttgctcattgaactgtattgtttattgttaggttcaagctactctaattgaatttgaagaaagaagcttggtcatttggatgggaacttgaccaattaggcaacagaatgaaactgatgaaaaataaaagatctgtgtttccaagcatctacttactcttctaatttggataccaaaagtgctgtgaaatttattgcaagattaaaggaatcaacttccttggtatttggtaaattttataattatctgtgaaatttccaatatctttccagggacaaacaagtgctagttttgaatcatccaaccatgaattcttctgcctagttgagtatcaagaactggcctgtgccattcatcaaaccctttgaaaattcaaagaggtttactaaagttaaatacagcatgtaataatccgcaaaatagagaactcaaatgttaatgagctgtcatttagccttgatttttatttcaatgtgaaagtgaatttgtgatttacattctgaatactttcacatatttgtatcgtggcatttgaattctaacttcacatattttgttttatctaaaaacaagcaaaatgaaaaccaatatgacataaacaatgatctaccagtgtaacatattgttgtgttcataatcatattcaatttgaaaatttaaagtttcttgaaaaatatatatatatatatatatagccacaaaatatttctctattacttacattctataattctaaagagattttggcagttttcccataagaaactcaaactcaactaacattttaatttctagtttggggatgaattattattacaggagtctagttttcttctttcagattattaaattaagcaagtaataacaaagcataatttggttttgctgcagtctctttccaacaatttaaaatattttgggatttttgcatgtgaacagtaataatatactacaaatccctaattcaaggtttccctttccatgtttagtcatacatacccggaattggctcaattcacactcgttgggaccgggatataaggcgacacctacaccctccataaacgcgaatcaactaggagctccatgtcccataatgcatacggcgacgtatcgaaacgaaccaacgtccacacgaacaatagtagcaaccgctgcgcctagttaatccccctgatagaattaattccggcaccggagcattcctacacatctagtagtatcagctgtaccc

SEQ ID NO: 208442 - DNA, 728 bp, Homo sapiens
atttggccgtaattcttccttgagctaagcgaggcagaagctctgcctgcttccaggagtggaaggtgaagaatttgttcccaactccagttgaggcttttgattccctccaagcacttcaccaaatcaaagccagtcacagagaatggagacacctgcccagaatacccaccgtccagggagattagtgtgctttgttcttcctgaccgagactcacaaccacattctgaggtcactcgagtgcccctgtctcatacattccaaaggaagttgaagctatagagacaacagtcaggggctggtggtggtgcttttgggggtctaggagagcccaaggccctgatattttaaaatgtcctcctcggcatctccagcaagttgccactgctggtgagcttcactgtctgccccgttgacacgatgggtttctagtaggggacgccattgatggaaggtctgtgaagacaatgctcgccaaacccctgacagatgtcgtatcatttgactcagcaactcagggcggggcggggtgggggaaattcataacacaaattcatttatttcacaaatatatgttgagtttttaccatgtgccaggcatagtacctgccgagtcaagccctcgaggaaaaaaagcccttaattagtcaacgttcgagctcacattctaattctcaacttcgtgatttgttaatccatcttataggcgaagaaagcgaggtataga

SEQ ID NO: 208443 - DNA, 558 bp, Homo sapiens
ccagcttatttttcagcttcaagacaaggtctactgtttctacttctgtgtgtttctggatccagagaaaaaactgcccttcaattctaatctcacctcaaaaacagaatgaggaaactatttctgtgatcaagaaagctgaaaccaaaggcgtggtccatggaatagaccttgacctagtgaaaggagcgcctacactcaactgtatctctgctactcaaattcaaatgcctttctaggtctctttactttgctttcaagctcagtcttggtgtaaatctatcaccttcaatataactggataaatatgtaaactttcattcacactaataaacgtgaaatgtaagctctacagaaacaaaaagcacagtcacaaataaagcattaatctaatcattagatattaaatgcttgatataatactatcactgtgtgagattatttttcaaaatttggttttctcatctcttggaaaacaagaatttttttttttttttgagatggagtctcattctgttgcccaggctggagtgcagtggcacgatctcagctcactgc

SEQ ID NO: 208444 - DNA, 462 bp, Homo sapiens
caaggtctcactgtgttgcccaggctggtcctgaactcctgagctcaagcagtcctcctgcctcggcctcccaaagtgttaggattacaggcatgagccaccgctcctaacctagaaaactctactttacgtttggcccaccacgctttctgttagtatgatcagtttgtgatggtttgtccaggactctccctgtttcaaaactgaaagtcctgaatctatgagcactccctgatgctcacctccaaccccttcctccatcttaggtaaaccagattggtcactctactttatctgttgcttggtctatacataagtgggctctgcctgactgatacttgtgtatagtgtgacttggcaccaaacagcacagatttttcagagaccagcaagactgttcatagagatctttgtgcccactgaattctgtcaccatttttctctgttcagcaaacaagttct

SEQ ID NO: 208445 - DNA, 299 bp, Homo sapiens
gtacaccccatgaaccgcaggccacagtccatcatggctgctcttccaggtccagctccttcttgctcccgaggcaggcaacggtcagggcacagttgacctgattgaaagatggaaagagcctggctccttacttgtgtctttgatcactgcatcagatatttttatgtcctgtaataaatgttattggtcaagccattgttgttggggtttctgctatagtcatccataggcaagccttacccaagacattgttttgttttgtaacagccccagtccttaggggagcaaagaggcct

SEQ ID NO: 208446 - DNA, 239 bp, Homo sapiens
gctccctgcccccacgaccctgttccagaccccccagcccagcaacaataataaacagcaagctctttttctttatgacaccaaatttctccaagcccaacagctccttccatcactacctcagccatagatcacattaaaaactcacagagggcaacttaaacacatcacatttgtttctctctatattatttcaaaagtaacggcattaaaaatggattttactacagaaaataaat

SEQ ID NO: 208447 - DNA, 688 bp, Homo sapiens
aaatatcattgaacttgatggcatagcaaatgatacagcccagagtgaagcacaaataaagaatggttaaaaaaaaaagaaaatagtctcaatgagctgtgggaaaataataagcattgagtataatataagtacaattaatatcccagaaggacataagaaagtggagggaggaagcagaaaaaaaaaatcatcatttagaaatatttcaaatttgctgaaaacaataaacccacaaatccaagaaagtcagtgaacctcaagtagaggaaatatagaaagccgtatcaaggtacattgtaagcaaattgttaataattaagtataaagagaacattttaaaagttaacaaaaatagtaacaatagaattattaaaaatgatgtaagctataagacaaaagagtgacattcttaaagtactaaaatttaaaaatatttgtcaacctagaattctatctcaattcagtattttatttcttgtatagttcatttattttcctgttcttcattgcaacactaatgatttttttctaattaaaaagcaaaagactttttcaggtacacaaagctgagagaatttatcattagtaggccagcatatcaagaaatgttaaaggaagctcttccttttgttttcaggtagaaaacaaaatgatactgaatggaaatatgaatgtacataaaggg

SEQ ID NO: 208448 - DNA, 392 bp, Homo sapiens
gtctcctctaaaccagatcactcgtgggaagcatagtgggatgaaagcctgcattgttgacagcagtttggagattaatttacgatcctgctgtaatatctccggttttgctatacatctcacagtaaaataaatgctagtctggaagcatgtggaggtccccattacatcgtggctgaaccactgaaagcaattactgtgaagatcaggtgtgctaaatgcagaatcaaattaacagttcccctgtgcattcatatctaaaagcaaatcagagaggaagctttgaggaggggtaagtgaaatcttaaagtacagtgcctgcctctgaggttgaggctgcatggattaactgattttctctgggtggtatgtgtcattgttccttcctaatc

SEQ ID NO: 208449 - DNA, 249 bp, Homo sapiens
agcctcccaagtagctgggactggctttgggggaagaaagcactaagcagttgagatggtctgagtttcttgtctcacatccggcttgcatggagaacagaaagtgagtgccatgagcaagactgggcctgcagcccttggagagaatcccagcaccatgggcccagcaggaaggactgatcccaccaaaagcatctctggcccctcctggctctcagcctgggtagtgcctacccctcacagaagtct

SEQ ID NO: 208450 - DNA, 793 bp, Homo sapiens
ttattaggcattcaggttccttctgtgaattttgtttctatttttcaccatttattctactaagctgtttgtcttttattgttgacttgtaggaatgttctgaatacaaccctttgcaagttgtatttattccagaactcccagcctggagcctgtctttgcactttaaactccccttccaccctcctggtcctccaaggtggggggcatacttgaggatcactccttactctctgctcaggccaccatgagtccctagactcaggctgcatttcccctacatttcccatctgggtgggactgtagggcaggcacatttcccagaggcagggcagggctgtagggcaggcatttgggatagaagctgcctctactcccaggatagagcccagattccccagtaagtctgcctgtgcccaaggcctgttccctcaggtttagagacctgctctcctggctgtggctggtggcagcacccaagccacctgtgttgtaggtgggcccattcgtgacctgtcagacaaccaaatgagcagtctatcccactgcccacttcctcatcgcagggctttgggggaagaaagcactaagcagttgagatggtctgagtttcttgtctcacatccggcttgcatggagaacagaaagtgagtgccatgagcaagactgggcctgcagcccttggagagaatcccagcaccatgggcccagcaggaaggactgatcccaccaaaagcatctctggcccctcctggctctcagcctgggtagtgcctacccctcacagaagtct

SEQ ID NO: 208451 - DNA, 455 bp, Homo sapiens
tactaagataggaaaagttacattgatcaacttttcatttgtcctgtacttccctcttgttgcacttactattctgtgttataattgcttgtttatattttccatcagattgaatcagacttgtttaccacagttagctcagtggtcactcagtagttatttgctcatcaaataagtaaatatcattggatcctctttttaaaactaacctgagattccttggtacctggcctaattgtttcacttgctctgacttcagagattttggtacttgttctctcagtgtttcttttctatttttatgctggcatatgcaatatattctgtttacttttagctatttggaagccaatcaccatattgctaacctagtaataattttcttaaaacatcttagacatttttcgttctgtgcttaatcaaaactggtatcttttggctcactttcacggaaa

SEQ ID NO: 208452 - DNA, 935 bp, Homo sapiens
ggctgaagtcgtcctggctgcacggagcagcccagtcttgtctctgtaaataccgcagatttgaaaaatagtcctattggaacccgtcagagggatgtaatacaagggactgtgatggctcttgaacggagccagagactcttcctgaaggactggactacctccccgcctaggaaggttgggtaacccaaagttgccacatttctgggctgcacaccaaggagaggccccggccactccacacaggaaatgcacgtctgggcacctggagccgcaggacctgagccactaactgtccctggatcccttctgcttcagaggcaaggaagactgccggagtcattgcttgcctgctggcttcaccagcgctttctgtttttccagttctcctcaccactcttcctggcgcctttctctgcctcccgcacccctgcctcctctaaaacccacagcatcatccctcagaacagctggaagcggacagctgatccttctccttgctggtcccccagcccagaacacagcctgggacatacgtgcggagccacagtgtctgttggtctcacctgagagctgcttgtcactcccacaccctctttcaaggagaagctgtcagcattgtccttctgcagcattcaacaggggccaggcattgggttagggctgaaaacactgatggagagccatcatctttgccttctaaagggcttggactgtgataagaaggtggacacttgaagcggctgcaggaccggcattccagtgctggaggggtgtttagtcctccatcagctcagagaagtaaaggcacatttattggcagggaaaacccaaggagggcttctcaggagagacacacatttgactctgggggaaagtggtccatagtaccatgtacaaaggtttaatttgctaatacattttttcaaatgcca

SEQ ID NO: 208453 - DNA, 998 bp, Homo sapiens
gtcacatgtgtcggtgccacagactgagtcacgtggacaaggagcgggtgtgcatgctggggtggtgtcggcggctggcgtccttgcagccagcccagctagagtaagtggaagagaggacagaaggtgagatggatgcagaggcggccaactgtaaaggggagctgaaaaggtcagtcgccggaggggatgtgaagctggcagtaggagactgctaggcgccaggaaccaaggctcaagcttaggtctaagcatgaactggagcaggaacgcttcgccctttggaatgtgtgtggacaagaatgtgagcagaaagtttgccgacccctgctccaggttagagaagagcaacaagagatatgaactaaaaagcctgaaataaatgtagatcagtcacttgagctgacatatgaagcagtcaactttactctgagacgttttgtttgatctttcaagtttctaaaagtatttggaagcgggaaacactgttcttcatatgagataaaaggaagaaaaaaggaccttatagtcaggctcattgtgaaaaaactaatattaagataagctgaagcaatcaaatgagagcatttgcaaatcacttgttggaggtaaagctggaagcctatgtagttcaggaaaatggaagatgagatggctgagatcccacgaaaagaccacgtccaatagaaactgtaataaaacagagctcagctacaggaattttcaatgatgacaaaattttaaagacatgcttctacttttgtattgactaaagatcttcaggttgaaagtgtcaagatctgcttaatagcatatcctctgttgcaacattcaaaatcatcaggattcttagatctcagtgaaaaattgatgtttgaagaataattgaagtattcagtccataaggaagcctgaagctccctatacaccttgaatttcatgctaaataatctgcaagttctggaaaatgctgcttaactctagaaaaactgactaac

SEQ ID NO: 208454 - DNA, 664 bp, Homo sapiens
atagatcaccaggagaaatgaaaactgtccacataaaaacttgtacatgaatgctcattgcatataaggaatacatatgacatatgtaatctattgattattcttaatagccagaagtgaaaccgaactggtgaataaacaaaatgtagtacatccatataatgaaatactattcagttactgaaaaaagaaagaatttaaaagttgctacaacatggttgaacttcaaaaacattatgcaggctaggagcggtggctcatgcctataatcctagcactttgggaagctgaaacaggaacatcacttgagcccaggagtttgagatcagtcagggcaatataatgagaccctgtctctataaaagatttgtaaattagctgggtgtggtgatgtgcacctgtagtcccagctactcaggactgagctgggaagatctcctgagcctgggaagttgaggctgcagtgagccgtgatcacaccgctgcactccagcctgggcaacacagtgagaccctgtctcaaaaaacaaaacaaacaaaaagcaaagcctttttggaaagcagtaataattcataagtaacaacttggcaagattagtacttagaatagtgcctaacacaataagtgtttaatgcatttttactgaatgaataataattatag

SEQ ID NO: 208455 - DNA, 264 bp, Homo sapiens
atggatttggatcaacaggtatgaagccgggaactgagagtggagtccaaaagagcagctgggacaaagtgatgaatcttgtactcacattgagagtatgactatgctgaaattcttaaaagatacagagagcagggaaccaagagataacaaggaaaaaggcaagtttctactatctgatatggtagaaactatgtgatatggctcaagtgagccaccacatcagagaacccacaggaacaacacatgccacactgacagccc

SEQ ID NO: 208456 - DNA, 188 bp, Homo sapiens
gagagttggatgaaggatatatgagaactgtgaactatctttacaaattttctgtaactgtaaaattgctcccaaataaaaacttaaaactcgctgatagtttcagctacttgagaggctaaggccagagaatcgcttgaggccaggaggtcgagtctagcctggtcaacagagtgaggcactgtctc

SEQ ID NO: 208457 - DNA, 192 bp, Homo sapiens
atcatgtcagttgcataaaaccccactgcaaagaatccattttaaggtctagagaactccaaaccttgtttccttcacatttcttatggaaaaaacatattatgcattctcctttcttgccccaaaccaattacctaaagcaccccctcccccaatactgcaaggatttgtctgcaaagaatgccacagcct

SEQ ID NO: 208458 - DNA, 213 bp, Homo sapiens
taagtggtgtggaaggagaaagaagaggaaggggagattaagaggaggagtaggaagagaaggaagacaaggaaagagaccatttattctcttattctcattatttcaaagcagacatactaggagtagctgaatcttgggttcatcttccatgtttgcagtctgctaagagcccagcacgagcctgcagggctccaggctgggtgaggagac

SEQ ID NO: 208459 - DNA, 415 bp, Homo sapiens
caggctcaagccgtccttccatctcagcccctgaagcagctgggactacaggcgcacgccaccacacctggctaatttttgtgttttttgtagagacggggttttgccatgttgcccaggctggtttcaaactgctagctcaggttatcctcctgccttggcctctaaaagtgttgggattgggggcatgagtcaccatgcccggtcctggaatgtgcattttaatgctagaccttttcatgtaaggcattgattcttaaaaacttttcctgttttcaaagataacttatagaaaagtgtgcaaaacagaaatgttctgtttaatgaataattacaaaacaaatgctcaggtaactgcaatccaggtcaactcattttcttgctgctgtatatctcgatgggtgtgacattttca

SEQ ID NO: 208460 - DNA, 201 bp, Homo sapiens
agtgctgggattacaggcgtgagccactgtgcctgacccatatttcttatttttaacacaaagagaggtatcactactcagaggaaatatttcatgaactaaaactgtttggagtcaagtgagctcatctgtccttgtgcaaatacagctgtttcaggaggcaagctaggctaatagcttcagaaagtgaattggaggatt

SEQ ID NO: 208461 - DNA, 467 bp, Homo sapiens
tcagatgttttacaaagttacgcccctgtataaagatagagtacctttcggcgaggctgtgtaaagatgtacattgtgtatacatacactttatgccaactcttctgggatgatttttccaggacctctggaatttactttttgtattctaacctaagaggactggattctgttttacacagttgtctagtattttcatattagcaaacataataaattgagtttgttcagtgtgggcattattttctctggcatagataagctttattgtttaattagaaaagaaatgcagaaaaatattaaagattaaatcaaattaaacatcctcacttaaataatgacttatacctcttccttcagtaagtacataggctcctatttgaactaaaaaatgtaattctatatgctgtttgctgatagcttgctttttctatcaggggcgtaacccataggatccgtgacgccca

SEQ ID NO: 208462 - DNA, 356 bp, Homo sapiens
gcaaggtacattttcttcccgcaattttttggtttttaaaaatcagttgaggatacattgattttgtagttttgtgttgtgccaccccttcaagaaatcaacatgctatctaatgaatatagaaccctacaattttaagttcacttcagatgaacaaaacagataaacgctagctttgtataatgtgcatttattcgaagtaagaatttgaaaagactgaatagtggaaggttatctgtggtgattacgccactgagagaaaaggagtcctgtagagaccacccccattttaaggtttcacagctacctcacggaggttaaaaactatcctctcattttaaggatgaaatgtgcat

SEQ ID NO: 208463 - DNA, 280 bp, Homo sapiens
acaaaggataatccacatccagggacagtatgaggtatcatcacactgctaagaacagcatgcagtgtaaaacttacggatgtctgttgctgggactatgcatttaatgtttttggaccacagataaggtgggacaaagttcaccatttagccttattttctaaatattatgtgacaagacaaatatgtaaatttagcagggagctaggcaggaaggctagcttttcttgctttggtcaatgagatgtgatgttcaatatctgttgccaaaaaaaaaatt

SEQ ID NO: 208464 - DNA, 342 bp, Homo sapiens
gccatctgtgtctgatgttttctctgtgggaaggttttaaaataatgaattcaacttctttaatagatattggattaaaaggttttctatttcttcttctgttagctttgattaattgcttttttgaggaatttgtccaatgcaaattgtcaaatttagtgatataaagttgtttataatatcctcatatcattttaatatctgtaaggtctgtggtgatgtctcctttccatctatattattagtaatttatgttttatcttttttctcttgaactagtccagcttggaatttatcaattttattaatcttttaaaataactaacttttggggcctggcat

SEQ ID NO: 208465 - DNA, 158 bp, Homo sapiens
cccggcctctgcccactcctggggcctcatctgttcaatgagggggttggattaaaagagatcctctcacttcagagttcctccactgtcattagtctgggttccccgactcccgatccctccattgctcctctcattaaagtccattctaattaggg

SEQ ID NO: 208466 - DNA, 667 bp, Homo sapiens
tcggtaccgaccactcctatagatcagtgcctagtcttgcggcccagggttcactccctggctgcaactatattgagaaggatgtgaacagggtccccttgggaggagccactgtgggtcactgtggccacctgagaccagcagccaagaggggtctcttctaaaaacagcagcccagcggacacagaccagaaggccaccaggagcataaagcctttcttcaaataacaagttaagattgttttcagcaggaatccctttggcttaggaggttttcctgggcatcttgaaaaggctgtctatttttattgcaatcaattttgttaaagttggatttactaaagaagaagatgaaaattgcccatgttatctgctgcttgtcagaaacttcacattccaatttctgttctcggccggacttgaggccccaaactcctcctgcaccactgccaggaactaaaaatagctgccagtgaccatgtgcgctggcacagaggcccagcatctcaggatggctgcctcagagccccacccgaccagtctttcccaggtgggctcagcagagccctgggactcccccaaggccaggtctccatctggaaaataacagaagtttctcctgtgagatgagacagcattaaaacaataaaaatgactgggcatggtg

SEQ ID NO: 208467 - DNA, 235 bp, Homo sapiens
attacaagcatgagccaccgcgcctggccctttctttcattttttaagactgatttgtattccatcattagaatgttccataattggtgcaagaattcctttattgtaaagtgtttaggctgcctccaaattgaggctttttcccatggccaattataatactaataattttcataatgaagaaccggcatcattaggagctggaacaaattaggtttttaagctgcagctaagt

SEQ ID NO: 208468 - DNA, 1096 bp, Homo sapiens
tctctttgccagctgccatccacgtaagttgggatttgcttttccttaccctcctccatgattgtgaggcttccccagccacgtagaactatcaaccctgaggattgggaaggaattatacataccaggaggcaaggagcactgggggccctcctgggactgcctatcacagcgtccttaaaggacaatattcaaatgggaatagtaacagctccagtctacagctaccagtgtgagcgatgcagaagatgggtgatttctgcatttcaacactgaggtaatttgatctttatactcacaccttcacacttcaacactggaatgaagtcttagtaccatctaacctgactggtaggaccgaaaagaaacaaagtcagaggctcaggaggccaattcacagtgagagctagatcagcatcacccaagacctaaatgctgtccttgcaagctaagtaggagcaatttaacactgattccgacatcagaagactaccgtccatgcactattgcactctgtctacacagaagaagctaccagcctgtgctgacaacaactttgacttcattacaaatcactgctaaagtgatccatacttaccgaacactgtacacctatggctacaaccgtgggttaccaacttccagttcagtatcgtctcggtccactcgacgttatgcaacaacctcaggatccgctagcaggccacactgagcagataacagatcgtctccatgtgcctttagaagcagaatcctgacctaagctgaacacctcacacggtgctctacgcggcacatcccgcagcgcgcgcacaatccacaccacgacaacgcccaacagccttaagaaagggaaggcctccaaccccataagcagacaccaacgcagccacacaccaagcaaccccacaacaaagcaccactcccgaagacaacaccagaacacgccgacaacaacgtgaacccgcaagcgcggcacgcgacagcggcacgacaacagccgcaacaaagacaagacacccacacaaccccgcgaacaccggagcactacgacaccacaacgcaaacacgcaacaacaacaccgagagcaacccc

SEQ ID NO: 208469 - DNA, 419 bp, Homo sapiens
ttaccatgcagactatctttgagctgactctgcaggccagtgaccagggttcaacttgctcagtgtcatcctgaacctgcatgtgatggtggatgaccattgcaaaaatgcaaggacactatgccaggagttgcagccaagtggggccctctttgatgctgcaccactcacaatgcaacccagctatcccatcaccaaagtggacaccagctggggcataaaggctgactgtcctatcatgtgcttcaggccagctaatgtggctcttcaaactagggatgtgcacgagctagatgcgtgccgtgtcactgtgggtaacagagatgcaacctgccaaggtttgttggtcaccgtggtcaatggtgaatcatcacgctgaaacatcacctggttgctgctcatagtttgcaggagttgct

SEQ ID NO: 208470 - DNA, 384 bp, Homo sapiens
tcctggactcaagggatcctcatgccataacctcctgagtagctggaatcaccatacccagctaattttttaaatttctggtagagatggagtctccctatgctgcttaggctgatcttgaagtcctgcacccaagtgatcctcctgccttggcctcccaaagtgctgggattataggcgtgagcctggccctgtttttcctttaagtaatgtttgaataaatgaatgatggctataaaattttgttctacccatttgtttcaagaaattttaaaatttctttcttaactgctttattgacctgctggtcattcaggagcatactgtttaatttccatgtatttatatagtttccacaggtcctcttgttggaggttattggca

SEQ ID NO: 208471 - DNA, 283 bp, Homo sapiens
ttcaatatagattgcaaaataagaattaggaaagtgaatcttgactttttatttttttttaatttttaaaattttggggagaacaaggtcttactccatcacccaggatggagtgcagtgacacaattatagcttactgcagccatgatctctggagctcaagtgatcctgtctcttcagcctcccaaagtgctgggattataggcatgagccactgtgcccagccgtcatgactccttttaaagcttatttgtgttaataaagcctatttttattccaccta

SEQ ID NO: 208472 - DNA, 857 bp, Homo sapiens
caaaaaaagaaagatcaagatagatatgatgaagccggggagcttgcttacgacaggggagaataaatacttacagtacactctctccatttaagagacacatggagcacatgggggagggagacctgtctaagaactggatcatattaaggagaaaaaagcaactggaatctcaggcttcagttgttgcattatgctgctgaagcatagaggagatggtcctttgtgatcagagcgtctcaactcgtttctggcaagctaagatgaactttggggttgtggatagaaagataaactgatctgcaaaagaaatgcacagaagtattgaaggctagaagttggcagacaagaaatgaaaagcatttagagaatgggaggcctgtgaaggtagccacaacccaggacttaaggagaacacaggctggagaggaactctccaaagcagagaatgggtggtgggttttccaggcaatggtgcctagtggccagttttaagttgttgcttgtactgtgctcagctacactcccttcatgttgccccaagccctctctaaagtctgataaatgatccaccactctgcagcagtggtctttgggacaatgaagacacctcggtggtgggtcacttagggaaatacaatctggaaggggccaacagtcccagagacaagtggggtagcagaaatatgcagaaccaagagttcagagtgatggtcactagaagaaatgtggcctctaaggatgctcagacaagtggatatgtatagtaggaccctagctttaccatcctggcatatcattcccatcatagctatttcatttttttccaattagttgctgaaatgtctacatgttct

SEQ ID NO: 208473 - DNA, 127 bp, Homo sapiens
tgacggcggggaaaggataggtgggctgtgcgctagggctccggggggctcgagggacgatgccagactggatgcccctcctcgccttaaggctcttcccgtttccctgatccggcgcgagcgtgtg

SEQ ID NO: 208474 - DNA, 250 bp, Homo sapiens
gcctgcgctggggtcgctgcagtccccgcagctgccccgggctgcttgcccaggcgccccggccttattccagcctggggagcgcctcggtggggagcacgggacagcgagggaggccgaggcgggggccctgggcgcccgatatctccgaaccggggaggcggccccgattccgagagccggaacgcagggaaaggcaaggacggggcggccggcggaggggcgggcgccgctcatcagccacgccagt

SEQ ID NO: 208475 - DNA, 431 bp, Homo sapiens
ggtaaatccagagaaacagtagattagtggtagcccatgtcttgcggggcaagagaaatgtgaagtgactgttaacaggtgaggggtttctttttggggtgatgaaaataatctggaattagataatgatgattgtggcacaatcttgtggacacactaaaaaacactgaattgtgcacttaaatttactctttaaaaagggtaaatttatggcataggagttacatcacaaattttttaaaatgacaaatataataaataatgtaatttcaatcagaatcccaacagcattgtgttttggggagaagaggaaaaggggcactttggggaggccgaggtggtaggatcggttgagcccaggagtttgagaccagcctaggcaaaatagtaagacaccccccacccccgcaccccctaccaccccggtctct

SEQ ID NO: 208476 - DNA, 389 bp, Homo sapiens
aaaaacccacaggcatttcacagaaacagtgcagatggtaaagtgtgggcctcatcagtaagtggggaaatgcaaataaaacaaaactgagatcttattttgctcataggcacatatcagagggattaataatatccagtgctggccggggtggaggaaaacaagtacacgttagtaggagtgaaaattggtagtcttctgggagggcaacttggcagtatcaacaattttagtatgtgtatcatttgacccagaatatgtctagatagtctagtatctagactgcactaggtacacatttgcacctagagaaatgtgcaaatgtgaacaaagtaacatgtaacaatgttcactgtggcagtatttgcaatagcaagaaattagaaata

SEQ ID NO: 208477 - DNA, 770 bp, Homo sapiens
ggtgtggtggctcatgcctgtaatcctagcactttgggaggctgaggcaggtggatcatctgaggtcaagagtttgagaccagcctgatcaacatggtgaaaccccgtctctactaaaaacataaaaattagccgggcatggtggcagatgcctgtaatcccagctacttgagaggctgaggcaggagaattgcttgaatccaggaggcagaggttgcagtgagccgagactgcaccattgcactccagcccgggtgacagagtgagactctgtctcaaaaaaaaaaaaaaggaatataaaatgttgctcctaatgtctgctgttttaggtggaagaaatatcccaccacacagaaaagagatgcttaaaaagcaaacaccccctaccttctggagcattttagaagactctgaaatcacccagacatttgagtcgtcagctgtgaaaggcttcctgtactgtacagtgagaaattgtctttatgcttattatctcacttcataagaaagtctgagaataaataagaggaaaaatatgagggatgcccatgatgatcacttgagttgaaagactctgaaaatggaagtcattagtatctgaaaggctcatagtaaaatataaaatgcatgatatattttgacaagatattcaatgataaaatatagatccaacttgcaggccatttatcaacttttgtccttttggaggaaataaacttgtctactgtagacaagctggtatacagaaggagagaaaagtttcttcaatg

SEQ ID NO: 208478 - DNA, 217 bp, Homo sapiens
aactaaaattttagaatctgttcacactatagatctacatagccaacaaacagccatatggaagggtatgcaagatcatctcctggttagacccccgctcctgggggtcactctttgactggaaaagaatgttactaattatactcatgattgtcttatctaggatgcaaagccagaataagagcaacgatcgccacacctgacaaatctgttcctg

SEQ ID NO: 208479 - DNA, 418 bp, Homo sapiens
ccgcggctgatgggggcggctagtgccgccccgggcgcaggtgacactcgcccggccagggtttcctctggctggggagagccccgggagggcgagactcagacacctctggggcggaggacaaggcagcgatggcccgagagctgagccaggaggcactactggactttctgtgccaggctgggggccgcgtgaccaacgctgccttgctgagccacttcaagagctttctccgagaccccgacgcgtcccccagccagcaccagcaccgccgcgagctcttcaagggcttcgtcaactcggtcgccgcagtgcgccaggaccccgacggcaccaagtacgtggtgctcaagaggagatacagggaccttttgggggaggaggggctgcagcgaccccgcgagccgcccgcggccgc

SEQ ID NO: 208480 - DNA, 188 bp, Homo sapiens
tagctccaatcattttctgccttggtaacaccacacttgctccttgcttgggctgttctgtacctggaaaactcttttcacacccaccttcctggacagcttggggaacagtagtaccaagacacttttccaaacaacagcttgggcgtccagcgctctcttctctgttagtccctgtgcattatgag

SEQ ID NO: 208481 - DNA, 980 bp, Homo sapiens
gatgagaattatagacaaataatatgcagggaccccccctggattcatcttagtcttgagctcatatagaattcagagaaatcaaaggcagttgacaaggagggtcaaggctgagtgcaagtgaacgcaactactcctgctggcttgatccccccctggtcatgaatggtggctgcgcgcacatccacgaccaaggcaagcctgagagacgccttggactctagcacagcagagggaaagactaaggatgcctttttctcccctctctctttctaaatgggtagcctgcactcctctcaagtgcgagacattgggactcctttgatcctcagactctgaagaaaaaatacctggtatttatcagtagcaaggcttggcccagctagaagttggaagatggggagacctagtcagctggggaaaataacaactataatactatcctatagctagatctcttcaaccacagagaaggaaaatggtccaaaattccatatgtataggccttttttgccctgcagaataaccgcaagctctgtcagcaatgtataatagaccttgcacttatagcagtgatatccagccagacttaatccagacagaagggaaaaaacagtctgcctccttagaagaggagacagaggcccctgcaccagcccaggtcccagctcctcttggatcatctcgtcccccttatccaggcccccttttgaacctcatcctgttagaagagttcgacctggatgcgctccagcatcacttcttcctttacaggaaatgcatagtgaatatggtcctatcaaagtacaagtccccttttctttacaagatttgaggcagataaaaagaaatctaggacaattgtgtcgacctggataggtatattgaagcctttcagaaccttaatcaaatgtctgagctttcatggaagggtatcatgttacttctcaactagactcttagagcttcagagaagcagg

SEQ ID NO: 208482 - DNA, 144 bp, Homo sapiens
tggaaaatcaacttcagaaagaaagttatccactgtgagcagggcaggctcgcggcttcttggtccggagacccaggtcccactggcccactcacccttggagagagcttgccgaagctgggtgtccgatatcactccactcct

SEQ ID NO: 208483 - DNA, 284 bp, Homo sapiens
gtgtataccagcaatagttgagaatgaatagtttctcctttttttcctatcactttctgcctagattgctttgtgatggctgtgatcttcctttgcctctcttttctatctctccgctcctattatactccagccccaatatgattcttgagcatcacttttgtttagtcgttcctgtttttttccaaatccatgatgatatctcctattgccaactaaaatcttcagtttagcatgcaaatcttacaagtgtggacccagcctactcttccagcctcacatcc

SEQ ID NO: 208484 - DNA, 794 bp, Homo sapiens
aacaccagttctccttcaagttgtcatacctgaaactgcacttaaaatagtctttctgaggctaactacctggaaaaagatctttttggaactattttctacttttgaaaagaaagacttttcttgcttactttaaaataatgaactggctaatagatataacctaagacactttactttctattgaaaagagatccacttctttacaatacaagtgctataaaaaatagcacacaaaattaaaattgttcctccctcacacaatcaagttgttttcaacatgtcatttaacacctctgattttaaagacttgcaaaaagtctcagagcttgaaggtatgaagaatgataccatatcaacttatttttgtgtagtgctttctactttatatagcactatcatatcattcatttgttcaatgaacagttattgaacatccgctttgttctagcactgttctaggtatcaaacaaagatcctgcctggggagcaaacagctaacaatgcagtgaaggagaaatctcgagatttctccttcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgacagtgagctgcctgcgtcccaaagaacaggtctgcgcttgaaagggatttggtttggccccctcctttatttgtttatgaccagatg

SEQ ID NO: 208485 - DNA, 1281 bp, Homo sapiens
gttgcccaggctggtcttgaactcctgagctcaagcaatctgcctaccttggcctcccaaagtgctgggattacaggcatgagccaccatgcctggccaatttcttactgttgggtagtaagagttctttatatattttggatataagtgctttgttaggctgtgtgatgttcatacattttccccatctgtgccttgtgtttcattgtcttagcggtgtctttttcccagagcataagttttaaattttgatgaagtctgatttaccacattttttcttttacacatttggtgttcatctaacagctctacctaacccagaccttgccagactttttctgtaaaaggtcagatagtaaatatttcagccttgctgtccctgttgcagctctgccattgtagcaatgaaagcagtcatagacaatatgtaaatgaatgataatggctgttccaataaaactttatgaacactgcagtttgaatttcacataatttacaaattatcaattatattgtttcgattattagaaaaacaggtagtggattggccatggtttgctgattcctggcctgacaaacccaagttcacaaagattttcctctttgattttgttgtggtcgttgttccacaccttcttttttcactgtttccttaaggtagagtgtacatatttataagggtacatgtaatattttgatagattgatacagtgtgtaatgatcaaatcaggttaattagggtatccatcatctcagatgtttatccttttttttgtattgggaagataacaaatgttctagctattttaaaatatacactaagttattgttgactctagtcaccctactgtgcaaataaaaactgaaacgtattccttctatcttgctgagtttttatgcccatgaatcaacttgtcttcatccctacctgcttcccagcccccggtaaccatcattctactgcctatctccatgaaatcaacttcttaatctctcatatatgaatgagaatatgtgatacttgtctttctgcccttggcctatttcacttaacataatgtcctccagttctatccatgttgctgcaaacagattttattttccaaaccttaagctttatagatgacttcactttttaaatggctgaataatatcctcttgtgcatgtatacctcattttctttgatttttctttctttctttttaaatagagatgagttctcactatactgcccaggctggtcttgaatttttttgctcaagcaatcctcctgccttggc

SEQ ID NO: 208486 - DNA, 401 bp, Homo sapiens
acccaaatatccttcaactgaagacagataaaaatttaaatttaaaaacctgtgatacatccatccaatggaatattactactaagcaagaaaaaggaacgaactactgaagtgtgaaacgatatggatgcattaagataagtgtgagaagccagatggaaaaggcagcttattgggtgattccatttatttgaaattcaggaaaagaaaaaccacagggacaaagaacagatcagtagttgtctgcattaagggaagaagagtttgtggatttggctacaaagtggcagcatgaaggagtatctcgattgtgttcatgatgacacaactctaagtatttgtcaaaatatatagtgctctacgtcaaaaaagtaaattttaccctaaatttgaaataaaaa

SEQ ID NO: 208487 - DNA, 237 bp, Homo sapiens
aaatttgtaaataactgagacccaaacttacaactgtacatttttcttattgttgggctgttgctaacctcaattaagaaggcttgatgatatttgtaaagtgtcatcactccaccatggtccagtaacatctgatcactccaccatggtccagtaacatctgaatggtcaagaaatatctaaacgtatgtaccaaaaatttgtgtatactactgtaccaataaaccatttgtttcc

SEQ ID NO: 208488 - DNA, 562 bp, Homo sapiens
tgctgtttacaggataatgagtagcatagctattttaagtgttgaatgatttctataatacgaacttccacattcctgacttggtggcttcagtctcttgctgtatttgttcttcctccttttttggatttttagatccctctaagaatcagatgaaagaacatacacacaaaagacccccagtctctgtgcaaagatcccactgtaagaacccccacactaatggaagaagaaaataggatgatggagaaaaatgagagacaacaaacgagtctagacaagaagtcctggtggctaaaaatggggttaaacttaaagctagacttgaaaaaaaaattaggagggaataaagatttgtgtgtaagaagggaggtgcttgaggagtagggagagaattgtagttacatatataaatcacaattatttttataatgtcgagaataattttattctctcctgatagatgttctattcattattcatgtattcaggtttccactctcttacaatgtccctctgttgaaattcctacattaaaaatatgcctactttccacactgaa

SEQ ID NO: 208489 - DNA, 423 bp, Homo sapiens
aacacatacactcacgaggatcaggaaaaaaacagatgacaaatatatggcatcctgaggtttctaggtttgatttctaaatttgctaaaatgcctaatttttgttaatgtacactttgtccaccttctcatgccaattcatgtctcacatcctttaagacctagactatgtgttggacaagaagctgttaaaggaaaaaaaagacctagactaactcatcttcctcaaggaacttttccccacacatgtggccgcagcaattgtggccatccagcagcctcttcttgtttacttttaactgactctcatttcctactcagtaatatttgctctgttctattattaaattttgtaacatcagggatcaatctcaaaactttgtatgtcctcttacaaatacctagaattgcactgcataaaca

SEQ ID NO: 208490 - DNA, 270 bp, Homo sapiens
tgatcgaaagttctcccacaagttattaaccttgaattacacacaaaaggcaatttcactgattttattctttggcagtagccaccttaaaggataagaaaaatagtgaacctttcagaagtttttacagttcatctttggaattttttttattggaatctattcgggataccaatttttttaaaaaatgtaactatgaaagaaaaactaaatttcttgcttcttaatttatagttgagctcaaagaacacaggactggtatgaattatg

SEQ ID NO: 208491 - DNA, 242 bp, Homo sapiens
gaatttcatctaggttgaaatgaatcttacttttttttagggcagctaataaacagtaatttaaaatgtttaacagagtagtaaagcccaccagctttgtaatcaaacaaccaagtttgatttctcattctgccattttctgtctatattactttgggcaagctactaaacctctttaaatctttgtttcctcatctataaagtgaagataattatagtgcctttctcttagggtaattgtg

SEQ ID NO: 208492 - DNA, 531 bp, Homo sapiens
gaaacatggtgattaatccaagtatttcactgtacagttgggaaactgaggaccaaggattactctcctgttaagccctgtcttattgactggtctgtgggtcattttacttactaggcattatagacacagtaactggggcctgcaagcttttcaaatacatactgaaagtttaagagaaactgaaaacacacaaattggctccaataactgtcaaaaagacaaagaaacataatggttcttgaagttcaatatgattcaagcactccaaacaccctggcagctttgcaaatgaatacgtttttctattgtctaaggtttatgtttagccatacgtatctatcgaagcaacacaaactagaatcagctattgagaaaagacaagtggaagaaaagcagcagcagagggatagttttcgaaactgaaaagagacagaaaagatacattgatcaaattccccaaacaccccaatggcttagtgagcataatctaacaagataaatgttcacaggcataaacatatcattcta

SEQ ID NO: 208493 - DNA, 921 bp, Homo sapiens
aaaaaggcatctcactttaatagtaagaggccagaatatgatgctggcagcatgttgtgaggaaatgtattagatgaaagaagttaaattccagttctccttttttcagaaatgaggtataggggagagaaacacgtactttgaaagaattgacccagctgaattggaaaatgtgggaaggggatggggaagaggctgctccacctgagatctggctccaggacttacagcaaggggaacttgggcaagttacagactgtctatgcctcagtttctttatcagcaaaacagaatcatcccataaactataaggtcgatggtatcagcgggtccccaaactgactgcacatctgagtcatgttaacaaacacattccaggccccacctgagccctctgaatcagaatccctgtaaggaggatgatgaacttgaatttgcactgactttcccagctgtttcttactctgatcaacttgggggtaggacccattgagctgcatcacatcattccaaagccaaaacacaacagcaggacaagaatattttcaaggcagtctctaaagcagaggagaaactgttgagggaacttagaagtaaaggagatctggcttgctgggctccatttgaactttgagtacaacagagacatgagcccttcgggacacatgcctgaggtagtgacaatccaactttggaagagtggaagccctagtttcaaattcaagcatgctttgagtataaattaagtttacctctttttgcacagcaacatggccaatctttcctaagctgctcagcttacaagaaaaggaatcatactgctaagaattcaaacttcagcagtcataggtaagtaaggaagtcttataaacctattctagccacctaaccagaaactcgaaatttagcaggttctttcag

SEQ ID NO: 208494 - DNA, 468 bp, Homo sapiens
aggctgtgctgcttgccacatgtgtgaccgtgattgtgttactttacgccttagtctattttcttgtaagtagaaacagaaacacctacctcaagggacagggggagcgtgagacagagctggtatctatcaggtgcctggcatgtggcagctcctagcacacactgctccctcccctgctgttttaggctatctaaccatatgcccttctgtgaaaaataaaatcaaatgactccaagacaaagattctagtgacaatttactacagtcagttggacctaatgttattttgttagactaggaaatacaatcatatgtttcaaaatgcagagtgtgcaaaaagatgtatggtgacaatccctcccatcctgttccctgttacccactttccctcccacagagcaactgtctcaccagcctcttatgtagccttctagagacatttttttaaattgttattttgaactg

SEQ ID NO: 208495 - DNA, 532 bp, Homo sapiens
cagaatataacagtcaagaaagtagaattaggctgggcacagtggctcacatctgtaatcccaacactttgggaggccgaggtgggtggatcatttgaggtcagtggttcaagaccagcctgggcaacatagtgaaaccctgtctctactaaaaatacaaaaaaattagccgggcgtggtggcatatgcctgtaatcccagctactcaggaggctgaggcaggataatcacttgaacccaggaggtggaggctgcagtgagctaagaatgaatatgaatatttacttcaaactctacctctctcagcttactggaaaggacatttagtagttagaagaaatgtattttaatggtgggaagagtttgctaagaatgattttcagagtattttgtagggatccaacagaagactatatgctaactttctcaaaagagagttaagcatcagtcttttttctcttgtaaaggaatcaagccacaagctgtatccctgtcaccagatctatggaattaaaacttctctttgtatttg

SEQ ID NO: 208496 - DNA, 702 bp, Homo sapiens
gtcaggcatgatggtgggcacctgtaatcccagccactcaggaggctgagacaggagaatcacttgaacctgggagacggaggttgcagtgagccgagctcacaacactgcacttcagcctgggtgacaaaccaagactctgtctccaaaaaaacaaaggtaatatgtaagccaggcacagtggtgcacacctgtagtcccagctactccagaggctaaggcaggagggtggcttgaggccagcctaggtaacatagtaagatcctgtctctactaaaagaaatagataaaagtattatctatttatttgtggaattgtgaaaaataagaaaaatctgttggctaaaattaagcttttcaaaaatacaattttggccaggcgtggtggttcatacctataatcccagcaccttgggaggccaaggtgggaaggttgcttgagaccaggagtcagagaccagcctgggcaacatagcgaggtcccatccctataaaaaacaaaaaaaatatcaaggcatggtggcgcacacctgtagtctcagctacttatggaggctgaggtgagaggatcacttgagcccaggaggtcaaggctgcagtgagccatgactgtgccactgcactctagcctgggcaacagagcaagattctatctcaaaagtacaattttgcatatacaaagttggagtcaatgaccacaca

SEQ ID NO: 208497 - DNA, 760 bp, Homo sapiens
acaaacattcgccatgaccgtctatgctctttcttttccgcatgagatttggctttaggtaatcctgtggttcgaatgatatcactatttagtttgagtgcatcaaagatcatcttttcatctagtttgttagcttcccgacctctcagctcaaatacactggaagaagtaagggcaccattagagcataaagaactaacatccagtgttctgtgactgtagggtaaagttcgatctgtaaaatgcctggaagatagactaccttttgaaccagagtctatctgttcatttagtctaacagtatcatagattgaccgctgtgggacgtaacagtcttcgatatttaggtcctcctcttcttcacccttccctacacatgggggattctgacgtaaacagtctggtctgctgagtggcttccccattttgcagatagttaaaacaaatattgcagctcttgacacagataagaaataagataaagcatcttccaaaaaagtatacttctgaacagagctatggagtgtctttagcataaagacacatgctcaaataatatatttcataatacatgaggtgtttaaggtcatcagcagtgcatcagtataaatgcaactatccttttacctggttgattttaggatgattctaaacaataaagtgcatcaataacagagaacaaaaatctccctttgtccacctttcccagctcccaaagtccccgttcacactccaaaacacagaaaataaacaaacacac

SEQ ID NO: 208498 - DNA, 1160 bp, Homo sapiens
gagagaaggtgtctcaggtctcgggcgcgggagggggtggcggagaggacagggagattccccagcgctggctctgaaatctggggcaggctttccttgccttactgccaatcccaactgtgcctggtagggtttgtccctggcgtcaaaggtaggaacagctgagcccttagatgtacccctgacggcgagagcccaggagtgggcgtttcacttttcctgcgtttggggagtccctgaggctatgccctttgacctttgacatgtgtgcagcttctgcttctccagataatctggtattccatatgaaaaatgagatgagaaacatcaagtacaaaccagtagactatcaacaattgcgtgcattaactgaagcaaagaaattggcttctgcctctgcaaagctaaagatcagaaaagcaatgttgacttcaaagttatccaaagaacaaacactaataaaacaacacaagcaagtgtggtggcaggaataccagaggctgaatgaagtcagatgtaaaatggaatctgaaataaaatcccttctcaatgaagagaacattggaaatgaatgtctttgtgaccttacaaattttgagcaagagctatcagaacaacagtgcacatatcttaaaaatgtaataaatcctattcagcagctgagagcagatctaaaatacagacagcatcacactttgcagcattcacacccacatattgagtttaactccgtgaaagtattggaagaggttgactttgtgaagaaacaattgaaaactgtctttgaaagacttaggctggagcaacagagaatagaaaatgatctttcagactggagtataaagattctagatcattctttggaagaaaagactaacccgcttagtgaactgcccattgaattagaaagtttggaatgcccataccctgatttgaaatcttcaattctcagtgagttctataagtttacacagaaatatcagaagaagcttcaagactttaatctgcagttggaagacatatacaggtgataagataaaactgagtcctgtgtagacttttgacactaactttttatttttgtttgggatcactatacttccaacttactgtatagttactatgtaactggaatacaatcaataaatgtttagactgac

SEQ ID NO: 208499 - DNA, 1903 bp, Homo sapiens
  misc_feature (1644)..(1644): n is a, c, g, or t
  misc_feature (1659)..(1659): n is a, c, g, or t
  misc_feature (1661)..(1661): n is a, c, g, or t
  misc_feature (1668)..(1668): n is a, c, g, or t
  misc_feature (1679)..(1679): n is a, c, g, or t
  misc_feature (1713)..(1713): n is a, c, g, or t
  misc_feature (1749)..(1749): n is a, c, g, or t
  misc_feature (1799)..(1799): n is a, c, g, or t
  misc_feature (1810)..(1810): n is a, c, g, or t
gagagaaggtgtctcaggtctcgggcgcgggagggggtggcggagaggacagggagattccccagcgctggctctgaaatctggggcaggctttccttgccttactgccaatcccaactgtgcctggtagggtttgtccctggcgtcaaaggtaggaacagctgagcccttagatgtacccctgacggcgagagcccaggagtgggcgtttcacttttcctgcgtttggggagtccctgaggctatgccctttgacctttgacatgtgtgcagcttctgcttctccagataatctggtattccatatgaaaaatgagatgagaaacatcaagtacaaaccagtagactatcaacaattgcgtgcattaactgaagcaaagaaattggcttctgcctctgcaaagctaaagatcagaaaagcaatgttgacttcaaagttatccaaagaacaaacactaataaaacaacacaagcaagtgtggtggcaggaataccagaggctgaatgaagtcagatgtaaaatggaatctgaaataaaatcccttctcaatgaagagaacattggaaatgaatgtctttgtgaccttacaaattttgagcaagagctatcagaacaacagtgcacatatcttaaaaatgtaataaatcctattcagcagctgagagcagatctaaaatacagacagcatcacactttgcagcattcacacccacatattgagtttaactccgtgaaagtattggaagaggttgactttgtgaagaaacaattgaaaactgtctttgaaagacttaggctggagcaacagagaatagaaaatgatctttcagactggagtataaagattctagatcattctttggaagaaaagactaacccgcttagtgaactgcccattgaattagaaagtttggaatgcccataccctgatttgaaatcttcaattctcagtgagttctataagtttacacagaaatatcagaagaagcttcaagactttaatctgcagttggaagacatatacagaaactgtcaactaagtgaagaagaccactggatttaccaggctattttggatcagtaccctggagatctctttggaagaaggactctgtatctggacatgttacaaagatattttcctcacaaatctaggcatgatttggttgaacacgagaaatattgtgaccaatatcgctttgctatagagcagcaaaatatcctgatatcaaattggaataaaaataggaaagactttatacagaaggctgtgctgacactcactgaggcttgtgcaacacatgaaatggagagcatgttggctaaggacaagaaaaagcaacaggaattgtgtgctgatctgaaagccaaggttcgtcaatggcgagcccaccaagaagaggtagcaagactggaaatggaaatttctgccagaagaagagaaaaggaagaggagaaagagaaactgtggaagaagaaggaattgttgcaaagagcagagaagaaaaaaaaaataaaaaaatactgggccaagaaaaaacagaagtggcaagaaatggaaatgagagatcttcagcgtctagaagaactgaagaaattaatcgctgaacagtcactaaaagacagagaaagggttaaatatngacaagaattatggnanaggcgtntgatggagaanaaggaagtggccttcaagaagctcatgaagacanagagagagcacggcggctagaagcccttaggaaacnggttgctgtgttgctcaattgatcctgtcaagaatgatgtccagatacantggcctccaangctagaatggcgcttgaccttggcagaacgattcattccttccaaacggcctcttcactttgactaccttacatgaacagagaataattcctg

SEQ ID NO: 208500 - DNA, 483 bp, Homo sapiens
gtgctccctttatcccccaacagggggtgcagccccagctctgtggcttttgcatgcaggatctcagtgagtcctgaaggcactctgttcctcagatgccaggcagccacatctgtgaagctctcccattcctgaatttatctcacccatttagcctagactatgacctcttagagggcaggaactgtttgtttgtgtctctgttgatcctcagtgcctcttaattcagtgaacataagaatgaatgtatagtacttgaactgtttactatagagaatgaagttaggtgtttataagtaacatacatgttgtttttatcaggaaacagaattggttaagaattctatgcttttttttcaaatttaaacagaggaaggcaagaaacaactttactagaagtgggtaatttctccttgagcttaaggtgttcagcagtactagtggagtaaacttcagtattagaggtaaaaaattcatacccct

SEQ ID NO: 208501 - DNA, 182 bp, Homo sapiens
ccttgaaaagacagtagtggggaaaaaaagtaccattttaccatgtgcctcaagtttgtaatactggttgcttaaacacccttcccttccacggtgggattttctcttcactttcccttgggagtctcaaatgaataagttacagtttgacagcagcagcagagcataagattttatgaatg

SEQ ID NO: 208502 - DNA, 853 bp, Homo sapiens
taatatatgttagtatatccaaaataattcaaagctttctttgaactataaaatgccatgaattaagccttcgaattcaaattgaactggaaggcattctgatcttgttaaaattattctctccaattcacacttatctgtacaatgtacattaataactaatttgttagatgattaataccaataattaacttgctagaggacccaggaaacagaatatctgcaaggcccagagtagatcataaataaataggaatgcagacataagatgttcagttttggaacagtaaagctataatgagttttctttaaaatcaaacaattgtacaatgcattatagtctataacttattctgtagttcaaataaataaaactttcccctgttacagaaagacagccctcctcccagcaacatttcagactggatggattgattcctcacctgacataactctaaaatcctcactgaagaagccaggaagtcaaactgaggctgaagacctgaaagtacaggggactaaacccagaaagcagtatctgtagcaaaatagttgacctgatggctggttggctcccaagaatctctctgtcctggtagccagataaagtaatcaaagggtaatcctatacttggtaagccagtggagtacttaggaacaagtctcatgttaaagggcttcttccatggagtgtggttaatgtgcaaaaacatgtctataaataaggctgttaggacagactcaccataacaggaaataccagagagatcaagggtatccaggaaagtccaaagatgacaatgtaatacaaatagagcaattaagaggttacattcttgcattgtaagacatg

SEQ ID NO: 208503 - DNA, 636 bp, Homo sapiens
atgcataaactttcttatcagctatcgttagtgtattttttgtgtggcccaagacaattcttcttccagtgtggctcagggaagccaaaagattggacacccctgacacagaggctcatccttccctaaatcaaattcttgtttgttataaaccttttctgtttcagcctctcgtgtacccatttcacccttctctcaggcccctgtaccttcaagctatactctcctgaacttggaatacttcagaggctctaagtgtagtctttctgtcctcagatttcctattttcattgtccccatttcccatctcaatctttcattaatgtgcatcagatcttgtctagatgttaagaagaaaacaatctgatggaactaatttacctttatctgtaaatgactcatgagctcttaactcttcccaaggtttttcacattttttgtaagtctgtaagaggttgctattaactcagataattttaaagtaaaaattgcaggctgtgttgggggaaggaatttctagtcttatgcataaataagtcaggccttactaggattttgcccgtggtttcttcccactcctggaagtgtgttcatatgtgtattgctatatatgtttgtgtatgtgtatctaataat

SEQ ID NO: 208504 - DNA, 654 bp, Homo sapiens
gagtggaatgctgaatttggtattggatcagatgggtgacaggagtgtggaattttgcagatgactcaggaagaaactcgttttcacattggaggtctgctttcatccactctggatgacaggaaatagaaggaagtaaaattataaaagtagagtgaggccatgttgaatagcaggctgtgactggtggataaagttttctaagcagctatttgatttaatatgaactaaacttttagaaaagatattactggcaggttgattatacttttactatcaacaaagatacatgctgaaagttgttgtaagaactattcaaaaaagtggacgttcaataaaatgaaatgatccacataatagacattatattctcaaagtttccattctcccaactttgtatccaacattaagattgtgaattttgttggatttttctttaatccccttatccctaggcatttattcgtatctctaacaaaattgcaataatatttgtgaaaatatagctatggtacacattaacaactgcaaatccatttaccgttcttccttactgataaaattctagttaaaaatgctgtctcagactcccttgtaactagggtgaccacataagttagttctggccagtcagataaaagcagaagtctcctg

SEQ ID NO: 208505 - DNA, 705 bp, Homo sapiens
tctatagataagtaaaaagtagctttggtcctcaaagaactgatgttgtcctgaataagtttaaagaaagaaaccaataattgtatcactgtatattaaagagtaagttcagtgtggtaatgttttataacatgcgtaacttagctttagaagcattcctagagttgacagtgattacatgtgttttaaagtcgttagtttgaaacatttatgtgggagaagacattccaagaaaagggaatagtttatacaaagccatagaataaagagagaacagaatattcaaggaactgtaagagtttaatatattggttctactgggagcaagagatgagactgaagcataggcagtggtcagatcatgaagaaccttatatgctgtggtaaggaattttaccttttctgaagacactataaagctacataatatttttaactaggcatgatcagatttatgattatacatttatgtgaaaatagttgtggatagtgaattatgggatgatgattagactagaggcaaggagacagttggaggctactgcagtaatacaaatgagaaatgatattccagtaacagttacagtggagatggagagggaattaggcctttgagaagtaactcagagattgagacacaggttttggtggccagttattggtaatggagcaaaatgattcaaggacaattcccaggtttcttgc

SEQ ID NO: 208506 - DNA, 1269 bp, Homo sapiens
  misc_feature (369)..(369): n is a, c, g, or t
gtaaaatatgaaaatggtcaaccaaagaactaattatgtggacaatgtggatagtcttacttgcacaaattggctgtcttctagaacttgatatgctcatgattcttaaaaaagtgatacgtgaagatagccctgaaaggattgaaaagattctcgttgacagagtttcacaaacttctaaaagaagagtcaattggtaaaaaactaacacagatgaatcctcaaagatactactcatatggctgaaaaaatataaaaatatttattaggtacaaaagatttatgactatgactttgtgatccattataggtctagaattattcaggttatctcttagaacaacttatgcttcaaatttgagaggactntgacccaggagagcagcatataattttaaggaaagagttaaagtgaagttttatttctgataatatggcagggtaggatccataaataacctacatactacaatttaaaacgtaatatttaaagaactccttatgttgagacagtacaggagacaaagcctagtgctcactttacaagatgagaagtgtaataggagacccagttcctgtaattctgagaagacttaatgtacaggtaaactagaaataaaggtgtttactttctcagtcagtttcctggggatctgtaaggaaactcatacatccaaagcattagtgctgggtagagggaagggaaaaatgctgttaagaaataaccacatgtcagtctgcacagaaatttgcagcctgaattaatattttctgattttggctgacaaaactcaaacgaaatttaaaggaccctaaatgttagtgcccccagacctcaggaagaggcaaacatatattccctcttcaggaaatcaccttcagccaggcatcaaataattcttccagctaaaattccaaaaggaaattttgctgttaaaaattattaaaagggccaggcgcagtgactcacaggagaaaattattagatcctagcaacaggtacctgtaatcccagcactctgggagaccgagacgggtggatcatgaggtcaggagatcgagaccatcctggctaatacggtgaaaccctgtctctactaaaaaaaaaaaaaaaaaaaaattagctgggcgtggtggcaggtgcatgtaatcccagctacttgggaggctgaagcaggaaaatggcatgtacctgggaggaggagcttgcagtgactgagattgcaccactgcactccagcctgggcgacagagtgagactcttatctc

SEQ ID NO: 208507 - DNA, 289 bp, Homo sapiens
caagtaaacaaacacacaccttacccaggggcccagaacaaataacaaacaatcggggaagagggcatgacctctcaggtagattacctcctcattgtcatttctattttcggtagaatggctgatttaacaggtctctatatccaccggggactccctggttgtgctgatgtttgctgtagttaccagcctaatggctgctttgtaaattgtttggatttgctaataattcctaataaggataattaagcaaacaaagcaatgggtagagaatagagtgtgtaaatac

SEQ ID NO: 208508 - DNA, 708 bp, Homo sapiens
cgatctttttttatgcatctctttagagcaaacaaggcaaaaaagcaaaaagcttcaaaagccctggttgagggtgttcactactatgtagttgatcatcccccatccctgagatgctttggtaagtttctgattttgctattagtcttgctatgttgccctgtctggtcttgaactcctgggctcaagcaatcctcccactttggcctctcaaagtgttgagattacaggtgagtctcagtgcccagcccacagggtcatttttaaagcccatgttatcaaactgctttccggaaaagttgttctgattcttgttcctgcacaaggttgcccatctcaccacatcatcactgacactgagttatcttttagcttcacatagttaactcaatcaggtggacatcttctgattcctgccttcaagaattcagtctagtagggagctcagacctttctaatgggaagctgtctctagataatcatgcaaggggcactcacacttgaagagtgtagtggaggggagaggggccgcttttggcccttgcagcatcacaaacgactgatgccagaaggggccttttctcctgctttctccctgactcctgaccattcttctcacctctagcactgcttccctgcaagtctgttctctatagagccggcaaagtgagtgtcctaaatatgtacctgatcatgtcactttctgtt

SEQ ID NO: 208509 - DNA, 180 bp, Homo sapiens
catccaacaagtatttattaaatgtttattgtatgctgggtactatgttagctggaacaatttgctaaagggattttttttaatcttagaagaactttaatttatcaaatataatagcaggtcagacttagtcttggagtaaagaacatgtttttattttgttttaatgaagggcaagaa

SEQ ID NO: 208510 - DNA, 300 bp, Homo sapiens
gggtagaaggtaggcccccaaggtagagaagggtgggtgagacacttctattttttgtttcaagctgcttagtcatatctaacttttaaaattttatatattttacttggataaaataaaattaattgacataaaattaactggcagtaaaagatttggaggaaaattgagaatagtgctatgatgggtaaaatttgaatgaaaactggaaaaaagaaaagttagttcattaaaggcaggaaagtgaaaaaaatcaacacacctccccaacaaagaaagcaaattgaacaagcctgatgt

SEQ ID NO: 208511 - DNA, 389 bp, Homo sapiens
cggggtttcaccgtgttagccagaatggtctcgatctcctgacctcgtgatccgcccgccttggcctcccaaagtgctggaattacaggcgtgaaccactgcgcccaacctcttttcaacatttatacccagtcccttcacgatctcatccagtctcatagttctattttttctgtatttatttattatttatttatttatttatttatttatttttgagacttggtctcactctgtcgcctaggctgtgatcgcaccactgcactccaacctggttgacagagcaagaccccacttaaaaaagacatttaagctaggtaagaagggaagtgaaggctgggcacggtggctcacacctgtaaatcccagcactttgggagggccgaagc

SEQ ID NO: 208512 - DNA, 323 bp, Homo sapiens
gcctagatgagatattctttaacaagttgagaaagtttcttctctattccttgcttactgagaggaaattagctttcttttgattagtcattgcgtagtatatctttgttcatccttttacttttgaccttttcacattcttatatttaaggtttcacccttgtaggcatgtaagatttgcttttttgaaattaagtttttttctaattcaaagtatttactacactatatctaatgtgtttactgatagacttaggtttgaatgtaccatcttactaataattctttctatcggtttttctgttactgtgttcttttctttt

SEQ ID NO: 208513 - DNA, 256 bp, Homo sapiens
atgtagttgaagaatgatcagaagctgtaaatggaagacataatggaaaagaggactgtgaagttatataaatggtgtcatattcagggaaacatttccaatgctcaatttaggtaatgtgcaatgtctgattcattctgcaaaatgctactcaaaggctggaaaaaacctaagaagttagaactccaataatcaaaactagaaaggcaaacttgtttttctctatccctccaacatcctcctcccctcaaaaaaa

SEQ ID NO: 208514 - DNA, 420 bp, Homo sapiens
tggaatgaattgtttaaaaaactttcagagaaggatgaaagtgatgacagaaaataataagtcatagggaagaaaaattgatgtaagaaataaaatgaatgtcaaatatgaattctggaaggaaaatatggcaatgatatagaaccctaataaaacaaatttccagggttgatgaaaactcttagtattcagatggttccctttttgctgagcaatatatatgaggaaagaggtttttgttttattttgtgtttgcctcagcctcccaagtaactgggattacaggcatgagacaccatgcctggctaatttttgtatttttagtagagatggggtttcatcaccttggccaggctggtcttgaactcctgaccgtgtgatccacccacctgggcctcccaaagtgctgggattacaggc

SEQ ID NO: 208515 - DNA, 567 bp, Homo sapiens
tctccccaaagaacctgtatttgatattttaaacctatcttcaaatatttaaataccattccaagtaaaacaaatacccgcctagcatgatcagccattccttacagctgacattatgtgggtgagacagggggaggataaaaaaagatcagtattattgcaatgaaccaaagaaaccctgaaaagaatcctgtgtgccggaaacaaacagaagactgtgtgtgggtgttccagctcgatcacccttgtacctttaggcttccagaaggagggaaggccactggaatccttgcaaatccttgccaggatgctaataaggttattctgtaatcatcaaggtggagtcttcctttccgtttcattttgagtgtttaattttaacatgacaaagtaaattggaaaaagcatcatgaataatgtatactgctccgattaaacactgacagcagaatgatggacatactgaggaaagaacaattagctaattcacaaatgtggatgctattaggcttctatttccaaggctaactgttcaaaattctacacctcgaatttagccaatataaa

SEQ ID NO: 208516 - DNA, 292 bp, Homo sapiens
tacccgcaggtttgtgcctctctccatgggaaagcagagaataggaatgagttctatttctaaatgcaggacatagtagtgcccaacacacaacaagcactttaaaaatatccatgatactggccaggcacaatggctcgcgcctgtaaccccagcactttgggaggccaaggcaggtggatcacctgaggttgggagttcgagaccagcctgaccaacatggagaaaccccatctctactaaacatataaaattagccagatatggtggcgcatgcctgtaatcccagcta

SEQ ID NO: 208517 - DNA, 640 bp, Homo sapiens
tatgggggggtgattttatttatttatttatttatttatttatttatttatttattttgagatgacgtcttgctctgttgccaaggctggttgcagtgagcgaagcttgtgccactgcactccagcctgggtgacagagcgagactcatctcaaaaaaaggtgagtggagggtggctattgcccacacccacccccattttagttttctcttttcccctttaagagccagacattaaagactagcacattcagaataggaagcgactgcatatgcacatggacggtcaggctcagagaagacgtaagaaaacttaagtgtatacctcagattgatccttgacacagagatagcctataaaaaacaaaacaaaaacaaaacacacaataataaaacacaaaaaaccctggggaagggagagaattggatttcaagagttaccacattattaaattcaaatgtccaattttcaacaaaaaatcataaggcatacgaagaaaaaggaaagtatggcccattcaaaggaaaaaaatcaacagaaaatgtctttgaaaaagtcctgattgtggatctaatagacaaagatttttaaatagctgtcttaaagatgctcagaaaactaaggaatatgtggaggaagt

SEQ ID NO: 208518 - DNA, 213 bp, Homo sapiens
cttgaataaacctcacgtacacccgcgttagcttaatgaatggctttatgtttccaactgaaattcccgagcggcaacatttcaccagaaagtcttaggcactggatttttcacttgtaagtccaaaaagttgtgttcacttctaatttatgcttcttaaaaaaaaaaagtctttaatcaattagggtcagagagagaggctttctgttcact

SEQ ID NO: 208519 - DNA, 434 bp, Homo sapiens
atggatggtggcgatggttggacaatgctgtaatgtacttaacaccacagaactgcacacttcaaaatggttacgatggcaagttttatactatgtattttttaagcacacttttttgttttttgtcttttgttttaaggagcagagagtttaataggcaagaaagaagggggaagaaagaaagaagcagcttccctgtacacagaccggcggggggtaggggaggctccaaagccaggagacggaaccccaaacttaggtaatatcagccagctatattcaatggctggaggaggcgtttaactataatttttaaaaaacagtcaaataggccaggagcggtggctcacacctgtaatccgagcactttgggaggccaagacgggtgggtcatttgaggtcaggagatcgagaccagcctggccaacatggtg

SEQ ID NO: 208520 - DNA, 279 bp, Homo sapiens
aggtacaattcctcagcaaggagggagaacattgtgagctctggctctgtgacctgtgcagagtggccaagaagagccggagtttgttgggagaagtggcatgagaggaagcagcagtttcagatgccaaggaaaagtgtctgtgagcaccttccttgcaccctggggtgagagctgggcactgagctgtgaggatctcacctcatctgggcactgagaagggaacaggccagggagctgctggtggcaacagaaccggggctggcaccaggcagtagg

SEQ ID NO: 208521 - DNA, 455 bp, Homo sapiens
gctggaatagccaaggccagagcaaggctaataggtagagcaacagcttacaggtgtgggggtggcagatactggcacccttgaaatggattcctcatgcccacgcttcactattcttctctgtggctaggggatttatggataaaccaaaattacagttaaaaaccagccataggccaggcacagtgactcacgcctttaatatcagcactttgggaggacaaggtgggcggatcacctgagatctggaatttgagaccagcctggccaacatggcgaaaccccatctctactaaaaatacaaaaattagctgggcatggtggtgggcacctgtaatcccagttactcaggggctgaggcaggagaaccacttgaacccaggaggtggaggttgcagtgagccaagcttgcaccactgcactccagcctgggtgacacagcgacactccgtctc

SEQ ID NO: 208522 - DNA, 413 bp, Homo sapiens
gcacttgttctatattgttcttaagggtaaaaccaagttacaaggagacagcactagattattttcataaatggctgtgtgcacagtgattagatatctccagatggccaacttcatagctgaacaattctagttcttagaaagttcttgtattggaacaaaaactgccttcctataacttggtcctgatctcaagaacaatacagaacaagtgtttttgtcctcagatttctttcacatctaagactttataatcttgtcctttaaactgtctgtaacaatgaagtccaaaagagttttctgcaataattttttctatgtgcatattcaatatggttgccaaaaccatatgtggatatagagtacttgaaatgtggctagtacaagtgagaaactgaattttaaatttaaat

SEQ ID NO: 208523 - DNA, 187 bp, Homo sapiens
ccttactatctgatctgacaggacattccaggctcatgttttacattttctgttccaactctttatttttatttatttatttatttatttttgagacagagtctcactctgtcacccaggctggagtgcagtggcgcaatcttggctcactgcaagctctgcctcccgggttcacactgttctcctg

SEQ ID NO: 208524 - DNA, 725 bp, Homo sapiens
tatttatttttctatctagctaacagtgagtttgcatagcggtcactcaaaaatatttgcataactaattaagtgctcaaagtgacagagaatttttaagagaggaggatttaatttatatttatgtatttaaagtttaacctggaaatgaagggacctagagctgtgtaaaaggcctaattcctaaagaagtctgaattacagagagcataaacttttgttttaaacagaagctgaatttataacaaaggaattaatactgcactttatatattttttcccggatatctaattttctctaaagaatgttaccatctaaaatgcacataatacatggttttaaaatttacatgtggggatattgatttacaagacatgatatcttttatgtgtatacaactcaattgagcagttttagttgtattaaagggaaataattgagataaggaaaatgtttctctcttcagtattgaagagcatttaaaatatgtttgctttatgaaagctgaattgataatacttatacacattatattttattatgtatacctgagtataaatcaagaaactctaaatatatgattagtttggatagatgcatatctccatcctatttgtgttgtttgttatcttgagaaagtaaattgtgatttattaggtagatacctaataatctaatatattgtactcagtgtagaaggaaacagagaatagacaagagaatc

SEQ ID NO: 208525 - DNA, 443 bp, Homo sapiens
tgttgtcctacatagtgtcgtcctacttaggtgtcctacatagtgttgtcctacatagtgttgtcctacatagtgttgtcctacatagtgttttagatcaccccctccccaataaagctaaaactcacctgagttgtaaaaaactccagttgacacaaaataaactacgaaagtggctttaacatatctgaacacacaatagctaagacccaaactgggattagataccccactatgcttagccctaaacctcaacagttaaatcaacaaaactgctcgccagaacactatgtagggtcctctatagtgttgtatagcagaaatgggagttcttgggggtgagcttgtgaaaacaatgtccgacggaactaatgatgaaagggcctggaacccacatagttaggcacgccagaaggaaacctatgggaacattagcccctgct

SEQ ID NO: 208526 - DNA, 372 bp, Homo sapiens
gctacttaaagaagtttcctcatatccctggtttattaacgatttttaaaaaggaacatatgttgaattttattaattgctatttcagtatctactgagatgactaccagtttctctcctttatcaacaacattaattccttaggcaatttcttctttttctttctctctctcattctttctttctttctttagagataggatcacattatgttgcccagactggcctcaaactcctgggctcaagagatcctcctaccatggcctcccaagaagctgggactagatttctcaatagatggctttgtttttttgttttgttttttttttgagataaggtctcactctgttgcccaggctagagtgcagtggc

SEQ ID NO: 208527 - DNA, 279 bp, Homo sapiens
tggtgttgacagtattgtcataattatttctgctggtaatgttagaaaactttgcttccttgttttttaaatccaccctcattttttagacaacatttaactataaaacatatttattagttcggtttgttgaagcaaataaatgaagcaaatttgttatattttggaacacaatatatttttgcaggttacacaccccaacctccctctctctggtcttgtcattactgatgatctgttgggcctattggtgccaagtaagcactgataaatattagt

SEQ ID NO: 208528 - DNA, 258 bp, Homo sapiens
gctgagaagttccatgacctgccatctgcaagctggagactcaggagagtgggtagtgcaattccagtctgtgtccaaaggcctgggaaccaaggggcctcgaggtgtaaatcccagttgaagggcaggagaagatgagatgagatctgcccacgcaggcaggcaggagaattgcttgaacttgggagatggaggttgccgtgagctgagatcgcatcattgcactccagcctgggtgacagggcgagacgccgtctc

SEQ ID NO: 208529 - DNA, 352 bp, Homo sapiens
cctcatgataattgtgtctgccctttattgattgctagtgcttgttctgggtgttgtgctaagtgctttgcaggcttaaatcattacatttgagttgccacacagtgagtggcacggggtcggtgggctttaccttcattctgcggaggagaaaatggaacctgcaaaaggctgaatgacttggccaagagattctgaagctagaaagtgacaaatcaaaattcacatagcttgaggggtttgggcaatggcaatcttcatccgatggggctggatatacaggggcactgctaaaatcatgaggaaatgcaacctataggaaatgggaattgagtgggacacacacatgcat

SEQ ID NO: 208530 - DNA, 201 bp, Homo sapiens
tttgagccacttgtcagacgctgaactatgtgtctgcttagaacccagagcagaatttagagctcagtttgaaagcttgcctgaatgcctgtccgtgggaagagcagtcaccagtcactccaccgccctccagctttggatcaggccattttaaccttcactgtcttcaatcttgatacccacatagttcagcgtctttga

SEQ ID NO: 208531 - DNA, 279 bp, Homo sapiens
agctgtcttccctcagtcacgccttcctccccatgcaggctcatccagtccctctgccctgctccagtaccctctccccacctttcaccgtggatcaggcccacaaggtcacctagggacgttttatatccaaagtaacatgacaacatctcctcctgcactgtctagtcacatgctctgaggtcaacagtggtgcgtccactaataacacatttcatactattcagcacaactcacaaccctgcaaacatagattaaaggaaaaatgccggaatatgg

SEQ ID NO: 208532 - DNA, 351 bp, Homo sapiens
gaaggtttatagcatgtcagttatcatagcacttttgacaatggagacttcatatcttgaggtgggccaggtgagtgtgcaaaatgaaatgtggttagaatattaaggcttgtgacagagtacttggccctcaagctgttctgactcttccaaatacattcagttcaagaatgcatctctggtttctattcctggtcactcgggaaatgactccttgtctgtaggtatttgttttgcatgaaaccaattatgatcgtgtttctcatgtgtagacatcattattatgagtgcagttttagttcagtccagtatatttatgtctatggggctagtttcttgtaattcaaatta

SEQ ID NO: 208533 - DNA, 416 bp, Homo sapiens
caattctctatttttcaattttctgcaatgaataggaatcacattttaataagcaccaagaaccatggaataataactttctatttaaaaaaaacatatatatatatgtatttttaaaactaaatctcagtgatcagtattttactctatagtctcagttgctgaccaccagagaaactaaaaccggagtgaaacttttccaggatcattaattgaaagaacaatgaaatccctccttagtggccttgctgtcctcttctatgtactcatttttaccgtatatccttggggtgggttctccccagaaggaatcctctctgaatctctctataacatcagctgtatcactgcctgatctacaattggagcttgatacatttttgctgactgaaataaaagctgaattcatgccttcc

SEQ ID NO: 208534 - DNA, 410 bp, Homo sapiens
ttcctttgctactttataatcatgaaatagaaaattgcttttgggaaatttctgccagagtactgaaaagtttccactatgttaggaataaacaataacaaaacagtttcttcctttcttgtggaggaaaatgaacactgcattttgaaatttcttctgggagaggcacatcaccgtcactgagagatctactcactgccgcactctccattccattccttcaacccagaaagtgcctccaagtgaataatttgatgtgtgaaaccatctcttcttaaaagccaatgcttgcaagtaaatcccagccagaatagcttattacaaatggtatgatatggaaaatgaacactcttggagggccacactgtttcttaagtttgtctctttttgtaaaagctgtttcacaccct

SEQ ID NO: 208535 - DNA, 233 bp, Homo sapiens
cacagacgcctttccatgtattccactgcccccatcccagtgcagtccctttattaacctcctccttgacttcagtaatatcttcagtattggtctccttgcctcatctctctgctctcatctgttggcccacctcaaccatgcttactttatattcatgctaatccattctgcttaggctgctatctctgccagaaatccttcagggattctccacttagtttagaattttt

SEQ ID NO: 208536 - DNA, 423 bp, Homo sapiens
tgccaaaggtggcaagaatgcacactgagaaaaaacagtcccaataaatggtggtggaaaaactagatagtcacatgaagaagaatgaaactaggtacttatttttcactataaacaaaaatgaactctaaataaattaagacaaatacaaggcttaaaactatgaaactattagtagaaaatataggggaaatgcttcatgaaattggagtaggcaaagatttttcgaataagactgcaaaagcacagaaacaaaaccaaaaatagacaaatgggataatatcaaactaaaaaacttctttacagataaggaaacaatcaaccgagtgaagagtaaaatatggaggggttgttgcaaactatgcatctgacaatggattattattcagaatatataagaaactcaatgattcaatagcaaaa

SEQ ID NO: 208537 - DNA, 393 bp, Homo sapiens
tcatattataatccacataatgcatttatacatatatgttatagagttatatagtctctctgagtgtactctaaaataaatacatattatagtttatttttataagagtatgtattagtctgtttttatgctgctgataaagacatacctgagactgggaagaaaaagaggtttaattggacttacagtttcacatggctagggatgcctcagattcatggcaggaggtgaaagttacttcttacatggtggtggcaagagaaagtggagaaaaagcaaaagcagaaactcctgataaacccatcagatttcatgagacttattcactatcataagaatagcactggaaagactggcccccatgattcaattacctcccactgggtcccttcc

SEQ ID NO: 208538 - DNA, 508 bp, Homo sapiens
aaatcaaagattatcagagactttgttgctgtagattatatcggtaagaatgaaacactccattcttgcctggagagtctaagctcttttgacacagaagcagtctcaatttacaacccaggtgcagagagattcagataaggggtttctggatacaacaatccatcttcatcctaactttgtaccttgcaaagaaacaggagcctgggtctatttcataatccaaatccttatccctgttttctttgaacctttcaaacactgcttcatttaaatactatctacattccactcattcccaaaatcctataataattctatcttttcctttgctgagccacctctgctgtggtccacagccaccttcactgcattgcatccataaagtcaactgtatcagataacaggtttgctcctggtgttctcagggtgattgggctggggaaattctcatccgtttaccagaatagtatgaagaacctagacagaagccaacttagaagatcag

SEQ ID NO: 208539 - DNA, 733 bp, Homo sapiens
gggataaaatctacaaaaaaaacaaaagtggggggtgggaaaggttaagttatagtaaaagatgaaggaaattttgaaaggttaactgaatttactttctttggtataagaagtgacttgggtttaagtatctgctatgtcactaattagttttgagatcttggacaagttatatagcttttctgagcccgggtttcttcatctgtcaaatgaagataatactggttacaaagacaaagtgaaataataaatacaaaattcctgacgcatagaaggcattggataagatatgattattctgagtggctgggaaacaaatgggtcacctcttgtgttgtttacacctcagctttgttttctttggcccttgggatatccaaggtctccagagacccaagcaaagattacttaaaggagtcagttccaaaagggttgtctagaaagtacttttgcctgaggttaaaccatttttaggaagctcctccttgattttttgtcttcccatttcagtctactctagctctccggggaaagcaaggacaaggagagacatacagagttgaaaaagaaaaaagaaagaccagaccatcagacaactgaacatctgagacacccataaagcccttttattacctttaggccacatgccagtgtctgagggtataaattgtacttaaaattttataaaagtcagctcttccttgcttaaataaagtgtgccccccacaaacac

SEQ ID NO: 208540 - DNA, 344 bp, Homo sapiens
agggagccggctccggcctcggccatcccaggaaggggcttccacagtgcagcggcgggctgaagggctcctcaagcgcagccagagtgggcgccgaggccaaggaagccccaagagcgagggagggctgccagcacactcacctctcgccatctactcaggaggctgaggcaggagaatcacttgaacctgggaggcggaggttgcagtgaactgagatcgcaccactgcattccagcctgggcgacaaaatgagactgtctcaaaaaaaaaaaggagagtctatgctaatgtttgggtttctacaagttgtgggtaatggtaaagttgaaatcttacgtgga

SEQ ID NO: 208541 - DNA, 535 bp, Homo sapiens
acactagagttaccgcgaatgatccagagagtcacgagaggtagacactaatggtgatgtccctaagtagataggacagggcagagttgtctgcaagacgtggacaggagaagtggaagaagctgacaccccacagtcttccaggatgcccttgtgattcactggctaccaagaccaagactaacagttaatctccccaaggtcctaggcagaaaacactgaacccatctctttccccatctgtaaccaaagagaaaggtcttccacttccctgagcagaggttgtgagacagagaattaagcatgttcattagcatatatgccctagaaaggcaaagaggaaatggagcagtttctcagactgggcttggtagcaaaatgttcaatggaaaacacagtttcagaataagtatagaacatgctacattctaggcccttccccagggttcaccagctacagttcccaatcaaaggctctgacaagccctgctgcaaagtgatctgtttctttttaactcagctgagcttcatctca

SEQ ID NO: 208542 - DNA, 325 bp, Homo sapiens
aagacagactccagagctaaaatggctataaggatatctctacccactgctaatttagcaactgccaattttcagacttgctgtatgacgtgttagttgaaacaataactattaatttaagaaggaaaatttcctttcactgttgagaaaattaagtggtgatctttcaaacattataagatggaaaggatgtaatggaacaaaactcccaatggcctttgaaagtctaaattggaaaatgcattctcaatgtaattttaattaaagcaattgaatttaagcagttgagataaacaagaaattggaagccttaaaccttaattta

SEQ ID NO: 208543 - DNA, 178 bp, Homo sapiens
aggaggctgaggtgacaggtggaagcgtgagctggggccagggctgtgaggatggagaggaagggacgaggccgagagagtcggggtcagggatcagaagggacagactgggggctgccggccatgcagaagtgagggggataagacagtggtgctatttagtagacgaatcattcag

SEQ ID NO: 208544 - DNA, 449 bp, Homo sapiens
tatgtgttttgagtactcttaagcaaaggttggcaactaactaaatggtaaatgaaacagtctccagacttggatgacaccatcagaagtctggactgcttctccattatactttaagaaagacaatacaggtaaatgtgggagagaacaccgtgctttggctgaatgagggactgcctctgtttctgggaatacatttattatgtttgccttttctttctcagagtgtggatgtgcaagggagagtgtgttagatatgtagttttgatttaaagcacagtggataagagcaggcttagttttatatacgagtggcctcagcaggtgataaattgtttttgactttcatcagttgccaacaaataagaaaagtgagagatttatcatgtatgtaaaaactgtagcaacattctctatcatgtaaaataaaatttaataaaatagcattt

SEQ ID NO: 208545 - DNA, 594 bp, Homo sapiens
tagcagagaatcaccaacttttcctttggttgttaatgtttcaccatcacagtttataaagtggactgtcactttatcttctgagttgctccgcgcccctgccgacacgctcagcggccggctcgcctccgcgctccggcccggtccccggctcctcagcaggccgctggctccagcgcgggacccggcgtggtgcagccaccggccggccgggtcgccgaggaccgcagaagcggcgcgcagcagccgggcgcccccagcggcagccatcgcccgcggtcgggaactcaaaaggaattatttaaagatagttttaaccttgtgacatttctcatttgcgttgctgtatacctagcctatactatttgtagaatacttggcataaacgtacatatgtcataagcattgaagttttttgttacatctgggattttctggcttgagtgggatgtgaattcataaatgtgatggttttgtgggggaactgagagaacttggcataaacaggtatacttactgatcctctctggatatttaagtgtggtaattcattcttatcactcaataaagtataggcattataaaaaaaaaaaa

SEQ ID NO: 208546 - DNA, 193 bp, Homo sapiens
ttaaatatcaccaaaataaatataagaactcagagaactacaaacaagcaaatcacaagaggataagaagaaaacatacacgaattatacggaggggaaggcctagatactaagacatgggaagaaaccaaaggcaaggtgagtagacaaatttgaataaatatgcaggatctagatacatcaattatcattg

SEQ ID NO: 208547 - DNA, 649 bp, Homo sapiens
tagaggtgaccctaaataggccaatacagaaaaatacggcatgatattaagaaaaaaacaacagcaagttgcaaatcacagaccaaaatttacatatttaatcccatgtatttttaaaatattcatgtcatgatagttaattttatcgttaatgtgactgaattacaggatgtccaggtatctggttaaacataattgctgggtgtgtctgtgagagtgttttcaaaagagattagcatttaaatctgtagactgagtaaagaggattactctgcgcaatgtggatgggcatcatccaatgcattgaggctctggatagaaaaaaatggtagaggaagggatgattggcactccctctctgcctaaatgcttgagctggaacatcgatctcctcttgcccttgatactcctggctctcacatcttcagacatgaactgaaatctacattattggctctccaggtctcaaatcttcagaatacaccactggccttcctgggtcttcagcttgcagacagcagatcatgggagccctcaacctccataattacatgagccaataccttataaattgctttagtgtatacacacacacacacacacacacacacgcaaatcagtaaataccatatctgttaatctgtcaccg

SEQ ID NO: 208548 - DNA, 553 bp, Homo sapiens
gaacgttaatggactgtatctccttgtgaggtcccatcaggtgtggcccgtgtcggccaggtggtttcccaggctcccacctgggggcagcagcaacacgacatcctaacgggtgggtgcctgagttccactagagtgaggctagactctgtggtctttggtctagcctcatgaccatcgctccatcaccggctgcttgggacagccaggcagacactgtttgggaaagtgttccagcatagtcctgtggataaccctttttcctttccccaaacaccagggtttttggaaccatcacctgggaagatttaggaatggctccctggtagtctcctaacagcctaaagaccccatgggcttttcttggcggtgttgcttatctgcatgccaaaggaccaatcctgtgggcaaggggctcgatggccccacctggaccctagacaaaatgaacgtactagggggatcccagcactggggagatttgcctggccttcctgggggagcagtatggccgcccacggagccggctgctggtctccctttcccataacct

SEQ ID NO: 208549 - DNA, 840 bp, Homo sapiens
gagggtggagggcaaaggcatagtttgaaaatgcataccctcttcggtattctaatatctctcctgatggggaatcactgattgacattgtctcagaaatacattttctgtcctttaaaaattctgaaataatatcaaatttttctcccctcagaagcctacgccaaataagtgctgtaatcttagtacaactttgtagtacagtcagactcatttgttgatgtctgactggctgagtttttaaaacctattattcccccttccgccccatatctggacatgccagtaagaaagctcaaatgcttccacctttgtgcctggtggaagttcaaaccacctaagaatcctcactgcagccctacctccaagccactaggaaaagccaggctcctctactttccctgctcaagccatttctggacctgcttgagaactcgctgctctctgtaaaagcctcgtgtgagtgataaaccttttcatatctatttggtcctaatgtaacatcagtcctaacacctaaaccaagttttgggtaaggggttcaacctctcctctgtgggatgactaaacactttatgcaacaagcagagggtctaggagatgaccactaccactgcagggctctcctcttgctttagtttgctaactgactcttgctggctagaattttttttttttttttttttttttgtcactgctggcaagctcatgctttgtgctgtgctgctttgtactgcgttcactgagccttaccaagcttctgttatagatgtgctcagctaagttggaatttttgataattggcatttaagaacaagaataaagtggcatttaagaaca

SEQ ID NO: 208550 - DNA, 500 bp, Homo sapiens
cagcctacctataggagtgtgcctctgagtgaaggtaaacagtggtgtgggcagctgagccagggctacgcctgcaggtgatggcctagtggggctgtgacccatctggcctgactgggaggaggaagcagtgtcttctgtggtgacatcctctctgcacagacaagagtcacccagtccagcaggttgagagtcagcttggggcccctcggcagagtggccagtgacaaaccatgagaccaccaaaacatggacatgcctcagtttgtgatagtggatttcaagaatgtagaatggatttttgtggttgcccatcccacactgggcactctttctctctcagtgactgtctttcatcccatttgctgagcagtctggagagtcacttgactccgattcctggcattgccattacgagccccatgtgttcttaggcacatcatttaacctttctgagcatctgatttttccattaatcaaataaagaaaataactcatga

SEQ ID NO: 208551 - DNA, 557 bp, Homo sapiens
ctttcaattaattatggagaggcaattgaactgtactctataaacttccatccatgttagctttgcactctaatttagattgttctgtctcctcacctgcagcagttctagtaaagaggattttaaaattcagcaagttcattaggatacttcaacatcagcaagtccacgaggatacttcaacagcagacaaccagtgcaaacactgttgaaaggagctgttacaattcttctctgttttctggcatatagattttggatattgtggcttgactctgaattttctgaatcctcttttgcatttttaggcttctccttgtgctttcatatgtacattaattatttagatagttctgtattacacttttccttggtgatggttaataccctttgccattatctttatgacttctagttggttttaatattcacttacttaatcttctctttcttgatttacaattttgctttatttcttcataacttggtcaaaattttcattcaattaacaaaaagtgtgtttgaatagcgtttattatatagagaggcagcaaagt

SEQ ID NO: 208552 - DNA, 410 bp, Homo sapiens
ctttcaattaattatggagaggcaattgaactgtactctataaacttccatccatgttagctttgcactctaatttagattgttctgtctcctcacctgcagcagttctagtaaagaggattttaaaattcagcaatccccaagttcatgatatagggttgtcaagatttagcaaatacaaaaaaagtaagatgtcaggttcaatttgaatgttagataaacaatgaaaactgtttcaggataaggatgccccacgcaatatttgggtaatatactccataagatatccttatcctaaaacattatttgttatttatctgaaattctaatttaactgagtatcctgtattttatctggcaacttatcctagtgggtagaaatcagactacctatatttctgaaaccatct

SEQ ID NO: 208553 - DNA, 383 bp, Homo sapiens
tttcggatagctacaaagaatcattcaatggagagctgaacctgtggtctagagcagtgatccccaaactttttggcaccaggttttgtgaaagacaatttttccatataccagggtgtgaggggggatggttttgggatgaaattgttcatcagacattagattctcataaggagcaggtaacctagatccctcacatgcatatttcacaatagggttcatgctcctgtgagaatttaatgctgtcattcatctgacaggaggcagagtgcaggcagtaattcttgcttgcctgctactcatctcctgctgtgcagcgcagttcctcacaggacacacattggagcagtccatggcctgggggtttgggatccctggtctaa

SEQ ID NO: 208554 - DNA, 742 bp, Homo sapiens
caggtatgagccaccacacccagcctaaactccttttctttatgaattacccagtctcaggtatttctttctagtagtgtggcacaagcctgtagtcccagctactggggaggatccgttgagcccaggaattcgaggctgcagtgagctatgattgcaccactgcactccagcttgggcaacagaaccagaccctgtctctaaaaataagaaggaagaaaggccaggaggattataggccatatggtgtacttcatcttactgggagatatctggtagacctgccacccgtggtgctaggttgatccatgagggctctaaggtaacccctgggatgagagatactgaggtccttttcagcatcctattactcagcagcctctcacctggtggtcttagcatccattggttatcattgtctgaatcctttgtttcactcgcggttgcaattttatgctttttcaagatcctcccttagtgaagactctgcacccccacttcccttcagcatcactggactcagctttttaaagtacttggattttcattattatcttagataaagccaaggtttcatttctttcagagaaaggccgcagagggaaacaaattgatccgtccatgtttggagcatggctattcttaggatgcggggatggtgtttcgactctgtgaagctcctgggattgtgtgcacggggtggggtgtgcgtgtgtgtgcgtgtatgtgtgcatgtgtgtgc

SEQ ID NO: 208555 - DNA, 416 bp, Homo sapiens
ccggctgcaggtttaatatgcctagttggtggcaagtggcacacctgggttggggtggggattgaggaggaagactggaatttcaggtctctggcagcaggggtggggtggctggggaagaaaggggagagaatacacatgggaagtaggatttgggctgaggcccatggatgatgatgcctccaaagctgaaaggtaaggcctcttgcacaggtcttctctcctggggcctagacatgcctgctgactacaagcacccagtttacattcttaatggaccaaatgatttgggagacatcatgcttgctctgaggctctgtttcccttcctctgaaatgaggggaactttttctgccccatctcactctctactgcctcatattctgtctgagcagattgaataaaataatgtcagg

SEQ ID NO: 208556 - DNA, 164 bp, Homo sapiens
catgtgtaaaatagacactggtagacctaccctgggggctgttatgaggacccagaaaggtttttcacatacggcatctgccaggtagtaggtattgagtaaatggtcgttgttttcacataatttggaagagggaggcagttgggagatcagggatagcaaca

SEQ ID NO: 208557 - DNA, 160 bp, Homo sapiens
gggtctggcactcagtgggcccttgataaatacttgttcagtgcgtggaactggataaggtggcggggatgagttgaggttgggggcaaaggggataggcctgactcacgctaaccactctctgagcccaaaccaagaataccccataggaagccagtgc

SEQ ID NO: 208558 - DNA, 465 bp, Homo sapiens
ttcagcagaaaagccctcagcactggcagcagaagcccctaaaagtatcttatgaaaataaaaaacaagtgcctactgccttccaacccagccacaggactttggtgttctgctattaactccatttttcccataagccctgagagttttagcaacagtttcgcagagcaggaggtttctgaggaatgttaccacgctgtggcagaaacagccacactagtttagtatctctcttctctagaccgtgagctcctttagggcaggaactgcatcactcttactcggcactgtatacccagagcctagcacaagggctgacagataaagtgtcttattgatggataagttacaaaactgacttgaatggaaccaataacatctcccccagcagaaacaggactaaaatcctggatgaacatcctgctcagaaaggaaggacactctggcctcagggcacactgctcc

SEQ ID NO: 208559 - DNA, 518 bp, Homo sapiens
cttgaagatatggaatacttcctgcctacatcttcaactcagagaccgccaggggatttcagtgtttattgcttttttctctgggtttggaacagttccgaccagctactatttgaaaaatgtagaagtatttttttgcttattatcaaaaggagaatgtagttttcttgcaacaaaatgagaacttgatatctttcttgcctcgagggtgtgtgttgggagacgggggtggtgttcagccttctcttcctccacctctgtatcctggtagccagaattgaagttccaagccacaccaaggagggtggctgcctttcatgaaaggcagacatgtagtaattacctttttgcctatctgccgccgtccccttgtgctgagggggttcccttgccgctctgtctgttgtctgcacactgcatttgtttgtctggaatgcagaactccttgcacttgacaatcactacagtctttctgctttttctcttaaacagcttttttaaagcacccagagaccctt

SEQ ID NO: 208560 - DNA, 491 bp, Homo sapiens
gtgctacctaggagaatatacctgcaacataaaaaccaataatgcataaagagtcctaaatccaatacggaaaaaaatggtaaaggatacagagaaaatccacatgaaaaaaatatacaaatagctaataaacatgagactacaatttctgaacctatactcaatgaagagatgacaactttaatactcaaagaaatgcaatttaaaacagaaaatgagttttcacctatacctaggcaaacgtgaatactaaacacagaccgcactggtcaatatgtgaggaaatgggcactagctcctactgttgctttaaaacaattttttttaaaaaacctggtgtgatcttttcagaagcaacagagtggtatcaaatttaaatatacataatgtctgatccagcaatttcatttccataaatttattctataaaacatacaagtatcccaaaatatataaaatgcgttctgttcctagtccatggagtttttaaa

SEQ ID NO: 208561 - DNA, 374 bp, Homo sapiens
gacatatgtcaacttaaaagcttttgagaaaaaattatactaaatgtacatttcaattttgagatgcatccttatttttcagagcctcaagacttgaaaagtcatgcacgttagatttgaagaaatgcagtattccaaaaatagttattctttaatacagtggtttaaactaaacttattctcttctagatacacaaaaaaatgataatgtttatacatggtacactaggaggatacacagcctgaggtaaccagccttctggacctaggctgagataatcacactggttaggaagttctggtttaaaccaactatatgatatagatttttaattaaatgacaaactttagaatttaggactttcataattctc

SEQ ID NO: 208562 - DNA, 895 bp, Homo sapiens
ttcctaggtgagttataaaaagaaagtatactcttaaaatagttttaaaggtcctgtctgcctttggaaactgtgttagttggcattcatctatttatccagcaattttttttttttttttttttgaaagggaggtggcagatgagctgaaatcgcaccattgcagcctccatgccgtgggcaacgaaggagcaaaacttccagtcgtcaagaaaaataataggaagacacaaaataagattacccctccttttatagggggtattagataggcttcgcagcagcttttattggagccttaactggttcgccaggggttagcagaccgccggatatttttttacgcagcagttgttatgttacaaggtggctggtgattgtctcttgcaaacacagatatcacccaaatacgttgcatacaaatgtgggcggagacagaacacatataaacgcggttgggggtcggaccgccttggtggcctggctttgtaactttgcttgctcccatatattagggagacatctatgtcccttgtggcggacacgacagtctgtggcctgacatccaagaaggatctctccacaagaaagggccctgtgtatttcccccaggggggagattgatctctctaaatcatgtgtggtgcgccactttatggggagtatatgatccccagctctggatataatagcaatatttttggcataaaagcgagaagggttataactctttttgttcccaacaccaaagatttcttataattaaagaaggatgattacaccccctggctgactaaagaattaaagggaatctgtttgataatgacagacccaccgagaggaaaagggcattgttatcggcggaggaaatatgatacgcggctactaaataagg

SEQ ID NO: 208563 - DNA, 401 bp, Homo sapiens
  misc_feature (17)..(17): n is a, c, g, or t
caattgatagcctgttngcaagcatctcgactctttaggatcccccaaccgatgtgccctccactgggaatgtctttgtcttatgcacgtagtctgccttgttgttgcaaataacatttctgctataatcacaggatgccccggcttcttcactccattcgacgtaaccccttcccacgagctccaccttcactatggggtccaccagggtgctgttcagggttaagatcacctgcccttttatgctggagccagccaggtagattctatcctcgggcagcactaattcgatcgacttcaccacagacatggggggttggggggtagagagacattcctctctgtcccccatgtccctgaaattcccggttcgttggccctagtgaggtaatccatctatg

SEQ ID NO: 208564 - DNA, 562 bp, Homo sapiens
gagttgcttattttattttatttattgtttcattgagtgacagagggcccaaagataagaagatagacttgttcctctataaactagacaggaaaatacatattaatagcaaatctttactattacgcacataacattttctgaagaagtttatcattttatttccttctcctagtgacaaaagagaagaggaaaatggttatgatccctactaagtaagaaaagaaggtctaagaatgaaactgagctctcctcgctataatctgacttcagcaatcatctgaaattgggagtagagttaaaaataaagctcccacccaaaggcagccaggatacaacccagttacgctgagtcagcatctttctagagacacttcccaggcagttagatatagccgtgcacagtcctctgggccagagcctggagctaatgagggaatctgggaaggagcagtgagacttttaacaaaagagccccacaagccatcgcgttcatattatgcctcttcaaaatgtcccagttcctttctcaccgtcaagtatcaccacactgacaaacagg

SEQ ID NO: 208565 - DNA, 463 bp, Homo sapiens
cactaacagatgactgccatcttgtacagatgtatttcgcatacagaaaattacatttaatcacaatattgtttgggtgggttagtctgtaacttgaagtaaaatgtattgacaggataaaatgaaagctttgaaacagtgcaaaggtggaaaaacgaggttgagcgagaagcaggaattaccaatcttcatggttagaagattcattaaacgcatttgccttcaaatattagattctctacagaatggtggtaaaaaggccagtgagaaattaacaatagtgagaacaccagagtagtgttaaaccaccttgataatcagatggctcggagcagtttaaagccctcacgaaagaggatttttttttaccttccctgtctcccgcaattaatgccatttctaaaagagaaaatatgtcacacatcagcgctcaataggctgacatgctcctcaaaacgttcct

SEQ ID NO: 208566 - DNA, 468 bp, Homo sapiens
cttataaaatagtagagtgtaggaaattatttccagggacagtactaggaaagataatattgctacaaataggcagggtgcagtggctcacccctgtaatcccagcactttgggaggcggaggcaggcggatcacttgaggtcaggagttcaagaccagcctgtccaacatggcgaaaccccatctctactaaaaatacaaaaattagccaggcatggtggcaagtgcctgtaatcccagctacttgggaggctgaggcagggagaatcacttgaacccaggaggtggaggttgcagtgagctgagatcaccaggcatagtggtgcgtgcctgtggtcccagctactcaggaggctgaggtgggaggattacttgaggccaggaggttgaggctgcagtgacctgtgattgcaccactgcactacagcctgggagacagagtgagaccctgtctcaaaaaacaaaatt

SEQ ID NO: 208567 - DNA, 306 bp, Homo sapiens
tgcctgcctccaccttccaaagtgctgggattactggctgagccaccacacccagccttcaaaccgtacttctctactctgcatctgctgtagatgacaggagtccatctcttcatttcattggtcgttgggaacaaagctcccgagtgttggatccttgtcttccagctggcctaaggacatgcaaagattagaagcagcacttctatgttcattgagccagattgtgtctgcttctgtggaaatggcctaggggactcactggccattctgtcctgggtccagttgccaggttaattcctgtga

SEQ ID NO: 208568 - DNA, 665 bp, Homo sapiens
  misc_feature (525)..(525): n is a, c, g, or t
tctgccttttaaaattgttttttgtcttttgttgttcagagaacgaccagagtattttctccccagtgtgtcccaacagattcttaggcaataatttttcttgttgatgatcccgtgctcagtagcacactacattgaagaaccctggccctcaccattgtgtgttggtttctgtgttaatctctgtgatctgaatcatgtcagagtgatgatagattttgtcattttgttgtgattattagtaatgttttactactgtattcattggggctgtgttgagaccagccaaatccatttatagctttactgagccggattgatttgtcaggatttcccaagtgaaagttgggcatattgcccagctcctgctggtggtatcagaatcaccaaccaccagagaaaaaaagactgtggggccctcccctgccaactccccttccctggccgcccactcaacccacacctctttcacgcaggacaggctgcccaccctgtccacgtgaagtgccaacgccctccccaccntgggccgagcccccacccctccctgggcccccaagtgagattgcacatttaactactgtaaggagaggagcggcgttggcaaatgtgaaccatgagaatatcagtgatactgatgagaataaactaaacgcctttgtaac

SEQ ID NO: 208569 - DNA, 405 bp, Homo sapiens
  misc_feature (405)..(405): n is a, c, g, or t
tctgccttttaaaattgttttttgtcttttgttgttcagagaacgaccagagtattttctccccagtgtgtcccaacagattcttaggcaataatttttcttgttgatgatcccgtgctcagtagcacactacattgaagaaccctggccctcaccattgtgtgttggtttctgtgttaatctctgtgatctgaatcatgtcagagtgatgatagattttgtcattttgttgtgattattagtaatgttttactactgtattcattggggctgtgttgagaccagccaaatccatttatagctttactgagccggattgatttgtcaggatttcccaagtgaaagttgggcatattgcccagctcctgctggtggtatcaagggagctgatggaaggggatcctn

SEQ ID NO: 208570 - DNA, 309 bp, Homo sapiens
agactgctgtcgctacaactaagaaagccaaataatacctactttcttatcctctttcctgtgttcgaaaacatacataacacgaagcaatgctttaaaaaggaatagcaagtacaaatatgttagactatcttttctaagtagtttgcttcaacttttttttggaggacatgaggagtggaagaggaaactaatgggagtcggaaagtgggctctagttatttttacaagcgtatttattttgtaagtcaactagatggaggcgaagaaagacgttccagcgttcgggttcacttcacacacacccca

SEQ ID NO: 208571 - DNA, 535 bp, Homo sapiens
agcttcagtggtggcctggggagtgggtagggtgtctcccaatttcccttcctcctcatcgcaggactccatctgttgaggaggagcgagaagatgagtacacgggcagtcttcgctcccagctgctcttcacaatggaaccaccacagttcaggccccacaatcactgccgtcgcaggtctaagtcactcgggctcctgcctctgccctcagccaggaaagcggtcactcaccgctcgaggggatgcctccaccctgaggtaacccaatcagacccctttgcctgtctcatgcctgtaatcccagagctttgggacgctgaggcagggggacgatttgaggccagggacttgaggcttcactgagctatgattgcaccaatgcactccagcaagacctcatctctaaaagaagaagaagaaggaggagaaagagaagaagtagaagaaggaggggaaggagaaggaggagaaagagaggaagaagaagaagaaggagaaggagaaggagaaagaagaagaagaaggagaagaag

SEQ ID NO: 208572 - DNA, 781 bp, Homo sapiens
ggatttagatattttgctcattccctgtcatcagattcaactgacagattcatcacaagatttctttaaatgctaaggtctgaaataaggtctttatttttttcattattcatcaacagatagtgcctactgcagtaggtctgagagttacggtagtataccatcaccttcaagatgtccatcttgtaataaaggagtcagattactaaggaaccaattacaatattgtgaacaaggtcttgtgtgtcatgttaatgttatgcttatggtgctacaggagcacacacatcctaggctttcaaaaggtggatcctgaagggtgaaggtggactcaaaggtagatgaatagttagtgtaaaagctcagaggcagcataacctagaatagtgccaactgcaaatataatgagatatacttaccaaagaatgcaaaactggaagcatccaaacagtgttcagctgtttaaaaagtcatgctttttaattgaagaataatttgccagtagtgcatggcatgtggtgaaagagtgatgtgggagccgtaaatgatgccttagtggtgtcataatcacgtagaatggtggagccagtagttttgggatgacattatagtgaacataccaattccaggtcatttatatgttgtgatgagtaacaacttttttatggtgttgaattgcagttgcgcaaatatccattacatatctcattcttaatttgtatactggaaagtaaaaccaaaacagtgcatctttttttgaccacaactcacaggaagaaga

SEQ ID NO: 208573 - DNA, 500 bp, Homo sapiens
ccatccgctccagtgtccaagaccctgatcttgggtgcacctctggggaccaggcaggttaccgagaggatgggccagcaggtcacacaccttttttcccaggtcctacatcgagtcctggcccttcatggggagagagagggagtgaggagggggtcttgatgcagggacagaagagctagaatctcagcacatgaccatcagtaagaaccgttggctgtgcgtggtggctcacacctgtaatcccagcactttgggaggctgaggcgggtggatcacctcaggtcaggagtttaagactagccaggccaacatggtgaaaccccacctctactaaaaatacaaaaattagccaggtgtgttggtgggcacctgtaatcccagctacttgggaggctgaggcaggagaatcccttgaacctgggaggcagaggttgcagtgagccgagattgcgccactgcactccagcctgggcgactgagtgagaatccgtcttgaa

SEQ ID NO: 208574 - DNA, 151 bp, Homo sapiens
taaatctatatagagatttgtgcatttgtagagtagtggttgcttagggctagagattgggggaaattgggaaatggggagtgactgctaatgggtatagggattctttttggggtgatgaaaatgtcctgaagttgactgcagtgatggc

SEQ ID NO: 208575 - DNA, 269 bp, Homo sapiens
gacagagcgagactccgtctcaaaaaaaaaaaaaaaaaaaaaagataaaaagaatgctgagaacaagactgagatatgggcagatcaaagattctggcaaatacctgaagacatagaggacacatgagccagagtaatggaagccatggctcagagcctgaaaaagagaaatttgtagcagaagtgattctccagcctacctaccaacccatcaaagtgagcaaagagcagatagaagaatataaataagaagctaaatggtcttcttt

SEQ ID NO: 208576 - DNA, 319 bp, Homo sapiens
tgtgtatatattttgtgttataggattagatatttaaaatcctcaaagtttaagaaatttattaaggtttaaaatgttctaacacacatgaatactcacaggcaaactcctcttctgtggaaataaactggcatggtatttagataatatgatgtatgaagctcaactttgaagtaatgagactaattcctataaaccatagaagaaaatcagtcttattaccttatatgtccaccttatacagtgcctctcatctccgtaccctaaatacagggcaaaacactcaaaatgtctaacttttccaaaaggattttaaatt

SEQ ID NO: 208577 - DNA, 464 bp, Homo sapiens
taactactagtcgtggtatgttggtcttatctgacaggagaatgctgtcggataatctcaatagtctacatatgggctatggtatcttggctgtgaacgacatctattgcaacgtcatgactgtttaataaacacatggcattctttagaaagctcattgatgggtttttatctaagcaagtataatgatttgtatgtatctctgacatatcattcatatgtacctctgaatcacaaatggactaggaggaataactgctgaccctaaagtattttcttttagctttatgctagccacaggatcttttcatcagtaattttgaatcatcactatctcaaaaattagtgatggcacaaggtcttaagtccttctggaatcaagcagagcttttattaaattatggtcaatatagagttttagttttatctgtatcctagacttacagatgtccagacacaggtag

SEQ ID NO: 208578 - DNA, 441 bp, Homo sapiens
  misc_feature (31)..(31): n is a, c, g, or t
  misc_feature (33)..(33): n is a, c, g, or t
ttagtcttagggaggatcacttgcaggtcantngtttgagactgcttggcaggtttgagaccaacctcggaagataataagaccccatctctactaaaaatacaaaaattagccgggcatggtggtgggtgcctgtaatcccagctactggggaggctgaggcaggagaatcgcttgaacccgggagatagatgttgcagtgagccgagatcgcaccattgaactccagcctaggcgacaagagtgagactccatctcaaaaaaaagagctatggggagagtggacaatgacagtgatctctgagatggccgatatgggcaagctcctaaagtggtaaagatcaggaccggaaggatggggcagattacagcactcattgtttagaggagggtactggaaagccggttagaccaccgcagcttgaatatgtcttcttcaaa

SEQ ID NO: 208579 - DNA, 315 bp, Homo sapiens
ttcctgggagcagcactgatacagaaatgaattattatagacagaaccaatacatgtaactattcgaatgtccattgacaacttgatgctgaaattgtcagagtattaattactaatttccctgaagaataaagaaatggtgtgtgtgtgtgtgtgtgtgtgtatgtgtgtgatcatatgtgaaacattttataagtacacagggtggtaggcatttaaacaaattgcatcctcaaagcatgtaattaaatattccaaatcacaatttcttgtcgaaataaatgtaatactgtctagaatgggtctttatatata

SEQ ID NO: 208580 - DNA, 263 bp, Homo sapiens
actaatacttgtggatcaaaaggagctatcacagatactagagcaccaacatcgggtggtggcagcacgtttgaggggtgtttagtaggtgagtgtttccattcagacatttgtgcaagcattataccaagggacccagagccaccctgaagctggctgtctttgcagggtgagggctgtgtgaactctaggacagccccagttctcacaattactttctgcaggtctcaattcctcctacagttccagttagatactattca

SEQ ID NO: 208581 - DNA, 417 bp, Homo sapiens
cagcaagcattttggatgacattaatgaaagacctgtgttggcatagtgtgctgcaggaaaggtcgggggtcaccacagccagtaccagaccttaaatataatcctgaaattaaatatgtacgtaaaatagtttctagagcacaaaaggtgaaggtaaaggagagtgctactgatcttttgtgtgtgtgtaataaagatttcgatgtaaaatgtacaacagaaaaaatactgtatttcaataataagaaaaatatataaattattcccccagtgctccaaatcccttctgtgtcatacaaatctttctcatctactttgctgaaagttgctcaagaatatcttattcacctttgactctcctacttaggtttatggatacagaaagtattcaataaagagtgaataatttagtctct

SEQ ID NO: 208582 - DNA, 465 bp, Homo sapiens
atagcatgttccagtttcagtcttagtgtaggtgcccttattacagacttgagataaagtccagggctaaccactcttacaaatttacactttgctaaagggtaccttgggacagagggagtgcagagcagagaaaacctacctgtgcaactgagaaggccgctcaggccacggggacagggcaggaatgctctcaggagtgtcccctgaacctgaacttgatttcacgccatcaccttccacctcttaaccagcatctcctggacagtcagccgagtgtttccatgataccagccatacctgatgccaggagactcgctacacttggaagctcttcaaggtgggactttctgtcttgttcagtttttcattctcagtagtcaacacaggaccttatacttaaaggaaataagtataatgtcctaacaagtgcttctggaataaatgatcatggctgaaatgaga

SEQ ID NO: 208583 - DNA, 536 bp, Homo sapiens
ggcagtgtttgggtatccaggctctgaggctccggcctcacctttccacggggtagaagggaacctctcctgatgacagcagtcgcaaagggccgaccatgatgatgaaatcccaggcggagacgggggaagcagcacgggatcccagcctcaggcctgcacggacggtgttggttgggggtaccttgggacagagggagtgcagagcagagaaaacctacctgtgcaactgagaaggccgctcaggccacggggacagggcaggaatgctctcaggagtgtcccctgaacctgaacttgatttcacgccatcaccttccacctcttaaccagcatctcctggacagtcagccgagtgtttccatgataccagccatacctgatgccaggagactcgctacacttggaagctcttcaaggcatgcttatctttgtgaactgaatcttggagaagcaggattgaaaataagagctatctttgaggctctagcacctacaagagacaccctccctctccaccatggatcacctgtctc

SEQ ID NO: 208584 - DNA, 710 bp, Homo sapiens
cgtggcagtgcttgggtatcgaggctctgagactccggcctcacctctccacggggtcgaagggaacctctcctgatgacagcagtcgcaaagggccgaccatgatgatgaaaccccaggcggagacgggggaagcagcacgggatcccagcctcaggcctgcacggacggtgttggttgggtcactgtcatggctaagaaagcaactccaacccacacactgcaaatatgaaggaccacgaaaggcacgcaggctctggtttgcatagtgaagatgagcgtctgtgttcctaagcatgaaggaggaccacatgagtatcctggacacctactgcatgaatgtattcgccctttcagatctagggacctgggtaccttgggacagagggagtgcagagcagagaaaacctacctgtgcaactgagaaggccgctcaggccacggggacagggcaggaatgctctcaggagtgtcccctgaacctgaacttgatttcacgccatcaccttccacctcttaaccagcatctcctggacagtcagccgagtgtttccatgataccagccatacctgatgccaggagactcgctacacttggaagctcttcaagatgtgtattgaatttgcagaaggcctcttttccaaatgatcaatgaatttcaacaccagagtcttggagtcagacaaggaaactttcagtacataggtag

SEQ ID NO: 208585 - DNA, 483 bp, Homo sapiens
ctcaacagttgcctctctctggcaaaaagtatttggtgtaatatttaaggatgattatgctagttttgcaagtatgacagcttctaatggaatggaaatatttttatgtgctctgcatagacttaaaaagttttatgttactttcacattgaaacagttcatgagcatctatttggcagttagagtattgtactttgacatagtaggtggcactgctattttgattttttttttcaccaagacagtgtgaagatacagatgtgttgggaaatattgaaagacagtttactcagtattatttcactgacagctgcccaggattccaatgaaaatgttatctgtataaagtgatgatggtatctccatttgaccatcacaaatgagataccatcacatcttgtaaggtagtttgtattattgtcattttacagatgagaaaattcaggtacaacaaggttaataaggtgtaaatgatagctaaat

SEQ ID NO: 208586 - DNA, 1019 bp, Homo sapiens
gtgttaaagctgatccttagccagggaagagctgttgagtgattttaactcaggaagcaacaggctgagactggatgtttataaggggcctcctgctgttgtgtgggttgtagaccataaaggatgaagcagagaggcaaatatgtcagacggtagcagctgctatccaggtgagagaatcaaggcctgtgctggatttgggggaataatagggattagattctgagatccctttttccctaacaggacatgatccctccatccctgccctcacccttagcacctggcatagtgtctgggccccagcaggagctccatggatgtgtgggaagtaactcattgatgccaaaaaccatccccaaagtcctgcccacaaggccactgtaggggaagacgcaggagcaggaggaaaagagggcataacagggtgctgcccatctctgtctccctagctattttaggaatctgagggacaggaaaatggggcttaggggagctagaagcagcttgagtcacttattctgtgaacacagcctgttgtctttgatttgccttcctcctcagaaatcctatcccatcagccatgcccagggtttgctgtcctcatccaacttgacccaactttacctcctgccattctgttgactattccctccttgaaatactgtcttcattcagtgtgcacaagccatcgctcctggatttccctcaatcctactctctgctcctcacctactcagccacccctcttcctcaagttgttgtttaatgatagaaactcctcagagctctgcccttacatgtttgcgctcttccctgagtgagcttgtcatactattgtagtgtagtggcttacaaggcagctgcaatccctccctctcttccctgcacacatgcctctttgaaatgtaactgccattcctcttatcataaggtagaatctatttctcagtctttagaactgggcttgctttggtcaatgggtaatttttaaaagtgatgaaaataaagacttaaaa

SEQ ID NO: 208587 - DNA, 124 bp, Homo sapiens
ttatatgcatgaactgcacatatttttttcctcaaaaattctttgtcaatcacctgttatctctatatacattgttgtgccaggttcctgcaaggactcattgagagcaagtgccaaataatct

SEQ ID NO: 208588 - DNA, 391 bp, Homo sapiens
tagaacattttaagcacttaataaatatttgtcaaaggaatggattcaaggtcacctaatctgattccagagctccaatgagtagcttgaatacattactagacagtgagttcttaaggctaggatctcttgtataggatctgcctctctctctctctctctttctctcatgctttttttgttttgttattgccttgcaattccacagtacctgaaaaaaaagtgtccactgaaatgtttgttgaatttagttatattttatagcacctctaaaaggaatggtgaaaattgtggctaactttaaagaaatctgttgtcatagaacagcttctcagtctgaggcctctttgatcttatgcaacaatttataaaatgggatgcatttaccatg

SEQ ID NO: 208589 - DNA, 408 bp, Homo sapiens
cccaaaagtatttggtttgtatgctttgtctgtggcagctataacagtggtaagaacattttgaagatagctttttaaaggaaccactgattttttcaaaaatcatcctgggggaggaattttggcatttcatttgagcagggattttgtcagaaaatgtgttttgatggtaggtcagcagcagtgctagtctctgaaagcacaataccagtcaggcagcctatcccatcagatgtcatctggctgaagtttatctctgtctctcaggataaatccctgtaggacaaatccctactatcatttctaccttttggggtgacatgtggaatcatacaaaggcttaggaagaaatacgtttgtttaaaccaggatgctttacttacttgaagtgacttcaatctagatttc

SEQ ID NO: 208590 - DNA, 409 bp, Homo sapiens
ggctctccctgtgggtagcaacaagagaaaatgaggaagaagcaaaagtggaaaccctgataaacccatcaggtctcgtgagacttattcactatcaagagaatagcacgggaaaggctggtccccatgattcgatgacctcccccgggtccctcccacaacacatgggaattctgggagatataattcaagttgagatttgggtgggggcacagctaaaccgtatcacttccctaatgtactgagagaaaattgtcaccctgcacccagcgtgttcagatgaggctctgttttcagtggaaggtgtctgtgctgagcagatgtctagatggtcgatggccccttcctgcctgagcctgtcatgtgggctgtgtcctccatctggcactgttgtgcacacacaggtccc

SEQ ID NO: 208591 - DNA, 802 bp, Homo sapiens
aaaaaataaactctgacccttcttatattccttatccctgatgatcacatgcttccctgcatccctgaatttaaaagatgaaacacatggcacatgcctgtagtcctgtagtcctacctactccgtagactgagacgggaggataccttgagcccaggagttcaaggccagcgtgggcaacatagcgagactccatctctttaaaaaaagaagtgaaacacaattttgagaagtgaggatgagtttctgttgcatactttacttggtaattaaaaaaacttaactattaaagtaagatggtggcttatggctataatcccagcactttgggaggctgaggcaggaggatcacttgagcccaggagttcaagaccagcctgggcaacatagtgagaccttgtgtctacaaaaaagttttttaattagccaggtgtggtggcacccacctgtagtcccagctacttgggaggttgaggcgggaggatcacttgagcctgggaggtcaaggctgcactgagcgatgatcatgctgctctactccagcctgggcagcacagcaggcccatctcaaacaaatgaaaacactatttgctgtcatctattaaagtccatgtttatttaggtaaaaaatattctgacaaaactccacttggattgaccctaactggagtattaaagcattataggcagcgtcgtctcctggatacttacctatggggaatattttagattctgactgcctcggtctaatagcctcaggggttcgcaccaagcaagaccatggcggctccagcgccgggtg

SEQ ID NO: 208592 - DNA, 434 bp, Homo sapiens
ttgttttgttttgttttgttttttcagatggagtttttgctcttgttgcccaggctggagtgcaatagcactccgcaacctccgcctcctgggttcaagcgattctcctgcctcacactcccgaatagctggaattacaggcatgtaccaccatgcctggctaattttgtgttttcagtagagacggggtttctccatgttggtcaggctggtcttgaactcctgacctcacgtaatccaccggcctcggcctcccaggcatgagccaccacgcctctaatgttaaaatttatggaaggccattgttttggactgagctcctatactaggccccaacagaccaaaccaacccagaatggaggcactctcacgtaatcaaactgaactttaaaaagtgccagtttaaattaaaaatgaaaaccaggaccaaaaac

SEQ ID NO: 208593 - DNA, 195 bp, Homo sapiens
tccagagtgtgtggccagaaagaatgacaagtgtctcccattagctcttggcacagtgcctggctcatatgtgcccaatgagtagccattccctggagatgtcgtttaggccccaaagcaagaagattcctgtgccccaatcattcttcatctctctgggccaccctgttactattccaaaaggtttggattgaa

SEQ ID NO: 208594 - DNA, 618 bp, Homo sapiens
ttctaaccagactgggagttactgctcaatttttctgacatgtgtttttccagattgtatttggataacttcaggcattgtgaaaatgaggaaaccatggagcttgttctttctatctttgtaaaatgatgaccatgcaaaaggtctctttttacactaaatctgaatctctctctacaagtttcacacactgaccttaggaaaaccccaaaggcaaaacacaacacatttatgacctcttccataaaacaatcttcaagaatttgaagacaggttatgttccttaccaagtcttctctatctcagcttaaaatatacaaaatgctttcaatttccttcatagcatctccttatgcttttccccactacctctctttttgaatctacaaggacactctattaaatggaactcaagcttcttggctgatttaaatggaattaactggattctcacattactatttctaaattaggttttattatgataaaagctcattctctctatatttatcattattgttatttttatcctataaaactaattaccttattattatataaattaaaacaacatagagttgtaaacataatgtatgtgcttcataattctagcttctg

SEQ ID NO: 208595 - DNA, 377 bp, Homo sapiens
atttcataatattcagaaactaatattagctattatagaaatttttcttatttttcctttttacaccatatatacattacatcctgtgtcaactacagctcacttctgtggttctgactattcaacaagaattcctaggtctgtcctgtgtaccatattgttattctaattatccatataattatactgcattaaacactgctatctgtgaataggctcatttattttactaagttcaagataatactgatattttttaattctgcaaaaaatataaaatgcatttttatacctactacccagaatgagcaaatattgtctttatatttcctttaaattgctttttttaaagaaataaaaattacagatttaaccaa

SEQ ID NO: 208596 - DNA, 551 bp, Homo sapiens
gaataaacagggtttaactgttaattgttacattatgctggaaaccacttaaacacgacactaaggtggtcactgtataagtagccctgggaaagaaggcccaggggacattgtaattaatatttttttgtaatagacttttgccctaacctgggccaaaaacgccatgactttctatcctattaaaaagtcagtaacactgttaatgtggagattgggagtaacaggcagtctggacttgggtctggacttgggctggcgcatgaggtgctgccgaacggcagttcttttttttttccttttgagacggagtttcactcttgttgcccaggctggagtgcaatggtgcgatctcggctcaccgcaacctgcgcctcctgggctcaagcgattctcctgcctcagcctctggagtagctgggattacaggcatgtgccaccacgcccggcttattttgtatttttaacaaagatggggtttctccatgttggtcaggctgatcccgaacttctgacctcaggtgatccgccctcctggcctcccaaagtgc

SEQ ID NO: 208597 - DNA, 315 bp, Homo sapiens
cagagagagcccaagggattcagtgactgacaagcaaccagctgggggcacctcatctccttggctggggaatgatcttgaccacatgaaatagaagtgtattgggatgcttataggtgagacgagattcagaagcagtcgtacctcctctatgcaaaccagttggcctatggaatgtctagctgccttccatccttctagatatggtcagcagcagcaacttgtatgtccccagttctaggcacccaactctggagaaacaggtttcaatactaaacaacaggagacaggtttgatagtaatttcaaacccacc

SEQ ID NO: 208598 - DNA, 347 bp, Homo sapiens
taaatccccagtcactacagggcaattcaaactatacaacatggcatacaatctgtcctcagtttatcttttcagtttcagatccaaataaatattcctccagtctgctatattatgttctagtcactttgctagctgttggctaacccatatactttaacatcactactgtttatgcttttccttctggctgtgctcctccatgacctgtgtacttttaacattttgtatatactctaacatagcaattaacacaccatattatagtttgactgtcaattattcgaaacagcagttatggtttattcacatgaaaatttcccaatccttgggtgggcgcgtggctc

SEQ ID NO: 208599 - DNA, 852 bp, Homo sapiens
agtattttttttttttgtatttttagtagagatggggcttcaccatattggccaggctggtcgcaaactcctgacctcaagtgatctgcccgccttggcctcccaaagtcctggtattacaggcatgagccatgacagtcagctattttttttggcatattttaagggacagaaattatgctttttaaatgttgcttattgcttttcaaggatttgattcttataagctacttcttcatttattaatgagatttaagaaagaaatcaggttacaaagttatgagcaattgtctctggaacccagaagttggttttaacactagagtttctgctgcagggcatttttactggactgtgattcctagaaggcaagtataagcactgtttttttgttgtttgtttgttttagaaacaagttcttgcgtcacccatgatagagtgcagtaatgcagtcatagctcactgtaacctccaattcgtgggcttaagtgatcctcctacctcattcttttgagcagctgggactctaggcatgtaccaccacacccagctactttataaattttttgtagaagtgtggttttgctgtgttgtccagaatagtcttgagcagtcttcccacctcagcctcccaaaatgctgggattgtacaggtaggtgtgagccaccatgcctatccctgctgtttttttttgagacggagtctctgttcaagcaattctcctgcctcagcgggaggctgagagaggagaatcagttgaaccagggaggctgaggttgcagtgagctgagatcacacaccactgcactccagcctgggcgacaagagtaaaactccatctcaaaaaaaaa

SEQ ID NO: 208600 - DNA, 691 bp, Homo sapiens
tgctgagattccaggcatgagccaccacacccggcctgtccctactttttttaatgccaagatttgtgtatttcatcttcagttgggattcatggcatctgtcaataattgatgtgaacttaaatggcaatttacctataaaaagataacttactactcttcttttaaaagtctatatacttctgtcatttgctggaaatgaattattagtctttattcagcaaacatttatagaccaaatagtgggtaccaaaataagtactaccctgcagctgcttgatgatggtaataactaacatgtaaatctttaataaacagtgtacattcttaatctgtccatcaactcggtacagtcagtattgttgtccgtatttcacagattaagacaccagcctagaggccgagtgcagtggctcacgcctgtaatcccagcactttgggaggcccaggcgggtggatcaccttaggtcaggagtttaggataagcctggccatcatggtgaaaccccacctctactaaaaatataaaattagccaggtgtggtggcacgcacctgtaatcccagctgctcgggaggctgagagaggagaatcagttgaaccagggaggctgaggttgcagtgagctgagatcacacaccactgcactccagcctgggcgacaagagtaaaactccatctcaaaaaaaaa

SEQ ID NO: 208601 - DNA, 563 bp, Homo sapiens
ctttggtgccaggtatttttggatttcagaattttgaggaaagatttgttttagattttggtaagagtaatcaaacacaatattaatgtggaacatggatagtcacattaagtgagagaaataaaagataaaaatagtctcccatcagtgctcagatgaagttttgccattatatattaggattaagctttgccaccaacatagttatagaactttgagttttcagagattttaggatttcagaatttctataagaagtcggtttcaggctgggtgtagtggctcacgcctgtaatcccagcactttggaaggccaaggtgggtggatcacgaggtcaggagatcgagaccatcctggctaacacggtgaaacccatctctacctctactaaaaatataaaattagccaggtgtggtggcacgcacctgtaatcccagctgctcgggaggctgagagaggagaatcagttgaaccagggaggctgaggttgcagtgagctgagatcacacaccactgcactccagcctgggcgacaagagtaaaactccatctcaaaaaaaaa

SEQ ID NO: 208602 - DNA, 502 bp, Homo sapiens
ctttggtgccaggtatttttggatttcagaattttgaggaaagatttgttttagattttggtaagagtaatcaaacacaatattaatgtggaacatggatagtcacattaagtgagagaaataaaagataaaaatagtctcccatcagtgctcagatgaagttttgccattatatattaggattaagctttgccaccaacatagttatagaactttgagttttcagagattttaggatttcagaatttctataagaagtcggtttcaggctgggtgtagtggctcacgcctgtaatcccagcactttggaaggccaaggtgggtggatcacgaggtcaggagatcgagaccatcctggctaacacggtgaaacccatctctacgggaggctgagagaggagaatcagttgaaccagggaggctgaggttgcagtgagctgagatcacacaccactgcactccagcctgggcgacaagagtaaaactccatctcaaaaaaaaa

SEQ ID NO: 208603 - DNA, 2011 bp, Homo sapiens
gggcagtgaggggcagcagcgcttggccgaggcccctgcggcgtcccgtagcctcgcgttaagccttgttcagagcgggggcttttgctgtcgcagtgggttccggagagtgcaggtgatctcgcagcaggtttcttgtgctggccgcgctcgccggacgaagaagagaagggcagttgggcctgcggccttggcgttcatgaggcctcagagagctccggaggagctacaactgtgagggggctgctagagttcttctcctcgggtgtgtgagaagcagcctaggaccccgggttcggggagtcgcaaagaaggccgtaagggcttcacttccttctccggaggcctgccttctgcgcgtcgattaacaccgcattctttcccacttcctctcaatgttttcttcatatatctggaaatatgatcagcgcccctgacgtagtggccttcaccaaagaggaagagtatgaagaagagccttacaatgagccggccctgcctgaggagtactcggtgccgctcttccccttcgccagtcagggtgctaacccctggtcaaaactgtccggggccaagttttcgagggacttcattcttatttccgagttctctgagcaggtgggaccccaacccttactgaccatccccaatgacaccaaagtttttggcacttttgatctcaattacttctccctgcgtatcatgtctgtggattaccaggcttccttcgtgggccatcctcctggatctgcctaccccaagctgaacttcgtggaggactccaaggtggtgctgggagattctaaggagggcgcctttgcatacgtgcaccaccttaccctatacgacctggaggcccgtggcttcgtgaggccgttttgcatggcttatatctctgcagaccagcataaaatcatgcagcagttccaggagctttcagccgaattttccagagcttctgagtgcttgaagactggcaacaggaaggcatttgctggggaacttgaaaaaaagctgaaagacttggattacaccaggacagtgctacacacagaaacggagatccagaagaaagccaacgacaaaggcttttactcatctcaggcaattgagaaagccaatgaactggccagtgtggagaagtccatcattgaacatcaagacctgctgaagcagatccgctcataccctcatcggaagttgaaggggcatgatttgtgtcctggtgagatggagcacatccaggatcaggccagccaggcatccactacctctaaccctgatgagtctgccgacacagacctttacacctgcagaccagcctacaccccaaaacttatcaaagcaaagtccaccaagtgttttgacaagaagttgaagaccttggaggagctctgtgacactgaatatttcacccagaccctggctcagctcagccacattgaacacatgttcagaggagacctgtgttacctcctgaccagtcagattgatagagcacttctaaaacaacagcatataacaaactttctctttgaagactttgtggaggtcgatgacaggatggtggagaaacaagaaagcataccctctaagcccagtcaagacaggccgccttccagttctctagaagaatgcccaattcctaaagtgttaattagtgttggttcttacaagtccagtgtggagtctgtgttgatcaagatggagcaggaactgggagatgaggagtacaaggaagtggaagtgactgagttgagcagtttcgacccccaggaaaacttggactacctggatatggatatgaaagggagtatcagcagtggtgaaagtattgaagttttgggcacggagaaatccacctccgtgctttctaaatctgacagccaggcaagcctcacagtaccattgagcccccaggtggtccggagcaaagcagtcagccacaggaccatcagcgaggacagtattgaagtcctcagtacctgcccctctgaggccctcatccctg

SEQ ID NO: 208604 - DNA, 540 bp, Homo sapiens
caaatgcggtctcactgtgttgccgaggctagtttcaaacttctggactcaactgatcctcctgcctcagcctcccaaaatattgggtttataggccaggcataagggactgtgcgtggcttaagtttccattttctaatgtaaagacaaaaaggcgtgaagtgtccaaagaggtaaatgatcccaaactcattttcattgccttttggacatgtttttgtattttgatattcaggtgtttaaatatcctctgatgttgagttaaaaaagaacaaaaattgaagccatagtatgacataggatgctggaaatgcacacagctggtgtttccattttgattctccctacctgtaactgctccctactgggaaaactttgggtcctcacaaagtgagctagctttctttcaaactttgcttggagggtaacagtgccaggaatatcagaagtgcctgatgcatgtagatctatttatgaaagcttgcttgaatggtttgctgtaactagtaagagccactttttataaaagtgcacataagg

SEQ ID NO: 208605 - DNA, 1177 bp, Homo sapiens
gtgatggttaccatggttattcagagtgatgggtggagaaggcaacaagagggaattggggggaacatctggagagatacatgatattatcaaggtctaagctttcattagggatgctggcttcccaggtgcttagaacattaataaaggttaactgaataactagaagagggctatgcacagacagatgttgagagtcttccatgaaccaaggattctatctaattatgtacacttgagggtcaagtaaaacaaagaaataaacaaaagtcaggatgctgctccactgggcctttgttgttccccttacacaacccacttgatttcctgctcagccttccagactgagatctggtcttgccttctctatgaagcctctactgcttgtcccacagctcttcacccacctcttgcctgggatgtcctttgtgctctcacagcaccgtgaacacactacttccactcatcctccacgctgtcatgaccatgtgtctgtgagcctgtctttccccgacagtgagctcctctgaggctctatgtgtcacatggacagagtgatggtttttggctgaatgcaccaaagtgtcacttccctcacccctaaggacattatcttgccttatctatcttgccaaatcctgacatgttttagtccccaattcaaactggctctttttgaggaacttacagtgaattctcaaccctctgtccctgcccttcctcctctgggcctcctcctctcctccctggatcagtctgccttcctccagttctttctccacactgagcaccagagatctttccaaagagtactctctccaggattaaaaccctcctgtggtcctcactcttcaagatcagtgagactcctcggctctttcctgtggggctcgtgctgccatcctctcacctaccctgcaactgctgcctcagggccactgaatatgccatgtgtcagcttcactcagggaaagctcttgaccctgtaccccaaagacagggagccactgcaatgcgaactctgctctgagatcatgtgttacccaagcacaccacactcctcacaactcttaaccagctcaagttccagcacctgacacagggcgtggcacagaatgggtggcatctgctgaaaggaagacagggactcctatttttgtatatattttataagaca

SEQ ID NO: 208606 - DNA, 535 bp, Homo sapiens
caggtacgaccatgaatacggattcactgttcgtcgttttacatcaagattctgctaagaccttggttactgtttttctgggtgtgttttttacacctagaatccctccccagtctgccttcctccagttctttctccacactgagcaccagagatctttccaaagagtactctctccaggattaaaaccctcctgtggtcctcactcttcaagatcagtgagactcctcggctctttcctgtggggctcgtgctgccatcctctcacctaccctgcaactgctgcctcagggccactgaatatgccatgtgtcagcttcactcagggaaagctcttgaccctgtaccccaaagacagggagccactgcaatgcgaactctgctctgagatcatgtgttacccaagcacaccacactcctcacaactcttaaccagctcaagttccagcacctgacacagggcgtggcacagaatgggtggcatctgctgaaaggaagacagggactcctatttttgtatatattttataagaca

SEQ ID NO: 208607 - DNA, 629 bp, Homo sapiens
gagctgactagaggatcccaacacattaccctcatcctgagtgggatggcagtggatgctagtcactgtcactgggactacagcctgcacttctccttcatgagagttaactccctcaagactgagctccacatttactactatggagctgtcaattctgcaaatcttgtttctttcatccgtggctccagctcctctaatgctcctcctgcccagatgctgtactccctcccatccctcatcaccagttgtttttcctttacacactgatattgctaatgctgttggataccagcaattagaattcctgatggggaacaaactaggacatatgtcattgatatactctcaaaaagggtttaggagacaacttagtcctgagccagccctgccctttgtgcttaaatgagacaggtgggtggaaagtccttgaaagaaggaagggaaaactaccatttataagtagcactggagggcataagtcatctcctcctatgctgttggtgttggggtagggtgaacagacatagtacgagagctggagagagccttaagaaatcttagtcaattatccaagtctcccatttctttttctttctttttttttttttttttgaggtggagtctgg

SEQ ID NO: 208608 - DNA, 283 bp, Homo sapiens
tgttcatgcaacatttactggatacccaccatgtatcagacactgctggtgtttgaacagtgaatgagatacatcaagtcactattcttattcagtgaagaagacgtacaatgaacaaatacacataaatatatgataaaattacagatagtgttaagtgctataaggacaaagtatggtatgggaatagagagtgatgggggagattctatttaagatagtgtggccagattgggcacaatgactcatacctgtaatctcagcactttgggagacgggggga

SEQ ID NO: 208609 - DNA, 237 bp, Homo sapiens
ggtgaacattggtcagaaggattttttagacagtataagtgagctacagggaggacctgaactaagtcagtagcaggggctagagataaggggacatatataagggacgataaggaatccacaggatttcgtgactaacgagacatgggggatgtgaggccaagagagaagacggtgaggatgcctaggattctggcttaagggcctgggacaatagcggtactgttcgtggtagag

SEQ ID NO: 208610 - DNA, 413 bp, Homo sapiens
aacagtgtggcccaagctgaaattcaaaaccaaatctgggaaaacggaaaggttgatgatctttcctagggtctgtgtgcataaatgtaaatgtatggataatattccaaggagatttctaaagaaaatgagaactgttttacacagaggcctaaaatactagagagaaaagtgaacagcacaaggcttaaaatattatcataaagccagaagttgacaggtaaattttataataggttttatgagactcagtacagaataaactttaggattcaggttcacagggaagtaaaattgcagggaataatatcaccattcttccatacagaacccaacagtgccctggctcctggaatgccaggaaattgaagaagctggaaaggcacctttggtatttgcaaaaggcgttagat

SEQ ID NO: 208611 - DNA, 849 bp, Homo sapiens
agtgcagtctaggcctccgcctccgttaccctggagcccaggttaccgccgctgccacccaggagccccgatcctcgcctctgtcccatccttgtgttcaaacctcccgcatctcggcaacctcggcacccgcccggcagcctccgcaggaaccaggcacccgctctttggcggtcagacgccgaggccccagctgggagtttggtcctaagagggaaggcaaggaggcgggacgccgcatcggctctgctgaagagcctgcgggttggagggcaaaaaagtttatcttctggatgccaatgtgaattgtggtctacaaatacattgtggagaaaatagattgcacagaaatgaatattatcaggatctgaagactgtgaaaatgtttttcagtattgtcatagtctcctctggagaaaataatctgtgaaattatgtgaatagagaccatttttcaaaacaatgggggaaagagcaggaagtccaggtactgatcaagaaagaaaggcaggcaaacaccattattcttacttatctgattttgaaacgccacagtcttctggccgatcatcgctggtcagttcttcacctgcaagtgttaggagaaaaaatcctaaaagacaaacttcagatggccaagtacatcaccaagcccctcggaaaccaagccctaagggtctaccaaacagaaagggagtccgagtgggatttcgctcccagagcctcaatagagagccacttcggaaagatactgatcttgttacaaaacggattctgtctgcaagactgctaaaaatcaatgagttgcagaatgaagtatctgaactccaggtcaagttagctgagctg

SEQ ID NO: 208612 - DNA, 1004 bp, Homo sapiens
agtgcagtctaggcctccgcctccgttaccctggagcccaggttaccgccgctgccacccaggagccccgatcctcgcctctgtcccatccttgtgttcaaacctcccgcatctcggcaacctcggcacccgcccggcagcctccgcaggaaccaggcacccgctctttggcggtcagacgccgaggccccagctgggagtttggtcctaagagggaaggcaaggaggcgggacgccgcatcggctctgctgaagagcctgcgggttggaggtgggctttgaagtgggcgtggagacggcgggggaggtggaggtgcgagtataaatgatcaaccagaaattatcttcaaaggaataaaaccagaagtatgtaaataaaaagcccaagataaagaaacagaaaagctgacactacatgaagcagagggcaaaaaagtttatcttctggatgccaatgtgaattgtggtctacaaatacattgtggagaaaatagattgcacagaaatgaatattatcaggatctgaagactgtgaaaatgtttttcagtattgtcatagtctcctctggagaaaataatctgtgaaattatgtgaatagagaccatttttcaaaacaatgggggaaagagcaggaagtccaggtactgatcaagaaagaaaggcaggcaaacaccattattcttacttatctgattttgaaacgccacagtcttctggccgatcatcgctggtcagttcttcacctgcaagtgttaggagaaaaaatcctaaaagacaaacttcagatggccaagtacatcaccaagcccctcggaaaccaagccctaagggtctaccaaacagaaagggagtccgagtgggatttcgctcccagagcctcaatagagagccacttcggaaagatactgatcttgttacaaaacggattctgtctgcaagactgctaaaaatcaatgagttgcagaatgaagtatctgaactccaggtcaagttagctgagctg

SEQ ID NO: 208613 - DNA, 385 bp, Homo sapiens
ggccatgaggctggggatgagggcagaactaaaacgtggctgggtgcctcgggcttcccatatgtcttttattaagaaaccatgccctaatgtgtttcttccattacgctcatttgttctgtttcagagttaggaagagggtggagggagcagagaggacgttcacggcgtgtcagattcttctgctcatttaaaggaaactttccacccaggttcccgctttgcttttaaggtggaaggttagacagtgagaagatggaattataaactttacatgaacagttcagaaaagagacacttttcattatactggacagatgttttctgctgtaggggagaggaaaatgggattaaaaagttttcgccttctctgtatctggagatc

SEQ ID NO: 208614 - DNA, 267 bp, Homo sapiens
tgctaggattacagacatgagccaccgcgcccggcccactccctttatttttataataactcttagattgtttcagttcacgtttcctcttagaaagaatttttgctgtattcagtcagttacaggtctcctgtaaaaggtctcctccaccctgtttcagcttggctgtgctctctcagagtttctcagtgggcgtgctttcggcatgtggtgtggacacttcttcactgtgtggggcatattacaagacctctggcctcctcccac

SEQ ID NO: 208615 - DNA, 632 bp, Homo sapiens
agacataccttttttcaaattttgaaaaaagtctgtgagtgtgtggcagttaccagaaaactttccagttacattgtttttgctccaagtgaaattggttaagattaattatattttccttttttaatacatggcacttgatccatcatattcttggctagaaataaatttttaattaatatttgcaccaaattaatagatgtttcaaaccacaacatggtggttctggaattatagcaagggacagtatgctgggttatataattaaggcttagcaattatctagtggattaaacagaccattgtggaactaactgcttgctttattaagacggtaatgattacacctgagaatgtaatgctggcccgatgagaaatttgaccttgctgccacatttcttgagttttaaaggaggcagaggtaagaaatgaggagatcagagaacagaggttccataaatcagtaccacagatgacaggagcatggataagtgcataattgtagactcaggataaagcaaagaatttagagctattacaaagtaatttgtgtgccataactctccgggaaattataattatcagagaaataatagactcatagtcaaacagcttctgaccatattacttgg

SEQ ID NO: 208616 - DNA, 402 bp, Homo sapiens
ttaagtttcctattaccttgagccttgctacattgtgaacaaaatattcacagcctgatctgggagatgggcatgtaactgacaaacacctggggcttggctctgtgctctgggcttgggaggcctggactcagttgtcctcacaggctgcaattaaagagctattagtaggattttgtacttggatgtttattctccctgcccccacaccctaggctggccctggaggggtacatgaatagagggtgggacccagggttctgggtggggagaccctgcactctggcttggctaacactggaggcttggctaacaagggaggggcttggcttggctagcactctggcttggcaacagggggccacgggccttctccagggtctgatcagatccatctctgga

SEQ ID NO: 208617 - DNA, 314 bp, Homo sapiens
cataaacctttacatatctgtcaaattatttttcttctaggtctctattcttaacatatccctgcaaacaaagatgttccctctttctgggcacctgtattaagtcattctgtctgcgagatatttacaagcctacattcattaattacatttttggatgaatttccattcatgtttcatcgttagacaacctggaaaccaactaaggttccagctctccaagtcagcaacaggatgggtcaatgactccctaagcagtggtatcaggcagacccccgctcctagacaatgccatcctggttatcaacatgcac

SEQ ID NO: 208618 - DNA, 144 bp, Homo sapiens
cttaactacacatatttgataggaagtgtccctttaactgtgagaaaatggtttcctaatgatactttttgcttttcactcatgaaatcactctgggttagcttctcatcagtccataaatgcccatacctggttctgtcaaca

SEQ ID NO: 208619 - DNA, 246 bp, Homo sapiens
ggctaattatatagtctaaaataatctctaagttaaaaatgtgttcagcaataagaaggagaatatataggcactttttacttccaaatagtttacaccaacaaggcaaatcattttcttaagaacttgaattttaattctggaaatgtgtctctgcattattttttaaattctgaattctgctgctgtttctgttaaagattttgaagtaattgttttaaagacaagaatcgtggggtatttggg

SEQ ID NO: 208620 - DNA, 392 bp, Homo sapiens
taccagatcctggtcacaaacgcacaatttcctgcggaaatcaggaacctcgagccggttactcagctgtatgtcagtgtggatgccagtaccaaagacagcctgaagaaaatcgaccgcccactcttcaaggatttctggcagagtgggcggtcgattttcttcaggctgacgctcgtgaaagcggtcgaccggggattccgggggtctctgaactagcacatcaagcagagtgagggcagggccaccacaccaaaaatgggatcaaacaggagttacaagtcgaagacagaaatatgccctgtccccagcctcttccctgtcttctccccaacactggcagccaggtccctaatccctgccaggactggaagagccatctgcaggaacct

SEQ ID NO: 208621 - DNA, 1892 bp, Homo sapiens
cctctcactcttttttttttttaaccgctacgccacagtccccgggagaattcagatcccaaccggggcttccggattctgtagtggctttggcctgtgtctggtctgaggacgcccggaaggcattgcactgaggctaagggaaaggtctctggagggagcctcaggaagagcaaatggaggccagagactggcaggagcgcgccagcgcaggatttaatcccgacgagcggattcagagccgtgcttatataaagcttcaggaagcgccgttccgacgatgaggtcgacacgcgagaggcgacctcaagagcggcggcgccagggatctgtgcgccaagggaggacgggagggagcaggttcgccataattcctggctccaggctctgttttgttggaccgagccactgtattttagctcacacaggagaattctggccctgggaaaattggtctcagcatgctgccaagctttctcatggacgtcagcgaatcccaacacactgtcggtcaaagccgtgctggaagaaacaaaacagttctccctcggtagaactgagaggggattggtccagggcccccgccgataccaaaatccaggttgctcaagtctctcatagaaagtggcgtagtatttgcacataactatgcacatcctcccgtgtactttaaatagtctctaaattacttcgtaacacctaatccagtgtaaatgctatgtaagtaattgttatactgtttttatttttactatcttttgttgtacttttttttaaaaaagaaattcatttgtttaatattttcggtcttggggaacccgcgtatatggagggcctgctacatagagaagactgagggatattctgtgcatccgtttctacggatcctctaaatcggcctttgttttcagccaggatttagtgcccagctgtgtcctttggaggccccacatggagctagcaaagtttgctaaatcgggttttgcaagaggactgtctgctccatactgggagtagttaccgcaaactgccctatgaaattggttggggttcttactgttagcatgtttattactttatcagggctctctgtaggagagtctatgagaaaatcttctggtttctgctgaaagaatcgtgttttgttggggtttttttcccgaaaaatattatttttaaaaactcttctgtgccctgtttaatctctcccttggatccaccttctgtgtgctcataaatcgtaaatctgtattcagacttctggactcgagacacgtagatccacctggtggttcttcagtcattttaagcccaaaactcaaaatctcccgaaatcaaaatgtttaaacttataatctccagggtgtgactcacgggggatgaggggagcaattctctccctccccgcataaagctggttctcctgtctgctcattgaacggttccactgcgcatcacagcatctacatgcctaaaccaacaccccagcattggcaacagatatcttcctctcccttggctgcttcaggacagggaagaaacatgcttgcccttttctgactctttagtaactctggccgaatctatcacattattttacatctctttacatcttactactcccccatcttggctgtgtgttccctactggcagtgatttttgtttattcatttttgtaaactgacacttagttcagtgtccaatataagctcaacaatagtttataaaggaaaagttcctgcctttgattgcttttaaacactattagaaaagacataaccaaattgcaacatgataaaacaaccgcaaacaaggctgagagaagtggtgatttctggtgtcagagggcacaggaccctgggcagaatcagagatacggtgtctgtgcagt

SEQ ID NO: 208622 - DNA, 1727 bp, Homo sapiens
cctctcactcttttttttttttaaccgctacgccacagtccccgggagaattcagatcccaaccggggcttccggattctgtagtggctttggcctgtgtctggtctgaggacgcccggaaggcattgcactgaggctaagggaaaggtctctggagggagcctcaggaagagcaaatggaggccagagactggcaggagcgcgccagcgcaggatttaatcccgacgagcggattcagagccgtgcttatataaagcttcaggaagcgccgttccgacgatgaggtcgacacgcgagaggcgacctcaagagcggcggcgccagggatctgtgcgccaagggaggacgggagggagcaggttcgccataattcctggctccaggctctgttttgttggaccgagccactgtattttagctcacacaggagaattctggccctgggaaaattggtctcagcatgctgccaagctttctcatggacgtcagcgaatcccaacacactgtcggtcaaagccgtgctggaagaaacaaaacagttctccctcggtagaactgagaggggattggtccagggcccccgccgataccaaaatccaggttgctcaagtctctcatagaaagtggcgtagtatttgcacataactatgcacatcctcccgtgtactttaaatagtctctaaattacttcgtaacacctaatccagtgtaaatgctatgtaagtaattgttatactgtttttatttttactatcttttgttgtacttttttttaaaaaagaaattcatttgtttaatattttcggtcttggggaacccgcgtatatggagggcctgctacatagagaagactgagggatattctgtgcatccgtttctacggatcctctaaatcggcctttgttttcagccaggatttagtgcccagctgtgtcctttggaggccccacatggagctagcaaagtttgctaaatcgggttttgcaagaggactgtctgctccatactgggagtagttaccgcaaactgccctatgaaattggttggggttcttactgttagcatgtttattactttatcagggctctctgtaggagagtctatgagaaaatcttctggtttctgctgaaagaatcgtgttttgttggggtttttttcccgaaaaatattatttttaaaaactcttctgtgccctgtttaatctctcccttggatccaccttctgtgtgctcataaatcgtaaatctgtattcagacttctggactcgagacacgtagatccacctggtggttcttcagtcattttaagcccaaaactcaaaatctcccgaaatcaaaatgtttaaacttataatctccagggtgtgactcacgggggatgaggggagcaattctctccctccccgcataaagctggttctcctgtctgctcattgaacggttccactgcgcatcacagcatctacatgcctaaaccaacaccccagcattggcaacagatatcttcctctcccttggctgcttcaggacagggaagaaacatgcttgcccttttctgactctttagtaactctggccgaatctatcacattattttacatctctttacatcttactactcccccatcttggctgtgtgttccctactggcagtgatttttgtttattcatttttgtaaactgacacttagttcagtgtccaatataagctcaacaatagtttata

SEQ ID NO: 208623 - DNA, 339 bp, Homo sapiens
  misc_feature (5)..(5): n is a, c, g, or t
gaggntccccgtgagacgacctgatgtaaaggtggttcaacatacataaatctataaatatgataaatcaccttaacagaatgaaggacaaaaaccatatgataatctcaatagttgcagaaaaattattttacaaaatccaatcccctttcatgataaaaaatctcaacaaattaggtatagaaggaatgtatctcaatacctgaaaggacatatatgatggaccatagctaatatctcattcaatgagggaaagttgaaatttttcttttctgagattaggaacaagacaaggattcccactcttaaggtcgtctgacggcaaggctcgtctcacgg

SEQ ID NO: 208624 - DNA, 297 bp, Homo sapiens
gcgacagtgtgagactccgactcaaaaaaacaaaaacaaaaacaaaacaaaacaaaaaccttcttgattatctttagaaaatccacataaggataaaattaaactggtcaagtttcacatctactgtcaacaggcaaatcacagcacagatttttatgagccacttctagtagcaaggatttggattcaggctaatgagactaaatgggatttttagagagtaggttaaggttaaaaaacagaaaagggtaaaaaacacaaaattatacctacacttcatttataatcatgtaaaat

SEQ ID NO: 208625 - DNA, 617 bp, Homo sapiens
gtgttgtgggcacagaccaggaccagcgctgagagcttctagcaactctggaggccaaccctggaaatacatggccccaaaaagaaaccagagtttacgacataaacttactagattcctttaattcctgccctcatcatcatttgcctagattattgcagctacctcctaattgagcttctgcctctagcctcacccttttgtgatacatctctcagacttcagccaaagtggtctttttaagccatagtctgtttgtgtcactttcctgctttctgaccttcatttactacttgtaggattaagtcctttaatgtagcataaaaagaccagtaataacctccagtctcatatattgcctgtcttctccagtaattccaataacagtaaacatgttgttttcccctcattgcctttattcatgctctcccttggcccaccccacaccttccatgcctgtaaatctcctgttcatctttcagcatctaactcacattatcatctctacctggaggccatctcagaaacctcttcctctgtgccttccctcataccaaggacatatcaccattgtgcatatcacactatattaacatattcgtctgtttccttactca

SEQ ID NO: 208626 - DNA, 400 bp, Homo sapiens
agccatcaagggctgaatgcctctccagttgccagaggaggagtggcttgtagagcggatgttcccagtctggcagaatcttctgtcaagtgttccctgagttgggctgccagggggcaggtgttgaacagtgaggaagtcctctcacctgagcagcttctgatgcaagaggggtgtcgtgagtgcctggaatcctatgcctgtgggtggagcgtgaacttagcctcttccctgagggtaggcagcatgtcataaccacttctggctgcccatggctggtttggggcaatatgccaagatgtagttttgcctatttggtttgctttttcctttaaaatgtacaaaagttaataacatgtaatgggtttttaaaaaattataaaatatgagatacaatcag

SEQ ID NO: 208627 - DNA, 481 bp, Homo sapiens
agccaaagaaaacctaagaggctttgttggggaggaacaggggaccctgccggaccctgcaggtttccctttccctactggctgaaagggagggctgcacacatcagggaggagaaatagaggaagaagatgatgggcacaaaagcagaggggcaacaaagtacagatcacatcttgggggcacagggtacagttctcagaatagagaagaatgtccaggtcaaaggtttcctagaaaactcccttctctttaaaacagacacatgattttccttgggacatttttatatacaacttacaactgccagatcactcttggaaaatccgctgctcatcttggcagtggcagtggaaagaagccagtgtccttagacatatctctttgtgggccccagccccaacatgcaggtgtccatagcacaggacagaggactccatgcagccaaaaatcagtgcagttaccccctaagtcctccatcta

SEQ ID NO: 208628 - DNA, 585 bp, Homo sapiens
cggggagacttgagtgggtagcgatatgggcagtggcccgtgcggggtctacagcataccaggatatacctggaggctgggccctgcaccagcctcagcagcacagatgtgttacggcccaaagggctaggggacaagtgtggagaggcgagcatgtccactcagactcagggtcctgccctcagcacccctacttccctgccctcgtctactctcgatgcgcccacctgccctcccaatgctaaacaaccagaggaagcccatggccaccaaaaaggctttcctctccggctagatctccaggatcctgcttgtatgttacaaatcaaaagtttggcctaggctggacacagtggctcacgcctgtattccctctctttgggagacctgaggtcaggccaacatggtgaaaccccatctctatgaaaaataaaaattagctgggcatggtggcacacacttgtcgtcccagctactcaggaggctgagtcaggagaattgcttgaacctggaggcggaggttgcagtgagccgagattgcgccactgtgctccagcctgggcgacagagggagacgttgtctca

SEQ ID NO: 208629 - DNA, 768 bp, Homo sapiens
ggctggggtgtgagggcctctccatgaaggtcttgggtagtgggtacccagggtcctggggagtgtggggactatgttacggtcttctggacctttggctacatacccataaacttcaaccacatgtgggttttcttggtactaaagaattgattaggctaggtgtggtggctcatgcctgtaatctcagcactttgggaggccaaggtgggtggatcacctgaagtcagagtcaagaccagcctgaccaacatggtgaaaccctgtctctactaaaaatacaaaaattagccgggcatggtggtgcatgcctgtaattccagctactcaagagcctaaggcaggagaattgcttgaacctgggaggtggaggttgcaatgagccgagattgtgccactgccctccagcctgggtgacatctcggaaaaaaaaaaaaagaattgggagtgggtagcaattgctttgccaccttaaaaaaaagttagactgggtgcaatggctcacacttgtaatcccaatactttgggaggctgagatgggaagattgcttgagcctaagagcttgaggccagcctgggtaacatagtgacacctcctttctacaaaaaattttaaaaattagctggacatggtggtgcacatttgtggtcccagctactcaagaggctgaggtggaaggatctcttgatccctagaggtcaaggctacagtgagccatgattgtaccactgtacttcagcctgggtgacagagcgagatcttgtctc

SEQ ID NO: 208630 - DNA, 463 bp, Homo sapiens
agtccttaaccttggcaaaataaactttctaaattgattgagacctgtctcaagatattttggcttcataccaacaaccctatgatgaaggtactttctaaatcctattttataaatgaagggctgaggcacagagaggttaagtatgttgcctaggtcacagtgaaaaatgaatggaatgtccgggtgcggtcgctcacgcctgtaatcctggcattttgggaggccgaggcaggcagatcgcctgaggtcaggagttcaagaccagcctggccaacatggtgaaaccccatctctactaaaatacaaaaattagccaggtatgatggtaagtgcctgtgatcccagctacttgggaggctgagacagaatcacttgaactcaggagacagtggttgcagtaagccgagatcgcaccactgcactccagcctgggcagcggagtgagactctatcttaaaaa

SEQ ID NO: 208631 - DNA, 227 bp, Homo sapiens
tgtcagtgaacatttgaaaactggggaaccacaaaacccccccacctcagggctgttctcaggctcgcccaactcatgaagtccaagctgttgccccagaggcctcttgcagaccttatcaaagccagggtcccagccaggcacggtggctcatgcctgtaatcccagcactttgggaggccaaggcgagaggatcactgacaacggaacggcctcactgacaacgg

SEQ ID NO: 208632 - DNA, 454 bp, Homo sapiens
  misc_feature (16)..(16): n is a, c, g, or t
accgttcgtacgaganatcgctgtcctctccttgctcgagatccattgtgctctaaagggtgaatttaagtatgtgtgtctcttgcaaaccactcatcagaggcacccgatggtcatctgcctgcccgcagactccaggcaggtttgctggcagtgtagccgggtggggtcatggagatgctggcaggaatgacccccctgtggggggcgcggagggagcagtgggcacccagccagggctctgtcagtgggactggtctgaaaccatacctcataataaaagtcatataatttgtggcagcgctgaaaacctgctccaagtagtggtttcttgatggagttttggaaccttatctgcggctggtaaccattccttgagaacttgttggagaaaggcgagtgagcatcttaagaaggctgctggggaagctgagtgcaccagggcggggggcca

SEQ ID NO: 208633 - DNA, 204 bp, Homo sapiens
taacaagggagaaaacaacacacacacacacacacacacacacacacacacacacacactcacaagcatctgcataaggcaacactgaaaggacatataagaaaatacggaaagggagcaagactctacattagctaccttccaatagcattctgtttttactcacataatcaaattacccattccaatagtaataaattaaca

SEQ ID NO: 208634 - DNA, 243 bp, Homo sapiens
gagggctgagctaatctaaaaagaggaggacttgtcattatgaggagagaaggatcaggttcttggttatgtgctatggagtctatgcttggaagtgagtacgaagtgaattaaaggaatctgaaaatacataggaaatttgagtggctaggataggtttaggtgggtattcctcagcatgattagtgatggaacaaggaaacaaactgatggggagaatgacatgttatggtcactggcagg

SEQ ID NO: 208635 - DNA, 755 bp, Homo sapiens
tctccctagagagagagagagctgttttcttttctttttcttttcccattaaacctctgctcctaaactcctcatatgtgtctgtgtcctaaattttcttggtgcaagaggatgaaccccaggttcagggaatgcatgtggaggtttggtacatggcgatattgcttgttgctgaggctcagtgtaagaatgatcctgtcaccaaggatttgaaatttggaaaagcctataaagttttcagaaaattccagaaaaaaaattctgcacagaagcatttaactatatttaaacgtatgagatacagctgatggaaacataatatttgacttggaaaccattattgtaaaaactaatacattgtctttctttcctgcttcacatattcatcaattgcctacaatgcgaaagacattatcctaagtactcacatgaaaacaaaaacaaaatggagttgtagatgctggcaaggctgtggagaaaaaggaatgcttgcctactgttggtggaaatgtaaattgatttagcctctgtggaaagcagtttggagatttctgaaagaacttagtactatcattcaacccagaaagcccattattgggtatatattgaaaaaatcattctactaaaaagacacatgcatttgcatgttaatctcaacactattcatcatagcaaagacatggaatcaacataggtgcccatcaacagtggactggataaagaaattggtacatatacaccatggaatactatgt

SEQ ID NO: 208636 - DNA, 201 bp, Homo sapiens
tccgcctgccttgacctcccaaagcgctgggattacaggcatgagccactgtgcctggccagaaagccttctttattgagcttggtggcagcccaaaactgattctttaagggtgtcaggacttaacacctcctgtgacttagccgcacctcctctcctttgactttcattccacctccttccaggatcgcaaggtcccta

SEQ ID NO: 208637 - DNA, 462 bp, Homo sapiens
  misc_feature (165)..(165): n is a, c, g, or t
tgaggtatacggaaacataagacagtgacagatacagatagatgaggatgcagaagtcagattgtcgcacttcaggattgagaccggaagcttaaaggctgtcgcaaggaggaagaactgaagaagtcgggaactcagagtttgcccccccgtacccaatgtggnccacaccactgtcagtgacgatgtctctatgacgttcatcaccagcaaagagggactgaactgccgtgtggtaggaggtacctcctaccccacgaaagaccagcctgtgtaacatagggagaccctgtctctacaaaaaataaaaaactagcccggcgcgttggcacacgcctgaagtctcaactatttgggaggacgaggtgggaggactcatgggaggataaagagtggctaaggcatacactccttatgaggtagctactgctcttagcgctttacccgtgttaatttcattta

SEQ ID NO: 208638 - DNA, 394 bp, Homo sapiens
tatgcccacgagaggctgcaataaaagcaccaacttttacaaaagaggtaccactgcaaaagctgttccaactaaggactagagaccagcaagcaagcaagcaaaaaatcctagcctcctttcaacagggaagtaaaaaaacagcacacataccttcttcctagaaatgttcaatttgcttccaataacttctgccattttcagtttgcttgtatgctcagaaagcattgctgtgaaacagtctagagcctattaaaataaccaaggtaaatgctgactgatttttaaaataatatattaatcacagaacatcattttcctggccacaagagggagaaacacaaaatccagcaggaacatttctctaaaaatgaagggagtgcaaataaggtac

SEQ ID NO: 208639 - DNA, 702 bp, Homo sapiens
actaagtctaagccacagaaataacaaaaatggaaactcaaaagtatttaagcatttgttgtgctgggcagagagctagtctctgaggatacaatgacaaacagggttgtcttattctgttttgtattgctataacagaatatacctgagactggtaattcataaaagtttactgggctcatgattctgcaggctgggaagttcaggagcttagtgctccatctaggggcttatggtgaggaccaggtgctgggtcaaaacacagtggaaaagcagaaaagggagtgggcatgtacaaagagatcacatcgtgagagtggaagcaagagaattctaggaagccaaacttccttttataacaacctgcttttataacaatctactcttgcagtaactaatccagtcctgagaaaactcactcccacagaagagaattaaatctatttgtgagggatctgcccccatgacccaaacaccttccaccaggccctgcctcccaacactgccacctaggggatcaagttttaagatgagttttggaggggacaaatcaaatcgtagcagagatacagggagaccagagctcagaaagaggttctaatccaccaggggtgccaagggaccgaatccaaaacggaaggtgaaccgaattccacagcaggtaacccgcaagactctggactacgggggcaccgggggagc

SEQ ID NO: 208640 - DNA, 594 bp, Homo sapiens
tcagccggcccgagttgggcctggggcttttgctttgagcactggcagggtcagaccagagagccctgggcgtgaggtccagaagggatctcagaggtccctttacgcacaaggttagtgaggtccagagagaggctggggcatgcctgggggtgcctggaaggtaatggccaagcctggtttggggagcggctttggtggcctcagcccctacctgttcttagcatgagccgcagagttcactagtctatattttggatgggcttaaagtgtcatgcctgttgagatttattttataaaaagtaaactgggccaggcatggtggctcacgcctataatcccaacactttgggaggctgaggcaggtagatcacttgaggtcaggagtttgagaccagcctggccaacatggtgaaactcctgtctctactaaaaatacaaaagttagctggatgtggtggtacatgcctgtaatcccagctactcaggaggctgaggcacgagaatcgcttgaacccaggaggcggaggttgcagtgagctgagattgtgccactgcactccagcctgggtgacagaacgagagaccctgttg

SEQ ID NO: 208641 - DNA, 372 bp, Homo sapiens
gccacacaggagcttttagtccagaagaaaatcccagagcctcagggagtgacttaggattcaagagagatttttgcttttgctaatggttttcctttcctttctttctgccactcatccagggttttaagccagcagccaagacgttgcttactcataacccccctctctcttgctttatttaagtctatgttttttcgttcacttttccatgcggagagaaaagaagagtgtgttttatcacaatctgttcctagaaactcttttattgaggatttggttgtaaaagggccatgcattctgtaggaatagtaagcagagcggggaaggagggggttgggtttccaccaaagtctccacgtcagataaatc

SEQ ID NO: 208642 - DNA, 225 bp, Homo sapiens
ttgaagactgtggacagattaattcaactttataatgacctgtacattttgaacagttaatgtgtgctttctctttaatctataatcatttccatccaccttatatcttttcctccacattcttagtcctctgtgatggaattttgttttcttcctatgtaatattatctctgttggattctgtgatttgcctagaacaatgaattgggaatacttgctccagct

SEQ ID NO: 208643 - DNA, 594 bp, Homo sapiens
taaagctctttggggtaatggaaaaattaccttaataaccaggtatccaggtgacagctgctctagagattccactgttatgtctctttaaacctgtgatttactaacattccactattctatacaagaacctggtccctccccttttgggagcggggaagggacaccaaattaaacatacctaaaagacctgggaggatatatactgaaattttaataggacgtcattggggtggtaggattacagaaaaaaaaaaatcctctttattaacaaatttactgatataaatataaaaatacttttatagtaagaaattatgtgtacctcttttggaaatatttatatgcatcctataaaattgttgggaggaagtaaatgaaatgtgaagacaccaattccattaatcaattgctgctctatgcacttcaagaataatctgcttttaaaaggtggcagagaaaagacgcatgtctcaagttctgtacactgggttgtgattaaaaaaaaaaaacgatacaagtcttaggccctacatcacaaatgtactgcagaacagtttcaacggcttaagaaggtcaaccttaatacattca

SEQ ID NO: 208644 - DNA, 283 bp, Homo sapiens
ctcttacacttggctagtttttagcaagttcctgacattgtaaataaaaaaactgtataaataacttgaaacctaaagtattttctttagaaagagtttatattggctttgggaagtcaatttgagacaggagcaatcctagatcaccttaatccagtttgggggattgagatgagttaaagttgggcttcagttcctgaaaggaggccattctatttcaaattcattcacatttctaggctgtagccctttgggcttccaacctaaagtttacgtgaagtct

SEQ ID NO: 208645 - DNA, 529 bp, Homo sapiens
accctccaccccacgttactgttttaatgtgtttagtatgtgtatgtgttcttacatagtttattttggtatgtttggtactttatgtaaatattacatatgtcttatctgtgcgcttaatatattgcatctaactgctgaatagcagtgagatgtatgcatctaccacattttaccagtctgctcgccagaggtgcacatgttaattttctccaactctgtcaccacaaaaaaaatgcttcaacatcttcatgcatgtccccttatggagcaatgtaagagtttctttgggatatatagcttggaatggacttgatgggtcacaggaaatgtcagattgttcttctagatggctgcttccatcaatagtgcaccacagtttttgtattcccgtttctctgccaacatttcagagctttctgccttttccctatctaacaggcctaaggtgatactacattgtggttttaacttgtatttctctctgatttttagaatctctttatacattccttggctttgggtgcat

SEQ ID NO: 208646 - DNA, 391 bp, Homo sapiens
gcaagggatattgggaaacatcatattttagctgggcacattatcttcttgaaaataccgtacatgagaagaggagaataaatattgatattgataggcaactagtagtgtgtctcaatgagcagaactttgctgtgactatcttaaaagaaaggcttctagttagacaacctgaggtcaggagttcatgactagcctggccaatatggtgaaactcagcctctactaaaaatacaaaaattagccaggcgtggtggtgggtgtctgtaatctcagctacttgggaggctgagacaggagacttgcttggacccagaaggtggaggttgcaatgagccaagactgtgccattgcactccagcctgggcaacagagtgagactctgtctcaa

SEQ ID NO: 208647 - DNA, 655 bp, Homo sapiens
taaaaatctgatagacacggacttgttatttattccggaaatatctaacgaggcccaccaggttcaaggcactggggaaggaccagggtcgtgcatttgaaaagcttaccttagtggaatagactggctgaagcaaacaaacaaggtaatgacaggtgtagtatggctttgcaggaaacacacagagtgatgaaaaagattttgtagacgaagcctctggctggataggatggctaaaaaagacctctaggaggaagtgatagttgaggagcctcctgacaaaaaaggcacgaaatacacctaaccacgactttacatacagggactgcagattccagaaccccctgaataagcccactaattccatgttgagcacctgtctctaaagccttctaagggctgtttctgtgctgcccacttcccctgcaatttcagaaggcttgatcaccccttacagtttatgggggctggcactgtggcactaatgggggaggttcgagagacagggagaattatacccatcagctttgagagacaaattctttaccttttcactgtttctatgtcactatatttctcagagtcatgagtaaacattaaaactatgatttttacgttggcatgttgtgatctgaataaaatgattaatgacatc

SEQ ID NO: 208648 - DNA, 931 bp, Homo sapiens
ctctgttcaacactacaagtaattctgcatcaagagaaagctccaaatattctaacaaccattcagcatttccaatgatcttagatccacgcttggtgcgaaaactgaaaacgagagaaaggaaacgctgtggccaggtccatctgatactgtgaaatatttcttatcttgattttctcctggataagatcctggagcttggctggagccaagatggctgaataggaacagctccggtctacagctcccagcgtgagcgacgtagaagacgggtgatttctgcatttccatctgaggaacgcagctcctcaccagcaacggaacaaagctggatggagaatgactttgacgagttgagagaagaaggcttcagacgatcaaactactccgagctacagaaggaaattcaaaccaaaggcaaagaagttgaaaagtttgaaaaaaatttagacgaatgtataactagaataaccaatacagagaagtgcttaaaggagctgatggagctgaaagccaaggctcgagaactacgtgaagaatacagaagcctcaggagccaatgcgatcaactggaagaaagggtatcagtgatggaagatgaaatgaatgaaattgaacgtgagaaggggaacgttcaagaagaacacaccgcaatacacagaaaccgacacaaccgtctcccacgaaatcttggggacttatgttgacacacagaccaaatccaccgtttgactggtgtcctgcaagtgaccaggagcattggcacccagtggacaaccactctcgcggactatttccaggagaacttccccatctagaggcgggcactctccatctcggatcagaaccgccagatgcccccacaagcatccgacactactgcggcacaacttcactacgcaccgttcggccccacaagctccctagaggg

SEQ ID NO: 208649 - DNA, 262 bp, Homo sapiens
tatcctatctatgcatatcagttcatgcatcaatgtttaattcttaaaggattcccctaggtgtgcagagttatctatgagattatgtataattaagtcctaattttagcacttgctggccatgagaatttgtgtaaattatttaatcttcacaactgctgataagattagcattaatgttttatttaaaagataagagaactcaaactcatgattctttctaaaacgatttatatgaaaatctttaacagtcttttatgta

SEQ ID NO: 208650 - DNA, 387 bp, Homo sapiens
aggtttgggggtacatgtgcaggtttgttatataggtaaatttgtgtcactgggggttgttgtacagattattttgtcagtcaggtgctaaccctagtactcaatagttattttttctgctcttctccctgggaagaggaaaagatcttgaccatgtatttccaaaaagcagaaatagaataaatggctagaaatgcaagaaaggcagattttcgctcagtgtaagagaaaatgtggttattatttgttttgatgtattaggagataatgagtttcctatcactggaaatacacaaacgattcaatgtggatcccagcaggaggtgggggatttgactagtcatctgtgtttaaaaacagtgttaacatgctacatgcaaatatgac

SEQ ID NO: 208651 - DNA, 433 bp, Homo sapiens
tccattcttaggatgatgtgctgcatttctgcaatggcacccactggcgtgcaaaagaaaaactggattttccaggttaagcagaaacatggacgccatactaaactctgaacagacacattcatgcatcttcttgtccaccagctgcaggaactcaggggttttactacttcatccttttatgcccaacaccccatcagctccagaggcagcttggctgcatgccaatgtcagtgtagaattattctatcctcacgggttcatatcgtttgtcaagtcaccaaacactcagaaatattgatgagtcatctacctagatgtttttgttcatttgtaagactaacttgtacagagttttgagttttcttaagattttagagatataaataaaccatcaattaaggatttagaattcactaaaaataaaagcttt

SEQ ID NO: 208652 - DNA, 579 bp, Homo sapiens
tatggagactacttttccatggtcggtacttggtttggactgaggtctcatgtggatcaaatccctgtgtgtgtgcaaagctaggtctatcattattttctgatggatgaagtggaggccatgctgtgaatgtgtgcacgtgcaagtctttgacacaggcagttttctctaaaatgcacagcctgccttaccaacttaactccttccacacctcagaccagcccctgcaattgccctttgcatgttctcatctggcctcatgatcatctccttccacgtgggtctccctccttccatgtggccctgcatggcaggcagggcacatgctaacctgtcttctggtagtttggagtgagtggagagggccagtgtcctctggatgaaggacaactgctccattgtgcagtgtttttgttgttgtttgtttgtttttgagatggagtctagctctgttgcacaggctggagtgcagtggtgggatctcagctcactgcaacctctgcctcccgggttcaagcgattctcctgcctcagcctcccaagtagctgagattacaggcgcccgccactacatgcagc

SEQ ID NO: 208653 - DNA, 341 bp, Homo sapiens
ttctgtgtcatccacctggagtttgatggcctgccttcggtgacacatgaaagctggtcgagtggctctgagacctgaaaagaagcaaaaaattttgctctgaaacggaagagctgggaggaggaacaaagggcagtggcaatggaaagcaccacaaagccagtgctgctcagtctgatgagctgggagagtcttgaacaaggtcaagatgtgacctctgcatggtcagtatccacacacaaccctgcactgacgcaaaagaacaatatttccctccagatttgtctccgtgcaaaagggaattgtgggcagatgccgccacctgataattaaaataatat

SEQ ID NO: 208654 - DNA, 324 bp, Homo sapiens
  misc_feature (22)..(22): n is a, c, g, or t
gaccctgaggatccagacgacntgatcatgtgactcatttattggatgagtctgaaagaagataggagtcccctgatcccaagaaaaacagttataaataatagttatatgcatatttcttgcaagtcaacaatcccctggttcttatgactcttaaaattttacatttcctgggtattataagaaaaatcagatgacagaaggtttcatttctcttataagtagatccattagcatgccttctcttgataactaaacaccaattgatgtacaagcatttcatatcccagcccactctacaacctcttttctccccctcctcat

SEQ ID NO: 208655 - DNA, 419 bp, Homo sapiens
cacgctgccacacttttcagaaattaaatatgaagactatcaaattgggacctcagaatcaagaaggggagcagggaatagagctgaaatatgcctgggttcctttcacattccccccattatatttcgaagagaagcgtatggaagttaacaagcaaggaatacaggagaaatacttaaatgttgagttcactttgtgcatagatttaggtggttaaggttcagatttacttctgtttttctgtgtttgaataagcactaaggatctgactaaaataggctacattgccttctcattgggactttggaagcacttaataggggttgtattggaatttcagggagaaatagagggaaaaaaatcacagttctagtattaattttattgcctaatccataaggtgaaatgaagcttcagg

SEQ ID NO: 208656 - DNA, 561 bp, Homo sapiens
tgaacacaaagaaaaaatggattaccaggaactctctgaaattggggaggggctgggaccctggtctctttaggagaaattctaagaggccaactctgggagaggcaggttatggccagaagaagagagagcgtgggcaccaggtcagtggtgctttgttacagcaggggaggaactaatacaccactctccccatcagggccctcagctgcacttagaagatctggctaggatgaaatttatcatgcaaccagaaacctacagaatcagtctctgaattttattctcataggaggagagtcagccaacaacatcgacagccacaatttatttgatgccttcaggaaacatttcaaagccagatgtttgtttgaagtgtaggtcctgcttcaggtcccagcgttccttgtctcagccacgttccaccaggtggcagcaggtgctatgctggtcggcgtggggagtttcactgttgttccccctccctctcagcctgaacgctaattccacaaataccaaccatcctgagggtctgttatctgcaaccaactggttggtatc

SEQ ID NO: 208657 - DNA, 394 bp, Homo sapiens
tggttgggggaaagatgaacaagagatttattaagcgtgacaaaatgctgtgtcacgctctagtttataggccagaaaaaagctagagagaaagagaaagctgaaaaaataaatggaacagaagaggaggcacaacaataataagaacacaaagagaaaacaagagatcatgaggcagttgttctctttaaaagaaaggattatttttaattgttgtttttaagattttatcactgtgaatatggagaacagatgtaatttctttccacacatgcaaataaatatgccagttacacagttaaaacactcactaacgtaatagagtagatcaatatttaatgaatgcttaatctggggttactaggaacttgacgttttcactgagtatgaataa

SEQ ID NO: 208658 - DNA, 258 bp, Homo sapiens
ctaccttctgggagataaatgaagcatagcacactagttggtatgagcactcacctatttggccagaaattgtcataagtaatcctatatgtggcagggttatatttgctcttataacgacatcaaatacagaaatggcaataaacagcaagttcatgtttttggaagaaacagttagctctctcttgagttctggcgcagtcttggcagttttctttggtcttttttgtttgtttgttttttgagacggagtctcac

SEQ ID NO: 208659 - DNA, 444 bp, Homo sapiens
gggcccactgttagctgctagaattagctgcacaattatcccggtcacaccaaatggtcaccaagggtgatagagatcctagatgcaacttaatgaaccatattcagttttatgataacaaccatgtgtaagcagacacgcttgacctaactctgagatgggcatatgcttacttgcaacagaatctgctgggtcacttgatgtatttaaataaaagaaatgtgattaatggcaacaaaacatgtctttctcagaacagtgccttgtcaacagtaaccagctagcctgacctttcaatggctccctgaagggtgggtatatacactattcgttaattgtggcttatatttgtaccttggtataaagcaatatagctgtcaaaaatactgtatattgaatttttaaaaagttgttatcaattaaaaaattgttattgccataatt

SEQ ID NO: 208660 - DNA, 440 bp, Homo sapiens
tggaatgttagtaatcgggtcatgccgtggcatcatgattaatcaaactatcccctgtggttgattgtgaagaagtgcctgaagctagtaacttaagggaccaagtggcggctgcacttagccattatagtagtaatgatgatgtcagaagtgtggaatgggaggctattctgcctttagtggcattcttatggaaaaaaaaaatgacaagctcaagtctttaaacactcagctcaagtcatatctggcaaatctcaaattatttcacttctttttatctccacctctaccatcctactataagtcatattttctcaactgaagttttgcgacagcttcctgctctccctttcttacagtccatttcttagagggtgaccaagataccataaagccaacacctctgcctaaaacctccaatgacatcctactgcattaaa

SEQ ID NO: 208661 - DNA, 648 bp, Homo sapiens
ctaagattcataaaaattattatagctttagtcttgacagttgcctttttattttaaggaaattaaccccagaaaacacataaacacgtgcatatacatacatacacacacgcacattcaccacacagtttatgaaggaatacagagtgcccactggatcattcaacttcactgaatgaatatgcagaaattttaaaaaagtaattttgaaaaatttcaaatgatactgaaaaatttggtattttgttttaaaaatcttgactcatttatttataaagtgtgtatatagatagatacaagcagagaaatatatatcaatataaatgtgcagtaaatatgtatttatatatatttaccctttcagttatatatttacataaccgaaacatataaaattaacaaagaaggcagggcgcagtggctcatgccgataatcccagccctttgggaggctgaggcgggcggattatttgaggtaaggggtttgagaccagcctgaccaacatggtgaaaccctgtctctatcaaaactacaaaaattagcctggcatggtggcatgcgccttgtagttccagctgctctggaggtaattcctgtattttttgtacaaaaatttgaaatatatataatttcatattacttttgaa

SEQ ID NO: 208662 - DNA, 603 bp, Homo sapiens
ctaagattcataaaaattattatagctttagtcttgacagttgcctttttattttaaggaaattaaccccagaaaacacataaacacgtgcatatacatacatacacacacgcacattcaccacacagtttatgaaggaatacagagtgcccactggatcattcaacttcactgaatgaatatgcagaaattttaaaaaagtaattttgaaaaatttcaaatgatactgaaaaatttggtattttgttttaaaaatcttgactcatttatttataaagtgtgtatatagatagatacaagcagagaaatatatatcaatataaatgtgcagtaaatatgtatttatatatatttaccctttcagttatatatttacataaccgaaacatataaaattaacaaagaaggcagggcgcagtggctcatgccgataatcccagccctttgggaggctgaggcgggcggattatttgaggtaaggggtttgagaccagcctgaccaacatggtgaaaccctgtctctatcaaaactacaaaaattagcctggcatgtgtacaaatatttgatatatatataatctcatattacttgtgcactcgtgc

SEQ ID NO: 208663 - DNA, 248 bp, Homo sapiens
agcttaaaatttaatgtagtagtgtcattttcattgtcaagataaatttacaaagtacatgttaagtttagcatagtgcctgatctaatactcactaaattttctgtgtaaaataagattaattaaaccctgattattcctgctttttaattatttcctttaagaaaactgaattgtcttagagtatattttaagatattgaagatagctgaagcattaattttcaagaaataaaaacctggaagttg

SEQ ID NO: 208664 - DNA, 167 bp, Homo sapiens
ccaaactgaaagaagctaccgtttgaaatgtctgtgattacagatttacttagactcagcttccgatagcacttatttctagctcattacttcctccggaaagaaagggtcagctctgggtgatgggagtttaacccaatgaatttggtgtgatggatagatatttg

SEQ ID NO: 208665 - DNA, 580 bp, Homo sapiens
gagaattgcttgaacccaggaggcagaagttgcagtgagccgagatcacgccactgcactccagcctgggcgacagagcaagactctgtctcaaaacaaaacaaaacaaaacaaaaagtcataaaaattaagtttttagtcagacatggtggctcacgcctgtaattccagcactttgcaaggctgaggtgggtggattgcttgagctcaggagttcgagaccaacctgtgcaaaatggtgagaccccttccctacaaaaaatagaaaaattagtccggtgtggtggtggcacgtgctggtagtcccagctacttgggaggctgagggaggaggatcacttgagtccaggaggcggaggttgcagtgagccaagatcgtgccactgcactccagcctgggagtctccagagggagaccttgtctcaaagaaacaaacaaaaaagtttttaaatactaatttttctcgtacgttcttgagaacattcatctttttaacttcttcttagtgctcttggtgcccctgggtacttccagtttattttggttctaaacacccaaggcaaaccaaggtctcactgc

SEQ ID NO: 208666 - DNA, 576 bp, Homo sapiens
caaggagctcacctccactgtgaacttcagtacacatattactgctgtccataatattatattatgataaaagtagattagattaaaagtagacaactgtctggatgttgtctgtgttgtattaaaaaacataggctataattagaaattgagatacttttatcaaatcctgaaatttgagtctgtgtttataaagggaaaaagtgattatactttaaattctttgaaatcgtttgcagaaaaaattaaaatctagtgttttctaggatagatctaaagtatttggatgctagtagtattacattttgtaatactttggtttctttgcacaaactggagcttggaggtgagaagaagaaacaaaaataccattacttcaaactatgatcatttcttggaattttagaatctcattttatagtcttctttatttgactttaaaaaatatcagtcaattcagatattacaaagaagttcactactttcctgactcttaactagcacattggaaagtggtttcatatttatgtattttaattgtggcaaacttgtttttaacaagtattgagggaaaat

SEQ ID NO: 208667 - DNA, 417 bp, Homo sapiens
ctcagctatttttctgttattgatttctagttcaagtccattgtggtcagacaccagacattatgtaatttttatgtttaaaatgtgtttaaggtgattctgaaggcccaaaatacagtctattttgttgaatgtttcatgtgagcttgagaaaaatatgtattctgctgttgttggatgaagtagtcagtagatgtccattatatctatttgattgatggtatggttaattttagctatgcacttacagattttctgcctactggatctgtccatttctgttggagtgttgaagtcaattatgatactgtatgcatttatttctcctcatatttctatgggttttgcctcacatatttttatactctgttgtcaggcacatacacattaaatattgttatgtctcatcgaatgagt

SEQ ID NO: 208668 - DNA, 188 bp, Homo sapiens
ccttttcatataactgttggttatgaaagtataaaaagtaatttttatactttctttggagaaatgtctattcaggtcctttgcctatattttaatctggttattcatatttttgcttttgagttgtgtgtgttccttatatgttttagatattagccccttatcaaatatatggtttgcaaatatta

SEQ ID NO: 208669 - DNA, 554 bp, Homo sapiens
tttgtgtgactctaccatgcttgataaggattcaggtagacctgaaagcttctccccagccactggatttgttctctcatctcttcttcttgcccccaaatctgcattttctgatgctgaaaaagagaatgatcagagttgtttcatatttttttagctttattctcttctactgtgagtacagctctgttgagctgtacagtacagtactgctttgcttgcaaagcagtacagatgcctaggagaagtttcaggatcacaggagaccagcagttacctggctgtaagctctccttttgactgttccttatggagggaatatttgtactcccagttgttaccttcctgctgaaggacatgagatgtgtctgtttgttatgaagttttccccctacttcccgagttgttgcttatctttgttgggctgttctctgctcttggttgaggtactgggatgtagaaccaccctctattagcatattagttattggactctgggtgaggctggagataccgtcattcctagagggtagaagaggtagggctcacaggca

SEQ ID NO: 208670 - DNA, 405 bp, Homo sapiens
agtgctgggattacaggcgtgagccaccgcgcccagcgacaataaatattttcaaaacagcaaacacatcttcccttaggcttctctcctccaagctaaaaacattacccagtttctttactcattattcattcatgcatttaacatttattgaaaatctactatgtaataggcatgatactaggtgccggggttatgacacaatctttgctctaaagacatttaagaggagatgaggcctggcatggtggctcacgcctgtaatcccagcactctgggaggctgaagtgggtggataacttgaggtcaggaattcgagaccagcctggccaacatggtaaaaacccgtctctactaaaaatacaaaaattggccggttgtggtggcacatgcctgtaatcccag

SEQ ID NO: 208671 - DNA, 389 bp, Homo sapiens
cagatatttccttctcaaaagaaaagcacatgattttatagcatttttaaacgccagggcatctcatcagctcagtcttttcagtaatttaaaaaaaaaaaaacccagatagtggaaatcagggtagtcaatggaaaaaattcaataaagctgaatatctcggcaccacagagtggtgtcctttgaatgtttgtttatcattcaaatataataacaccaaaaagaaaaaagcatatgaagtgatggatatgttaattagcttgattatggtgatttcacagtgtatacacctactatcatatcaactagcataccttaaattatttttatttgtcaattatacctccataaaactggggggaaaagccactcttttaaaggcttaatag

SEQ ID NO: 208672 - DNA, 361 bp, Homo sapiens
ggttgcagtgagccgagatttcgccaacgcactccagcctgagcaacagagtgagaccctgtctcagaaaaacaaaaaaaaacccaaccccatgtgtgtggagggtggtgggtgagtcttcccttggatgcaaatgggggccctggcagcctccttggggctggtgtgaaggagacccccagcctcagaccctgggcacgccagcagcagcaactcagaataccacccggaagcaagccgctggccctgcagactctccaccttagaacagctgtgtctgtgacaaggacctcgctgtgtcccttactgccttgggggctaggagtggctggggtgtgtgctgagggcccccacagagcct

SEQ ID NO: 208673 - DNA, 867 bp, Homo sapiens
agtgctttaccgattcacatgacaactggtaaaacgaaaacaaacacctttccaggaattgtgaattcgagttccagaccctctgggattccgggagcgcagctgctatttatgttaacagtcattggtcccaggctggtgaggttagaatttccaagtataaaagtaatttagtttcgttttaaatacattttagggccaaagaaaagtggaacgatttaaagaaaaagatgaaatgaataatagggcaagttgggaggtggctgtcctgaggtttcatgggacaacattaattaacctcatgaagtgcctgcatggacaacgtgcccggtgtggttacaaacaaaccaatcagcacagatcctgggtggaaagcagggcgcagccacggaggcacagtaggggtgcagacttgaaggtttttaggaggtaagccccgagggcacgaagctccacggagagactgttgacccgcctgggagtgcaaggtggatgagagtgggacacctgccagttgtttgcatcagcagacactcagagtccatggaaaaaatgagcctagaggtttttaaaccacaacacaagcaaaaggcacctggtcccgttcctcttaagacagaagaaagaggcgtaaaaccagctccaggtgccacccttaagaaatgttacagtgccggatgggaagagtaaaccctgaacatctcttcttaatactttacagacttcaagtgtattttatggtgacaaagcatattgaagacaaatgaaactctacaaccctgaaaaccagcctgaattattttgagagacagacagtggctgcaaggagaagcgtcgggattttctgggctggccatctccagtgtc

SEQ ID NO: 208674 - DNA, 412 bp, Homo sapiens
ttaaaaatcgtgtttaaatatatttgataaatagtattcatttaatactctgctggaaggacagtatcttaatagtttatgaaatgggcagcaattaataaatacatttgtgttaaaaatgtcctattcggcagggcgcggtggctcacgcctgtaatcccagcactttgggaggccaaggtgggtggatcacgaggtcaggagatcgagaccatcctggctaacacggtgaaaccctgtctctactaaaaatacaaaaaattagccgggcgtggtggcgggcgcctgtatttccagctacttgggaggctgaggcaggagagtggtgggaactcgggaagcggagcttgcagtgagccgacatagcgccactgcagtctggcctgggcgaaagagcaagactgcgtctcaa

SEQ ID NO: 208675 - DNA, 449 bp, Homo sapiens
gggggctcaggattcaacaaagcattgttgaaagcagtcactaccacatcaaccgggcctcaacatgaaattatctgccatcgcaagaacttcagtatcataattctcacacatgagaaaattaggcctatggtgataaaccaattgctcaaagtggtaaagactatttactagctatttctgtaatatttattcccaccatcagtaaccagactttgaacctattctaagtagcaaggtactcatctaaaaaaactacattcccaaccaggcgcagtggctcacgcctgtaatctcagcactttggaaggccaaggcaggcagatcacgaggtcaggagatcaagatcaacctggctaacacggtgaaaccccgtctctaataaaaatacaaaaaaattagccaggcatggtggcctgtagtcccagctactcgggaggctgaggtgg

SEQ ID NO: 208676 - DNA, 220 bp, Homo sapiens
taatcccagctactcaggagactgaggcaggggaatcgcttgggcccagaagacggagatcacaccactgcactccagcttgggcaacagagtgggaccctgtctcaaaatgactagatcgcatacaagttggtgtaaatgctgagccaggtaagcaaacatcttgcttgccacaggggtttggagaagggagagagcatcaaggtgtcaacgaaaagag

SEQ ID NO: 208677 - DNA, 363 bp, Homo sapiens
ctgccaaaataagtgtaatcatgttgttcagcctaacaagaagggggtgctttgcatgcacaattccatgcaaatgaattcacatttccatttagctgtaatgggcacattctccccacagctgtgcttttcgttgtgacatggagatagaagctccactttcaaaattattggatttggaaatggagttagaatattgaatttggtgcctaaaataataactatctctttttaaaaacattattatatgctcaaaaccccttccctggactaagtcatttaattctcataaccctatgagataggtactgtgatcatcttcagaacagagttttggagcatagagagtgggtaagcatctgg

SEQ ID NO: 208678 - DNA, 356 bp, Homo sapiens
atacacagcatagagacagacttaaagaaataggaaacctccatataattaaggtgctctagtcactaatctccaaattggtcactacttctgaaatcccagctaatctggttaattattaaaaccatcattcaggtgtattgtgtaaactaaagaaacctggccttcagggcagagcctacattgtctcttggtgcaaaactgaatatgtagttggtctagacatccatacatcctcctcaaggtcatgccatttttaacacccttcattgtccccaacactgaaatgtatcttacaagagaatggaactcaggccctaaaagaaattagattgaacctaaaagaaaatggtcag

SEQ ID NO: 208679 - DNA, 601 bp, Homo sapiens
tgttgttagatgtgagatgggtatcttgaagatagcagatggttgggtcttgtctttttatccaccttgacactccatgtcttttaagagggacgtttagccatttatactcaggattagtattgatatgtgagattttgatcctgtcattatgttgttggttgttgtatagacttgactgtatagttgctttgtagtgtctgtgggctatgtgcttaagtgtatttttgtggtagtaggtgtcattcttctgattccatgtttagtactcccttaaggacctctttcttgtaaggctggtgtagttgaagcaaattccctcagtatttgcttgtctgagaaggattttatttctctttcacttatgaatgttgggctggtaggatatgaaattcttagttgtaatatcttttctttaaggttgcctaaaagaggcccccaatctcttctggtttgcaaggtttctgccaagaagtctgctgctagcctgatgggagttccttctgtacatgacctgacccttctctctagctgcctttaagattttttcttttgcgttgactttggtgaatttgatgacgatgtgccttggcgcaggcaa

SEQ ID NO: 208680 - DNA, 348 bp, Homo sapiens
aggctgaagactgaaatggtctatttgccctcaaataagacatctcatatcagcctctagatcagggtctcaaaaggacctttaaggctcattacacacggcgttctatggaaaggataataacgctgtgaaggagaaccctgatagagagaaggtcaggaaaatctgaaaggatttcaccattgaaggtgccactgttgtaacagaaaaaactgtgagagctatcaacccgaaacaataaattcctgctgcagaaaactctgtccagatgttgtgcatgacttcatgggatttgcaacagagccaaccaaggaaatcatgaaagagactgtggctatggcaaaaaaa

SEQ ID NO: 208681 - DNA, 432 bp, Homo sapiens
tcccacctgagactcaacagagggcggtatgagcacttgaccgcacctctgcccatatgctgagagcaggtcagtactgggacaccctggagttactaaactctaagctaagggtgatccacccagccctatcactccttcccagctccatctctccacatagttcaaggtcaggctcaaccatgtcagcccatggaggtctttggcaggagctggggctcctgtagtggggagggaacctggtacctcaattctggatctcaccttctcttccctgcagccttgtcccaacatttactggctttgggtccagtggcacagatgcagcatcagaaccctccctcccatcctcaaggctgtagatcatagcagtcttcaggggcccaagctctttccaggtcctgctttccaaaaatgagcctcaaatgcagc

SEQ ID NO: 208682 - DNA, 495 bp, Homo sapiens
atgtgatagcttatagtgtgatctcgaaaatagtgtcaatagaaaataaccaagtcttgtggaccagtaaaaagaagcggctaaaaagacattattgggataactggcataatcagaacataaactgcggattagctaatagcatagtgtcaatgttcaatttcctgaatgtgataactatactacagtttcttaagagaacagcctcattcttgggaatgcacactgaagtatttatgaatcaagaggcatgatttctgcaactttcacatggttaacaaaaaaaattatatagaaagaggatgataaaatagatgaggcaaaatgttaacactgggtgaatctgggtaaagggtatataggagttccttgcactattcttgtaagacttctgttaagtttaagatcatttccaagtgaaaatgaaaaggttgccttgggtgtccaaccaccaccccaatcaaagcttgtgtctccctgttcacccacctgaac

SEQ ID NO: 208683 - DNA, 552 bp, Homo sapiens
  misc_feature (522)..(522): n is a, c, g, or t
tataaacacccaccccccaactcttcaactcattatcagtgacttctatcagactcttgaatatgcacccttgggaaatggagtaagaaccatagcttaaatcgtttaaactcatatgggacaaaacgatgaaaatatgcaagagggaacaatcttacattggaaaagaaatcaagccaatgacccaatatatctttttattatttcttgggagaacctgtatgtttaattcatggaattcttcactgtttctatgttgaaatacacttatgtgaaaattgcactcctattaataaaataggactttaaaaagcccaaggattttagtatcgaaatgtttctgtgcaatatattaacattcattgactatgtgaatccccacctgtacttcgtgtaaattaccaaaggtgccctttcctctgtgcacatgacacgtgtgcccttgccggtgtaattggactcatgcttagggcttagtgaggctggtatattcaattactaccacctggcattccttacagngtagtcaacaccttcacatctgaatgtttg

SEQ ID NO: 208684 - DNA, 619 bp, Homo sapiens
cggactcctgcctgatgagtttggggacactgatgcccctgagtgaggctcaggatgggggagtgaaagaaggtgccagagcaacacagtttggttcagatggtaacagtggggtgtgccacattaagaaatttgaaatcaacccatcaattaaatagagaaagggaggaaaacaatgtacatttaatacctattaaatgaaaatacttatgaaatggaaataaagcacccgtgcctcctgctgatggtcaaaggtctccctgccagtgagtgatgggagcacaggattgtgacaggtcccaactgatgctaaagcttattttgacctcacctggttcctgagggccaatggaggctttgaagcaagggtgtgtcctgctcacagttttttgttttgttttcagccaaggagccaggagccaggaagaaaggaccagtgaggggagtgggagggtcagagaggcggggccatcccaagcccagaggcagcaccagctcctaaggcagtgagtagcttggggctctaaaggcagttctgatttgattcttcctgaactacccttggactttctagtcaaagtgtgctttggtcgtgctgtgcagatgtggccctggtgac

SEQ ID NO: 208685 - DNA, 561 bp, Homo sapiens
gcagcaatggggagcccttgcgctttggcagtccctgggcacatagagatcttggcctgagctgacctttgtccttgagatgtctatagggggagtcatgccacaccatgctcctgatcagggcaggtgtgagtggcagaaatctgttccatgccgggcgagactttgagcgtttgcagatagtaactcacacatgttcagggctctagggggcagatactaggagtgttcctgctgcagtgtaggaccttagccatgtggtccagcatggggttgtcatgaattccactgggactcaactgggatggggtgttttgtttgcacaggactcagccagtcttaaaatgcaaagttctgcatcctgggagccctctcagtcccagacaaacctaagtggccctgtggtgggctgagggtcaccctacctcttgggcagccctggtgggactggaggcaggtgtgtgttggggccaggtgggaggcaggtggcctggacctcccttgtgctcccgcctgctgaggctggctgtctggcgaggctggcgtgtgtggatgcagtgg

SEQ ID NO: 208686 - DNA, 245 bp, Homo sapiens
gccttctgtgtcagcctcggccagagattaggaggaggccctggggcatcagtgagccattgatgtcccaagcatcgggctcagtggccagaaacagtctctggagatagaaaggcctgtgaggattcagtggagataccagctagggcaggtaggaccaggtctcaggtccccagtatctgaggtgtgatggattatcaaagaatgcagagcccaagttttaggatcagagccaaaaatggggg

SEQ ID NO: 208687 - DNA, 641 bp, Homo sapiens
actgcactctagcctgggtgacagagcaagactccatctcaaaaaataagaagaaaagactgtatcccctttcagttctggaggctagaagtccaaacaggttgttggtggggcttctgcttcctctaaaagctttagggcaggggcccccagccccagagccacagaccattacttgtctgtggcctgtcaggaacaaggtcacacagcaggagataagtaacaggtgagcacttgaagtttcatctgtatttatggctgccccccatcgctcacatttctgccgtagctcctcctcctgtcataccagcagtggcattagattctcataggagcgtgaatcctattgtgaactgtgcatgcaagggatctaggttgcacactccttatgagaatataatgcctgatgatctgtcagtgtcttccataacccccatatgggactgtctagttgcaggaaaacaagctcagggctcctactgattctaccttatggtgagttgtataattatttcatcatgtattacgatgtaataataatagaaatacagtgcacagtaaatgtaattcacttcaatcatcccggaactatcccctaattcccaacccggatctgggaaacaattatctcacatgacacc

SEQ ID NO: 208688 - DNA, 864 bp, Homo sapiens
acaaggaaggaaggaaggaaggaaggaaggaaggaagaaaaatgtctaagatgacttgtttttagatttttgattttagaaagaccactttggctgaaagagggggaataaaataaatgggacagagagaagtcagaagtgtgggggctgttgtatgacccaagccagaaaggatggggtctgaagtcaggcagtgggattcaagaggaggggccgttaaatagcctcagtgtccagggaagagggtcttgtctgggctgaagatcaaggagcgaaacttccctacaagaaacgctcttgaatgtatcaatgagttttgggtttcacctgcctccttgccaggatcagttatctctgaggtattctcatctggaagcattatgacatggcccccagatggggatggcatgggagacaagcactcaaatcccactgtggggagatcatttaggtacagtccttttagaaagcaactgaaaataagtataaaaagccatagaaaggttgtcttctttgccaattatttgtatttctgaggaacttacttaaggaaagaatttgaggttagacaaataagttaactgtgacatttccttcacctatctagggtcccgggacgaatctcctggtccaggagatccatgacccggagggtgcgtgcgtagctgaatcaccatgatccgctgcaccgcagatctcataagagacctaaatcaccgggagccgacatcccaaagagtcagagcggcacacgcgagggaacgggaccaagagggacccccggcgacaagaccaccacaccagggcggacaaccacgagaacgagtaagggtaagccggtagaagaaggcagggcagggcgcg

SEQ ID NO: 208689 - DNA, 289 bp, Homo sapiens
caaagtcctggggaggacatcataaaatggagggtgtgtatgtgtgtgagtgtgtgtgacggggcttgggagggtttgactttcaacaacagaagaggcagctcttcagtagaaccacagggaaagtaagaaagaagggaagactgggaagtctgttagtggctttggagggtgtgaagggaatgccttcttcagaccttaaaatgccttctgtcatgaaaacattggcacaggaggggaaatactaaaagtgtcagaactggaataatgaaagaagtgctgaactgat

SEQ ID NO: 208690 - DNA, 323 bp, Homo sapiens
tactttttcagcaattatgatgaataaggtattgtaatatagccacaacagattttaatgtgaaaagttataaggaacacacttcaagaagaaggaaaatgatcccaggaggaatatctgagataaaggaggaaatggcaagcaaacaaacttataaacttgcttgtaaataaaaacaaatatcgttgaagagaagaaaagcaatgatgtctaaaattctatgttcttggaaagacgaaattaaaatattggacagaaaaaacccaacaagtcgtaactcaagagaaagaaataagaattaaaatacctaagattttatattt

SEQ ID NO: 208691 - DNA, 167 bp, Homo sapiens
atgaaataaggtgaaaaagaaaaaaaaaaagtcattgttatacaaacatcaaaaagcattataaaaatccatttctagcctgggcgtagtgacagaaacctgtaattctagcactttgtgaggctgagacaggcagattggttgagctcaggagttcaagaccagcc

SEQ ID NO: 208692 - DNA, 301 bp, Homo sapiens
ataacaaatattaatttgttccaacttcttttcctcattccttccgtcctccaattttgccacatctccaaagacctccaccctggatgtaaaactaggagctagagggaaggagttctctttgatgtagtgacatgtcatggttccttgaagttatggccatggtgggatgaaattaatctgtgaacccagagacagatgtcatggacattcaagccatcagacactgtaggcaagtgcctatgcacttttccaggaactataaaaaattttaagacctggaaaaaaattacaagctcta

SEQ ID NO: 208693 - DNA, 387 bp, Homo sapiens
agcaactactgccactatctaccagctacaaaactaataatcttgatgagtccctctcaccacacttatataatcaattaccaagtcatttccattcttcctaaaaagcatctttcaaattatgccattactcaaaaatcatgctcaaaatcattataattatagacaaactaaggcttagggggaaaaaagaaaaaaaacagcataaaaggaaaagcctttacaattgcctacaggtcctcctgttagtgttctgatgtcagtcatctcctccttctctccctcttgttcattctgttccagccatactcacctaagagcttttttcatgaacgtgccaggcacattactgccttagggcctttacactagctgttccttatgcct

SEQ ID NO: 208694 - DNA, 500 bp, Homo sapiens
tttcttgtccttcagagctggccccatctttgctaacggttgccctggacaaggggacaataatacaactcatggggggcttgtgaagattaaatgagaaaatgaatgtaaataatgataatggtagcaaacattaaagtattttcttgtgctaggcactgtgctaatgactatttacattgtctcacttaatccccaccaaaccacttgaggaaagcacaattaatacctgcattttacaagggagggaactacaggttggaaaagttaaatgacttgcccatgatgacacagcagggaaacacggggcctgtatttggatccaggtcatctgactctactgggctcttagcaaccctgtagttacaaaccctctaagggattcactaggtacctgcatttagtcaacaactaatgaatggcagctagtaagagattctgttcttttttttttaagatggagtctcactctgttgccaggctggagtgcaatggtgcaa

SEQ ID NO: 208695 - DNA, 242 bp, Homo sapiens
ttcatttcagttcaggtaatggggacttttcttctcctaacaaaatgggttttatactcatcaaaaaacacaaatgacataatagtaaactatccaaaaaatcaagtatcgggaaagggttagaaaagggtgaggatattctaataatcaaaacccaaatgaatacaaaggtaaattaaaaacatcattttggagaaaagagctttttaattattatttgttctgtttcttgtttgttagga

SEQ ID NO: 208696 - DNA, 186 bp, Homo sapiens
atagttactcaacattttttaatccacgagccttagtgaactaacagcataaagaaaaatccacaagtctgggcatggtggctcacgcctgtaatcccagcattttgggaggctgaggcaggtggatgacttgagcccaagagtttgagaccagcctgggtaacatggtgaaaccccatctttcca

SEQ ID NO: 208697 - DNA, 261 bp, Homo sapiens
gggccatgggaaaataaacaataataacacaattttggaaaattggatgagtgagaaaagacttagcagaactcccaaattaaagtactaaaccagcagcaggaaagccaagaagcaacttgtttgacactcaagagccttcaagtgtcaggaattggcagcatcagattcttctggaagtgtggtgaagaggagagactaaaatgagaatgatgcattgaaagtttatttaagaagcagtcagatcactagatcctttcc

SEQ ID NO: 208698 - DNA, 220 bp, Homo sapiens
gggtcaatgtgtatgattatttttagtgctaatgaatgcattcttttttttccagaaaattcaaagctgaaaatatttcattagaattgcagcttctgtagatcctcagtaaccgcattttagtcttataaaagctaatatactatagttgccagtttcaaaagctaatatactgaagttaatgggcaattccaaacccttttcctcagaggagccaatt

SEQ ID NO: 208699 - DNA, 279 bp, Homo sapiens
agttagtctacaacatcactgcaataacacaatgcttgctgaagtggtcactttcacatactgtttgcagagggcaatttgtcaagagtcaacacatttggaactttgcccaccttgtttgcctgtcattccactcaggattccagcttttagaaagaattgcatctgattgtaaaaacccaagttcaagaagtgaacttggtctataatgggaaatcattggggaaaacccataactgagtgtcaatgaaggattggtaaataaattatggtatatac

SEQ ID NO: 208700 - DNA, 104 bp, Homo sapiens
ctcaggccgtgcttatgccctgtgctcacatgtgtgagggggtctgcagtgcacgtgtgatggggtgtgtgtggcactctcagctgcccttcctgtcttctctc

SEQ ID NO: 208701 - DNA, 473 bp, Homo sapiens
cagcagaccagatattgtgctcctcgacccaaccagtaaatgttgtaaatgtttatctttggggagagaaggggaagggcccacccagcttctgttcttctttcccttggtaacttaccatctatgagttagtgagatggagacatcctaaccattaatccagggaaagggaggaatctaagccatcagcaagggagttagtgcttttcatcaaatttgagacacctgtgacatcacattttagcatctctgaaatgtgatcaattgcatgtcataatttaactggcaaaatatttttttgatgtggagcataaaataagggcacataaaagatttggtggtgctgtggtttgaacatgtcccccaaaagttcacgtgttggaaacgtaattgccaatgtaacggtattaagaggtggggtctttaagacgtgactgggtcatgagggtgtaactctcatgaatggattaatg

SEQ ID NO: 208702 - DNA, 370 bp, Homo sapiens
tttatagaatcccctaaaggtggaggtcatgtttgcatcagagggtggtacaaggggagggaggtacttagcctattcctcaccatcttcatctcccactgagatcacctcacatacaggtgcccttccactgtgcttagccagtgagggactaaagactcccccacagagtataaattgccatgtctatttcagagtgacagctattaatattattattgttatgactctgaaagcccactcatctttgagtctctggcaagaggtgaaagacaggtgttgggaggtggctcctggagcgtctgtagacagcatttgcctaaataatggaatccacgtgtaataatcatgcttgagataaagagcttcc

SEQ ID NO: 208703 - DNA, 436 bp, Homo sapiens
aggagaaggaaggaaggggaagactgagaggacactcgagaggtccaaagctgcactttgtctttcgtcttctgctttttcctttagttaacacattatttgtaagtaataatgtactgcattaagtaattaagtaatgaatgcatacagtcctcatatattgcatcggtacaaaagtaattgtgatttttgccattactttcaatggcaaaaagagcaattacttttgcaccaacctcatatatgtataaaagtattcaagcaaacagaaaaaagtatgacttctctctctgaaggtcattgctgttatcacattagcatttatccagatgcttttatttatttaaatgtatacatacacatacacacatagaaagaaaaatgtgcctttgtgttttatgcatattttatctaataaataatattattctgcatt

SEQ ID NO: 208704 - DNA, 335 bp, Homo sapiens
agttcttaagaatgtatagctagaagagagtggatgtcaaaaccactaagcccccaggaagatgttagtcagaagatatggtcaagactaatggaaagttagaaccaaggagtgcaggttctagggttctgcgtggctcagggtgaaccccacacttgactcagaacttctgtgtggcagaggaggaaggaagaatggtcaggtcatcatctgtccatccacttgtttattcatccatcttgttttgtattgctttttaaggtaaatataaaagtggctaaaatatctgtacagtggaaagaatcaagataaaataaagaccaatgtgttgaaga

SEQ ID NO: 208705 - DNA, 385 bp, Homo sapiens
tccctacccatatgcccagttatgggccctcttcttctttctagaggctggccaaaaactaagttttcaaagtacaaaatggatgctacagatttcgttgctttagaggaaatgtctgacggctcttgtatttaaacttaagtagctacactgggactcacagtttcatatcttgagttctagaccagagctatcaaccctaaagcaacggcaaggggttagaggtactcttcttgattcgaataataaaaaatgattttttttttgtagggacaaggtctcactgtgttgcccaagctggtctcaaacccctggccacacactgctgggatgacaggcaagagccaccacacctggtcattggaggtgctcttgctttgtgtgt

SEQ ID NO: 208706 - DNA, 725 bp, Homo sapiens
gacagagagttcagaggtcaggtcgtgacgagagaaacagcaggcaggcgcgcggggcaggtggcgcgggcgggggcgactcccttcagggagcgtagccggggtcacctgggcatctgagtccagggcaaagggggcagccatgccagggcccagtgcagaccagtggggctgggggccatgagtggagtcatggcagtgaggggtgagggggacaagcacggggctgaatttgtacccggccagccatctccgtctcccctcctcagctgtgctcacagacttgctcctcccacctctcggcacccccactccctggtctcccacttccccgcttctgccatggcttccttttcctcagccaaatccagcagactcagcggtgtgggcttttttttccttttttgagttgggggcccaggctggagtgcagtggcaccatcctagctcactgcagccctgacctcccgggctcaagggattcttttgtgtcagcctcccgagtagcagaaaccacaggcaccagcacagcaggcctgggtgcttttctccagccagcattacgctgaccctccctccctcgggggcttcggcttcctgccctaggccatgcggcctaggtgttggtctcccttcccacccaccccaaggggccccggaattctggctttctgccactcctcagactccttcctgggagacttcaccacttccagaattcaggc

SEQ ID NO: 208707 - DNA, 347 bp, Homo sapiens
ttacaggcgtgagccaccatgcccagcctaagtttccttttctaataccacttttgtgctcaaaagctgaagcacagagaagtaaatccctgctgttacacctagccatttggaccagctgttcttgtgacttactaatggacaagcaggagcactcccttggaaccaggggcttgaaaccaaagaggaagttgaagagaatcagcagataacaattctttactacatcacagtgaaatacactgccatagcccctagtgttatttgttgccatttcagcagtcctggggcctcagtaagtggcgcctacacagcccgtcagacaaccagcccaacaaacctgtcga

SEQ ID NO: 208708 - DNA, 417 bp, Homo sapiens
cacaaaagctttgggaagcctagctttgttgactataaatatggtacttcacatttccaaatagcttcatagtcagcatttcacaatatgctatgcggtcactcagtttttcacagttttgaaagtgagaaaactgacatagaggttagatgattagttttagttaattgggaatcccaaatcttatgtgccaactcagggatcttaaaaaaaattcaagtgcaaatgtcagaatataactatccatttgaccttcatgaagctgatcatgtactaaggcaacattttcatttccctggcaatcttggcaccttcaacatagtttaattgtttacaacctttagtgataaaattaaattggtgttctttgtgtatcctttacgtatttggtgaattttcatttatcctttcaaagtc

SEQ ID NO: 208709 - DNA, 759 bp, Homo sapiens
gtgatcatttaaaccaggggttttaatcttttggcttccctgggccacactggatgaagaagaattgccttgtgccacacataaaatacgctaacactaacgatagctgatgtgctaaaaacaaaacaaaacctcatagtgttttcagaaagcttacaaatttgtgttgggccacattcaaagccatcctgggccgcatgcagcccatgggctgcaggttggacaagcttgatttagacctttctgaatcccatgctacttaagctttgattattaaaaaaaaatttccattatacagatgtagaaaattaagattcataaatactaacgctgatctaagaccacatatttagtgacagactagaattagagttctgatctcagaacatctagttgtttctatagctcatttcagataaatgaactttaaatgcttcatataaaagtaagagcagtttttagcaaccaagtaataatatcagaataaattcttgcatactggtattctgtaataccacaggtgaaaataaaaagataaaagtattttgcaaatccttattgatgtactaaagtgaatttagggaatgagaatgaagcaagcagaagagatttgaaattactttggtaacgggatttattttagtaaactcttatggactgcctactgccactaatttggatttttttatgagaatcatgggctttgtttcctcatctttctcctgactcagaaacttgtataaccagttactaaactat

SEQ ID NO: 208710 - DNA, 1283 bp, Homo sapiens
catagaaagctacttgagtctgagcatggtggctcatgcctataaccccatactttgggagggtaagcaggagaattctttgagtccaggagttctagaccagtatgggccacatagtgacaccccatcattacaaagaatacaaaaatgaaccaggtgtggtgatgcatgcctctagtcccaactactctggaagctgactggggagaatctcttgagcccaagaggtcacagagcaagaccctgtctctgttaaaagaaaaacaagtaaataacagaaaagaaagttacttgagaatgagctgtggaggctgagaggaggaagaatgtgagtgtgtgtgtgtgtgtgcacgcacactcatggagaggggataaggaaaaccaagagagaaaaagacgtgaaagagaaaaatcaacccagggagaaggaaatgcaaggatcacagctgggcatgcagcaggcctagaaagcaaccagtccaggatagaataagaaggaaagggctctgtagggaaaggggactcgatagaacattgcatataattcacagtttgagaaaaactgaggaaatcatgaaggcaaacagtacaagagggggaaaaaacaaaggcaattagaaacatcaggaaaaactaaagccgtgcagcaaaacatgtgcaaccatattgtacaactcagctcaacagtaagcaagatttaaagcgtcaccaaaatgtaaacacttggttaacttttaacttttagaacaaaacagaacatttacatatgagaactaaatctacttgttaccagtcagtataattaatgttccatggtaaaggtgggaggtgaaacactgaaggaaggagggggaggattaatatggccattttgtaaagtgaagagtcaagaaatactggctacagttaagggcataagaaataaagttaaataaactcacgtttagttctcacaacaaccatcctacgtaggcactgttatcatcttaatagttctgaggggaaaactaaagcttggagaagttaagtaattcacctggagcccctagctagtgacagccagaagccaaactcaagtgcccaatctccagagcatgcactctcactctatttcatctgctagcataagaatattatgtaaagaaaatgatttactccctaaagaaaagctggctaggcacactggttcacatctgtaatcccagcactttaggaagctgaggtgggtggatcacctgaggttgggagttcgagagcagcctgaccaacatggagcaactctg

SEQ ID NO: 208711 - DNA, 240 bp, Homo sapiens
caggagaatggcatgaaccagggaggtggagcttgcagtgagccaagattgtgccactgcactctggcctgggcaacagagtgagactccgtctcaaaaaataaaaaaaaaaagttaagagcttgaagttgagctttgtgcatttccactgtatgctaagctctttcctgcctcagagccttatatgtgctattaccccacctagaaaactctgcacattacatccccatgcctgtccgt

SEQ ID NO: 208712 - DNA, 341 bp, Homo sapiens
tccccagaggacaccctaataaatctctaagtgtcaatttccaaatttcttattaaaaaacacttttatataaaaagacacttgggctaacatatgatacttactaataacttgtgaatagggtcacctgggaataatgatgtttgcaattacttaagaataacctaatatcatgtttaaacatgtgtgggtaatgctgcaatgcagtatctagctccctttacaggattgaaggaactctttttcaagctgctgggaatggagtcatagtttttagccccctttttatataaagaaaactgcctcacccaaggccatgccacattctgtgggcagtgtgc

SEQ ID NO: 208713 - DNA, 387 bp, Homo sapiens
cattgtgactacccatctgctataaaagcatctacatgcttcttttcaagttctgtactcaccttgtcagacaggtaagcagaccacagatctgcaggaatctgtagactactttcagtagcctgattcacaagagcttatttttttacatttttacacttatctttctggagctggtcattaatgacctctttcatatcctctatcatttcctcaatgcatttttacaactcaaggcaaaactgttaattccattaagcaaaatacccctaaatcccttaagtgatattataccaggtttgcttaaagaagcaatctaatggtgtcatcacttacaatgtgatctgattctatcacaggatcaacaataatgatggcttaactttt

SEQ ID NO: 208714 - DNA, 505 bp, Homo sapiens
  misc_feature (498)..(498): n is a, c, g, or t
tggtgagtgtagctctgtgagttggaggctctgtgcatgcagtggagccagcagagcccacacagactggcgagcccgtggacttcagacatgtatgtggaccagctgatttgcttcagggaaaggggccctgggtactttggttcttcatgtgtttggatcactgattgagatgaagacaaggtgctattaattcaggagaggtagagagaggctgcaggccagggtagtgtgagatcctaaaggactgagaatgtcccactgtggctctcccatgcccttgtcccgggaattgttccttatgctaatagagtgtggattgattttcttccacaacagccaggtaagggtgtgcagggtttacacagcacaaggacacctggccacggggccaaatggggatggaatcccaaccaccctccacgtcctaagctatatgcttggatggggttacccagacagcaaaaaaaaaggggggggggccccaaaccctttttnggggggg

SEQ ID NO: 208715 - DNA, 370 bp, Homo sapiens
tgtgtgtgtgtgcgtgtgtgtgcgctgtacgttaatatggagagatgggcttgggccagtgggaaatagagagacccgcaagcacagagtgacagggtttgatagtaagcagcaggccagcgttgctgcttttattcctcggtaaatccttgcacaatgccatatgctcttgcattccgtagctgctgcatagggtgtgatttagttaatgcccgctctgcaaacaggaaacggtgctcactgctgtgtatgcttttcatggagataaagtgtcaggagcaagaccccaaacctgcgaaatcactaatgcaaccgccccccatgccccaaaaggtgggagtgggggataaaaagagtaggaaagtggtgt

SEQ ID NO: 208716 - DNA, 817 bp, Homo sapiens
gaagcctgtctgggaggaaggacaacactagtcaggcgtcaggagttctgtggagccctctgtttataggatgccagtcctggcatgtggctgtggtctaggttaggggaagagaaaaatccctgaattgctctcccttcttggttcagagccctccttcccaggatttagcccgtaaccaagacaagtcacagatagacgatgacaagtcaagacaactcatagatagacggtgagaggggcacagtggtgtattttaccccgtgactttctcaccccttctctttccttcaactttgtctcaaattgcagaactgggtactcctggggaaaagcctcctgagtgagccatcggggagctgtgcccagctaaatgggcatttctgaatggtttcctccagcagggaatgaggcccctcattctgcttctttctactgtgggcacccagtgtctcctgaaatgtgaacagcaacagagcagctgctcaccctcgtaggcaggaccccacctcacctccatcagcctgggaggttctagtggatagtcactcaccaagaagagcaccagacgcaacgctctggccacctggagccctctctgaccaggactgcttttcctctcccgggccctaccaggcctattagtggaacacacccggcctcttcttggggttggttttgcactgagaatttccggtggaacacagatgaggttggagcctttaggttagtgaagcctttggatatttttggcagtatggttctatcagcattgtagaaagaagacctagcttaaaaattgcctgaaatctgagga

SEQ ID NO: 208717 - DNA, 435 bp, Homo sapiens
acagatttttgggcaagatttacttccctgaatgagtccattaccacaaagataaataaggtgtcaccaagtactgatttcatcagcaatccagataataagactatttctcctttctttgaacccatagacacaaaactttctcatatgcctgttccacctggactcaacagtagcaaacaattactaaacaaaaccaaaggatacaatagcagaaaccacacatctgcaaatgaagatgaggtatctgtgacttcaaagacttggctggtttctgtggccctttgcacctctgtcatctttctcggctgttgtatagtcatcctggcatctggatgctgtggaaagcagcagggccagtataaaccaggacagagaaaatcaggatccttgcaaattaaaaaccgtaaccatatgaaggagaactcttcatag

SEQ ID NO: 208718 - DNA, 214 bp, Homo sapiens
taaataatttgaatagttcaattcttattcaactctgtgtttattttggctataagtttacagtatttatttgcagtaattagttgactatcctgaaaatgctagctaaccactgattacaaagggtttattcaatatagatagcagtttgtatgtttagggttcaaacatatggcaaaaatagaaaaaattcagatgtaatagctaataaata

SEQ ID NO: 208719 - DNA, 369 bp, Homo sapiens
aacagggaaaggcatggtgtgaagggctttctgggtttgtggttccctggcacacatctggtataagatgctgctagggaaagtagactgtgggtccatggattataagtgatgatgatttttggaagtgttttagcttttgagttggcagagacttacccaaagtttggtttggcatttccagcttttcacagacacagctagctttggtttggaaggagcttgagagtcttttgagtctagccaagttttggggccagaatcctcccatgagtggccttttggtagccatactgtgattcttcccatcccagaggacagcattggtggaagatagcgggaaggtggtggctgtggggcctgagcagc

SEQ ID NO: 208720 - DNA, 549 bp, Homo sapiens
ggccacctgccaggatcaagaaggatcctgtgaaaggtaaactgtaaacattccttttatgagcaacatgcttggtgccctgtgagggcagggttattgtttgtagacactttccagaaagagatgcctcaagaccacattagaaagaaattacaacacaggaagagagagggcaagttctctggagtctctttttataaggatgctaatcccattgcaagggccccatcttcatgacctcctttaaccctaattatctcccaaaagccctgtctccaaaaccatcacagtggaagttggggcttcaagatatgaacttaggaggggacacaaacattctgtccatagcagtaggtgatgtttaactctattccaaactgctatagttttccaaggtggttgtatcactgtacacccccaagagcagtgtataagagttctgaccgctcatatactcaccagcacttgctagtggcatctttttcattttagcctgactatatagtagtatctcattgtagttttaatttgcatttcccggaagacaga

SEQ ID NO: 208721 - DNA, 399 bp, Homo sapiens
gagaatatggagaagttgcagatttcatatttggaatttgagagaccttctggtctaattctaatttctaaagtgtgaagtgaggttattagctgaagtatgggagggtatagaattttaaggcaatagaagaaattaacaaatgtagtctcttaaaagaaatgtgttcatatgtatatgtccaggttaacacataggaaaatgcatacaaagtgtgcatcaacaagctacaaatagtgataatctagggataagaaagcagaatggagtataaagtaatttttaaaaatattcattttaagttgtttcctttatctctgctaattataattatgagacgttccatgtactaaacaacatgattggcaagacaagttttttgtttgtctgttttatccc

SEQ ID NO: 208722 - DNA, 501 bp, Homo sapiens
agatgaattaaaaattaaaatgggtaaaaaattgggtaaaaggtgatcaaaactctgacaaaccagaatactttaaaacttacaagttgtaaaaccaccctatgtagccataaattgctgactttacaaaaagtgacttacagagagtagaactgtggttattagagactaggaagggtaagggggagaggaggatagagagaggttgggtaaaggatacagaattacagctggataggaggaattagtcctggtgttctgtagcactatagcatgaatatggttaatatagatttatttattgcatattttcagaaagctagaagagaagattttgaatgttcacaacacaaataaatgataaataaattttgaggtgatggatgtgctaattaccctgatttgatcattccacattgtatcgaaataccactctatatcccataaatatgtacaattattacatgtcaactaacaataaagggaaaagaaagtgactta

SEQ ID NO: 208723 - DNA, 703 bp, Homo sapiens
caagagtgagggatggcagtggggcgggcagagtgaaatctttaaggaagttgggagttaattagattggagagaatgggaaatttctagcaaggaaagaaacagctagaaatagcggtaaaagagaaaggcaattagttctgaagggctctaacctagagtatatgtggtggaggcaattgaagagttgattcacagagacccttgtatgctgagttaagtgtaacagatgatgtaatgtaatagatcatcactgaaagggtgtaagccagagagtgacatgatcacatttatgttttaagtagaccctgtggctacagcatgcagattagaggagggttaagcctgagaaccagctgggtgcagtggcttaggcccgtagtctcagcatttgggaggctgaggcgggagaatcacttgaggtcaggagtttgagaccagcctgggcaacacagtgagaccccacctctaccaaaaaaaaaaaaaaacacaaaaacacaaaaaagcaatttcaggcaccaggaaatgaaggcctgaattagggtggtgatagagaaaggttaggagggaacacaggagagccatttagaagagtgatgctcaacagaaataaaatgggtcaggagccatattagaaaagtaaagagaaataggggaaattaatttaaataatatattttagttaaccaaaaatattcaaaat

SEQ ID NO: 208724 - DNA, 216 bp, Homo sapiens
gggacggggcatggaggacgggaagccggcagggaccatcagaggacagctccaggcagaggaagccccccaggagggatgagcagaggcctagtctgagacctaagcaggtgtcgactgcccctttagttttcttgctcacaatacagaatgtatgtgttgcttttcaatagtgttttaagcttgtttaatattatacggccaaaggaggaaaat

SEQ ID NO: 208725 - DNA, 426 bp, Homo sapiens
gcatcttttcctaatgaggatgtgcgtaaatgtgaatgtaaactgtgcatctgcaaggaagaatctgggagagcaaatggaaaggttggcctggctcgaatatggagaaccctgaatgccatgccaggaggatttgagcaggagggcagagtggtcaggtttctgccttctaggtgtccttctactgtggagaaaatcagctggagcaagagacactgcaggggagagattgtgagagggcaggtggagccgtcctggtgagaggggatgacacctgaattagggagaggggaataaaggatgaggtggggccgggcacggtggctcacacctgtaatcccagcactttgggaggccgaggcaggtggatcacgaggtcaggagatcgagaccatcctggctaacatggtgaaaccccgtccctac

SEQ ID NO: 208726 - DNA, 328 bp, Homo sapiens
gcatcccccctacgctctcacaataatgacattatccagtcatgagagcagagccctcatggcttaatcacctcttcatgatccctcttaatactgtcacaatggcgattaaatttcaacctgagttttagagagggcattgaaaccacggtaaacatataccgacaacctacctttatatgaacatgattgatatgaagagtaataggttatacattttagccggcagctccataactctacctattaattctctgaaaactcttgagtgaacaccattttatcaactgattgtacttgtttgctaattaaacccaggatattctat

SEQ ID NO: 208727 - DNA, 177 bp, Homo sapiens
ctgttacttctctctttgagcggaaaatgaggagggattgctatctcgtttcagtttttgtctttttggccggcaggagacttaaattgtccatgaagagactgagttcaagttggatttaaaggagcagtggaggaagagttgctaagaaagtcatcatttctggccaggcacgat

SEQ ID NO: 208728 - DNA, 291 bp, Homo sapiens
ctttgagcaggtgaagtgtcaccacacttcgcctggctgttggatcactcatgcagcgcacattttctgccagtgggattttgaaggaaacatccgtgagggaccaatagactggccccagcccaccgcatagggtggcaggcacttggtaaaccagtcacagttgagagtctggtcccccgccttactcttccggaccataccctggagagacagagcataagattgatatcagggccttacgtcctcacttcctctggttcgtgacttcttttgctcccaagagaattg

SEQ ID NO: 208729 - DNA, 297 bp, Homo sapiens
tctgcctgatctccacctagtgtcattgtgggatcgtggccacacatgggccttccagggctgtgctgttggtgaccagtggtgcttgtaaccctgaagtgttggcatggcctcagctgactgggctttccctcatgcccagggcttaaacttgaactctgcctgctctgttagcagtttttctctacatttcttttaaaatagactttcacttcttccttcccatcccccccaatacaactgccctggcatcctggctttttccattcttgacaaatgatctgtccactgtaactg

SEQ ID NO: 208730 - DNA, 330 bp, Homo sapiens
cttgagcccagaacgtagaggaggttgcagtgagctgagatcgcgccattgcgctccagcctgggtgacacagtgagacccttgttgtttttcgatagctgtttcataatttgccaacagttgctgtatagtattccgttgtgggaatacaccacaattttttttattcattttgcattgataggcttttggggtaatttgcagcttagagctattataaatagtgctgttgtgaatatttttatatatttcttttgctcaacttagatgtttcttttggttgtgttcttaagagtttacttgctatgtcataggttggtcaactttagt

SEQ ID NO: 208731 - DNA, 626 bp, Homo sapiens
ggctaggataggattatagaaaactgggtgattgtcaacagggatgaaccatacacacccctcaagatccacttttacacactgcttcttgagatctcaaggtttcaggaacatgaaaaaatagtttgtcacaaagaaaagctttgggaaggggattaaagcagagcttattataaatttctgcctcattttacatctctgcaaggcgggaatgatctcttgatccttgacttttgttgcttttgattaaagaagagaaattgaaggagtaatagtttactctttcaatttggggaaagaggtcttttttatcaactttgggctttagttaagtaatcatggaacgttcttgtacaaattatatttaaaaccaagccaaacaagagcacacttgcaagagagctaaatgtatgatcatcttgtgctgtatgtattagcctgggaggttttccaaaggaatgatcatccctagcattctctttggcatttctatgtagtgtcatcatcttctgtgatatgccacacaagaaggaagaccagtggttgatttctgggattaaacttttaaaaaaactctttaggatctggccccaacccagtatcctctttcctgcttttcccctcta

SEQ ID NO: 208732 - DNA, 419 bp, Homo sapiens
aaactattaggtgttcctgtctcagggaaagagtctggctattttttgtaattagcagtgcaaacatttcttaaggttgctgcttttcacatctccacgaaagtgctgcagcgaggaactgcagtagccaaaacagattaatgtagatgaaattagagagatttgttgatagtaacattaatggccaaattaaaggcaagtgagaactgatgatactagcaatttttaaataatatacagtaaaccctatcagttttggctaagatgagtgaagcaagctgctctaatttaagtaagtatctgagttataagattgaatgactaaaagtgacaattcctttagaacctatagctgggcagtagacaattacggctttattagtaatggttattagtgataatctatgcttgaatataat

SEQ ID NO: 208733 - DNA, 252 bp, Homo sapiens
atagaaggggccctcaaaagtaaagtgcctaagaccgggataattcacaatgtgcctctgattgccccacttcacagcggggatacctccaaccgggggtccaggttgggatccgaaggagcgacaccgcgccctgggcacggggcacctctgggacttctggaggcgagaaaagaaggcgcgaaacctccgcgggccgcgcgtgccatctgccgggcacctgcgggactgcggccggcgggaggggagggg

SEQ ID NO: 208734 - DNA, 547 bp, Homo sapiens
taaagtgctaattaactgttgctgcattcctgtatttgagcctctctaattatgccaattattttgctacccaataattattattgaggcagatccatatttattggtatgaaaagatctttgtgatatatatacacagtaaaatatatacatatatttagtaaaaatccaagttttaaaataagatgtatgctaagcctaatttaaaatatatatattcatgcctagattgatttagaagtaatattcgtgcagataacactgtgcatgggtgtatccctgcctgctcccctaaaataggtattgattcttttaaagtcttttgagggataataaaagagactatatttttcttttaattggttaataatctttgcttatttatgagttccaaagacacagatatttcatctattattgtatatttttatggaaagaagaaacatttaggacagaaactcgttatgatttcaaggtcaaacatgtatttcctaattgagatttggtttaaagttttaattcatagaataaaatgactgattattgg

SEQ ID NO: 208735 - DNA, 405 bp, Homo sapiens
ccaatctatttatgtgaggaatagatacataaaaccttactggtatttagtaggaaatcttttattgttaatattttatttacaatcttacttgatatttatcattgagttaaattgcacataccattcaggtatggttaaaaactcatttctgcttcaggcagtcagacttttctgttgcaaatctcaacttttggctataaaaacaaggtatcaaaataaacaggaagttacttctatgtgttcaaatatagcacaactactacttgaaactcaaagccttttctccttaattataatatcttcagactgcttttctctatatagattctcaaaaaaaaaaaggtttctggaattggttcatccgtaattttcctttccatgattttccggtgtttggtttaa

SEQ ID NO: 208736 - DNA, 229 bp, Homo sapiens
tatttagtaggaaatcttttattgttaatattttatttacaatcttacttgatatttatcattgagttaaattgcacataccattcaggtatggttaaaaactcatttctgcttcaggttgaaatattctcaattgttttgactaaagtatactgtcctatatgctgtgtttacatccatgatggtatatttaacatgcaaggggtacaaaataaaaatccaaatattg

SEQ ID NO: 208737 - DNA, 349 bp, Homo sapiens
taagaaatcacagtggaggaatgaaaatgttctacagctgagtcatggtgacagccacacaatttggttaaaaaaaaaaaaaactatgaattgtacacttgaaaagatgaatcataccttttgcacgagcacaaactattccccatccctcaccaaagataactttttgcgtgtaaatttataggagagttgtcaaaaaataaactatggtggtatctaaagaaggtttccaccataaaaaagggggtctgaggggatcaatttggtcacaataaattcaagtgtgtctgagtacgctttgaaggtcactaaactgctagaacacatcaacctaagaaagtaagatctc

SEQ ID NO: 208738 - DNA, 254 bp, Homo sapiens
tagtgaaaactgacaactgaacaacactgattatgaaacaaagattttggaccgcccaccctgaataatgaagagttatgtcaagcaaaattgatatgaaacgatgtgtagtgatttcaagttgaccccccttccactgttgataagtactcggtcacttcgatagttttatttctatttttttcttaagaaggcttattctaaaggtcctcttttcactatcattgtaaaaaataaaataataattttaatta

SEQ ID NO: 208739 - DNA, 748 bp, Homo sapiens
ctcttcccaattattggtaatgtctgaagacacttttggttgtcctaacaggatgtaggagagttctggcacccagtgggtaaaatctagggatgctgctgagtattctgcagtgtaccagaaaggccctttacaacaaagaataatgtagccccaaatgctaatgttgagattgagaaaccctgctgtaaaatctaggtaagatggaacttactaaaagtaatttagtaattccctgaaataatctgagatcctgccctaagtcttatagttttatagaagaggtaagatacaagaataaatgtttgtagcagggcagaggtgccttgtaaggacagaaacggtaatatagttcatatgaggtagaaatctcagtgggtgacaggttaagacctcatgagcagttagtgttgaaactgtgtgataaattctgaatgggcttactttcaggttgaaggaatttattttccagaggaatcactctttcatgtaatttactacagggtaagagtttagaaacattactgctagcaaagaaaaaattacctcccttctaaccccttgacatttttaaatcaaaggaccatttgatcctaactaaaagatgctttgagttttatgcaaatgcacctttatcagtatacgtcagaaaaatgtttaccaatagatctctctccctttttttaaaaagtgaccttgaggggtaaaggtcattcctttgacagaaattgttgtgactgatcttgtg

SEQ ID NO: 208740 - DNA, 650 bp, Homo sapiens
ttagtgacatcatcatgcaacagcactccagcctgggtgacagacctagactcttgtctcaaaaaaagaaaaaaaagttcttctttcttcaataataagctaaccttagcttgctgtaacttttttactttataaacttacaagttttaaaacctttttgactcttgtattcacacttagcttaaaacacaaacacgtagtacaactgttcaaaaatattgtttctattcttaatttataagctttttattattaaaaattttttaaacttgcttttactttttaaacttttttgttaaaaatgaagacataagcacacacattagcctaggcctacacagtatcaagatcatcattatcactattttccacctccacatcatatcccactgaaaggtcttcaggggcagtaacatgcatggagctgtcatctcctgtgataacagtgccttcttctggatacctcctaaaggacctctctgaaggtattttacagttaatgtttttttctttttaataagcagaaggaatgcactctataattaacaataaaaagtatagtacatgcataaactgataaagtcatataatactattatgtattatgtactatatataattatatgtgctatacttttatataactggca

SEQ ID NO: 208741 - DNA, 195 bp, Homo sapiens
tgatggaaaacaaagcagtagcaattggaaagtccaaacaagagaataagtagggggatgaaaaagaagcaataaattataacttcaaagaagccatctacctaacagggaaaacttggcttcactttatcagattcatcattgcttcaaagagttgatgagaaaagctagactaatgaatctactgcttccctg

SEQ ID NO: 208742 - DNA, 651 bp, Homo sapiens
gagtggatgaccatgctatgtgatcacaactgtgaacggctaagcaaagtgaactgagtttagtattgtaatttcaaaagaaccttaaagtttgtaatatttgacatatttaatggtatgcagaatcctatttcactgtacattatcaggcattcatggcaagcaatttacaaaaacaatcagtattttgtacagaattagcttagagcttagcttagggaaaacaaggagggaggagaatgcaacagcttacaaagcaatggagacactcccatgtctacaaatgggggcaggggaagggaagccctcccacattctctagggtggcaactgaagccctccccacaggtatactagttaagggtcacgtgtcacagtgggcttgggacaggacagtttccttccctctgaaataagatccataacccctcagtgaaaggaaagctagagctagagaggtgtacaaccaaaagcttaaagcttgttttcctgaccccttgaatccctaaatgcagagaaacgttcctccctctttttccctccatttcttccaacataagctgctgagttcacgtaataatgtgggaactgtataaagatccatggccaatttctagtctagtccagggcaggaaatgttagaaccgactg

SEQ ID NO: 208743 - DNA, 764 bp, Homo sapiens
ggtagaagcaattacaaaaggaaaggagtggagattaggaagggagaggtaaagagcaggaaggctcccatgaaagctgagcctgcagatcaaaattcaaaagtacttgaagaaaaactaatcccaagaaaggcaatcagtcactcaagagaaaatgaaagtaatgaactacctagataatactataaaattagtatgttaggatcctcagtgctcaatgacatggaagggtaaaatgtcagagcaggcaaacataagaaccagtgcatagagtcaaccagtaagaaattctgggggtgaaaatactgtgtaacacctgaggtgattttggtttcaagtaattgaaaacccaacactggcttaaaccataaggacacttacttttagcttaataatagtggagataggaggttcaagggttcattcaatggttcattgtttacaggcaccagatcctgtttgtgtttctgttccatcatcttcagctttgctttgctgtgtctattacctcatagtcacaagatggctgccacagctcagatgttataccctcataacatcccaagcaggatagtaagagcagttcttagccttttatcagagagaaaaaaaaatctcagaatcttccattaagcactccatacacacacactgttagtctcattgtattaaacaaaggctcatcctaaggccaattacttagcttagatccttaattaatgctttataggtaggagggggggcccatttcctggagcatgtgg

SEQ ID NO: 208744 - DNA, 564 bp, Homo sapiens
caaagagaaagaatgtgagtgccacatgactggttaagtatggattctcaaactagggctttaaatatccttcgtgattttttttggcatgaaaacttgtaagaccactggtgggctctgtacaaagtcggctaccccttcattctatatcttcctctgcccactttcctcccagctattaaaaatgaatgtaggctgggcacagcatctcaagcctgtaatctcagcactttgggaggccaaagcagaaggaaagcttgagcccaggagtttgagaccagcctgggtaacaaagtgagaccctgtttctatttttttctaaacaccaaaaataatgactgtaaggcagtatgtagccaaacaacttggcaaagtttgttatctttcctccaaaattctctcactctccaaccttccctctttcttgatagctcatccatagccttgagctcagcattacctctgaactaggaagctcttctccagctgacattaggatctttgcatttgtccctaatgaaatcaaaatatagggccattcgatattatcctcttttcctcctg

SEQ ID NO: 208745 - DNA, 513 bp, Homo sapiens
ttttttgtggtatctttgtctgattttgatatcagggtaatgctggccttttagaatgagtttggaaatgttctctcacatttagttctttggaagagtttgaggaggattggcttggtgatagttgagagtagaataagcactcgtttcaagtttggtattgttgcactgatgctccacttgactcgctgcatattacaactgtaattattaattacttcagtgctgttaatcatagggtagtacaagctagattaaatggcaaacaaatgtacaaaacattttattactattgggttctttatacattaatgttttaagacacaggcaaaaaggaaaacatcgagagtttactgaaaagcaaaagttttgtagtgtgtcttgaatttagtaaacaagtgtccactctcctgcatcttaaacaagcactttgtttttgttttatttttttgagatggagtctcactctgcactccagcctgggtgacagagcaacaagactccatctcaaaa

SEQ ID NO: 208746 - DNA, 632 bp, Homo sapiens
gaggggagagtcataaagtaatgttagtaataatcgttaccatttacggagtaattcacatgggtcaggcacaatatgaggtgctaaacctttgttaactctaatcttccaacagccctgtgcataggcatcatgagctcccattttgcagatgagaaaactgaggctcagggaagtcaaaattttgccaggttacatagcaagtcagtgatcagtctacactgtcccatgctgccctagagctatagcaagctggaaacccagagggttctggctctcctccttcttcgcactcaggcacgctggctaccagatgagtttacattctcttttttcccctcttcaccagcttttggatgattaataaatttcaaagcaaatcatgcagggatcagcacagacttctcatttctatcaacagtgtcttctccaagaaacagtggagaatggtcttcagggaggcagccacctggactggaggaataaagggaaagtctattaccgagaagaacgtgcacttggccccatggggatgggctgcctctgacctcagcgtcctttttcatctctaatttctgtgattctgggattcaacataaacctcattcctcatgcagcgccccgagtggcag

SEQ ID NO: 208747 - DNA, 350 bp, Homo sapiens
tggaggctgaggtgggaggattgcttgagcctgggaggctgcagtgagccatgattatgccgctgcacttcagcctgggcaacagggtgagaccctgtctcacacaaaaaaaaacaaaaacaaaacattcatgtgcaggtgtttatgtggacataagtgtttgagtaaatatcaaggaattgggtcatatggtaagagtatatttacttttgtaagaatctgccaaactgttttccaaagtggctgtaccattttgcattcccaccagcagtgaaggagagttcctgttgcttcacatccttgacatcacaactggtgttgtcagtgttttgtcttgtggccgttctaat

SEQ ID NO: 208748 - DNA, 421 bp, Homo sapiens
cagatgtcagaaatcatttctgttttttcttctcaatatcagcatccaactggctgaccagcaatgtgtccccaaggaacagacgctggagttgggtgaagacaatctgcatgtcctaaggggttagctttgtaaatgaagggtaggaccagcttcctctcagccccagggcatccatctgctcccttaagaggctccacctccatcactgaggctgtcctctgggaggaaaggaacaacgtgctaatgttcactaaacatgccttgagatgggtcacccccagacaattatgaaacccaggcacagaaaaagactggagggtggctgaggacacatgaccttgtaaaatttccaaagcagaacctcaaaccaaagacattccgataaggtgtctgtgcctggggaagataaaagaagaga

SEQ ID NO: 208749 - DNA, 372 bp, Homo sapiens
gaacatgaccttcgaggagacactgacgtgactccttacagagcaaacgatttgcatgtaagtgaaatgcatgtaagtgaatgtgaaattggagcagtggcgggaagaaagattgtccaagccctggaataagacaggaatgtgaagaaacagcagaggaggaggaaggattgcagtcatgacccccacttcatgccatactcctcaagcatttgcttacatccagttatgtgagggaggtttgcggggcttggaagttgtataattgtatctgtgtagttggtctggtgggttttgcaacttgccctttgctgcactgggagggccatttttgtcccctccagcatcacctgatgttgcagcatagcccgc

SEQ ID NO: 208750 - DNA, 712 bp, Homo sapiens
atccgaagtccggaatcagggtgtcagcgggacggcttccttctgctggagctagagtgggaatctgtccgggcctttcttccagtttctggcattgcccacagtccttggggttccttggctcctagaagccatctctccgatcactgaacttcatcgctgtgatcgctgcctctgccatcatgtgaccttctctgtgtgtcttcacgcggccttctacggaggacaccagtctttggatggggacccaccttaacccagcatgacctcatctggtcataattacatctcaaagacccactttccaaaggaggtcatgtgctgagtctgtggtggacctgaagtctcgggagcaatgccaacccagcatgatgcctccccatgcttcgaggcgccctctgtgcaatggggatggcagcagtgatgcctcctccccggccgctggtgaaatgagaaaacaccggcaaagactccagagcatagcctggctccccgcaacagccaagccaggtggcctgttccagctggcatctctccagctgcagatgagatccccggggtcccttctgcctccttccctccaccccagagcagcccactcttgaaaacctgatgcttcctttagactttcagggcatatggctccagtcagagtccacctctggttttgttttgcctgttggtaaaccctggataaatggtcacatggaac

SEQ ID NO: 208751 - DNA, 216 bp, Homo sapiens
agcaagtggattcacaatgcaaccaagtcctagtccttacctttcctggttccattctccaacagaggaatttcaaggatacagaatctatgacatactttgaagacaaaggcattttaaactctaattaactcataatttgccttgagctgcttttttttgagacgaagtctcactcttgtccccaggctggagtgtgatggcgcagtcttggct

SEQ ID NO: 208752 - DNA, 411 bp, Homo sapiens
tcgactctagacgactcccttaagctacctgcacccggcctagattaatatttcttaaagtgtgatcagaacctcttcaggtacttgttaaaattcagattcctggacccaccctagacctactggatccaaatctctgcagacatggcctggacatcttcattataacaagcttccacatagattattttgtcagtggccatgtcttgctttgcttctgtggaaactgctctccatcttctggagtggaatgtcccccattgctatccacatggtcctcgcctccctgatactgtagtctcagatggcacctcctgaactgggccgagctcaatcactttcccagaccctgcccacctcgctggagctcagtggtcccatggtgggcaaaggagccaagtttgggcaaca

SEQ ID NO: 208753 - DNA, 282 bp, Homo sapiens
ctgaactagagcaatatgtcacacttttgaaagagtcttgtaaacagtttcttccctatgtagagacatctctgaagtttcttgtatggcttgtagtaagcaaaggtaattaacaaggattatacttttttcatttcctggaggggctggggaggataataccaatctgtgtgcaaactaaggatctggaagaactacactatttctcccttcctgtctccctctctggttttctgatcgatttgtctgtctcctctttatcctcttccttacacttgttct

SEQ ID NO: 208754 - DNA, 491 bp, Homo sapiens
ttaaatgtccataatggtccaaaaggaaacttttttggttagttaatttggttagttagtaagtaaaagaatgtgttgcgctctgtctgatttcatatttccaatagtggttttcaaaagatgaaaaattttaattagttgattgcactaataagatccgatttgttaacattttggttcataggaacagaatgaagaaccaattaaccaagtacagggtaaaactcagcagtaggactaaaatgtccattttcttaaggaagaaaagaagcagacactcaacaaccattttctgagtctacatggggaatccatataaatacacaagtttttattgtagtgtgaaagaatcaatgcctatcaatttacgttacttaatgaaggtaaattccaaacccagcatttcattttatttggtgtctttcttttatgttgctataaaggaatacctgaggctggataatttataaagaaaagagtttttatttggc

SEQ ID NO: 208755 - DNA, 757 bp, Homo sapiens
ataccaaccccgtacacccaccgaaggggatgtcccactttttccagcgctgggagcaaaaagataacagtgagcgaggttgaaaaaaacagggtcttgcttcgttgcccagcctggtctcaaactcttggcttcaagcaatcctcctgcctcagcctcccaaagtaagaaccatcaggaatggtggctcatgtctgtaatcccagcactttggaggaccgaggcaagaggattgcttgagcccaggagtgcaagaccagccttggcaacatagcaagaccttttctctacaaataatataaataattagcctgatgtggtggtgtgcacctttggtcctggctacctaggaggctgaggctggagaatcacttgaatccagaaggcggaggttgcagtgagccaagatcatgccactgcactccagcctggctgacagaatgagaccccatctccaaaaaaaatacaaaaataaaacacctgacagtgaaaagagcaatttgaagaaaaacaaaatttatcttcaatgtgaaaagcaatttataaaaatccgaatacttgccaggagcaacttgacaaaaaagacaaaggtggtagaagaaatgtaaccagcccacaattccaatgttgataacagatgagctccctttcaaggtgactgacatttacacaagtacacagagcaagaagaaggtctgagtgaactgccaagcattttaacttctcctgagaccaagtacatcaacagttctcttgg

SEQ ID NO: 208756 - DNA, 424 bp, Homo sapiens
aactgtgacttctaatttggtctcttagcatgccttcagcctctaggccctggggcccatttaaggtcatttaggcagaggccacatctgtggtatctgaattatctggctaagcatcctgtactcattgggtatttgccaaccatatgctagatcagggtctgtcagaatgccctcattttggaaaactatttaaatggcaagaaaaattagatcttagaaagaaaagcatgggtatagagctcaaggaattggcacagctgggtatcattagcaataatcaaaccttatccagtataaaaagcaacagaaagtgatgatgtgggagcagtgtgtatttgtatgtgtatgtaagtttatgtatgtatttgcgtatgtttgtatacatgtatatatctgcataataaatgtatataaaattttt

SEQ ID NO: 208757 - DNA, 485 bp, Homo sapiens
catccaccttgtcaaatgggctctcatccttttcaaagtggagccatgccatgtagagcagacactgcaagcttgatgggaatgaggcatatctggctcaaaagcatgtttatttgtgtgtttttaaaagtgtaaatattgaaccaacattttaaaatcaggaaattatacttaaaaagcattgatttctggcttccgttttaaaaatcaaaattgcgctttaaagttagcgcaattaaaaaatcatatcactatgatttttaaaaatcaaaagatgtgattataaaagttttttacaattttaaaataaataaataagatgtgactaactatgaactcacattgccacatgacaacagctagagctgaacagagactgcccccttgagatcctggatgaattctcgaactcaccacagtactcaccacttcccctcatctcctaaggctttaattgaaagtcagttactaaatctatagagaaa

SEQ ID NO: 208758 - DNA, 257 bp, Homo sapiens
ttcaggttctcttatatgtggatcctctagatctccctgctgtcttcatcttgttttttacctgcctccctttcttaattgtccaaaatctagagttgactcttaaagaatgcaggggttagtggctggcttccatctcaaggcagttgaaaaattgtgtataaccttttactccccccagatctaactattaatagcctattgttgagtggaagccttaccaataacataggcagtcagttaacatgtatcttgta

SEQ ID NO: 208759 - DNA, 372 bp, Homo sapiens
cagggattttgtctgttttgttgattgctgtagccctggcatcttgggcagtgccagcacctgttagcattaaatacatatttactgaatgaatgagtggcttcatgcttaaaagcaagaagagagaccttcatagagaagtaggaaaatgaattgttgcacaaataaagggccatgtaatgagagagagagagcaagagaaagagcaaacaattaaggagcagcagtggcttcctgcaggggagaccaatgccttctgtcctcagcggaaacagcttggcattcttccaattgatgaatggcatggaccaggagcactagttatcttcagcttctgagcatccgaataaataaacatacaaatgcataaca

SEQ ID NO: 208760 - DNA, 611 bp, Homo sapiens
agctaactccaagagactttcagtaaagaaaggctgaacaccccaaaatcattcagcatatttacaatatgtaaattatcacaaagcaaaacctttatacaaaccatgaaatacagcccaatagagtaaaaagccctaggatagaaagtagtgaaagactcattaacagtagcgttgacacatggcttcaattgcaactgtaacaattgcatgactgatctgttagtcaactgtggcacgtgttcccagtcaggggttctgctaattgaaagttagaatcataagacatttaaagattgtgcaggaacagcattattcgtacttggtactagaaagcagtaaaccgattctgacttggttaaatttaaaaatctctttcagttgtaatacacaagaacttcactgttaggccgtacgcggtggctcacgcctgtaatcccagcactttgggaggccgaggcgggaggatcgattgggcccaggagttcgacgtcggtgagccatgatcgtgtcactgcactccagactgggcgacagagcgaaaccatacctcattcgtacattcattcattcataattaataaaataagtacaacgcacttctacataat

SEQ ID NO: 208761 - DNA, 358 bp, Homo sapiens
ccaggaacgggaaacgttccaggaacgcctgctactgagatcccccacatcttggactggagagagaaaggctacgtgactcctgtgaaggatcagaaatttacaagctgatgctaaacacacatgtgataggatcagggctcaggctcaggtctgagcctcaatctgacactctctgtggagtgtcaggaaataacagataaatagcatcgaatttgaaggtttgccgagaagtgagagaaaaaactccctttgcctgcctcctaggcttcaaagctgtctgggccaagacgtcaatttagctgcatcatgggtcaatgaggcctttgcgaattaggcaaataaatcaagttactag

SEQ ID NO: 208762 - DNA, 238 bp, Homo sapiens
acaccccaggtaattgttttgtatttttagtagagatggggtttcgccatgttggccaggctggtctcaaactcctaacctcaggtgatccgcccacctcagcctctcagagtgttgggattacaggcgtgagcctccactgtgtctttttatggcttgaaagcttttttctttgtatcgtcgaataatatttcattatctgaacgtgccacagtttatttgtctattaatctactgg

SEQ ID NO: 208763 - DNA, 469 bp, Homo sapiens
  misc_feature (368)..(368): n is a, c, g, or t
  misc_feature (391)..(391): n is a, c, g, or t
  misc_feature (412)..(412): n is a, c, g, or t
  misc_feature (415)..(415): n is a, c, g, or t
  misc_feature (417)..(417): n is a, c, g, or t
  misc_feature (419)..(419): n is a, c, g, or t
  misc_feature (438)..(438): n is a, c, g, or t
  misc_feature (454)..(454): n is a, c, g, or t
ccatcatttttcctccctttaaatatgatgtgcctgggtgtggattttttggcatttataccgcttggtgttcttggagtgtctttgatctgtgatttgttgtctgtcattaattttagaaatttctccatgattatttcaaatatttctttcattcccttcctgctttcttcctctcatattttgataaggtataggttatatctttgattctgccctgcagctcgttgatgtcaccattgttgtttcttgttccttttctctttgaattccattttggtaagttctattgacatcatcaagttcattgactctttccttggctgtgtgccttctcctgaagaacctggatggaattcactacaganctgacagctggttccactttttnccactttttttctcttcttcnttntngnccttgggggaggaggccancttcttcctggggcantggctggaactgtgg

SEQ ID NO: 208764 - DNA, 564 bp, Homo sapiens
tgcctcctgggttcaagcgattctcctgcctcgcttcctgagtagctgggattctatcatgcctggctaatgttttgtatttttagtagagacggagtttctccatgttgtccaggctggtcttgaacttctgagcttaggtgatccacccacctcacccttccaaagtactaggattacagtcatgagccacagctcctggcctgaatgttttctttattgtatgttctgactcctgtttgagcttttactgctttgctcaggattttcacaacgtattggatatagtatgcataccctttgttttgtgtttaagagaaatgtctgtggtgttttattactatggtgtttttttgtgtttaagagaaatatctgtggtatattattatggaatttcttgttagtttgaagtgatctttatcagctaaaggaatgatttttatgttcttaatttttatttttatcagtgcttaattttaatttttatcagtgaatgagtgttgaaacatttagtgtcttttcaatttctgttaagaaatgagttaatttttgtttacccctttt

SEQ ID NO: 208765 - DNA, 436 bp, Homo sapiens
aacctaggtcttagtcccatttctgttcctgatgtgctgtgaataaacgcatctcatttcaatgtttgtatgagagaaacattctcaagactatgagtcagacaatgtctgcaaagcacacagttagctaagttttaggcaaagagctgatcaatcacatttctttttctttttttgagacagggtctcactgtgtcacccaggatagcgtgcagtggctggatcacagctcactgcagccttgaccttcccaggctcaggtgatcctcctgtctcagcctccaagtagctgggactacaggcatacaccaccacgcccagctaattttttttttttttttgagatggagtttcactcttgttgcccaggctggagtacaatggtacgatctcggctcactgcaacctctgcctcctgggttcaagcgattctcct

SEQ ID NO: 208766 - DNA, 462 bp, Homo sapiens
gaagagcttccatttttctttttcctctccagctatacttttagaaacttccttaaaggatgtttggtagaataaatctaagttctcttcctttttcctttcccactgctggacagcaatctgtccaatccacagtcacataagaatattcctttaaggccgatgcctgcttagccagttaaatccaaagacagtgtttgtaggaaagggccaggttaaatggtatttttaaggctaatttgggattgaccttattatcattggataatcagttaaggaaacaaaaaagtatggatttagcagtagatagaaatgagaaaattggccaaggccatcataaagacttagaatgcttatgctaaactatgtaacagtagtgtatgtattgtctgatatagttctcagttataggatctttgttctggggcacacaggaaggtagtgaaagctagtatgggtagt

SEQ ID NO: 208767 - DNA, 404 bp, Homo sapiens
gagccagatggggagaatacctaaagagaagaacatctgaagtgagtgaagaggaggatgaatttatcacagttgaaataggaaaagacattctaaactgggagacaggaccgattatggactttatttttccccttgccacatttcaaaaagagctagaggtaattcctaaagatatgagtatagaataaaagtaaattagatggaaaagcatctaaagatgctggataaaatacatggttaaccttgagagggaagcaaagaaattcctggagagcagaaacaagaaagaaatatacattcacaaaggtgagtaacattatagacagttttccctggagttactggccaatcctcggtggacaaaagcctaggttttaatgggctacttgctgagatgacag

SEQ ID NO: 208768 - DNA, 463 bp, Homo sapiens
ttaatttagagggtaaatacgtcaccagatttattttgtagtggtacctaccttttgtcttacactgaggtagtggttggaattttagaaacattcccatttaagtcaggaacaagaaaaatatctcctttatcactgttcatgttgtactgactgccccagctgatgcattaagagataaaaataagttataagcattagaaacaatggctgggtgcagtggctcatgcctgtaatcccaacactttgggaggccgaggcgggcagatcacctgacctcaagtcatccgcccacctgggcctcccaaagtgctgggattacaggtgtgagtcaccgtgcctggcttctttttttttttttccccagacagagtcttgctcttgtcaacccagctgggatgtagtgagctgaggtggtgcccctgcccttcaacctgggcaacaagagcaaaattttgtttca

SEQ ID NO: 208769 - DNA, 393 bp, Homo sapiens
ccaccaaagtaataaagcttcattaagcaaccccaaggaaatggaaatctatgaattgcctaagaattttaaaatcatattaaataggatcaaagagcttcaaaatagcagagatctaaaactaataaaaaaatgcataaacaaaatgagaaatataataaagacattgacatcataaaaggaaagaattcttgtgctgagaagatttgtagtcaaatttggaacactctagtactgtaatggaggtgtgtaaatctcgttaactttagtgtaaagcttgtaaaatattctgaatacaattatggaagtgagaaggtcaacagagtactttaataacatatttcatcatacagcgaaaggaagcaatgaacttgagtttagatcatacagtta

SEQ ID NO: 208770 - DNA, 549 bp, Homo sapiens
ctgggagacaagcctagggtaagagacagatttagttttcaccacatgtcattttgttggggcagacagcctctaaaatggcccccatttccccgcctctgatattcacacccttgcttggcccctccccttgagtatgggcaagagctataactcacttctgaccaacagaacacaggaaaggtgatggaatgtcacttccatgcttaggttacataagatagcaacttctgtcttgatagcagcccctctcgtttgatgctttatgaagcaagctgccatactggagaggcccatgtgcaaggagttgagggccaacaaccagcaagggactgaggcccttgatgaattgaattctgataacaactacatgagcttgaaagcagatcctatctcagttgagccttcagatgagaccccatcctggttgacaccttgattgcagccttgtgaatcagaagattcactgttaagcagttaaactgtgtccagatttctgacccactgaaactatgagatcatatatgtgtgtggttttaagctgccaaa

SEQ ID NO: 208771 - DNA, 438 bp, Homo sapiens
ctaaaattccaaccacaggtgttgaaagtagcccagtattgaggtatgggaacccgtgcagtcctcaggctctgagaaggaatgatgcaaaaccgaagacaatatgccatttgtgcagacatttagagagaacctaaaggtattacatgtgacactatatatatacatagatgtgtgcatacattgtatacatacatatatttttaaaacagtataagcaggagtctattttccaaagctttgaaaacaaaaactagtagaaattatgcaatttcttcaaatacaacatgccagaatttcaaatctggtacatctaaaatttcaaataccatatactaaaccctatttgggtccagaaaagcaacttctggctctcctagtaccaaattgtgactgcctgagtgagccgtaattaacagaaatcagctttctcaggtt

SEQ ID NO: 208772 - DNA, 620 bp, Homo sapiens
cttcctaggtaagaaatacatcagcaactggcaatgttgactgccagtcttcctattcctgccactcaggatagttctcatctatcaagcactggccctgtgcccgactgtacctgtgaagtagacataagtgcccacatttgacagaagagcccaccaatactcagaagggttaaggaatttgcccagaggcaaagccaggtctgtgagatgacaatgtcctaactatcacttgattaaagttatggggaaggccatccatttaatgaaaaagccaagacccccgaggaacaaacacaagaaaagcaaatagagaaaattggggatcagaatgaaagcggtggaaatagaagtgacctccacggtgccctctatcatcggagtagcagtgagagtggccaggggctggctctcgctgtggaaaactctggacagaagaaaaggacttggcagactgtgggtgcaaacaaccccaaccccaccagaccctgaatttcatgctttgggaatattcattctcggccgatgccaaagaaccaacatgtttctgtagatgtgcataaaacaaattgggacttcttgagaggtttttgcaggtctttggaattatgacaaggagt

SEQ ID NO: 208773 - DNA, 395 bp, Homo sapiens
tgtagctcagaagctgagggtttgcccctttcatagcagtggtccagagtcttcttctgtcatccggctggagtgcagtggcgtaatttcagttcactggaatctccacctcttggttcaagcaattctcatgcctcagcctccggagaaactgggattacaggtgtgcaccaccatgtcttgttaatatggctacttcttaatttccttccagctcataaaatttctgtgttcacatagttagattggttagatactaattctacctttgaaaaataataatcattttataaagaaatagaaatttgctcatttgagcatttaaaggattttcaaattgagaaactgtgtaggtagagttttgatataataaagtcaaagcagaaagatttcct

SEQ ID NO: 208774 - DNA, 535 bp, Homo sapiens
ataaaaggaataattttttaaatgctagggtagaataaaggattcaaagaagaattaaaggaagagagaggaaaagagaaagagaaggaatcataaatgttctgagatattaattgaagataaactacttcttgtagctttccattcatctttagatagagggcaccagaataagaaatgcttaacagtttccccgtgtttaatttttcacagaacatatttaaggggactacactaggtactataaggaatacaaggaataaaagaaacaggcaactgcttggctttttgactacaagacctgaaaaccattttgactacatacctgaaaagttaagtgacgctgcaagcagtatgtgattaagggctaaaccaaaaaagtaaaggaaagtgtaggtgtgctagtttctcattttacaatgtaaagttctgtaaatactgcctaatattaaagggtcaatgagcaaggccagaccaagggtctaggtcaggttcatgaatgaatggaatgatgattcatgcttgattcagaaaa

SEQ ID NO: 208775 - DNA, 513 bp, Homo sapiens
ctggggcagagaaccttgaaacttatcttctctcagcactagttttggggaagccatagagttgtgataatgtgggatgtacctgtacctgcctgttactgtgtgctactacacctgaattgggagctgtgagttggcatggaagccttgggtctgtggaactagatctgtataaaagatgggcaggaaatgggagttgcagcttctctgtgtgaaggtgacctatgtgccccttggctcttgctgcaccctgtgtgagtgaggaggcaaaagaagcagtgtactgaggtagctgctgggccctggatgaggtaaagatgctgaacctgccatatctcctcttctgtgttcttctgtaagggctaagtacatggagtaatacttagattggttcctgagcccgagtgctgtaacagctgctgggtcaatgtggtattctcaatccagtctctgggtttgttttttattttttgttgggggcaggcagtgcagcttaaataacagacatttatt

SEQ ID NO: 208776 - DNA, 382 bp, Homo sapiens
taataggagccagtccccacagcaggaggtaagcagtgggaaagcaattgaagctttatctgtatttatagccgctccccattggttgcattactgcctgagctccacctcctgtcagatcagtggtggcattagattctcaaaggagcatgaaccccattgtgaactgtgcatatgaaggatctaggttgtacactctttctgaggatctaatgcctgatgatctgtcactgtctcccaccactgccaccccctgcctaccttcatggaaaaagtttcttcatgaaactggtccctgtgccaaaaagattgggactgctgttctaatcagataaatagcatattcattagtatattcattcaacacaaaaatactacagat

SEQ ID NO: 208777 - DNA, 609 bp, Homo sapiens
gcccatagaagacatgactgaaaataaaattttcccctacttcgaagtgggcattttgttcctctccgtgttcagcagaataggggcttttcagcagtgccgaggatcttggaattggttaagttgtgtgctggcagttggtgggcaggatatctgcagtgaaggacgtcaagtatgcaagggttttattgttaaaatgtttttcatttggctacagaacatccactatgtgataaaactggcaaaagggaaacaagagtgcatggttagctcaggatactttatggagtatttaatagagataaatgtaatcttggacggatataccagtaaatagcttacatgatggaacaaaattctttacaaatcactgtgctaaaattggttttcaattctccatcatttctgactgccagaggttctgtgtatgagtgtggcaggaatatgcttgcaaagcagatccgaatccacgctgcgcgtggtgtgctgcttctgcgtttctgatgtcaactaaaactcagatggctaatatgataaaccttaattagcttaatacaataagctgttttattatttagtccttcattcttgtcttttgagagtcagtga

SEQ ID NO: 208778 - DNA, 513 bp, Homo sapiens
gggcccttaagcagactttgaaattatggagagctttcctgtttttaaaagcctctcaaactttcccttacttgctctccattcaattcaggggttaaaaaaatgttctactactgtctctggggtttcctctgaggttgctgatgccccttctttttaattgcatttttatttttctaacacctacctcttacacagaaatgatgccccttctgcatgttttgatgccggcacaggtgtaagcaatgagaactatgccatacctgcctccttgccaacagttgataaccacagacaggaagacactgatttcagggatgagaagaaacaggtgtcttagaaacacggtactctccactcatcctctggaatccttctataaccttcagtccctgtattctctgggtccacacatgccttcaagagctatgtcagcctccttgaggcttgagggggaaaaagtcactctgcttttctcttctctcattaaaaacaacaaaaactagacttcca

SEQ ID NO: 208779 - DNA, 492 bp, Homo sapiens
taaactccaccctgaagctaaattttctcttctgcaaaatggggataattacattatccttgtggtcttactttatggattcaattcatcattcaacaatgattcacagggctgggcgtggtggctcatgcctgtaatcccagcactttgcgaggctgaggcaggaggatcgcttggacccgggagctggaggttgcagtgagctgagatcacgccactgcactccagtttggatgatagagtgagatcctatctttaaaaaaaaaaaaaaaaaggttaactgaagatggggaaggggtgccctaggagtggggcacaacccagcaaacactccaaggtgggagggagcgcggtggggattaagacaggccacttctgtggccaaacactgtggaagctggggaggaccctgacctggctcaggtgttcacaggccccctctggctgtgtgtggggaacaggtggtggaggacagggaaggaggctttgcca

SEQ ID NO: 208780 - DNA, 227 bp, Homo sapiens
cttggataagcggatgagggctgattacgaaaaattaatcgtcattgaatttagtattactaaactcatagcatttgtccagatttgtaaacactattgattctaatgtgaaagatggaaaagcagtcccagaattggcttagcacagagactctaaatgatagtaaaacaacatattcaactttaattcctgtcttattgttaatgggaagttagttatggttcta

SEQ ID NO: 208781 - DNA, 660 bp, Homo sapiens
ttgttgtgtttatttgttcttagtcaaggtgtctaatctactatgctgtttccttatgcacagatggaaacttatcatgcataggagactctgaaggaaataatttttgtttaaactttgccttagaaacttcaagggaattcagaacaggatttctttaatgatctggctgtattatattaccgattaccaagctgaaaaatgcttggcagaacttttggcttctgaggttttggatgtcttccaggtaatctgcctcggaattttgaaatacaaataaatgagttccagttcaaattttaaaaaatctgagctgctaggcctttgtttaccttccatctgaacattttggtacagatataccaaccaagcagaaagaagataatcagtcgacatttctgaggttattagtggccttggtttaaaagaacaaaatgagagtaaatggtttaaaacttcatcatgtttcttcctagtaactggcttctggtgttggcatttattttccaggatgttttctcccagtttttatttgggagaggaggacgagggtgttctttgctgctttgtttctcccagagggaagattctgaatgttcctttgttaaacgttacacacgtagcttttgttttactttcttgtctggtagccaagtattt

SEQ ID NO: 208782 - DNA, 287 bp, Homo sapiens
atggacaatttattctgtgctaaatggtcccgaatagttttaaactacttaataccttttataattctctttccttctttgattttagttatcagttcctgctgctagtgcagctacagcgggcagcctctcccacttctaattttgtttctaattttctatgaggaaaaacaaacttgtcagtttgcctgcatctcctactaacctactgccatgcattggctagataaaagtgttaacgatagaatggcagggaatcactactctgtgcctatgatcttaaaact

SEQ ID NO: 208783 - DNA, 485 bp, Homo sapiens
acttccaggtcaggtcctcaaaaagggaaacaacttacttactgcatcctaccattttccttactcatgggctttgagtcacctccaccctgtagcagatggcacaccctggtgcagctgcaggccccaagacaaaagggtgtccctggatgaaatggaacaaaaacacctactcacccagaaccacctgcccactttcaggctgctaagtgagaaagaaatatgctttatcttgtttgagctactgcatatttggagtatttttgtgacagcaacttagccagtattgtaaagaaacagcattgtatctgtcttaagagaacgacaccctagtggcaccaacgctactcctccattcctccccaggactacaaggagataaagcccacactgcaaaccccatcaggcctgagaattatactcagacctgaggctgggcaaggggaataggcaactgagcaattggtatcatttcccattttaaa

SEQ ID NO: 208784 - DNA, 558 bp, Homo sapiens
ccagtcctttcaccagggtaattatgatgttcataaatgagattgttcatgtacaatttctacaccagtagccaatttctttaaatggaaaggaacagattatatatacctatgtctccaactagagctgaacatgattagtgagagaaaatgcaggcataacgccaatgccttcatactggattaccatgcacctgatggactcccccagggacacacagggagaagcatgtcttttgggcttggatatcgcctgcaacgttgtgacaggctgttaacacaggtctccaccacagcctctcccaatgcgtcctccatctgacacaccataaggctttttaaagcacgctcaaacagtgagatgccctttcattcaacttggtagacatctattgagcaccttctgttaccatgtaccaggcattgatgggagcccagttctgacccaaggctaggttttccagctcagcatgtccctggctcccaagcggatgaccgagttctccggtgttcccctgtcctttcgcgtccccacgcctgtgctcactccgcccctcc

SEQ ID NO: 208785 - DNA, 644 bp, Homo sapiens
gagccaattaaacctcttttctttatcaattacccagtcccaagaacttctttatagccgtgcaagaatggactaatacaggtgtctagaggataaccaagtcaaaaagtgaatggagaacacaatgtgaatatccgaagagcaacaaactttctagctcaagacttagatataggaggcagtatcaagtataggaaaggttacctcaaaatgacatctagagtaaaatgggctaaggaccagggatgaactacaaaaaacacagatatttaagaccacacagaggaagaaaaattctgtagagaatgagtggctacaaagatcagtgataaacaaggaaagagtagtgttactgaaagacagggtaaaggaattttaaagaccaactggctgcttttccagtgcatataaatgtttgtttatacaatactgtattctattaagagtgcaaaagcattatatctaaaaacacaatgcacataccttaatttaaaaataccttactgctggccgggcgtggtggctcacgcctgtaatcccagcactttgggaggccgagatgggtggatcacaaggtcaggagatcgagaccatcctggctaacacggtgaaactccatccctactaaaaaatacaaaaaatta

SEQ ID NO: 208786 - DNA, 269 bp, Homo sapiens
aaaattatttttaaatcttttgagttgtgtgtgtgttggtggagagtttgtggcagagattgacgataactcatccgtacacttagtgaatcatgactatgactttgatcatcctactttagaatgtagaggagataaacccaaggttgtgctgcttgtttcagaagctgaactaccaggaaaatagaatttatccatcttggtctttactatgtgcccagaatagtgcctgtcatgtaataggtgcttaataaatattcagtgactta

SEQ ID NO: 208787 - DNA, 526 bp, Homo sapiens
agccaatataagagaagcaacaaattataagaccttatcaattgatttttgaatggtgactatgggagtaacccccaaatcttgagtgtctacatggaccctgaaggagctggtattctgattttcagtttaaagatgtagccaagatcaaagttgctaaagcccaactcctttattaaaaccaatgctttctctaaggtccatatctctatcactgttgtctaccaccaggttggaaacctcagggtcactatacaccttcctctgccttaaagccaattcatcagtaagttcttacagttctgcttccttcatattttttctcacatctgtgtttccattccaatttcactgcaatcacctactgctttttatctagctgattgtttactaactggctctccaacctctttcactcctctagtcctgtttctttgcattcactaaatctaagatgactacattagcctgacactcaaggtcagttccgtatctcttctaactttactcatgtgtcctgtatatt

SEQ ID NO: 208788 - DNA, 890 bp, Homo sapiens
cttacggctttgggactaataaaaatctgccttgcgggtaaagatgggctgtgagttagccactactcagaaacctgggcctgtaccttgtctgcaccatcagggggccttgaaaataccatccaattaaggtgtatcaaatccatatctataggctttgagggtatttgggacacataggtagagaagacgtctctaaatgttgtccagagaatccacttggttaagtgactcctgagtatcctgctggcacataagttcattttaaaaagccaatatgagtgctttatatgtaccatgaacttagcattcagtatctctaaatctctcaccatgactccccacaaaacatgaaacccttttgacacagatgcacaaaaagactcggaagggttaactgcttgagttcacctagcttctcatggcagagcaggacccaactctacaatgaagcttgccatgcatcagaaccactcaccttcacctcaagcaaacatttcctctttctcacaccccatgggtgtccttgactaactgccacctgtaactgcactcatcttttgagatctttttccaaagaaagatggttctggtaaacacagcaagcagctacagccaacagcagccatgtaagtgacaccagcaatccccactattactaatacttggatgtcttctagtcagcaccaacatatttgttggcctttacacaaacgaaaccccatttcctccaagctaaataacatcatagtatagtaggcatcaaggatgatgtgcttgtttctggagcttcctacccacaaaccccatgttaagaaaacctcttttccactttactattaaagagtcaaataaaaatgatgcttattgctatccagcacttgacataa

SEQ ID NO: 208789 - DNA, 540 bp, Homo sapiens
tgggcgatttaaatatgcttgtgttcacatctattttaattattgtggtgtcataagtcttcgtctctggtagtgtaaatcagacaactttgttcattagaagtgtcaattttccactaaagaacctgttaagattattgggcttatactgaatctaaagatgagttcagggaactgtcccatccgtgaatattatgtaggtctgctttaattttttttgagacagtctcgctctatcgcccaggctggagtgcagtggcatgatctcagctcactgcaacttccacctcccggattcaagcaattctcctgccttcagcctcccaaatagctaggatcacaggtgagtgccaccgcaccggctaattttttgtatttttactagagacggggcttcgccatgttggccaggctggtcgtgaactcctgacctcaactgatccgcccaccttggtcaggtctgctttaatttctcacattagtgttttacagtttacattagaggtgttacatacacatctttcattgaatttattcctg

SEQ ID NO: 208790 - DNA, 370 bp, Homo sapiens
acaccataatgacaaatcttcttatttccagagacaagaaataaaggtcaaatttaattaatttacactgccaactcccaacgtcagtgacctttggtttgacacctcagtatgtcatgtgcctatttgccagtgctattcatcctgaaatcagacaccattctcaactgcactgtgaaggagctgttgcttatttatatccttcattgaattccttttccataattgtttggaacatcaagcttattgatgagcaacggaagctggaggtaacaagactggtgtttggagatagggattgtggccaaccagcaggacactggcaagtatcatgacagctgttgagactgcaaggtgttgaatcatcaga

SEQ ID NO: 208791 - DNA, 545 bp, Homo sapiens
ggagacacagttaagctaatataagccatagaagtttagagaataaatgctgtaaaacagaataaatcattttcccctttcagataaagagcaggctttcgcaaaaaaatcttttgtctctctctaaactgaatgactaagttctttcatgctaaagcttgcaactaagtttgtctaagaccccctagtcaacatacaataacaagcagtttctaaccagggtgtaaggtatttgatacctaaagcattctcatgactacaatgagtaaccaaactccacagcttgagaaattgttagacagaacccgcagatccctttctttgagaacatgagcctgtgaaattatctatctttgatctaatttggctttctcctcccttccgagttcactgaacatcacacaaaaatgattgcctggccactacaatgctaaatctggggcactaggaaactgttctagggacgctgaatagaagagctcccagggtaccttctattgttcactgcagagcagccaccttgatgaattgttttaagatatcgt

SEQ ID NO: 208792 - DNA, 747 bp, Homo sapiens
atacgtgtgctttcacgcctggctagttttttgattttttgtagaaatgcgggttctcactatattgcccaggctggttttgaaatcctggtctcaagtggtctttcctcccaaagtgctgggggctacagtcatgcgctaccacacctggctggtcttcttaaacttaataagacttgttatgtgtcctaacagaatgcaccaagttcaaacaagaatattatgtaatctgttcctttttactgtagagtcctgtacatatttttaatgtgtagttggtctatgatatgatttggatgtttgtacccttcaaatctcatgttgaaatgggattcccaatgtaggatgtggatccttgtgtggtgtgtttaggtcatgggagcaaatctcttgtaaatgacttcgcaccatccccgtggtgatcaatgagttctcattctgttaattcacatgagagctgcgtgtttaaagaacctggcactttcttttcatgcttgctccctctctccccatgcaatatgtctggtttctctttgccttcaccatgattgtaagcttacttagaccctcaccagatgcagatgttggcaccacacttattgtacattgtgcataactatgaagaaaacaaatcttttttctttaccagtctacgtacttttgcctttaatgatcttcacttataggccccacgtgggcccaacgaggaactcaccgtccggctatagggggtcgcggccttgtgcg

SEQ ID NO: 208793 - DNA, 670 bp, Homo sapiens
atacgtgtgctttcacgcctggctagttttttgattttttgtagaaatgcgggttctcactatattgcccaggctggttttgaaatcctggtctcaagtggtctttcctcccaaagtgctgggggctacagtcatgcgctaccacacctggctggtcttcttaaacttaataagacttgttatgtgtcctaacagaatgcaccaagttcaaacaagaatattatgtaatctgttcctttttactgtagagtcctgtacatatttttaatgtgtagttggtctatgatatgatttggatgtttgtacccttcaaatctcatgttgaaatgggattcccaatgtaggatgtggatccttgtgtggtgtgtttaggtcatgggagcaaatctcttgtaaatgacttcgcaccatccccgtggtgatcaatgagttctcattctgttaattcacatgagagctgcgtgtttaaagaacctggcactttcttttcatgcttgctccctctctccccatgcaatatgtctggtttctctttgccttcaccatgattgtaagcttacttagaccctcaccagatgcagatgttggcaccacacttaggggtaagggctcccggagggttaagggctcccggagggttaagggctcccggagggttaagcgctcccgg

SEQ ID NO: 208794 - DNA, 529 bp, Homo sapiens
atgccattgcactccagcctggtccacaagagtgaaactccgtctcaaaaaaaaaacaaacaaaaaaaacaactattgatttagtcaacaacttagatgaatcccctggaaattatgctaagggaaaaaaagacaatcccaaaaggctgcatactgtatgactcatgtttatctaacatttgtgaaatgacaaaacttcaggaaaaaaagtttagtaactgacaaaggctagagatggaggggctaggccaggcatggtggctcctgcctgtaatcccagccatttgggaggccaaggcaggcggattgcttgagctcacgagttcaagacgagcttgagcaacatggtaaaaccccatctctacaaaaacatacaaaaattagtggggcatggtggcaagtgcctgtagtcgcagctaatcaggaggctgaggtgggaggatcgcttaagcctgggacacagagggtgcagtgagctgagatgcaactactgcactccagcctgggcggcagagcaagacgctgtcac

SEQ ID NO: 208795 - DNA, 765 bp, Homo sapiens
ttgtctgtggaaagctgctacccccaggagacaagcatctgggagagcatctccacagaaaaagaaaagtaaagtgggagttgaagtcattcaggctacttgagacaacaatttttaaaagctcctattttccctcagttaccaggagattttcggtcaaagtgttcaaagaaaataggtggataattacctccattatttcacttggctttctatggatagacatcgtcaaagatattggcgagttcctcttgtcctactaatcttgatgggtattttgttgattcacttccaaactctgaagtaaatgtactgcttattataacgaaaaacaacctttaagatgccctctgtcctctacctctaggcagagtgagcagcagcttgtacagtgaaatttaaggtccttcttcccacactaataatgtcagatcgtcccaccaccaatacaggggaggaaaaaccctgagttccatttccaactctgccatgacttgctctgtgacccgaggcgagtcatcatccctgtcggtgactcagctggctacccataaaacgagaaagtcagtctgagtggtttccctaactgggttcctcatcaaaatcaccagtgatactgttaataatatgcagataattcaagtcctcatctcggacttactgaatcagactctgaggattaggagccacactgcatctgttttaacggctactggtatcatggtcagcaggtggatagtaacaatctgggcctctggcggggcc

SEQ ID NO: 208796 - DNA, 123 bp, Homo sapiens
ggtgactttaggtgtcagtgatttctactattgaattattacaaacatatatttttgttatgaaatacactatttaaatcaaatacttaaaaaatacttgccattaatttgattgtagttctg

SEQ ID NO: 208797 - DNA, 169 bp, Homo sapiens
actccagcctgggtgacagagtgagactctgtctcaaaaaaaagaaagaaagaaagaaaatcatttttaaatcacatttctttaaataactttataatgagaccttgacaaaagtgattttctaagtaaagccagtgtctttctgaagacaaactataatggagaatag

SEQ ID NO: 208798 - DNA, 193 bp, Homo sapiens
acttttaggttcaggagtgcatgtgcaggtttatgtaggtaaactcatgccacaggagtttggtgttcagtttattttgtcacccaggtaaaaagtatagtacctgataggtagctttttgatcctctccctcctctcactctccaccctgaagtagactccagtgtctgttgttcccttctgtcgtcttctc

SEQ ID NO: 208799 - DNA, 395 bp, Homo sapiens
aaaacagatttgattctagaaatcagaattctcacactaataggcttccatttaagaaggctctcatagctgacaacagactaccaaatgggttagatttttcaattttataccttagtccataagtgctaatttctcagtggaacagtcagataatatactactagagattactgaaacctctagtcacagctctgaattattaatttaaaaggttatgcaccagtgctaatataaattatctttaaaaactatctatatgggtaacattttaataagctttaaaacatgatttttctctctcaacgttgaaagcaaaatataatatagaattggctctgagtgagctatggatttattgtattttttccaaaagatttgcaccaccgttcctt

SEQ ID NO: 208800 - DNA, 618 bp, Homo sapiens
gtgagacacttgctatgcaagggcacattcaatttctaaagaactggaacaccaactgcaacttcttatatccttgtgctttagactggaatccacaatacgtaccagatataaagaaataaaatagcatgccaaagttaataaaatattttgagtgaaaaaaattgttgtatttatttgagacaggttcttgctctgtttcccaggctggagtgaagaggtgcaaacacggctcgctgcaacctcaacctcccgggcccaggtgatcctcccacctcagtctcccaagtagctgaggtgggaggactgcttgagcccaggaggcggaggttgcagtgagccaacattgcaccactgaactccggtctgagtgacagagcgagtccctgtcttaaatttaaaaagaaaaaaaaaagagcctttcctctaagatctggaacaagacaaagatgcccattttcatcacttttattcaatatagtactggaagtcctagccccagcaattaggcaagaggaaaaaacaaaggcaaacagtttggaaaggaaaaatctaaatctaatcatccttgtttgtaggcaacgtgatattatatttagaaacaccaaaagactccac

SEQ ID NO: 208801 - DNA, 418 bp, Homo sapiens
tcaaagtgccttttgccacattcagtaacatattcacaggtttcagggatgtgaatgtgggcatcttgagggggctgttatctgcctaatcacacatcatacaaggcagacagaggtctgcagggctttagaaaccaccagtgaggccaggtgcggtggctcacgcctgtaatacctgcactttggaaggctgaggcaggtggatcacttgaggtcagaagttcaagaccagcctggccaacatggcaaaaccctgtctctactaaaaatacaaaaaattagctggtgatggtggtgcgcacctgtaatcccagctactcaggaggctgaggcccgaacccaggaggcggaggttgcaatgagtcgagatcatgccagtgtactccagcctgggtgacagagcgagactctgactcaa

SEQ ID NO: 208802 - DNA, 137 bp, Homo sapiens
tccttgtcacctaaaagcttcctgagaacagaaatcacctgggttcagatctgctaggccgacgcgtgcccaacaccccacacacacccatcaaattagatggacgaggtgccagctacactttcaaagctagtgat

SEQ ID NO: 208803 - DNA, 525 bp, Homo sapiens
agcatatagggaaacgttaaggattataggcaccggagaggtaacccggcttgaggggttggttaaagggaaaggcgagacttagggcgagaccgagcggggctaattgaggcgacccggggaggggcgggaccgcggactggatttcgacttccaaattcccacgaggtataggagtctgagggttgcacaggaccttatgcattgtttgactcctccagagcctttagagaaacttctatcaggcccgcctgctaggcactagtcggggagataatgtagccagggagatgtggcggacagaaagggcagagaggctctctgaggagcggatggaggatcgtgggccgctttactgagaaggaagagaccctgcgagaaggagtagtgtcgacttggtcccgtcagccggaccccacctggacggctggggccacttgtggtcgccgggaggtgtcacctctaactcttcgtgtcaggagtttttctacctctccggagttctttggctctcaggaacctagc

SEQ ID NO: 208804 - DNA, 523 bp, Homo sapiens
tattcattttagaaggatgagggctaaggtttttatactcttaaaatgtatccttggctgtcggctaccacttacagatgagtaaaatatatgccacagtgagttgggaaatacgtttcttctcttatgctaatgatatgtttttaatatctgcaaccaggaacaatgaaaagaagaaactaagagagaaacggcatgtgtatttaactaccagaaaggactctttacaaactggatcaaaatgaaaactaccctccctagaagaagaactccattttgaaactgatttggtatcctgggattttatgttactgctgagttgtactggccagaataccaggaggctatggcgatcacaaccacacttcctactggatttccctacagttgaagtgaacagctggtgaggcccatcttgaaacatttcctaacccaaaatattcatttagaagggatccagcgcctggtagatactcaataaccgtaactattgttactaatttttccatatttagaaattccc

SEQ ID NO: 208805 - DNA, 356 bp, Homo sapiens
gcgggcaccgagtcggggccgcgacgggaacacccaggagggccggggcggctgagtccagagcgcgcagaggtcgggcggggacgactctccccatcggcccctgactgcgaagcccgggaccagccccgggcgggagccgccgtccgcccgctcacccaggagcttcccagtccagcaccccaaacggccaggagtaacaaggaaagttcgcaggcaggcgcagagcgcctgggtacctctaagcaaacccccaccctagttgcagccgggtcccaaagttaagatcccgcctctttactccttagggctaagttttccaccatcaaaacaagtctttgcttccagtttacaga

SEQ ID NO: 208806 - DNA, 177 bp, Homo sapiens
aaaaaaacgaagggccagtgcagagatctagagaggaaaagaacttgtcttgctggagaagcagtcaaggtagccaaggagagtactgagaagagtacgttggagtgagtaggtagggactctatggagtagggccttaaaggcgatgattaggccaggcgcggtggctcacacctg

SEQ ID NO: 208807 - DNA, 312 bp, Homo sapiens
ttacaacaaagcccaagacaagatggtccctcaatgcaaataaagtctacagactttcaagtactgagacagaatgcaagtattagcaaggggacttgaaactggtagtcttcctagttactaatgtcttagtaagtcatgtgttctctctggacatagaaattcatctatcctgtcagtttaggtggcttggtgggttactgcaatctgtcttagggttagctggttgtattttcagctatagtcttggtggtatctagtacttcagtagcataaatacttcagcagcataagcataaggcttctgggaag

SEQ ID NO: 208808 - DNA, 395 bp, Homo sapiens
acctgtgtgcatgctgcgtgttccctgcttgatctatgggcagcctctcctgggatgaaaacagtagctctgggtcatggctctgcagggagagaagacctggttaagacttgggctttggcaggctgtggtgactcatgcttgtaatcccagaactttaggttccaaggtgggaggattgcttgagcccaggagttcaagaccagcctagacaacatggagagaccccatctctgcaaaaaaatacaaaaatagccagatatggtggcacatgcttatagtcccagctactagggaggctgaggtgggtggatcacttgagcctgggaggttgaggctacggtgagctgtgattgcgctgctgcactccagcctgggcgactgagattccatca

SEQ ID NO: 208809 - DNA, 480 bp, Homo sapiens
agctggtatagtaatagtaatacctggcaaaattgtgtttaaatcaaaatatattagtaaggaaagggagaaactgcaaaatgataaaatctaccaagaagatatacaatgtaattgtcaataagaagtaaagccaagacttggagctaggtttgtgtctactggttcaatgttcctaccaacaaaaacctctaaagaacacagacctataaaaacctctacttgaagcccactgtgcaagtactggtaaatttcttgcccaaaatgaaaataataattataacctgcaccatagggctattgtaaaaaataccttaggattgagacacactgcagctatcatataaacgttaaataaaaataatgcttcctgtatccttactagggttgggcaaatccagatgtatattatacttttcacatatttcaaaatattttcaaatgttttggtttgggttcaacaaaaacctcaagtacaaa

SEQ ID NO: 208810 - DNA, 978 bp, Homo sapiens
cagagtgccagaggagggtggctgtacaagcacattttaattggcaaagcagagtcgctgcccagcaaggaagagtatgcaggggtttattctgctgctcttctatttcccctttaaggcatatatctcttacccctgcacccaccaactttagtcactcctagcacacagctggcggccgcccacccgcacccgcacctgcacccgcacctcagagagcttgctgatccctgagccgtgcactgaagcttccaagcagctctacctaaaggcaagcactgcctgctttttacaacatatacaatgggctaacctgatgcacagaaaaaccctgggtcacatgacaaccaacaaactcattgctcaggatggctctccgccacgtttctcaggcactgtgcttggctctgctggccaactgagtgagctggagcattttctcttgggtgtgcatacccctccacctgtccaactttaaaacacagaatcaacagggatgttacactaaaggggaccctagaaaccatataaacggtggaaaattgaggcctggactgacccataacaaatgagacatcacataatggcaaatgaaccatgaccagaaaacaaatctctttagtacacagtttagcgcttctgcttatacaggttgaacagccctaacccaaaaatccaaatcccaaactttttgagcgaagacatgaggctccaacgagcatatcagactttcggattaggaatggtcaaccagtaagttctgcaaatattcaaaatctgaaaagaatccaaagaagtctcaaatccaaaatgcttctggtcccaagcatttcggataagaaacctgtagtttaatcatcagtcaaaatttaagaatagagttgattttgggccgggcacggtggctcatgcctgtaatcccagcactttgggaggccaaggtgggtggagatcaggagatcaagaccatctggccga

SEQ ID NO: 208811 - DNA, 1355 bp, Homo sapiens
taaggacagatacacctcttaataaagcggtcaataagacagtctcttctaatcagctctgctggtcccggcctatttgagaagcagtcaaggtaaatggtgcccagtcttctgaccgaataggcgcacaggcaacgccatcctttcccccaacactgtactctccagtgctctcagccaacttaaccactgctgcgtgttactcccttggttcccaggacccatgacctcattctttccacctactctaagaattaatcatgattttctggggagaggggaatgaaagaaagttttaaaaaaaaaaaaaaaagtcttggaggtaaatatttctgagactctaaaatagctgtgaggctgggtgtggtggctcatgcctgtaatcccaggactttggaagggcaaggcaggcagatcacttgaggccaagagtttgagaccaggctggccaacatggtgaaaccccatctctactaaaaatacaaaaattacccaggcgtggtggcgggagcctgtaggtccagttacttgggaggctgaggcaggagaatcgcttgaatctggtaggcggatgctgggattacaggcgttagccaccatgcccggctctcatctttattttctgtgatttctgcatattagttgcgcagtctaaaatgctgacataacccacaaacactgttgtcctttccccaattcagaaagttgaagatttgaaacatttacatttgaaagttgattcttcccccatgagacacatctaagttaataactagcaggacttatgttcatttattctcattctctaccttcttttaccttaaattcatagcatttgtgagcatattttaaaacaaatattaatgaaaaaacaatagaatctcagtttcattcaggcgacgattttgcttttaagtttgcacaagacagcttatttattattaaggtagacaaaatcaattttgctttttaaacattttcataagagcctcctatccttttttcttgtgtccttacaaatatctgaatctcttcatgggtgttttagtttaatttgtacatttgtctgtcagtagctgggaaaattaaatattgtttcagccacaaaccatgccattctaaaattgagaatgctaaaatgtttcctttttggtacattttatcttctaaggcccatgtggcaagtgagaatgcagaactatgatcgaatttattttttcttttgaagtgttttagaaacattttggcatattttgagttttattgttttaaaaatagttaacagaccacgattcttattctgaactgttttaaatgaactgtggatttagatgcttcgaaactaaaatatgaga

SEQ ID NO: 208812 - DNA, 477 bp, Homo sapiens
gaagggccactgatagcatctgccacaacttcacatctcatccatctaaccattaggtttatctggttacctaatagtgatgataagaaataaacgtcataagatcaatcaacccaccaatgactcaacactatatcagggtctatggaaaaagaaaacaaaaattgttcactttctgtagaagatccatctgtccccttcctcctctctaacagggtcccgcttttgctcacaggatctgttctcctcctccgagcatggtgctcatcaaccaataatggtgactccattctacttgcaaatgcttagcttgggaatgggcatgaaatatgagggttaggtattgggggacactaaaagtctgccttgctgataaaaaaagacatagaacaagagacagggagggaagggagcgggaaggagttctgagagtgacactatcacctagactctgtctataattctcagtggctgaga

SEQ ID NO: 208813 - DNA, 374 bp, Homo sapiens
gaggaggatggaagaaccataactgcaagatgctaagaacctggtgaaggaagcagaaacacttgggaaagaactctaatacctgtgaagtgccaagatacgggcatagtcagaatgttgtgggcatataaagaagagagaaaataatacttatttccaactggagagattgggacactagcttagaaggagatagagtttaagttgggctatatataggatgacctaccatcccagttttaaaacttaaagtcctgcatctcaggacactcctcagttggctgagtgagtgataaaggacagttgtaacttcaagtttatctcaagggtgagacacagtgaagaaagtctcaatggcaatgggctgggagtgg

SEQ ID NO: 208814 - DNA, 248 bp, Homo sapiens
cagtgaaataagtcaagaaaacgaaataaaaggaatccagactagaaaagaagtaaaactaacttaattctcagatgacttgattatttacatagaatatcctataaaatcttaaggaaaaaaaaaagctacttgaatgaatatgagagttcaggaagtttccagaatacagatgaatatctaaaaattaacggggcaggaaatgtaaccacaacatgatactactagatgcctgttagaatgtcttt

SEQ ID NO: 208815 - DNA, 152 bp, Homo sapiens
gtgttcttgctgttgctaacagagagctaaatgttctgctttgaatgggatgtgtttgtttttattggtaggagtggcagaaggatgaatgaaggaattcatgttttttaactgtgtttctttaagtgacatgtctgccttctgggtagagg

SEQ ID NO: 208816 - DNA, 346 bp, Homo sapiens
cacttaggctggaatgcagtggcatggctcacggcagcctccgcctcctgagtttaagcaaattctcctgcctcagtctgccgagtagctgggattacaggtgtgcaccgccacgcttggctaatttttgtatttttagtagagatggggtttcaccatgttggccagactgtctcgaaatcctgacctcaggtgatccacccaccttggcctccaaaagtgctgggattaaaggtgtgagccaccacgcccggcctatacttaacttttttggaaactgccaaaatgttttccaaaatggctataccataccattttgcatttccactactaatgtatgacagtt

SEQ ID NO: 208817 - DNA, 387 bp, Homo sapiens
tccaacccatcccccactatcctctagggaccaccatttttattctctgcttctatgagtttgacttttagattccacatacaagtgagatcatgcagtatttgcccttctgtgcctggcttatttagcttaacataatattctttaggttcatctgtgttttcacaaatgataggatttccttatttttaaaagccaaataatattccattcatccaatatatattacatcttttaatccattcatttgttgatggacactttggttgattccatatcttggctattataaataatgctgcagtgaacatgggagttgcatatatctcttcaacatactgattttatttcccttgaatatatacctgcaagtggagttgttggacc

SEQ ID NO: 208818 - DNA, 501 bp, Homo sapiens
ggattacataaagatactaagtctacaactcactgacatccttgaaagagagggagagaaagcaagcaacctggaaaacatatttgagaatatcatccatgaaaatttccccaaactctctagataggaataaaattaaaattcaggaaatgctgagaaccactgtgagacagtatacaagatgaccatccctcaagacacacagtcatcagattctccaagtatagtatagtttgaagttgggtagtatgatacctccagcttaagttctttctacttatcattgctttggctatttttcatgtctccaaggtcgacataaaataaaaaaagaaagaaacagaaaaggcagctagagagaaggggtaaggccacttacaaagggaatcacatcagggtaacagtgaacctttcagcagaaatcctacaaggcagaagagattgggggcctatattcagcattcttttttttttttttttgagacagagtcaccaggctgg

SEQ ID NO: 208819 - DNA, 242 bp, Homo sapiens
tgagccatcacaccgggccaattagttatttttaaaacatttactttactgattcattttcaaaatcgagaacactatgaatccaaatataaattaagtaataatgagtctatctctagaatttatcttttctttttcctccctctccctcttgtactctacacatgctgcagatgtgtcttttctctatctgcactcctaccactgcctgaaggcagctcttactacctcttgcttgaatg

SEQ ID NO: 208820 - DNA, 373 bp, Homo sapiens
tataccacattttatttatctgtttatcaggccaggcatggtggctcacatctgtaatcccagcactttgggaggctgaggcaggaggattacttgagcctaggagttcaaaaccagcctgggcaacacagggagacctcgtgtctacaaataataaaagattagctgggcatggtggcacatgcctgtagtctcagctactcaggaggctgaggtgggaaggatggcttgagccttggagatggaggctgcagtaagccactgcactccagcctgggcaacagagcaaaagcctgtctccaaataatgaatgaatgaatgaatgaatgaatgaatgaatgataaataaatatttgttaatcagttgatggat

SEQ ID NO: 208821 - DNA, 142 bp, Homo sapiens
ccaaataaatatttctatttaaaaaatactgcactccctagtatcatataataaaaagcaagataggaaaagcgtccttagaatttaaaggtgttagaattcaattagatataacgtatctcctgacctcgtgatccgcccg

SEQ ID NO: 208822 - DNA, 404 bp, Homo sapiens
ctcagtggctcatgcctataatcccaacacttacgaaggccgaggcaggaggactgcttgagcccaggaattcaagactggcctaggcaacattgcaagacactgtctctacaaaaactttaaaaattagccaggtgtggtggcaaacacctgcagtcctaactactcaggaggctaaggcagaaggatcccttgagcacaggagtttaaggttgcagtaagctatgatctgagagacagagcacaactctgtctctctctaaaaaaaaaaaaaatttggacaggtgtggtggctcacgcctgtaatcccagcactttgggaggccaaggtgggtggatcacctgaggttaggagttcaagaccagcctggtcaacatggtgaaaccccatctctactaaaaaa

SEQ ID NO: 208823 - DNA, 366 bp, Homo sapiens
agtctttttacttgctttgagtttttgatgtatgcgatgtgtatgcagtagtggtaatccatagcataatattcttgacatttaagcaccctcaaaaaaaataataaaaacctgtagatttatggatcctgttcaaaaaatggaagaggataaggatcacccttttccccctcgccttttacattttgcttttatgggggaaattatttaacaaacaaggagagcaaacctcaggatcagaggatgtaccccattcccgctacccttaggtctatctatggaattgaaaagaaactattgagactcaaagatactgtcagatccaagaatctgatttcaccaccaaattaaaataactacagcatt

SEQ ID NO: 208824 - DNA, 163 bp, Homo sapiens
aaagaaatacagtggaaaactcccctatgttttactaatatactgatatatgtgtgattaatagaaacatcaaaataaaaataattcaaagtaatcagtattaaaattaatatttgattaacatttaataggcaattttttaagctaggtttccaaattaaag

SEQ ID NO: 208825 - DNA, 214 bp, Homo sapiens
aaaatgattagttcttccttaaaaaaattttatgtagaaaacaaattaatgatggaccttctgcccaaagcagctttgaccaggagatctgagattgatgctgggactgctgctgagatccagaggatcaacaagctcatagcagcttcctcagcaccatgagatctggattgttaaacatttaggagttaaaccatgtgtccatatgggggtc

SEQ ID NO: 208826 - DNA, 140 bp, Homo sapiens
gtacatgagatgattttaggtgatttacagatgtttcttgagcttctcttgctggtcactgcttggcacagtccagaagacaatctgttttccccgatgcctgcttctgttgggctgtccactcctgccccacccattca

SEQ ID NO: 208827 - DNA, 411 bp, Homo sapiens
tttgcaatcttaagagagagattttctttgtaaaaggtggctgtgaaatttccaaatgtagcttatgtttgcagccaaaagtaaggcccttgtgtttttagtgaggtgaccttgatttgctgtagctctgtaaaatctcatctccattctgagcgtggatgtgtgttggacagttattgcttactaactggtgctagtctagttgaagcattcccgtgataaatgctagggaaggcagcagaagcctcacaacctagtgctaaccagagagcagtcaatggcctccgtgatccctgccccatgccctggggacctgataaaggacattcttttcttttcttcaagatccttttaaagtttgattctctggattatctaataatttactattttgggttgtggcaactttgc

SEQ ID NO: 208828 - DNA, 737 bp, Homo sapiens
attggcgggcgggcgcgctgagggcagcgccggggacgcggcctcagcaggggcgccccgccacggggagcagcccaggcgctcgccccaggacgttgtccggcgggctgggctgggacccctctgcctccagggcgcgtcgggagcagcagggatcggtgccgcgccgtgagggtgcgcagaggctgccctcgggcccgctacccacagaccctccgcggggcagcgtctccgggccggccgcgccctggtccgccgaccgcagacgacttgtgacacggacggcgcgtcctgctgaccccagccggcgccgagggcttggaatctcgagcgggaaaagactaccatggctgcaggagtcttgcctcagaatgaacaaccatattctaccttggtgaataacagcgagtgtgttgcaaacatgaaagtttacttctacaatttcggatggaaggattatggtgtagcgtctcttactactatcctagatatggtgaaggtgatgacatttgccttacaggaaggaaaagtagctatccattgtcatgcagggcttggtcgaacaggtgttttaatagcctgttacttagtttttgcaacgagaatgactgctgaccaagcaattatatttgtgcgggcaaagcgacccaattccatacaaaccagaggacagctcctctgtgtaagggaatttactcagtttctaactcctctccgcaatatattctcttgctgtg

SEQ ID NO: 208829 - DNA, 990 bp, Homo sapiens
ctctcagtgaaagttcctcactgagtgagtggggctgactcttcctgcctccggctcttgcctcccagtgccatgcaggtgcaggatgcaaccaggcggccctcagccgtgcgcttcctcagctcctttctccagggccgccggcactccacctcagacccagtactgcggctgcagcaggcccggcggggctctggcttgggctccggctctgccacgaagctgctgtcctcgtcctctctccaggtgatggtggctgtttcctcagtcagccatgcagagggaaacccaactttccccgaaagaaaaagaaatttagaacgtccaacaccaaagtacacaaaagtaggggagcgtttacggcatgtcattcctggacacatggcatgttccatggcgtgtggcggtagagcttgcaagtatgagaacccagcccgctggagtgagcaggagcaagccattaagggggtttactcatcctgggtcactgataatatactggccatggcccgccatcctctgagctcctggagaagtaccacatcattgatcagttcctcagccatggcataaaaacaataatcaacctccagcgccctggtgagcatgctagctgtgggaaccctctggaacaagaaagtggcttcacataccttcctgaggctttcatggaggctggcatttacttctacaatttcggatggaaggattatggtgtagcgtctcttactactatcctagatatggtgaaggtgatgacatttgccttacaggaaggaaaagtagctatccattgtcatgcagggcttggtcgaacaggtgttttaatagcctgttacttagtttttgcaacgagaatgactgctgaccaagcaattatatttgtgcgggcaaagcgacccaattccatacaaaccagaggacagctcctctgtgtaagggaatttactcagtttctaactcctctccgcaatatattctcttgctgtg

SEQ ID NO: 208830 - DNA, 1108 bp, Homo sapiens
attggcgggcgggcgcgctgagggcagcgccggggacgcggcctcagcaggggcgccccgccacggggagcagcccaggcgctcgccccaggacgttgtccggcgggctgggctgggacccctctgcctccagggcgcgtcgggagcagcagggatcggtgccgcgccgtgagggtgcgcagaggctgccctcgggcccgctacccacagaccctccgcggggcagcgtctccgggccggccgcgccctggtccgccgaccgcagacgacttgtgacacggacggcgcgtcctgctgaccccagccggcgccgagggcttggaatctcgagcgggaaaagactaccatggctgcaggagtcttgcctcagaatgaacaaccatattctaccttggtgaataacagcgagtgtgttgcaaacatgaaaggaaatttagaacgtccaacaccaaagtacacaaaagtaggggagcgtttacggcatgtcattcctggacacatggcatgttccatggcgtgtggcggtagagcttgcaagtatgagaacccagcccgctggagtgagcaggagcaagccattaagggggtttactcatcctgggtcactgataatatactggccatggcccgccatcctctgagctcctggagaagtaccacatcattgatcagttcctcagccatggcataaaaacaataatcaacctccagcgccctggtgagcatgctagctgtgggaaccctctggaacaagaaagtggcttcacataccttcctgaggctttcatggaggctggcatttacttctacaatttcggatggaaggattatggtgtagcgtctcttactactatcctagatatggtgaaggtgatgacatttgccttacaggaaggaaaagtagctatccattgtcatgcagggcttggtcgaacaggtgttttaatagcctgttacttagtttttgcaacgagaatgactgctgaccaagcaattatatttgtgcgggcaaagcgacccaattccatacaaaccagaggacagctcctctgtgtaagggaatttactcagtttctaactcctctccgcaatatattctcttgctgtg

SEQ ID NO: 208831 - DNA, 462 bp, Homo sapiens
taaaaaataaaaaataaataaaaaaaataaaaaactcaaaagaacatcctcagaaaaattcaagagaatacagcatctatgaaatcagtgctggtattatttccagaaaaacagaatattaaaaattgaaggaaataaatcaaaaaataataatagaaaaacttccctggggccaggcatggtggctaatccctgtaatcccagcactttggaaggctgaggcaggcagatcatgaggtcaggagttcgagaccagcctgaccagcatggtgaaaccccatttctactaaaaatacaaaaaaaattagtgggcatggtagggcgtgcctgtagtcccagctactcggaaggctgaggcaggagaattgcttgaactcggcaggtggaggctgcagtgagccgaggtcacgccactgcactccagcctggacaacagagccaggctccatctcgacaaaaaaa

SEQ ID NO: 208832 - DNA, 685 bp, Homo sapiens
tacaccccatggtccttgagcacacatgtcctgggccctggcatgcactcccccaggcgtcatgtatacacacagtccacacgtttgcaaacgggcagacacacctccctcttgcacatccgtgcacacccagcccatatcttcctgcccctgcgtgtgcacacagtcccagttagtttacaccgtgcacacctctccatacatacaggttcccagctgtgcgaccactcacccacacgtatgcatttattttttaacacacacatgcataccatttagtaggaccccatgtacaagcatctgagtgctttacaaattcaaatgtatttaatccccctatcaacactaggaggtagtttctgttattagcgccattttacaaatgaggaaactgaggtgtagagcagttagatcggtgtagagaagctagatcgtgtgctcaaggcttcagtccaggctcttggccctgacacgatgctgtttgcctgttgaagatgtgtgtgcatgcatgcaccattcacactgtgaacgtgtcccagcatggccacaccccctcaccgtatacacatatggccatgagcactcaatctcaaggtcatggatgcacatgcctcacacctatgcatggaaggacactcggcacacatacttgtctctgcacacacacaccacttgcacacccatg

SEQ ID NO: 208833 - DNA, 458 bp, Homo sapiens
aaaaaatgtgaccattaaaaatggctagaatagcttaataatataatatcatatttattctatgatttccagtggaatgaactgttatggtctccctgattgattataattttaataaacttggttgtgtgtggctaggaacaagttcattccaagttcattttttccctgatgtagataaaattccatcagctaagttctgctactgtgccccatctccagacttctagctaaatgaagtactacagggctctgattcttgctcaaactcactactgctaaactgaaatgcttgaggtattcaaaactgttattttctgcgtcaatttgatatatgtgcagcatttcttttttaaaaggacatgttctgaatgtttagagtgtgtagataaccactcccaccccccaacacactcacgtaacagaagaaactttggatacttttattgtgtaaactt

SEQ ID NO: 208834 - DNA, 507 bp, Homo sapiens
ccatggatagtgaattggggtcataacaacgtccttatcatacttaacaattttttaaattgtaatacaaaatgtgatgatataaagagctgttctatatatttaaatgactatttaaatatatgtatttcttttccaatttgtgattaagatcaatagaggtagtagtgatatatttccctctcataagtttcacactgcttatctctgaaaacttcaaagttgtcaggtgaggagtgcctatttatctaatttctattccagtatgttttcactttagatttgtcacataaaatggagactgcgcaatgacatgcaaagtaatctgtttatgtgtctaaataaaatatgtgaagtatttacatggtttgtgtgaaagtccaagtaggaaatatgcagaaggatttttagcttagctgtatatttttgtcaggaaattatcatcatgtgaatgtttatgttggagctaacaagcatcactctcattaaaaacaaaacaaaagcaga

SEQ ID NO: 208835 - DNA, 450 bp, Homo sapiens
ggtcaaagaatccactaaatttcaagaaagattaattctgaggttgataagtcttgagtatcaatttctggccacaaaggaaaatgccagatttcaaaaggcagaaataatcacttttttctcatccataatagttctcaaatttaggaattaccaacagtaataataggagcaaaaaaattagtcccagtaataaggaatttttaaaactttcatgtttcatggattgaagtagaaaccttaaaaattatagaatatctagaaaaaatattacaaaaacaagcatatcaaaactgaaatggcagggcaaaacttacattctgagagaagtttatagccttaagtaactgtatagctgagtcagaaaaaaatgaaataagcattcacctactccccaaattagaagataataacacatacaaaagcagaaattaatgaattaggaaagag

SEQ ID NO: 208836 - DNA, 329 bp, Homo sapiens
tggtgaaaccccatctctactaaaaatacaaaaattagccaggcatggtggcgggcgcctgtaatcacagctacttgggaggctgaagcaggagaatcgcttcaacctgggaggtgggagttgcagtgagccactgcatttcaggctggacgacagagcaaaactccatctcagggaaaaaaaaaacactttgggaggccaaggtgagaggatcacttgaggtcagaagttcgagaccagctggccaatatggtgaaaccgcgtgtctactaaaaatacaaaaattagccaggcatggtggcacacgcctgtaattccagctgctcagg

SEQ ID NO: 208837 - DNA, 140 bp, Homo sapiens
ctgttgaatcttatcttgcccagaaaccctgcccaaatgccatcttagccagaagccctaaccaaatgagacaagatgaaaggtcttgcttaccggcactttcgttttaaactcatttcgatagtatttaatgccaatgt

SEQ ID NO: 208838 - DNA, 468 bp, Homo sapiens
agaagcaagattgcagacatttctgcagcattatgtacagaaagcctgccatgttcattagctgattttaaaatcattagtaggcatttaaagcagtgacttacttaccttattgtagtttgagaataatacaaccaaacttcactaagactttaaaattcaccctagtgaattttaaactgccctccccattaatttgccttaaattacagtgttgctttttgccaaggacctttcagagaaatgggccatttcatctacaggttggagaaaagtttaattctggggttaaagcgtaaatgaaagagagtgtgctgaagaacagtaaggcttaaaaacccaagttatgtgtaaattgttctcaactcaagagaatatttgtccacctacatttttaattcctctttttaaaagtcctctctgctcttcaacgatgctctgctctgtgtcactcaaggacactggtgg

SEQ ID NO: 208839 - DNA, 216 bp, Homo sapiens
cttggcttcccaaagtgttgggattacaggcatgagccaccatacccagcctacgggtctatttctattgattgttgttttctccctcttgattatgggtcacatttgcctgcttctttgcatgtctcatgatgtattatcattattttttatttttttgagccaagatcatgcccctgcactctagcctgagtgacagagtgagactctgtccca

SEQ ID NO: 208840 - DNA, 280 bp, Homo sapiens
acatttctgtacagcaatgaaagaaaattttttaaaaaaatcttgtcaatgtctgtgtaagcatgaccacatcattgcccttcttaccctgcatccagcatttcaattaagattatcatggtatgcccaagcgtatactctgtgttttttcctagacatttctaatccagaaatttctgcttccactgcttccacatcagataggcctgaaattagactctgtgagggatgaaggcatcgattactagggtagatgcagtggctgccccctctctccagg

SEQ ID NO: 208841 - DNA, 392 bp, Homo sapiens
ataaataaatttaagaggcagagagagattttagtgacaattagagcgaagtgtgttttgtaatgatggaactgcttttgaaccctggttacatttttaaaaggtcaggccaggcagcacagacacaatccccagtgttgctgatgtctgtgagtgatcactttggtgacagtgaggcatcaacaatcagtttggcaatagcaacattatttattctatatcttctttttccttcaaagtgttttttctacattatgaaaaacaatgggagggaaggccagtgtgactattaataagacttgcactaagcattttgcatcttgtcaagcagaccatatttttagtgcatctactttttgataaatacattacatggcctggaccaaaacctt

SEQ ID NO: 208842 - DNA, 526 bp, Homo sapiens
tatcctactgtgcactgtgaactgttctactgtgtactgtcctactgggtaccgtgaactgtcttactgtgaactgtcctattgtgtactgtcctactgtgtactgtgaactgtcttactgtgaactgtcctactgtgtactgtaaactgccctactgtgtactgtcctactgtgcactgtgaactgttctactgtgtactgtcctactgggtaccgtgaactgtcttactgtgaactgtcctactgtgtactctgaactgtcctaaactgttctactgtgtactgtcctactgtcctaccagtgtcatggaaactgtcctattgattgctgtgctgctgtgatggctggaagattggcattaactgaaatcatcatggcctgaaaggccgttgagactttagggatatttactgctatgccacatgtccctaacccctgtgcagttcttgttaatgcgttttctttctgttttcctaccatctctgctttctcctgacacttgcatccagaggtaccgagctcca

SEQ ID NO: 208843 - DNA, 451 bp, Homo sapiens
agcatggctagggagacctcaggaaacacaatcatggccgaaggtgaaggggaagcaaggcactttcttcagaaggcggcaggaaggagaagtgatgagtgaaagaagaagagccgcttaaaaagtcatcagatctcgtgagagctcactatcaagaacagcatgggggaaaccatgcccatgattcaattacctccacctggtctctcccttgacacgtggggattatggggatgacaattcaagatgagatttgggtagggacacaaagcctaaccttatcaattggactagcttgaactgatctctgtagaagacatgtctattagaaagaaatttcaaattaagtggaaggcagggcagcaccctttaataagacagaccaaggtgggagaataagggtgagagctctgaaagaggtgtcagcataagcaattgtatgctcccacct

SEQ ID NO: 208844 - DNA, 530 bp, Homo sapiens
tagagaaggctgaagagagagcagaaaagaggaaagatggaataaagtctacagaagcagtggcaaaggatagatgtatgtattctcagaaggaaagatggatggattgacttataaaagaaatggaggaaggaaaaacagctaaatgggacagagaagcaaagatagaagacagaagcaagggcatgtgggacagcaaaacgaagactaacggaatataaaagcaagaatggataaagacagatggaaaatcgtaagagggtcaaaaagaaggaaataagaacgatgtcagtgaaatgatagaataggaagtcctggactttcctttcatccacagacacactgattcaacagcaatacacagatcaattccctttgtgagaaacaaactagttgagaagctcctgcacattgggagaatgtgaaactagccacactgaaactagcaggagacaccctctcatcaaaatctccactcttggcacagagccatatgattgagacaaaactctcagctcctaggttttccc

SEQ ID NO: 208845 - DNA, 704 bp, Homo sapiens
ggtctcaagctcttggctttaagtgattctcctgcatcgttctcccagagtgctgggattacaggtgtgagccaccgggctggccctgcttcgtttctgtagatgagagggatggtttcatggacttctcttcatggtgcagcctaattgttactctttggacttcttccagctttcatatatccttaataaccaatatgtaataatcagaactgtgcagagtggtacagatgtggacggtctagatcacgtgtagagcaggatgatgttttgcttagcttctagcaccctttatgatgctatgaagagtttcttagacttgggagctgcagaaagctgttagatcagcttgataatctgtagaccatcagagccatttcattcctaatttctgacctgtagctgatagcttaggacccatcatctttaaataatagtttgaattattttaaccacactagggctagatctaatctgtagttttctgccctcttgcctggccctttgagaacttctgaagttcatctcagtttgccgtttcccttactgagacagcttggagtcagcagacctgtagacactgctatatcatccccttgtcagacaattttatagaaatgttaagcaagattggcctagagatcagccctaggaagcctgcactgcttagaattctccatagagagaaatgtccgtttttcagg

SEQ ID NO: 208846 - DNA, 457 bp, Homo sapiens
agtgtctccactgcagctttctactggccaaatttgtgaggacccacctgtaacaaggggcaactggctatctttagtcatcagcatcaaatccatcttcagcccgaaagacagaaataatttaatcctagacttggatagattcggtgagttttttctttcatgctctatgtaagaaaaacccacaaagaaagcagccaaaaatgacttttacccctgagttgagatcacctagattttattcatcagtgaaagctccgagaaacgacaaagccttgtgaaaatacacacagttgtccctcagtatccactggggattagttccaagatccctgcagataccaaaattcagggatgctctaagtcccttatataaaatggcacagtatttgcacataacttttacatcatctctagattacttataacacctaataaaatgtaaatgctatgtaaa

SEQ ID NO: 208847 - DNA, 389 bp, Homo sapiens
tcattacacagataaggaaataggaacacccttctccccctcttaccactgagtgactttccactaacgtgagccaaacttgggttttaaccaacccactctcagcaaatgaacagcgccctaaagttaaagaatctctcctctgtgttccctgtaatagatgcacctaaccgacaggtaaatattcacaggctgctctacaactaataaaatgatatattcagtctattaaaacaagttaaaacatgacagtggaaataaattttagcaaaactatttctaaactattttaaactgccaaaccactagcttcctttaatttgggctttcccatgttaatgtacaacattcctagtggtggaaaagcttcagagaaagaacaagacaca

SEQ ID NO: 208848 - DNA, 381 bp, Homo sapiens
tccttggcactcttttgttattaaaacttaaaacttctctgttggtttaaatgttgaccattattattataacagaaaaacagttttacccactggttaaaggaaaaaaaaatcaatctcaaactatgacgtccgagttatactcctggctactatttatctttgaatcagccatctaaccaacatttaattggcttgcttcctcagagatatttattcttaacttgtttagtctgccagtaaatgaccaccaaatcgtcagttttgtttttattacagtctttgctggtttgcttatttgtgcatcactttatttaaaaagagtttagggcaactaatttattttttgtaaaaataaattttgaaataaaatgtggcaaa

SEQ ID NO: 208849 - DNA, 102 bp, Homo sapiens
gttatggacttaataaatcacattgaaatggaacagaagttcatttattgctaccggaacagaaagactagaatgttgtttatctgcctggcccttggttca

SEQ ID NO: 208850 - DNA, 622 bp, Homo sapiens
tgctagacatttctttttcaaggtactccttttggcaaacccacttgagttccattcttcagataaagagccaagatgcactgaaattacatgaccttctcagagactcccacccaaagagaggcacagctgggctgaactcccatctccctctgatgggcgagcccagctccttccccctgcagggaccccttagagcagggcctcctcaccatcactgagcaaacctgcataagtggcagtgaacaaaactgacacctgaatcatgcacctcaactacaacacccacatttgaaaggaaaccttccttgccccccttggaggaagtgagctcagttttgggagaggctggggtgtgtatcaagcaccactctcagtaaagctacagtggtagccatggtaggagtgatttttaatatttcacatacaaaaaaaaacctgctttaagaattgagaaccaggaaaaattgttcttccacgtgaatggctgtgcttccttctctcggggactgtgggtggcttacccatggactcctttgaactggaagccagtgtcatccctgtaaacatgttagtctcctgtgagactgttttcacaaccttttaaaattatgatttttat

SEQ ID NO: 208851 - DNA, 445 bp, Homo sapiens
taggatgcttatgacatcactaggtgataagaaattttatctccatcataacctcctgggaccaccaatgtatatgtggtccttcattggctgaacattatatagcacataattttatatatatataaaatgtatatacatattatatttaatatacaatattatatgttatatacatatatatgcctctgtgtgtgtgtgtgtgtgtgtgtgtgtgagtgtgtgtgtgtgtgtgtgtgtgtgtgtatgctcagcccatagaagcatctcccaactggctcatatgtctttttgacatgtccccatcattgagcatttttcttactctctaacacaggagacttaagtgtttggtatttgataatactatttttaccaagtgataattttaaataacattactgttatttatttgttagttgtaaaataagtacttgtgcagaaa

SEQ ID NO: 208852 - DNA, 514 bp, Homo sapiens
tctaaaaatctaattctgttggccaagtccagcataactttctcagtctttgtctacaagcacattgttacaacctcggggcctatcatatccctaatgcaatgtctttcttaatttgaaaattagtatgactatttcaatggaaacaaatcccaattgggagatttttaaaattacttatatgtgtatgtatagcattctcagtgttgactagatgtgcttatcagcagtgccagaattttatgaaacatttttgcagccatttttcatcaaagcatagaagctttccctacattctgctcactttattttaatagttaccttcttcaattcagttgcatcatcagtgtttatttaccactaaaagatattgaaaattcctaaagtttgaagttctatcttttgtaaattaaatgtgtgcttcaccatatttgcaaaccatgagttacttcaaagaaggactatttgtagaagttttcattctgtgaaatttcagaatatggagtaccagttc

SEQ ID NO: 208853 - DNA, 834 bp, Homo sapiens
tcatcttgggcctgtgttatctgagcacattcatttcctttcttattgaagctattctgaggcaagttttctactacttctaaaaaaaaaaaaaacaaaaaaaacagttactcatgatcctgaggtaggaaaaggcttaagacaatagatttgagaacagaaaggactgttctatgctcaagggccagaatgctaaagttttacaagacgtcttttcagaaacaatgctatctggctgtctagaactgcaaactcctcccaaccaatcccctggctctgaggaagtatttactcctcagagtgaattaccaaggaatggctttgtgtgtctgtgtattctgaagaagctgtaactacagaactagaaagaccatggctgagcctcactccaccaacagaaataaatgctgaaccagcaatggcagcatacacatacattactgtggtgtgtcaggctgctgggagaacaatgttcttccttctagtggacaaagactacactgaactgcaggaagcacaacccctttggtaatcagattttcatgtttctcttctgtgaaaatagtaaccaggaccaattctaagaatgagtaactacctagagattctcaggctactataaagagaggaatctgaaaaataaaagaaattctcatgaaaatgtggcaggcagagccaagggtaatctatgtgaattaataaagaagtataaccttcccttttcatcttgccttcccttttgtctccagtattcaggaatcagcatagtggctgaggtagctaaggacacagggcagtgagaaagggttgggggtgtgcacaggcccagggcaa

SEQ ID NO: 208854 - DNA, 351 bp, Homo sapiens
ccacaattgaatccaaacaagatagtatctgtaggtgggaattatttctatccctgaaatgaaatgtcagatttaataataatgtgtatgctgtgttccatgtcatttaatataaatcctgtctttctctattttatttttcacaaatcagccaacatgatattttgaaaatgaaaactgtattatgccactcctctttttaaaacttctcagtgcactcagaatgaggcccaaggctctcactatcaccactactgccccatctgcacctcagtcttcactcatgtcattttcccttttcccgctacacctgggacacacaggtttcctttcagctcctagaactcttga

SEQ ID NO: 208855 - DNA, 120 bp, Homo sapiens
aactgccatgttatggaaaggaccacagagctggaaatgctaagtggactctaggtgctgagaacagctcctagctgccactcagcaagaaagcaggtattttagcccagcgacagcaag

SEQ ID NO: 208856 - DNA, 593 bp, Homo sapiens
tctgtgaggtgggtaggaagtgttcctctcttacagatatggggacagtattggataagttagactgatatgcccaaggtcacccagctagtgagtgacagacagggatatgacctagctttgcagactcaggagcttctgttcagtccagtctactttgcactgctgtgatggctaagtcctaggcagtgatctctttgaaggcaaagactgcctaactcacctctgcttcctcagtgcctagcacaggccctggtacagaataggccctactggggctgaaggatggaaggagagagagagggagagaataagggggaaaagaaggaaggagaggagagagaatgagatggaggagagaagaaaaaagagggagtaaaagaaaaggaagaaaagaggcagggagagaaaaggaagagaaggcaggtggtctgctttagctgtttctacatatcacctcgaatgaaacaagaaagaagtctgtgttgatgttgtcactgtttattgttattttactaatgtactacctataacattctgctttccacctccacttttttttaagtgcttggaatagtcatgtcctggtagga

SEQ ID NO: 208857 - DNA, 427 bp, Homo sapiens
gctcaagcaagcctcccctctcagcctcctgagcagctagtactacaggcattcaccgctacacacaactaatttttaagtattttgtaaagacagggtcttgctatgttgcccaggctggtctcggactcctaggctcaagcattcctcctgccccagcctcccaaatatattttttgcttgttaattttatagggtaaactattggttattgaatacttattttatagcctgctatgtttgtgactctcttttagttattaaagtctgcttgtcttagttgatattttaacttcaattgtatcctaagcaaacagtggtcattttctctgtctgtcctggtaattgaagctcttatttcttttacttgctttgtttggtaggctagcatttttttactggtgttacatattaattgtgatgggag

SEQ ID NO: 208858 - DNA, 348 bp, Homo sapiens
ctgcctgattccctagtttggcttcatgtctgccctcactctgatcttaggacctactcagcctcacacagtagtcttgttatatccctgagtttctcagcagcaggtactgttgacatcttgagccagtcaatacaaaaaatgcaaaaaatagtcaggtgtggtggtgcgcacccgcagtcccagctactcaggaggctgaggtgggaggaacggttgagctcaggtgttgaggctgcagtgagtcgtgctcccaccactgcacaccagcctgggtgacagagtgagaccctgtctcaaaaaagaaaaaaaaattaataagcccagaaaggaaagctgtttgtcata

SEQ ID NO: 208859 - DNA, 411 bp, Homo sapiens
agttttgacccatatggatatcttaaatattcctattattgcaagtttatattaaaaggaggttaaattgtgaactcacaaactcatagcatcatagcaccatctcaatcaaaagtattatcttctgtgaactacaacagttttcacttctttcgcaagtgtggagtgacgtttgcctgaggctgtatgacctgtgatatcatgacaaattgaaggccaaagcagatgcgaatccagctgttttctattaagtcaaatgccaaggagatttacaaagatgtaaaacaatgcgcctcttctcaataacctttggttttgaaaattgttatttttcataaaaaatgttgcttccattaacctgtaataggtttactaccattattttaaataaaatacacatttcaaatggct

SEQ ID NO: 208860 - DNA, 898 bp, Homo sapiens
tccccgaggctacacagccaaagccggggggctggcctagccaaaaggggcgggcgagcacggcccgcgggcggcgttcgctggagctggtggaccgggcggctgaccgaggggcggacgcgcggcggggcagaccgctggggactgcgggcggcgctgtgtccgtcgccatgacagatcagacctattgtgaccgcctggtgcaggacacgcctttcctgacaggccatgggcgcttgagtgagcagcaggtggacaggatcatcctccagctgaaccgttactacccacagatccttaccaacaaggaggcggaaaagttccggaaccccaaggcatccttgcgtgtgcggctctgtgacctcctgagccacctgcagcggagcggtgagcgggactgccaggagttctaccgagccctgtatatccatgcccagcccctgcacagccgcctgcccagccgccacgctctgcagaactcagattgcacagagctagactcgggcagccagagcggcgagctgagtaacaggggacccatgagcttcctggctggcctgggccttgctgtgggactggccctgctcctgtactgctatccgccagaccccaagggcctgccagggacccggcgcgtcctcggtttctcgcctgtcatcatcgacagacatgtcagccgctacctgctggccttcctggcagatgacctaggggggctctgacagaccctggacccagggcctcacctgccactcaaccaaagagtcctcgagccggcccgccaaggggactgctgcttctttttctaaatgcatatttttcattatttataatttgtgtaaaaaacacaccttcaccttacaaggtgctgaccatattaaatgttcaagttctctca

SEQ ID NO: 208861 - DNA, 838 bp, Homo sapiens
tccccgaggctacacagccaaagccggggggctggcctagccaaaaggggcgggcgagcacggcccgcgggcggcgttcgctggagctggtggaccgggcggctgaccgaggggcggacgcgcggcggggcagaccgctggggactgcgggcggcgctgtgtccgtcgccatgacagatcagacctattgtgaccgcctggtgcaggacacgcctttcctgacaggccatgggcgcttgagtgagcagcaggtggacaggatcatcctccagctgaaccgttactacccacagatccttaccaacaaggaggcggaaaagttccggaaccccaaggcatccttgcgtgtgcggctctgtgacctcctgagccacctgcagcggagcggtgagcgggactgccaggagttctaccgagccctgtatatccatgcccagcccctgcacagccgcctgcccagccgccacgctctgcgacccatgagcttcctggctggcctgggccttgctgtgggactggccctgctcctgtactgctatccgccagaccccaagggcctgccagggacccggcgcgtcctcggtttctcgcctgtcatcatcgacagacatgtcagccgctacctgctggccttcctggcagatgacctaggggggctctgacagaccctggacccagggcctcacctgccactcaaccaaagagtcctcgagccggcccgccaaggggactgctgcttctttttctaaatgcatatttttcattatttataatttgtgtaaaaaacacaccttcaccttacaaggtgctgaccatattaaatgttcaagttctctca

SEQ ID NO: 208862 - DNA, 874 bp, Homo sapiens
tccccgaggctacacagccaaagccggggggctggcctagccaaaaggggcgggcgagcacggcccgcgggcggcgttcgctggagctggtggaccgggcggggggcagaccgctggggactgcgggcggcgctgtgtccgtcgccatgacagatcagacctattgtgaccgcctggtgcaggacacgcctttcctgacaggccatgggcgcttgagtgagcagcaggtggacaggatcatcctccagctgaaccgttactacccacagatccttaccaacaaggaggcggaaaagttccggaaccccaaggcatccttgcgtgtgcggctctgtgacctcctgagccacctgcagcggagcggtgagcgggactgccaggagttctaccgagccctgtatatccatgcccagcccctgcacagccgcctgcccagccgccacgctctgcagaactcagattgcacagagctagactcgggcagccagagcggcgagctgagtaacaggggacccatgagcttcctggctggcctgggccttgctgtgggactggccctgctcctgtactgctatccgccagaccccaagggcctgccagggacccggcgcgtcctcggtttctcgcctgtcatcatcgacagacatgtcagccgctacctgctggccttcctggcagatgacctaggggggctctgacagaccctggacccagggcctcacctgccactcaaccaaagagtcctcgagccggcccgccaaggggactgctgcttctttttctaaatgcatatttttcattatttataatttgtgtaaaaaacacaccttcaccttacaaggtgctgaccatattaaatgttcaagttctctca

SEQ ID NO: 208863 - DNA, 303 bp, Homo sapiens
attaaagaagggagtatgtgttgtcaggggttgaaatgatgtgaggtataacatagcgtctattcaagatactgggaagtactattgaccaggatgggggcttcgacatgggcttagggagtcataagtggagtccgtaaagaggtatctttactataaaagctattgtgtaagctagtcatattaagttgttggctgctgcttctttttctaaatgcatatttttcattatttataatttgtgtaaaaaacacaccttcaccttacaaggtgctgaccatattaaatgttcaagttctctca

SEQ ID NO: 208864 - DNA, 999 bp, Homo sapiens
tccccgaggctacacagccaaagccggggggctggcctagccaaaaggggcgggcgagcacggcccgcgggcggcgttcgctggagctggtggaccgggcggctgaccgaggggcggacgcgcggcggggcagaccgctggggactgcgggcggcgctgtgtccgtcgccatgacagatcagacctattgtgaccgcctggtgcaggacacgcctttcctgacaggccatgggcgcttgagtgagcagcaggtggacaggatcatcctccagctgaaccgttactacccacagatccttaccaacaaggaggcggaaaagttccggaaccccaaggcatccttgcgtgtgcggctctgtgacctcctgagccacctgcagcggagcggtgagcgggactgccaggagttctaccgagccctgtatatccatgcccagcccctgcacagccgcctgcccagccgccacgctctgcagaactcagattgcacagagctagactcgggcagccagagcggcgagctgagtaacaggggacccatgagcttcctggctggcctgggccttgctgtgggactggccctgctcctgtactgctatccgccagaccccaagggcctgccagggacccggcgcgtcctcggtttctcgcctgtcatcatcgacagacatgtcagccgctacctgctggccttcctggcagatgacctaggggggctctgacagaccctggacccagggcctcacctgccactcaaccaaagagtcctcgagccggcccgccaaggggactgctgcttctttttctaaatgcatatttttcattatttataatttgtgtaaaaaacacaccttcaccttacaaggtgctgaccatattaaatgttcaagttctctcaaaaaaaaaaaacccgggctcttttcggggggaaaaggtttgaaggccaggcctacgtccggcctttggtcaggggactgcggcccaagggatatcgacgaa

SEQ ID NO: 208865 - DNA, 861 bp, Homo sapiens
tccccgaggctacacagccaaagccggggggctggcctagccaaaaggggcgggcgagcacggcccgcgggcggcgttcgctggagctggtggaccgggcggctgaccgaggggcggacgcgcggcggggcagaccgctggggactgcgggcggcgctgtgtccgtcgccatgacagatcagacctattgtgaccgcctggtgcaggacacgcctttcctgacaggccatgggcgcttgagtgagcagcaggtggacaggatcatcctccagctgaaccgttactacccacagatccttaccaacaaggaggcggaaaaggtgacctcctgagccacctgcagcggagcggtgagcgggactgccaggagttctaccgagccctgtatatccatgcccagcccctgcacagccgcctgcccagccgccacgctctgcagaactcagattgcacagagctagactcgggcagccagagcggcgagctgagtaacaggggacccatgagcttcctggctggcctgggccttgctgtgggactggccctgctcctgtactgctatccgccagaccccaagggcctgccagggacccggcgcgtcctcggtttctcgcctgtcatcatcgacagacatgtcagccgctacctgctggccttcctggcagatgacctaggggggctctgacagaccctggacccagggcctcacctgccactcaaccaaagagtcctcgagccggcccgccaaggggactgctgcttctttttctaaatgcatatttttcattatttataatttgtgtaaaaaacacaccttcaccttacaaggtgctgaccatattaaatgttcaagttctctca

SEQ ID NO: 208866 - DNA, 1000 bp, Homo sapiens
tccccgaggctacacagccaaagccggggggctggcctagccaaaaggggcgggcgagcacggcccgcgggcggcgttcgctggagctggtggaccgggcggctgaccgaggggcggacgcgcggcggggcagaccgctggggactgcgggcggcgctgtgtccgtcgccatgacagatcagacctattgtgaccgcctggtgcaggacacgcctttcctgacaggccatgggcgcttgagtgagcagcaggtggacaggatcatcctccagctgaaccgttactacccacagatccttaccaacaaggaggcggaaaaggtgccacgtgcagggctatcctgagggttggggcatctcctggaacaatgaggttggcccacaacagaacaggagtcaacacgggccctgctactggctcagttccggaaccccaaggcatccttgcgtgtgcggctctgtgacctcctgagccacctgcagcggagcggtgagcgggactgccaggagttctaccgagccctgtatatccatgcccagcccctgcacagccgcctgcccagccgccacgctctgcagaactcagattgcacagagctagactcgggcagccagagcggcgagctgagtaacaggggacccatgagcttcctggctggcctgggccttgctgtgggactggccctgctcctgtactgctatccgccagaccccaagggcctgccagggacccggcgcgtcctcggtttctcgcctgtcatcatcgacagacatgtcagccgctacctgctggccttcctggcagatgacctaggggggctctgacagaccctggacccagggcctcacctgccactcaaccaaagagtcctcgagccggcccgccaaggggactgctgcttctttttctaaatgcatatttttcattatttataatttgtgtaaaaaacacaccttcaccttacaaggtgctgaccatattaaatgttcaagttctctca

SEQ ID NO: 208867 - DNA, 2055 bp, Homo sapiens
tccccgaggctacacagccaaagccggggggctggcctagccaaaaggggcgggcgagcacggcccgcgggcggcgttcgctggagctggtggaccgggcggctgaccgaggggcggacgcgcggcggggcagaccgctggggactgcgggcggcgctgtgtccgtcgccatgacagatcagacctattgtgaccgcctggtgcaggacacgcctttcctgacaggccatgggcgcttgagtgagcagcaggtggacaggatcatcctccagctgaaccgttactacccacagatccttaccaacaaggaggcggaaaagttccggaaccccaaggcatccttgcgtgtgcggctctgtgacctcctgagccacctgcagcggagcggtgagcgggactgccaggagttctaccgagccctgtatatccatgcccagcccctgcacagccgcctgcccagccgccacgctctgcgtaagttccacatcaccaaccatgcatgcttggtgctggcccggggagggcaccccagcctgccgttgatggcatggatgtcctccatgaccacccaagtctgctgcagcccaggcctggcatcccctctcgcctcagcccctccccagaggccaccctctggccccgaggggagagtgtggcaggcacaggcagtgcagatgttggtctctgtctcccactttctcccccttcctccgtctctctctcatggcagttttcacacagcatggggcatcttatacgtccactcttgcccttccttttctaacctcattccacggggatcccttcatgtctgtgtggacagcaaccttgttcccacagctgcatggcgctcctaggcggtcccagctggaattacccaaccccatgacggaccctttcattgcagcgatctgcacacgtgtgggtgtttccataggacattgtcaggcacggatggctggtccgaagcacgtgcatttcagttttgaggctcctgtcctcaggcagtgtggactcaggccctgggagtcatgtggatgccagtagcctgggcccacagagctgctgggatgtggggggcatatcaagttgaagatggcaactctgatctgacgcctctgtgctcagggcccctggaggaggggctactgccccttggcccttagacaacaggacagagaccagagggactgggcggcttgtcccaggctactgggctgtggtctctgaccccctggaggcctccccacgcctcacagaacacagtgcagacggtgggcggggagagctcgaggggaggcccagccctgcaggtgggactggctctccctccccagccacgagtatgccacagggggctttcaaaaccaggcagggccaagccttggccccactggaggtagagcaccttctgtggctcccgggtgcctttaggcccgtccaggagttggagcagaggagaagacccagactgtgcatagttccctgaggagggctagcctcaggtgccacagcctggttcggcctggcggccccaggacgcagcagcaaccttgggcttcctgcggggtgactaccttgccctccggccctgcccgttgactaactatgctctgtggttttgtttccagagaactcagattgcacagagctagactcgggcagccagagcggcgagctgagtaacaggggacccatgagcttcctggctggcctgggccttgctgtgggactggccctgctcctgtactgctatccgccagaccccaagggcctgccagggacccggcgcgtcctcggtttctcgcctgtcatcatcgacagacatgtcagccgctacctgctggccttcctggcagatgacctaggggggctctgacagaccctggacccagggcctcacctgccactcaaccaaagagtcctcgagccggcccgccaaggggactgctgcttctttttctaaatgcatatttttcattatttataatttgtgtaaaaaacacaccttcaccttacaaggtgctgaccatattaaatgttcaagttctctca

SEQ ID NO: 208868 - DNA, 887 bp, Homo sapiens
tgctgggattacaggcatgagccaccgcaccttgccagccccatgctttctttgtgaccactcccagcctgtttcccaacctcccaccccacagggagtatgaggagtagcagtgatgcctgtgacagaggcaatgccaggcactatgtggtgtgggtaaggggcaggttgtcacaggagctgccatccagcaggtgtcctgacacccaacagggaagctgaggctgggggcctgaccttggtgccctgccctgacccacagccagcccccctggcctgatcttccctggcacccccttgtaccctcagttccggaaccccaaggcatccttgcgtgtgcggctctgtgacctcctgagccacctgcagcggagcggtgagcgggactgccaggagttctaccgagccctgtatatccatgcccagcccctgcacagccgcctgcccagccgccacgctctgcagaactcagattgcacagagctagactcgggcagccagagcggcgagctgagtaacaggggacccatgagcttcctggctggcctgggccttgctgtgggactggccctgctcctgtactgctatccgccagaccccaagggcctgccagggacccggcgcgtcctcggtttctcgcctgtcatcatcgacagacatgtcagccgctacctgctggccttcctggcagatgacctaggggggctctgacagaccctggacccagggcctcacctgccactcaaccaaagagtcctcgagccggcccgccaaggggactgctgcttctttttctaaatgcatatttttcattatttataatttgtgtaaaaaacacaccttcaccttacaaggtgctgaccatattaaatgttcaagttctctca

SEQ ID NO: 208869 - DNA, 762 bp, Homo sapiens
atgagagagttagccacaccctgccgaccctacccacatctgtggctctggcgcccccactgagccacctgttccttgacaggtgccacgtgcagggctatcctgagggttggggcatctcctggaacaatgaggttggcccacaacagaacaggagtcaacacgggccctgctactggctcagttccggaaccccaaggcatccttgcgtgtgcggctctgtgacctcctgagccacctgcagcggagcggtgagcgggactgccaggagttctaccgagccctgtatatccatgcccagcccctgcacagccgcctgcccagccgccacgctctgcagaactcagattgcacagagctagactcgggcagccagagcggcgagctgagtaacaggggacccatgagcttcctggctggcctgggccttgctgtgggactggccctgctcctgtactgctatccgccagaccccaagggcctgccagggacccggcgcgtcctcggtttctcgcctgtcatcatcgacagacatgtcagccgctacctgctggccttcctggcagatgacctaggggggctctgacagaccctggacccagggcctcacctgccactcaaccaaagagtcctcgagccggcccgccaaggggactgctgcttctttttctaaatgcatatttttcattatttataatttgtgtaaaaaacacaccttcaccttacaaggtgctgaccatattaaatgttcaagttctctca

SEQ ID NO: 208870 - DNA, 2333 bp, Homo sapiens
tccccgaggctacacagccaaagccggggggctggcctagccaaaaggggcgggcgagcacggcccgcgggcggcgttcgctggagctggtggaccgggcggctgaccgaggggcggacgcgcggcggggcagaccgctggggactgcgggcggcgctgtgtccgtcgccatgacagatcagacctattgtgaccgcctggtgcaggacacgcctttcctgacaggccatgggcgcttgagtgagcagcaggtggacaggatcatcctccagctgaaccgttactacccacagatccttaccaacaaggaggcggaaaagttccggaaccccaaggcatccttgcgtgtgcggctctgtgacctcctgagccacctgcagcggagcggtgagcgggactgccaggagttctaccgagccctgtatatccatgcccagcccctgcacagccgcctgcccagccgccacgctctgcgtaagttccacatcaccaaccatgcatgcttggtgctggcccggggagggcaccccagcctgccgttgatggcatggatgtcctccatgaccacccaagtctgctgcagcccaggcctggcatcccctctcgcctcagcccctccccagaggccaccctctggccccgaggggagagtgtggcaggcacaggcagtgcagatgttggtctctgtctcccactttctcccccttcctccgtctctctctcatggcagttttcacacagcatggggcatcttatacgtccactcttgcccttccttttctaacctcattccacggggatcccttcatgtctgtgtggacagcaaccttgttcccacagctgcatggcgctcctaggcggtcccagctggaattacccaaccccatgacggaccctttcattgcagcgatctgcacacgtgtgggtgtttccataggacattgtcaggcacggatggctggtccgaagcacgtgcatttcagttttgaggctcctgtcctcaggcagtgtggactcaggccctgggagtcatgtggatgccagtagcctgggcccacagagctgctgggatgtggggggcatatcaagttgaagatggcaactctgatctgacgcctctgtgctcagggcccctggaggaggggctactgccccttggcccttagacaacaggacagagaccagagggactgggcggcttgtcccaggctactgggctgtggtctctgaccccctggaggcctccccacgcctcacagaacacagtgcagacggtgggcggggagagctcgaggggaggcccagccctgcaggtgggactggctctccctccccagccacgagtatgccacagggggctttcaaaaccaggcagggccaagccttggccccactggaggtagagcaccttctgtggctcccgggtgcctttaggcccgtccaggagttggagcagaggagaagacccagactgtgcatagttccctgaggagggctagcctcaggtgccacagcctggttcggcctggcggccccaggacgcagcagcaaccttgggcttcctgcggggtgactaccttgccctccggccctgcccgttgactaactatgctctgtggttttgtttccagagaactcagattgcacagagctagactcgggcagccagagcggcgagctgagtaacaggggtaacacctccctgctgcccctccctctctctccctctctctccctctctctttaccctccccagggctccatctccgcctcaggggcttctccaccccaagtctggctccattcctggccttctgttggtgacagacccccccctaaggtgctcgtttgggggctcttcaggcagcacctcagcctggcacccccactcccctgcgcagcccccaggcctcaggaccccacccctctgaggcccaggggagccctgttcacgctggtttctccccaggacccatgagcttcctggctggcctgggccttgctgtgggactggccctgctcctgtactgctatccgccagaccccaagggcctgccagggacccggcgcgtcctcggtttctcgcctgtcatcatcgacagacatgtcagccgctacctgctggccttcctggcagatgacctaggggggctctgacagaccctggacccagggcctcacctgccactcaaccaaagagtcctcgagccggcccgccaaggggactgctgcttctttttctaaatgcatatttttcattatttataatttgtgtaaaaaacacaccttcaccttacaaggtgctgaccatattaaatgttcaagttctctca

SEQ ID NO: 208871 - DNA, 508 bp, Homo sapiens
ctggcgcccccactgagccacctgttccttgacaggtgccacgtgcagggctatcctgagggttggggcatctcctggaacaatgaggttggcccacaacagaacaggagtcaacacgggccctgctactggctcaggtgcttcttccgttttgaaggtggtacagtaattttaaaagttaggagctcaaatccaaatctcttattattgcaattgaagtctaatgcatgttcacttttaaaaagtttagaaagtttaagacgtttatacaagaaaaagcacatattccttcctcacagacaccacagctcctgccacccatctgcctgccattttcacactgccatggtttaactccagttccctgtggccatgtagaatgatatgctgccaccaggtggcagcaccaggccacagactccaggtcctggaggtcaaggcccagtggcctgtccactgaccttgagaaccacacatttctctgtcatacacatcaaaagagccaata

SEQ ID NO: 208872 - DNA, 689 bp, Homo sapiens
cgagcacggcccgcgggcggcgttcgctggagctggtggaccgggcggctgaccgaggggcggacgcgcggcggggcagaccgctggggactgcgggcggcgctgtgtccgtcgccatgacaggtgggcacggggtcggctgggcggcagggatgcgggcgccctggatgggtggcccggcccgggggtccggctgccttgcgagtcgcctgcaggccgcgcctgggcagcgggggccgagtgaccttggcccgtcagctgtcggtggtgcgcgagtgcacccccgcgaagtggtgggtgtcccggggcttctacccggcggggccgtgccagccgaggcggtgccgggcatgatgggtggtggccaggtgcggggcccgaagagggcgggggctacaaggcagctccagggtggggctgcacagccgcggtctgggctcagccactgccaatgtgtgtgtgtcccgtggtggggaatttggtctgaaagagtaggaggtggtagaaatgacaccggagagaattcacagcggtcctgctgtgattctggccacggaaacaacgctccatccttacaaccaccccagcgaggtcgcgggacaggcgatgcgttcctcggcggcatgtgattcctgtgggactcttggagtctcccagactccttcggtggtccacgacgctcttgcccc

SEQ ID NO: 208873 - DNA, 340 bp, Homo sapiens
taataagcagccttagccaaaggaatgaaagatcaaatagaaatgtaggctcaatgtggtggctcacacctgctatcccagcactttgggaggctgatactggaggattgcttgagaccaggagtttgagaccagcctggctaacttagcaagaccctgtctctacaaaaaaaacttttaaaaattagctgggcatggtggctcaaacccatagtctcagctactcaggaggctgaggcaagaggatcacttgagcccagaagtttgaggctgcattgagctataatacgatcatgctaccacattccaatctggacaacagagtgagaccctgtctaaa

SEQ ID NO: 208874 - DNA, 377 bp, Homo sapiens
catccccatcctgagtggtctattctctagaatcaagatgaccacactccagcaggcatttcaaattgtggcttggactcacgcacaggccccctcctggttcccaggtgttctatgattttcgttggcatcgatggaaaggtcacctgtgccccccttcctccggaacatgcctggacaccattgtttgtttcgccatcgccccgtatgccctctgtgacacacattcacagcatctgctcttgaatacaccagtgccacgtgtggtcacactggctctactttggatttgcccctttccctgtttgcacgtgtcctgcacttttaccagaaggtggtaaaagtaagagaagaataaaattttggacatgtaaaat

SEQ ID NO: 208875 - DNA, 875 bp, Homo sapiens
ctagtagaggcctgggtgttggctgaagctcttcttcagcaaaatggcgacttcctggttcgcgcctctgggtcccgtgggggcaacccgtgatctcctgccgctggcggggctcagccctccatttgaggtgttccgtgtggccctgcgtccccggccaggccgacccacagccctctttcaactggaggatgagcaattccccagcataccggctctggttcacagttatatgacaggcaggcgcccactgtcccaggccacaggggctgtggtctccaggcctgtgacttggcaggggcctctgcgacgcagctttagcgaggacaccctgatggatggcccagctcggatagagcctctcagggcaaggaagtggagcaacagtcagcctgcagatttggcacatatggggcggtcaagagaagaccccgctgggatggaatcggcccctggaaccccaagtcctgcataccctccgtggcctgttcctggagcaccatcctgggagcaccgcccttcacctgctattggtagactgccaggccacaggcctcctgggagtgaccagagatcagcggggcaacatgggagtctcatctggcctggagctgctcactcttccccatggacaccacttgaggttggaactgctggagagacccttgccctccacctctgcaggcatcagacactggcgctggccggggcgctggcggtgctgggctgctcggggccgctggaggagcgcgcagccgcactgaggggactggtagagctggcgctggcgctgcggccaggggcggcgggggacctgcccgggctggctgcagtcatgggcgccctgctcatgccccaggttcgtggggagcagg

SEQ ID NO: 208876 - DNA, 165 bp, Homo sapiens
tggtgcacacggagcgatatgagagcatctttaaaacatgattatttgtaaaagtttacaaatacacagaatgaaattaatcacatgagaccattgacgttcatgcccggaaacagcaatgggcactctccaagaacacgtcccaataaaaagatcgtcattaca

SEQ ID NO: 208877 - DNA, 1104 bp, Homo sapiens
agcgggcttcgggaatggcgggggaggcgcgcgggagtggccgcggggagcttcggcttcaaggccctgggcgtccgcgcgcggatgcgggtctggggcgggttggggctgggccgggtcgtgaagatgccgtgggccgcggagctgcgcggattctgggctgtggggcgggcacggcctttccggaggcgccgctcctgggcgtcctttcaggcgggcgtggaggcgccagcctcgggcgcgtttagcctcgacctcgggccagcccgcttgccgcgccgtggccctaaggagcggctgccctgctggaccgcatccaccagcagcctggctctgccgctatcgaaggaggcttttaaagcgctggggttacagtccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagaagtctggaaagtagatggtaacatgatgtggcaccaggataaccaagacaagcttaaaattataaaaagaggtcatgaatgtgatgcatttggaaaaaatttcaatctgaacatgaactttgttcctttaaggaaatcaaacagtgaaggtgacttagatggattgattttaaaacatcatttagatttgcttattccaaaaggagattatggaaaagcagaatcagatgactttaatgtgtttgataatttttttctccattccaagcctgaggatactgatacctggttaaaatacta

SEQ ID NO: 208878 - DNA, 628 bp, Homo sapiens
gacatatgtttggtcatacatctaataacaaatctttgatcaggagcataattccaattagagcagtggttcttgacagcggcagtgttccatcctaggtattttatacatgtatcagaattttattttatcatctcaatgactagtaaaaggcaaggttgctgggtgccctgtgatgcatgtgacaatctttctcaaaaggaatcctcctgcttctcctaaaatatttgaatgacccactggattttgatgtaggttagagactgtttataatcatcggagcctagattttattttacttaaatcgcagagtactgtttttgctattttaatatgctgtaagtttccccagaaaacaacttgtataaattgacaaaacttattttgttcagaatttttccaggagatgctcaatatttcagaaaacgacctatctaaagacaatagtgtttgtggcatttaagatagaaataaagtacaaaccgtcagtctgcatgcaaactgtagttactgtattctcacgattctaattatgggtgcaggcacccaggactttgctatgttttcaaatatagtttttttctattgctatatatggaaattcttataattttattctgaattaata

SEQ ID NO: 208879 - DNA, 257 bp, Homo sapiens
ccgcctcccaagtagctgggattataggcatgcactaccatgcctggctactttttaaaatgtttgtaaagatcgagtttctcagtgttgaccaggctggtctccaactcctgggatcaagcagtcttccctccttggcctcccaaaagtactgtgattacaggtgtaagccactatacccagccaaattctctttatttttagaaatttggagagagatgtacagatacattatgattcactccaaactacaaacc

SEQ ID NO: 208880 - DNA, 584 bp, Homo sapiens
caggtggagagtgtttatgtgtttggaggctatcagtcaccaactcaagaaatgtaaagatctaaattatgatagatgaaaatgtgaaaatgtgatgtggtaaactaaccacccccacaaccatgttcccccttcctgcccatgcaaatcaaggacctggcttttaaaaatggtgaagggaaatgttcttatcacccattcctgtcagagatgatgcagctcattgctgatgctgagatccaacgtccagtgcctgagtacccctggattctgagcactaggggctggactgtggagaccatcagttcataacatcctgtccctgctccctgctgtagatgactgagaccaggtaacaaagacacttaacttcataaattaaaaatgtgtaaattataaaatacatttttaattatagaatgaattgatgttcagcaaagaaaagttgaatgtaataaaactctcatttatttccattatttgctttcatcatcaaaggaaaaaaagcatctctctgaagttaaatggcatttcattttgattaattgtagaaagaagattggaaaaatctcccatgaccaagg

SEQ ID NO: 208881 - DNA, 286 bp, Homo sapiens
cctccatcagccagcggatgtcatgataattatttctggtgtgagtatcagagaatcacatcttaaggtggggtttttttgggagttgctgatgagtgaatgccagaaataataatctgacattaagcctttgtgaatctgaccaaatgaatgtcgaagaagagaatttatggtgaagtcagattgcatgctatttcatgaatgcatttcttttagaatgtaaatgacagaaaaattattcattatacctataatcaaactacaagtttaatagataatgaaaatg

SEQ ID NO: 208882 - DNA, 446 bp, Homo sapiens
agtccctgctacttgggaggctgaggtgagagagtgacttgagctacggaggtcgaggctgcaatgagccgtattcacaccactgtaccccagcctgagacagagaccctgacaaaaaaaaaaaaaaaaaaatgagaccgggcaaagctcccacagaaaggctaagttggagtcctggctagatggcctttgttctagaaacccttgctttgctggctggggactatctggcatgctcccttgccacaggaggagcagccgttggcatctttggtgctgacctcagccagcttgtattttaggaaccaggccccatgaggcagaggccttatccttgagcccttgggtctcacagaatcgccggtgcccaggagctatggttggcccagtttctcttgcattttagccttttgggctctcttcctttgagagtccatccttgacat

SEQ ID NO: 208883 - DNA, 340 bp, Homo sapiens
ctgtaaagatatttctgtggtatttaaaataattaatttattattatttcccatttatggaaagttccgttgtgtaattttccatttaatggatgaaccataatgatctaaactaattctatactgttgcatattttggctacttccttttttttctgttttgaggcgaacagttagtaatctcataattaattcgagaagtgcaattatctggctgggtgcagtggctcacacttgtaatcccagtactttgggagactgaggcgggcagatcacttgaggtcaggagttcgagaccagcctggccaacatggtaaaacttcgtctctactaaaaatac

SEQ ID NO: 208884 - DNA, 521 bp, Homo sapiens
agccaagaaggacattctgagtatcggggccagctaggacaaatgcaggattgcacagaagccgtgtggccagtgcagttactgagggagagaagatggtagatgagttccaagaaataacggaggggctggctcatggagagtctggaaggtcacggagagattttgccttactcttagttggaagcctgtggaggagcctttctcattggggctcacctgagccctggaaggcagaagtgactagagtgattatttgttcagttctcccagggatgggaggcacctcatcctgggagagcagctccttagttgcatacactggctgcctgagagcattagggcctcaggctctggaaccctgcttgagagaggctgcgaagtgttcagagcaggacagtgccaggtgctggctgatacttcacagagcatcgctgtggcggctgcagaggacagacaggcccaggcattggagcctgaggccagtcacacagcattgcaggcttggggtggttgaatgg

SEQ ID NO: 208885 - DNA, 447 bp, Homo sapiens
cccccactatagcattgggcaagaaaagccattcagagctgcttcaattatgaaaaagtaaaatataaaacccttctagcctgggtaaacagatacaagtaactttagaacttcaaaatcttcttttcacagatattgtactttgaacaaagttatcaactcccttaggtctgatattctaaactacatttttaatgcattaaaaaaatacccagatgggtttaaatatgaaatagctttctaaaaatgaaaatgatttagtttcaggaagctacatctaaaataaatggtatgagccaggccaaaagaactttcataaccaccttgccccaataaagcccttatcgtggcaggcatagatgatgtttgcattttgcgtattagaatgtaacagctctcttccctaatctgaccaatgtcactataaatgtgtgtgtgtgtgtgtgt

SEQ ID NO: 208886 - DNA, 394 bp, Homo sapiens
taacacaatacattatcaacatctataaattatttgaactagaaataatacaatatattattctcaagggcatatggatattacacatgataaacaatgttaagccataaaacaagtctctacagatttaaaaagataaaaaatcatagaaagcatgttctccaaagacagaataaaatctgagagaacaaagaaatatagaaaattaaaatacgtgaaaatcaacatcctcctaaatagccaatgggtcaatgaaaaaaatcacaggggaaattagaaaataccttgagattaatgaaaaggaaaacataacccaagaaaacttaagggtgtagtaaaacggtgagaaggtaatttatacctataagcacctacatttaatgtaagagataaa

SEQ ID NO: 208887 - DNA, 211 bp, Homo sapiens
ccttataatttttttcagtagaatctgaatggacatcttgtaatctcgtcttcatgcctgagatgatttttttttgtctttttcctccatttctttctggcatgtcataatctttaattttacattttccagcattttgtttgagatttttcaaatttctggtattaggttttctttcatttctttaaatgcttgtgcaattatatttagt

SEQ ID NO: 208888 - DNA, 538 bp, Homo sapiens
tcaatacagaacttaggagccactttataaaggttttattttatcatagatgtgatgattggggccatgccaagagttttgtccttttctgttttttttaaaacacatatacgtgtgtgtacatgtatgtgtgttatattgatgtgaacaaagatttctattactgcttttaaccaatttttcttcttatatactcaaagtgagattaacacacaatggctcatggcactaattttaaaaaagtaataccaacttggtgataaggaaaggaaagtgggataaaaaaaagattcaataaggcaagtaattaaatgatatcgcttttttttgcatttaaattctaaaataagtagacatatatgactgtgtataattacagtgttatgcctaaaacaaagatgatatgaaaatatgcacaagtttcaactgatggcaaagttaatctgaactgcaagtatacatttcatcaagagcaatcacaatacatagacatacacacatatcctcaaactgcaaatctatgtgaacgttaactata

SEQ ID NO: 208889 - DNA, 310 bp, Homo sapiens
aattgagattataaaaaggctgctgagcacatcagtattttgagaaaatgccatatgttttaaaaacacgtttttaaaagtcgatgttgaaaaaggcacaccaccaagctgcgaaaacatcaccaatggcagaagacggcagactactcaatgagaattgaattactcatcaattcaagaaatttgacactgagctgcaggaattttaccatcctaatagttccaacaacttccagaaaatacaagagatagagggaaagaggatagtgagaatgagagaatcagtgaagacatatgtagcgattgggca

SEQ ID NO: 208890 - DNA, 391 bp, Homo sapiens
aagaggactttgctctgttcagtcattcatgggtccatgcttctcctatatagccagccctctgtctcctaaggcctggagtcctccatgggcctccaatctgtggctgacagaggatgttgacttgagacccatctttgattcattatggagcttccacaggctgttgaaatcctctaagtcaaaagtcctcaaactggggacacatgcctaaggaatacaggagcatgggtatttaagaaacttaatttccagaatcttcatgtatattttttcttaaaactgatttacctgagagcacccctggttcttctttcccacctctctttacacaaatgcctttctctacctttaaaaagaaaaagaaaaagaaatggctttcatttcagat

SEQ ID NO: 208891 - DNA, 545 bp, Homo sapiens
tcttctcccctgacaggttttctttcttttctattttttttttaattgagttcactcttgttgcccaggttggagtgcaatggtgccatctcggctcatgcaactgccgcctcccgggttcaagcgattctccctcctcactgtaattttatgaaatccagtcagagcaaagtttatatgtcaagaccagagtttcatagcccctataagcctttttctggccacttcccagcactgtggaaacacagcctggattttggttttatatatactcctcccacataaacaagttttctttcttttctattttttttttaattgagtttcactcttgttgcccaggttggagtgcaatggtgccatctcggctcattgcaactgccgcctcccgggttcaagcgattctcctgcctcagcctgaaaccgggaggtggaagttgcggtgagtcgagatcacaccatggcactccagccggggcaacaagagcaagactccgtctcaaaaaaaaaaacaactataggagagcttgagctggcatttactt

SEQ ID NO: 208892 - DNA, 423 bp, Homo sapiens
tgggaatgtcctgttaggccactggctagtctccattcataaaggtaatacacagatgaccccaagtccagccagcccatgtctgagtgcacgctggttctaaattccttggccatacacagtgcaaccatggcaagttgtaactccatgctctgaatgccaaagtgtaggaaccctgtcacatccacagcctctgttctacggctgtccccatggcaggggctaggcagggtgagggctccagtgacacagcatacttccaggtgaaggtgcacaagagtgcacaggagggtctcccggcagagcccggagcaggtgctcagcgagggggtgggagtcgcatgtggttgctgggcttgcaggctgccctcacacggccctggatgccgcttggccactggcacatggagcagtttactgtcg

SEQ ID NO: 208893 - DNA, 102 bp, Homo sapiens
caacccaacccatgcatacaaaaagtcagggtttgtgatttaatttagaaatagaggcaagattagaaaatggaattgtgtggagacttggagatcatgtag

SEQ ID NO: 208894 - DNA, 366 bp, Homo sapiens
acgggggacgaaaggtaaggagtgcaattcccaattttaaaagtaaaaattggaatgcattagtttggtgacttgtagcccacaaagaatttaagatttagtccttccaaactgcaggaaaaatacaagaacagctaacaacaggtataccatagttgttgttgtttttttttgaagcataatttttctctctccagtccccatgtttattaaaaaaacaaatcattataggactgatttgtttgcaaaataaactttagtcttattatatacttggcctgattatttgcataaagtgcaacacaagtaattattttttacataggcttctagaattggctttgatagaactctgttccataagga

SEQ ID NO: 208895 - DNA, 185 bp, Homo sapiens
tcacaccagccagagagctccactatatttcctgcttatatccttttaatcaactcctcatgtaccaagcacccaatagtgaagagtcacaggtaacccagttctgttaacattatagtttccttagtttcctttattttccccaaatttgctctgtcccttattatccaattctgcattcacct

SEQ ID NO: 208896 - DNA, 532 bp, Homo sapiens
gtgattgctgcttggtttccttggccttaacttgccagtgattacttagcatgggtcagccaggcctcctgctgaactcccaggagcagagcatgtttgtaccctccagattcctataagacgccctgtccaggtgtcccccagcgtctctaccctgtatgtccctagcacagctgctcgtcctcccctggaacctccgcctcatctcacacaggcttgtcatgatgggtctccaccatccactcggggttaagtgggcagggagtcttccaattgctccctttcccctactccttaaaaccaagaccccttcaaacttgtctcctaagggtctcaggaagcacatcctgcccaccttgcctttccagcctcatctgctgccccctcatttgcactctgctttggccatagtggctttctttcccttatgatgggtggctcatgcctataatcccagtgctttgggagtccaaagcgggaagattgcttgaggccaggaatttgagaccagctgtgcaacacagcaagacct

SEQ ID NO: 208897 - DNA, 350 bp, Homo sapiens
tcatggcggaagataaaggggagctgaaatgtataacgattacttggcaagaaaggaagaaagggggaaggaggaggtgctaggctcttttcaagaaccagttcttgagggaagtaagagcgagaactcactcacttcttggagtggcacaaagccattcatgagggatctgcccccaccagccaaacaccttccacaggccccacctccaacagtgagatcaaattccaacatgagactttgtggagcccaacaaactatatccaaaccatagcatgcatttttctggggagagggtctatcactttcatcaggatctcaaaatagttttggacactgttaattcaagg

SEQ ID NO: 208898 - DNA, 487 bp, Homo sapiens
cagaatgggcttaccaggaaggaatgagtggcacatgctacatcatgggtgaacctcaaaatcttgagatacgggaaggaagccagacacaagagatcacatattgtgtgattccttttccatgaaagatactgaaaaagcaaagaggcagaaagtagttgcttgaggctggggtgggcatagggaggcactgtgagtgccatgagggatcttagtgggggcataaaaatgtcttgaaacttatttttggtaatgactgcatcactcagtaaagttactaaaattcattgaattggatacctgaaatggatgagttttatgagacgtaaaatatgtatcaatgcaaatatgcctcaatatcttcatatttaagtgtacttttttgttacaaaaaagaatggggctcacagtagacatgggaacttacaagttttaaattgtagtacggttataagggaattgggaagtcttcgtcatgggagacgta

SEQ ID NO: 208899 - DNA, 443 bp, Homo sapiens
cagcattaggcagtattaaataaaatttggagataaaagctaatcagtgtgtataacaattactgatatcaaaatcaaggaataagaatcaaatagcacttcttactgttcatggacttcaaaagatttatatgaatttggtactattaaaacttcctctaaatttaaatatgaaacagatgggaataatacagttacatgagaaatattagtcatttctcagtgcttatgagctgggtccctttggtggacagtatttgtgcaaatgttttagtaactacatgactctgctctgttgtgagccatagttatcatatttttatttattctaaccagttaaattactatttactgaacacccactgcctcttgtactgaagtcattaaattctttgatacattttaaaaaagaaatagttgctttttctctgtttactaacttt

SEQ ID NO: 208900 - DNA, 376 bp, Homo sapiens
gtttatctccctctgtctccccgtggtagtaaacggagttccctgcagccagtcagaggcccacctgaggagggagtgcagcctctgccagtgttcttccctgtcaggagccagttaatggtcacccccaggcctcaggccatcaccatcgtgggtagttcctcatcctttctggacctggggtccctgggccacatggcacttgcatgtgctcacacacttgtatacacacatgcactcacacacacaggcaattcctcacaaacactctgactcaacaaagcgagttttaaagtggagttaacttcagagagaggtgaagatgatatcccaacattagaaggttttcctgtggatagatcaggcaccgtcttcc

SEQ ID NO: 208901 - DNA, 370 bp, Homo sapiens
aaggccactgacatggacgaggggcgtggctagggtggtgagagctgtcacagagaaaacagcctctcctaaacccagtcgcccaaccttccaaaccggcaggactcaaggcacttgcacgttttctccatctgggccagcggttttcaacccctcagctagagatgtctgctgattggacaatgtgatgagtgcttgtgatgcgccaggcactgtggtaagggctgcaggtattatacaaccagtgctctctgctctcagggaatatacagtctggtggagcaactcaggtgtaaatcaaataattacacatcaaagtacagcaaaaacagtgataagccctgggactgtatctgggcagagaggtggg

SEQ ID NO: 208902 - DNA, 417 bp, Homo sapiens
ttaggagcaactcaaaatttaaacaatgctttcactgtcttctccaagatgaaggtgtttgatactgttttcccaactgtggctatatatcctatttaaaagtatgacttatctacagtgcaaatgagagcaacttttacgtactggatgaaatattctgtgctggggttttgcaaataatccatgagttccctgatagcttctagctttaactcttatacagcattgtcttgggaagatgaaaggtcaaagggttggaagaatagagaacctgaaaatcattgagatattgagccctgtgtttcacaaaatagtgctaagaagctttatactatgttgccttaaagagaagaagccaatctatctctgaatttcttcctggagacagcttcgtaagttggtactttttgaaggacg

SEQ ID NO: 208903 - DNA, 389 bp, Homo sapiens
catatgtttctactgagagcatttcatggagaaaagctgcattagggaaacaagtaaatacagaccccaatgaagcaaaagtgcatttgttgtaaagttaaaagctaaaggtggaaaagagacaaagcatctacgtaatttacaccctaaacctgctgcatagagtaaccacttttaaaaatctctacttcttccaaaattcaaataatttaagcacttccctctaagggcaagcattaaggaagcagtaagaagaaacaacagtaaaggacaagggaaaaaaagaagaaaggaaaaagtcatcgtccttgtgctaggtatttgcatggaaaagatgacagacaaagctctctctcttaaaattaatgaaccatctcctcagatactta

SEQ ID NO: 208904 - DNA, 280 bp, Homo sapiens
ctccacccactacatgccagtagctccctacagttgcggcaaacaaaaatgtctcccggtgttgccaaatgtcatgtgagggacaaaatgccctcagttgagaaccactgtttaacattttcatgttttacgataggcagccgggcgtggtgtctcacgcctgtaatcccagcactttgggaggccgaggtagatggataatttgaggtcaggagtttgagaccagcctgaccaacatggtgaaacccagtctctactaaaaatacaaaaaaattagctg

SEQ ID NO: 208905 - DNA, 417 bp, Homo sapiens
aagaatgcacatactttagttattgatcattaaacagaaatatctaaaaggaaacaagaaggaatcggagactagtaccaggaaaagctattttaatactggaaaatgaaatgatacggctattttctaaaatttaaactgtaaaacaagacaaatcaaggtaaataacattttagaaaataaaagaatcattgatattaattgtggttttggtttcaaaggacttatctctgtttcacagtaatcaacttaaattttcatgttttacgataggcagccgggcgtggtgtctcacgcctgtaatcccagcactttgggaggccgaggtagatggataatttgaggtcaggagtttgagaccagcctgaccaacatggtgaaacccagtctctactaaaaatacaaaaaaattagctg

SEQ ID NO: 208906 - DNA, 910 bp, Homo sapiens
atctagtggaggtctcgtctgaaggtgaatgacagattggactcaagcccttttcagaaaccccttcaggatggttagaaggtccacaatcttcattcatgattctggaacccccaaagcattctggccataatacctgaactggcctgaactcaatgcaggcagaacccaactgggataccagtgcctttagccttcacttgtccctcctcacggagccctgcggatgttccactgcaggatagtcatatgctggacggcagactgaggcccaggccctgctggcgtccaatatggacgtatctcggatcagcgagagctgctcaggaaccacaccacggtaggtgcatgctgagcacctgctgggacagcccccggtgtgacactgtccacagcagctggaagcggtgactgtcggtgagttacagtggaggattccagggtcgggtttggctatggaattaattaagcaaagcacagataaacccattctctacttaaaaaactaaaatattacagattccatcaatggatgaatggataacaaaatgtggtccatttgtacaatggaatatgatttggccttcaacagaagggatctgacacctgctacagcatgggagaacctagaggacaccgtactctgtgcaataagccagctgccgagggaggaacaccttgacattccactcacgtcaggcactagaggagtcaaattcatagcaagtagagtgggggctgccaggacctgggatagaggaaggtgaaaaaattctagaaatggatggtggagatggctgcacaacatcgcgttgtggatgtggtcactgagttgtacaatttaaaatggttacagtggaaaattttatgttacgtgtattttaccacaattaaaagaaaatattacaga

SEQ ID NO: 208907 - DNA, 515 bp, Homo sapiens
ggaacagctccggtctacagctcccagcgtgagcgacgcagaagacgggtgatttctgcatttccatctgagatatactaaggagcttttgcaagtcaatgtgcaaaaagacactacaatgagtggagaatcaacagtgctctcagaactttgctctcagaaaacttaagttaccaggcactaagtggctactcaaaatgtggtttgtggaccagaagcatcacatctcctgggaactaggtaggcctaatggaatcaagagggccctttagagtggaagagggaatttgaagaaagaaccagagacatgtcagcatgagaaggactcagcctaatcttgctgcctttgaagttggaggaaggggcctatgaagctggaaaaggtgaggaaacagattttcccccggggcctccaggaagaaatgcacctgctggcaccttgatcttagccaagtaacctctacgtcagacttctgacctataaaactgtaaaataataaatgtgtgttgtttta

SEQ ID NO: 208908 - DNA, 317 bp, Homo sapiens
cagtgagccaagatcacgccattgcactcctgtttgggcgacaagagcaaaactcaactccatctcaaaaaaaaaaaaaaaaggaaaaggaaaaggcctactgccggacctggcacagcctggtcattcattacagaacaatagtcactccccatgaaccctctccgtgcagaggggatcgtcatggaaagtgctagaaacaggcagttgagttgaggagtgagggtgcaggggcttatctctgagcctgtttctccatttggaagttgggtgtaattgcctacaggaaatgttcactcatttaacaaataggtact

SEQ ID NO: 208909 - DNA, 449 bp, Homo sapiens
cccgttgcatccttaccatagtactgagcacacagcactggatttgtccctctccactagagcatgagtttgaggggagggactgggtcttctatcttatctttatatcccaagcaccccgctgggtgccaggtacattttaggggctcaagaaattcttgttgaatttgataaatttagaatagtccattgccagtggtgattccaatagagtcactgatgaatattaaacactgattgataaatttgtgattgataacagaacagtcaacctgaaggcaggggatattaatgaaatagactggttccaaaaaccattattatgatcatgactgttgttattctttttattcttctgagttttaggggatgaaacacaatatgagtatggccctgtcaatgcgattgatctggggcagagtgcttcctccgagttgagcccaggtgct

SEQ ID NO: 208910 - DNA, 288 bp, Homo sapiens
acctgcttgaaagctattaaaatattcctcccttttccaactacacttctgtgtgaggccagattttcattacgtactttagccaaaatgacaaagaacaagattgaatgcagaggcagatacaaatccagatgttttctattactaaagagacattaatgatactaaagagatttgggaaatgtaaaacaatgccactgttctcacagaagtattctttgttttggaaaatatagttactttccattaaaaattatattgttagttttaaataaacatattaaagat

SEQ ID NO: 208911 - DNA, 300 bp, Homo sapiens
gcttagttcaggcatacgctgacctgaatgggcatttaccctcagatgggtacacacctgtcaatatgtggactcttctgtcagacagacacagcttcactcatgtggattcttccctcaaacacaaatgtccccacatggactatttcctcagactgccacatatgtccttacatttacactttcctcagaaaacagacatttcctcatgtggactcttgtctcagataagcaaacatgtctcaatgtgaatgaagtcttcactcagataagtatacatatttcaacattgactgtttc

SEQ ID NO: 208912 - DNA, 253 bp, Homo sapiens
tcatgcaacccgcccaggtagtgattggatcttaggatctggctaaagagaggggaagtagtccagtacgtctcaaacttgggccaagggctacaggccagcttgccagtaaagtgctttgcattggagctttggacacaagttcaactgaaaataaagggttcatttcctttctaattgtctcttacgtgtgtatctccctcacacactcccagggtagaaaagtgactggcaagatagactaagcctttct

SEQ ID NO: 208913 - DNA, 557 bp, Homo sapiens
actacacatgctgcttacattgtatttctacaggatagcaccattctagatagtataataagccctgcttattgaatacgctcagtagaaagaaaccctggaatcctttcatttcaaacgatctcctgtcggccagccaactttcttcatttgcaggtgagattcttcatctgtaatgtagacaaaataaacccccctcacagactggtaaggactgagaacacaaagaaagcattttaagcgttcagcaacactaaatgtgttctcagtaaatgtcacttccctttctgtgggtgcattcagtagctggtttagtcatcttggggttagtcatggaacgtctggattccaaccctctttgttcctttttctccactctaatcacttccacagaattcaccataacttagagggcaggggtctgtggtgaactttctaagcaaaagctaccccttccccacagctgaattttttactcctaccacttgtcgaccatatccttcccacctcttctctgctggtgcattcattaataaattattaaaattaatctcaaa

SEQ ID NO: 208914 - DNA, 215 bp, Homo sapiens
aaaatttatattttggggatgtcaaagttgtccaaaaatggttttattgggcagtgaagaatgtagagtagatatattgcatcctaatcttagaagaaatggttggtttaatcctgtttgaatctaagaactttacagtttatattcaaaacactccatattatgtagtatgtagcagacattaaaaataaaatgttacttgaagtataacccca

SEQ ID NO: 208915 - DNA, 201 bp, Homo sapiens
cagtactttttattcagaaggtttctgcataaaggtgatagtcttttgacttaatatattattgtctcctgccttgtgtttctggaatgaatgaaggtcattatttagaggataatctgggttgtatttgtgtcgtcagattgaattttcattgcacatgctacttaatgtctttaccaaataataacaaagggaaagaaa

SEQ ID NO: 208916 - DNA, 530 bp, Homo sapiens
ctgcaaatgaaacccggggtttagtcctcatctctgacctgaaggcttgaatgttgagatctctttctgaccctgagagctccttcgtgttcttccagtaaatgtcccaagccctttctcaaaagtcctgtttttcttgctgatgaatagtaaattgatatgcatctattatttttatttacctattggtagttgcttagtatttttaggagcaaatatgatttacaaaaaaacatgagttctgatacaatttcttttaggatttgaataggaaaagtagttgttgttttcttctttttttttttttttttttttttttgagatgaggtctcactctgttgcccaggctggagtgcaactccagctcactgtagccttgaactcctgggctcaagtgatcctcctgcctcagccttccgagtagctagaactacaggcatgtgccactatgcctggctaatcttttattttttatttttgagatacaggatctccctatgttgcctgggctggtctttaactcctgggct

SEQ ID NO: 208917 - DNA, 819 bp, Homo sapiens
ccgatagtagatgggactacaggcgtctgccaccacgcccggctaattttttgtatttttagtagagacggggttttgctgtgttagccaggatggtctcgatctcctgacctcgtgattcgccggtctcggcctcctaaagtgctcagattgcaggtgtgagccaccgtgcccagcctaattttttgtatttttagtagagacgggttttcaccatgttagccaggatggtctcaatctcttgacctcgtgatctgcccgcctcagcctcccaaggtgctgggattacagatgtgggccaccatgcccagccctatggccctgatcttaatgaagtgttccccactgagtaagttgccagcattagggctgaagtatacagagtagcatgttcagaaaggagccatcagtttctgttttctggagtgtttttaccaagaatggaccaagactccttagataaacaatagcactagtgtccatacttactgacccaaacaccatttgccagtttataaaataataaattccagaaatattactgcctcaacattatgaaaatcagatttcctaaaaaagtacttagcagtgttgaaatatctagacactattcacgggtacttaatgaacaaggcacgtgctcagtagattgattgccgtcagacacacagtttttctcatttgggaaagttagttattcccacatcagccaaatacagcacagcatacagtggtcagtagatcatcagcttactcctggtctcctgttgtgaaacgctctcagatgaattgttcttgtgccatgacacaccaacgtgg

SEQ ID NO: 208918 - DNA, 113 bp, Homo sapiens
atggaacgagacacaaaggagtacatggagcgtggttccatttacgctgagtaaacaaaaccaaacttagggccaggctcggtggctcacacctgtaatcccctcactttggg

SEQ ID NO: 208919 - DNA, 262 bp, Homo sapiens
agactcaaagaatataaaagcccctaaatcaggaacgtatggttgccataacaacttggctacatttccatgaattttatggcagaaaaatgcctaacatgtctgatttacaactgcaaaaggaaccacggtgttcatttcctgaatattggtcatggcaaactttttgttttagttatttggatttgataggtatgttctctaattggctgtttcttgttacatgccttatgtaattaaagcaaaaattaatctttaaata

SEQ ID NO: 208920 - DNA, 329 bp, Homo sapiens
tcaacaaggaaaaatgaggggtcgctttaactagcctaaggtaagtcagcagaatggtacctttttcttgcttctctcagcaagtaagacaggtgtctccagtacctttaaagataacttttgagagaagcacttctaggccaaactttcagagaactgaaacagtggatatccaccatctgctagcttgtcacaggaagcaaagttttactactgccccagggaaggggccctcctactccaacaccctatcctgtataacaggtttggcatgcccttggcaacagggccctctgaaaattcaggaagcaggaccctgaggatggctc

SEQ ID NO: 208921 - DNA, 641 bp, Homo sapiens
ttccttagcagaacatcacctcttcattttaagatcaccatacctaagcagcaacgctatgggaaaggaatcatagcccatgccaccccacaatgccagataaaccaagtgaaattcaagtttcagtcttccaaccgagtttggaaaaaagaccggactaccattattgggaagttctgcactgcccttttgcctgtcaatgacagagaaaagatggtctgcttacctgaaccagtgaacttacaagcaagtgtgactgtttcctgtgacctgaagatagcctgtgtgtagtttaacctgggcaggacacatctccctgcattttttttttttttttgagagagaggtgtgatgagggatgtgtgtgtgcagcttattgtagaccattactactaaggagaaaagcaaagctctttcttattttcctcataatcagctaccctggaggggagggagaactcattttacagaacttggtttcctttgccgatcttatgtacatacccattttagctttcccatgcatacttaactgcacttgctttatctccttgggcattcgtacttaggattcaatagaaacatgtacagggtaaacaattttttaaaaataaaacttcatggagtatctgaaaaaaaaa

SEQ ID NO: 208922 - DNA, 112 bp, Homo sapiens
gaggtcaaaatcagcaacaagttctacaatccagtgctgatatcagatacaagcttcaaggacgaatttctttttgaaggcttattccagtttcatgaggctagcatggggt

SEQ ID NO: 208923 - DNA, 351 bp, Homo sapiens
tcaaagaaatccagggacttgtggaaggagagaaaccaatggagaggattccttcagaaaggagcaagggggatcaacagggctgactgttgcggaagatgagttcactgaagactgaaaaatgcctatggttaaacttaacatagaggtctctggtgatcttggtgaagtgagatttggtggaataacatgcccagaagccagctggagtggaatgaggaatgagtaggaggtgaggaaatggagcagtgagtgtggataactattctctctttgcagatcacagtgtggtgagggtgaaagaacatttaaataaaaacagagacctcagttctgacctgcaaggtcagt

SEQ ID NO: 208924 - DNA, 313 bp, Homo sapiens
tcatattgtcttctgtgttatctcagtgataaagctcattttgacagtgtttgagattacccatgttaaatcatcatggcttagtggttaagatctaggctttgtaattagacatactgaagttgctgtctcctccctgtcaatgaacagagtttgacaatggaacattagatatctttctagacccagctttcccaactttatggtaaggacaacttcatagaactattatcagtggtagagacaggttttgagcccatgttctctggttctaagactcattctattgatggatatgttagaggttcaaggt

SEQ ID NO: 208925 - DNA, 543 bp, Homo sapiens
ccagcaaggacactcagtcctttcactgcaagcaatcaaattctgccaacaacctgcatgtgcaaggaactggatccctcaagcttcttgcaaggaacatagcccttgcaaacaccttgattttagccctgttgagacccatatcagatgtctgacccaccaaactgtaaaataacaaatatatgtaaaaacaataaatttttgtcattaaagccactgtggtaacttgttaaggcagcattaggaaactaaagcaggtaatagggaattaaaggacagaaatatttttggactttaattgaactattggcaattccatatttactgtaacaccttaatacagtattttatgttgaaaactgcttcttaatttttttttttcttttctttgggtcagggtctcactctgttgcccaggcttgaatgcagtggcacgatctcggatctctgcagccttgacatcctaggcttaggtgatcctcccaacctcagcctcccaagtagctaggaccacaggtgtgcaccaccacgcccagatagttt

SEQ ID NO: 208926 - DNA, 281 bp, Homo sapiens
tgatgtccccttcacaagaacaagctctcctcaaagaaagcctttaaataactgggcgtttctgtccaggtagtacctatgataactgaaggaaccaatgcaggttagttttcctcagtgtctgggtatggtaagcagaataacagctcccagagatgtccacatactggtatctgtgaatgtattacattacagagcagaaggtaattaagctcacaggtggaattaagtttgccaactagctaatctttttttttttttttgagatggagtttcgctct

SEQ ID NO: 208927 - DNA, 452 bp, Homo sapiens
caacggggatgagttgcatgaacattacgtgaagcactactcagcaggtaaaaggaaaggagccatcaagacacacaacaacggggatgaattgcaagaacattatgctgagccactctcaaaaagatacaagcggccgggcgcggtggctcacgcctgtaatcccaggactctgggaggccagagcgggtggatcacaaggtcgggagttcgagaccagcgtggccaatgtggtgaaaccctgtctctactaaagatacaaaaaattagccgggcatagtggcacatgcctgtaatcccagttagtcaggaggctgaggcaggagaatcgcttgaacccaggaggtggaggttgcagtgagccgagatcgcaccacggcacttccagcctgggcgactgggtgagagtccatctcaaaaacaaacaacaacagaaaaaaacagctgggcat

SEQ ID NO: 208928 - DNA, 309 bp, Homo sapiens
tgcaagaagagctaatttagagtgggagctctgcaaggctctctgggttgcagagaccttagtaaagactaaaagttagctaaagaaagatcttccctagtagagaagcagcatgctcagaggcctgcataggataggaaggacctgaaaggcagtctgcgcagctggaggaggtgggtgaggtcagggagctctggggccttgtagccttgctttgggattgggctttgctccctaatgcagtggaaacccgttaggagttgtctgttggttggccgggcacggtggctcacgcctatgatctcagca

SEQ ID NO: 208929 - DNA, 507 bp, Homo sapiens
aatgccatatcacaggagctgtgttcttcactgcttattactaaagtataagttgactgctgaagccggcagggggccaggaaaaggaaattcaccatttgggggctctggggagtgaggggcaggaagccaagcagacacatgctgttgaatttcaggatcccaagtggactcttgggattttggaaaacttcagatgggccaaatgtggactggtcctagaacattcccgggcaaattaagccgatggaggggataaagccctacccaagcctgagctcaggtccatttacatccagaggctgtgggggatctgaccaggctgatggcaccctctgcatggacagcacccggctctgagcaaagaaccacagaccctgctggaggccacctgggacttctggtttgaaaccagagggcagaagtttaaataaacagctgataccacaggtgagacccagctgccaatttccagaagtcaccattagagcgcgcggcgcggccggg

SEQ ID NO: 208930 - DNA, 552 bp, Homo sapiens
gctttttttttgataaatagaccacttattttcattttatgtactgtcagtttttaaattgtaaatatgtcatttacgtattctttatcatttaacatttttcattcacatactgtcaagcaacctcagttttcaaaagtttaatgtgcaaattattgtgaaagtgaataaatttgtgagtaattcctacagggtgaaataactatgatttaagaaagaaaatttcctagctgtctaaaataggtataattttaagtaaaaccaggttattgaacatgatgctttctacttgagacaaaatgagagaagagagcaagtgtgatcagattaggcattcatgtttgtgtcgactgtgccagcacagaattacatgtaaattagatgttaagagccaaactggccgtttagaatgtcccaaagggaagacactcctcttgctaccaggctggctgaggatctgaaagggtggcttcaggaggttgatagaagtggacaacaaccaagaaaacgtggatatagaaaggccaagaaggaaaaaccagaatgtaagat

SEQ ID NO: 208931 - DNA, 159 bp, Homo sapiens
cctgcccttgccttccactcaccccgtcactctccttctcattactgtgtccaggctcaaagcagcagctctctgggaaggcccccgttctccagtttctcccacttttgcatccattccacatgcaccatcgttcatgttcccatcacctggagagac

SEQ ID NO: 208932 - DNA, 570 bp, Homo sapiens
gtggttgggaaactcatttactgggtccaccaaaggaaacccaattctgccatgtttttgcaaatactacacgtccctttgctctcaatagcaaaagtgatgttatagttttttttacttttgtcagaatcaaggcttcggccacctgtgcaatattttcccatggaatgcagcagtaaatccaagtaggtatatccgtgctcagagagaattctccatagttctgactcctgaaaaacaagtctcattagctctcatctagtttgatgactaaaagtgcacagcagttataccccagtggaagtgatttttctcacctagctgctctctaactcttacggctatctagttgtctgagctgctggtttgttttacttattctccaactgaactcattccaaaccaagaaaaaggaccaaatgaaattttcagttattatcatacttgctccttgaataagaatgctagagtctggaggcagaagaagactaagttaaaaaaaaaacagcctgaaggaattctggagtgagttttgtaagtctaattgtcaaagaagataaatggtctcag

SEQ ID NO: 208933 - DNA, 396 bp, Homo sapiens
ggcctctggttgaatcttgggattatttaagaaaaaaaaaacctggggaatttaactttctccttcatgttttctgtgttcaattcatatttgaaagcaaagacagagttcatatttttgcatttaggacccactgtgcaatatgtaaaatttgcttttaatagtcttttgccacattttcagtcattaccattctccagactcacgctcagtgcttctctggctgttgtaaagatttcccatgctgacatgacagcataacaaacagttgcagcccagaataaagccctggaacccaggtatgtgcagagaaggagagaacccctggggacgcagtgtccattctaaatctggtgtttcaacccctgatgaatctttcttttccagaggaacaaa

SEQ ID NO: 208934 - DNA, 357 bp, Homo sapiens
aaaaaaaaaaaaaaaaaaacagaatcaaaatggccccaaacttctcagcagcaatgatggacactgcttagaagtctatactgataaatcaagcatgagggtagaaaaaggacaatttcaggcttacgaagtctcaaaaaattactttccataaattactggaggacatgcttcaacaaaaagtgagcataagccaggaaatagaaactctgggaatacagaaaacaggggctacacaaagatgagagaagggactccttaggttgatgacaaagagaaattgatggacaatagctgtgtagcctccatccagattggagtgagtctgggggaagagggggagttctgaggcaaaaa

SEQ ID NO: 208935 - DNA, 430 bp, Homo sapiens
cagttgtaaaatgtcagactgtcacttacaatataaaaaaccaaaaatgatggtatttgtaaaaatgttatcacctcataaaaacaaattgtaaagacatgaaagtgatcttgctatgctggtctttcagaagtgagttagtacagctactttaaataccagttgtgtagattcccacacttttctaccaatggagaggtttacacaagcataatttaagttacaattacactaattaacatctcatttgcataaattgttgaagtcaaaacaacaaagaattgtctaagaagcttaatcctatttgtccaaaatagaaagattttttttttaaaaaaaaaactatgctctaaaaattggcagcttaagtatgtctttagtatgttgagctgtgtccttttaaaaataaatgttttcaattttcttaata

SEQ ID NO: 208936 - DNA, 487 bp, Homo sapiens
tcaggctcaagagatcctctcgcctcagcttcctgagtagctgggactacaggtgcatgccaccacacctggctctattttttatttttggaagagatggggtttcaccatgttgcctaggctggtctccaacttctgggctcaggtgatcttcctgcctcagcctcccaaaatgctaggattataggcatgggccactgtgcccggccaatcataaaggttttgataaaggcaagcagagactaaggtatcattgggagggggagggggcaaccaagagaaagggagagagggagaaagacaaagcagtgtaaggtttgacagaaactacttcacagttttgcaatgcaccagttatatttacacactagttctgcacaccagacaaattactctctttaagcactgtagttatgcttgccctaccccaaaactagactgaacacttctttgaataatactatagggtcagcagagggtgaatgga

SEQ ID NO: 208937 - DNA, 219 bp, Homo sapiens
atggatcacaaatgcatagaaccaacctgctctgttgtgtctttccagcatgctcagctgcaactctcatttacctctctacctattgcattcaaccttgtgtcccaccattccaccaaagaagcccttattaaagttgatctgggccaggcgtggtggctcatgcctgtaatcccaacactttgggtgggcgaggcagaaggattgcttgagcctagg

SEQ ID NO: 208938 - DNA, 156 bp, Homo sapiens
aagtgaattgattgcaaacatgctgttgatataaccatagaatactggatatccatgggagagcttataaatgctactggacatttgtacacaactgtgtgtatatgtgtctgtgtgtgtgtctgtgtgtgtgtgtgatgaggagtggggggagaa

SEQ ID NO: 208939 - DNA, 490 bp, Homo sapiens
ctctttagagtcactgccctagagctatacttgctttgaccaaatttcttcagtcacatctctcaccttggaaaccaagaaaaatgttaacactgaaattcccgagagtttaaaacaaacataaggctttctgtaattgaagcaaaaacacattgtacatttgtctaggatttattcaccattttaatcaggcactaaaagtctaagtttgagaaagtttgtctgtcttgacctggagttaaaactgggttgacctgaaaaaggaactgttttgttcctttttcaaagcacggtgtggagagagctattgcctggttagaagcagctgtgagatctttggtaaatggggaaggagaggtcctaaggaacaagcaggaaaatggtcccttatggtttttcaagtcatttggtatgaaatacccttgaccttatttatacgttgtgaatgaatggttctgaacttgaaatatgtattcgtgaggaaggaaaa

SEQ ID NO: 208940 - DNA, 837 bp, Homo sapiens
gggtagacaccatctaatcagctaccagcaaggctagaataaaacaggcaggagaagatggaagagcagacttgctgagacttctggccttcatctttctcctgtgctaggtgcttcctgccctcgaacatcagactccaagttcttcagctttcaaaatcttggacttatattggtaatttgccagagacccttgggcctttggccacagactgaaggctgcactgttggcttccctattcttgaggttttgggactcgcactgatccaccactggcttccttggctcctcaacttgcagccggcctatcatgggacttacctagtgatcatatactcaatctctaggaaacccaattgacaagtttctggcaattcaacaccatgtagtatcgcacgtcagaaatcggaatgctgtgacctctgagataattcacccaccggagtcagactgctgaagaacactggatgggtggaaaaggaacatctcaaccaggagagaaggaactgagtcaagaaagggctgcatctggtgaatatgtccctcccagtgatggaacccagggctgctgcagccaagagtctataacagtggagacgccttgagcaaagccccagagcccttgagctgcctgttcccctcctctgacatgatgggtaatctgatggaagcgctgagaggcactgcctagaattaagccctatgtgtaaacgaagcaaggaagaaagaacatgtgctatcaaatatgattcatgattcaaatatattttaatatcttattcttttcacactctgagaaactattctgataatgtgattgttttgtaaaggagtgt

SEQ ID NO: 208941 - DNA, 317 bp, Homo sapiens
atgtgtcataaagatcagtgctctctcagcctccatccatggcagacatgcctaatggattacaatactccttcccgctaaaccagtactccacaacccagtgccactaatcaatagaaactgctgtgcaagtttaaacttatttcaatccctaacctaaaccattccaataagcagtagtagtgtgtttccaacaaatgtgacactttttgttccattttagtcaaaacttgttaaactaaggatatgaaatatgaactcctatcaattagattactgatgactaatgtcagtgcttgggttttaatgaccaaact

SEQ ID NO: 208942 - DNA, 353 bp, Homo sapiens
cagaaagggatactgctgtttcttagcaggttgctcaataggagaggccctgaccctctccagaagtaagctcacccaaccacccagccaccctttcccatttgcagaggcatttaggaaactccccagctgaatctacagaggcacaaattttaagtaatttgactgactttaaaaatctgaaaattggaaaatagtttgccagtttcttacgaacacttaaccatatgacccctaaggcccacaaggtgtcttgtacatacatgtgtgttgcagtattattattaatagccccaaactggacacagcccaaatgttcaccaacaggtggatcataaaaacaaattatagtt

SEQ ID NO: 208943 - DNA, 742 bp, Homo sapiens
  misc_feature (529)..(529): n is a, c, g, or t
  misc_feature (608)..(608): n is a, c, g, or t
tctctaaaaaaaaataataataaatttaaataatttaaaataatatacataaactttttaagcggtcatctgatcttctgatgtaactcattttgcgtaattaataatcatgtccagtaagtagccagtgctccttttaaaatctgtcagactctgtcactcctctgttcataaacctacaatggtttcctagcacacttagaataaaatccaaagtcctaattttcaacatttacaaggccctacatgatctgacccttccctccctcttccaacttactctccgcattcttctctcttaccacactccagcccacactgcgattctgagcacatcaagaaagcccctacctcagggctgttgcatctattattcattcattcctttgagatgctgagtttggtgagagatttctagtgaaagaagagggcccataaatatagactgcatgtgtgtgcgtgcgtgtgtgtgtgtgtgtgtgtgtataatcttttcaaaattgaaacttattttgggtatgtttttctnttattgcttctgtagaacctactgggttggtgacatttacaagacagagtcttgaagattttccagaatgggaaaggtnacaacaataataaaaataatcctagaccccctagaaatagaaggactcttgcaccatgagaggattctattttatagcacctagaaaagatggttttacaacctctatttatcctagtgccagggaatttcttc

SEQ ID NO: 208944 - DNA, 514 bp, Homo sapiens
tctaattgccaattttactgaatataaaatgtatttactttctcttcctcgtggcttccctgggaataatactcaaaaagccagtgaaaacacttcagtacagaggaggcttccaggtaggtcctttctgggccttttctcaaggaattttattgcaaaagcatccgaatgtcctcattatagggtgaggtgacctcttcgggttccctgaattactgatccatggacagctttaaagcaagcaataaaatacgtacagtcatccttccatacctgtgagggattgattctaggacctcccacagatatcaaaatctgtggatgcccaagttcctcatataaaattgcatagtatttgcatataacctatgcacatctcttgtatactttaatctctagattacttacaataattactatagtgtaagtggtgtataaatagttgctatactgcattgtttagagaataacaataagggggaaaagtctgtacatacttagtacagacacaatt

SEQ ID NO: 208945 - DNA, 590 bp, Homo sapiens
ctttcattcaactcttcaggggtcaaagatttctaccctgttggaagaagccactgttgaagtgtgaaaggctactctgctttctgcgtccatttaacctttggcctgccctaaagagccagccaagtgtcaatcagggctgattgggcacctgtgcctggaaacaagacagagaaatttagctcttccaggtcatcaaaccatctccagatggcaaagaacttctgaagttatgaacctaacttgcttgtgatgcaaattagtgacctagggtgagatgcttcattaatgcttactcctgtgagcctccaaggtgtcagaagttggactgcttactctcacattttttttttgctgtgtaatgtgcattaaaataatttatattcatagagatggtccaataaattgcatatggctagttaataagctgctaaagcagagaagaaaattagatttcatttagaagaaaacaatatttggctttccccatggaaatatgtgaaaaagctttagaaaattctgttaacattgaggtctcagaagagactgtgattaaaaataataaaaagaaaaaaatatgaatttctatc

SEQ ID NO: 208946 - DNA, 500 bp, Homo sapiens
gagggcattatgattttaaacggatttgtgctttatgttgtacactagggttttttttaacccatttattggaatattagtatgtctagatttttttattagaaagaaactgaaaaacttttctgctttccctgttttgtatgtgttcattcatttttccagtgtttaaccaagatggactatattacctttcaaaacaatgcaaaatttgagcctgaagcaaagctcctcttattgccctctctttgtcgtcattggtcctcccataaaagtgtttattttgacttttgatacttaatttttcaggtgttactaaaataatctttacagtcttgtttatgtctgccaaatgacagtaaagcaaaaaaatcaattaattcataattttttaatgaaagatttctgtgtacaaattcagaagcatatagtatattttacaaaggttgaaatcatttaagtaaaattatttgtctggccgttctaaattccatatttttaaa

SEQ ID NO: 208947 - DNA, 360 bp, Homo sapiens
tttttatgttccatcaaatctcctctgctgtaattctggcccatttattctgatattaagtgaagatgagcccaagttttccatctgcagttaactattttatgcatcattttgtaacattgagcttctgatccactcaaacatgaactagtcggtacttaaaattgagccctttaaaagctgggcatgttgatgcacgcctgtaatcccagcattttgggaggctgaggcaggcggatcgcttgagctcaaacatcctaacacctgtagaacaacacagatgtctgctgccacatgcagtgatttcaaaagttcaagaccagcctgggcaacatggtaaaaccctgtttttaaaaaaaa

SEQ ID NO: 208948 - DNA, 450 bp, Homo sapiens
gcttaacatttttattaagttcaatttcctgtttttggtgtcatctaaaaactggttaaactaaggtcatgaagattttctgttttccttgaaaagtttagtattttagttattacatttaggtctatgattattttgagttaatttttgtatatggtatgaagtaaggatttaaattcatattctgtatgtgaatatccgattgtctaattactatttttattttatttttactttttgtggagatgaggtcttactatgttgcccaggctggtctcaaattcctggcctcaagcaatcctcctgccttggcctcccaaggtgctgggattacaggtgtgagccactatgtccaacctcagcaccattcttgaaaggcaatcctttcctcagtgaattgccttggtgttctttaatcaacaataaattgacaatacctgtaagagttta

SEQ ID NO: 208949 - DNA, 359 bp, Homo sapiens
ttatgttatatatataaattatgtaaataagttattttataccaaaaaagtacgtattttccagtgcaacttaattaattggtattctgatttatacatcaatctaagatgactttgttaatatgagtccacaagaggctatctagatacgtgggttaaattgagtttctacacctgctaagctgagagccaaactgtggtgcttggagacgcattaaaggcacaatcactcttggcagtgcttctgggtgctcagcaggcatctcaccctaagaactctaggccattctgattcatttcagtagtagggagcaagttttttttttttttttttgagatggagtctcactctgttgcca

SEQ ID NO: 208950 - DNA, 632 bp, Homo sapiens
tagaggcgagaggactggcttctccttcactctgtaaatctttggaagacatttctgcctggggctttgtcaccctgaccataggtcagagaaacgtattgtttcatattaaataggtgagttaggaaacaaagtgttgggaaggtaatctacagctctacaggtccctctgttcagagtggggtagtgttatccagagcaaatctatgggatcagacacactgaagactaaagcaaaacaccaaacccactcattcccaagggcatccaattctcacatgccatggaaaaaggatgattcagaacaggactgccaagtagggcaattacatacgcatttaaggcgctagtttctggagctgatgaaagtgttcatcccagaagccgtaagtctcctaagggattgggtggtgtttgcaaagtcacattacttttatggcatcttaggctgaatgactcatgtatcaggcacgatgacttctccgacagggctgccaaacaaccttgtctaggcaaatggcaatgtagaaatacagagaactgatggagccaaatggcaatggagggaaggtgggaccaccaagaccattcctccaagccaaacttatgccaccaggtcagtggtcatctgt

SEQ ID NO: 208951 - DNA, 314 bp, Homo sapiens
actgtggggccccgccgaggtgaccggccagaaaggagtgcagaactccggccagggcgggctcagagcctgcacccacgcctcctgcctgggccgccctgtgaatgggggagaagggcttcctgtgcctcagaaactggaggccaagaagcacatgatggacgggtgggccgaatgaggccaagctctgccttctacagcctttccaggacttttttcttggaaaatgtggagcttgattggatgcctttgtagtggagcttccatcaagttagagctgcttgtgtggcagtgtccatccgggagtcagtaga

SEQ ID NO: 208952 - DNA, 291 bp, Homo sapiens
atcacctgtgcggcgagcacactcaacgataaatgatcacttaaaaaatctggaagccagtctcagtattattcttatttaattcagggaaagagacacaaataggtcccaataatctcccaaagatttttttttctcaagaatagatcatttactcccataaacgagagattcctgaatgcttttttgtctaagcacacacttaaaatatttgctctgtacctcttctcccaagaacagagtctaagcagaattgatatggaaatatcttaatccagctattagtccaga

SEQ ID NO: 208953 - DNA, 643 bp, Homo sapiens
ctttattttattcttggttttcattttattctggtctcagggccatacatttattttagtttaattaattattattttgacaacattactcgggtgatatctatataatggtagataaccaatcagttagcttaattaatctaaactatttgaattcagggaaatattagtcaaatctgctgtttgactaaatacaattcaaagcaatatatttgtgactgggaatatagaacacaaggaaacaaatgcgtagcccatctgcagtatgcattcttccattttacaaccactaaccattgaggctgatacaattttcaagcaagaagcattgcttcccaaaggtaaaataatcagaaatatttctatagtaaattgaatttttaattggcaatactgcttatttttttctagcaaagacaatttatttcagtaaccttaaataggaaaagtactcaaaaattaaagttgattttttggctttttgtagtctctctagaggtcttctagaaaattaccactgttggattttaatctgcttccattaaccaatcttacagagatgataaatggattaatactgaccaactataaattgactgcaaataataagccacataaaagctgaagtaggaaaactactcca

SEQ ID NO: 208954 - DNA, 481 bp, Homo sapiens
ggccaatatagggacaccctgtgtctattaaaaatacaaaaattttctgggtgtggtggtaggcgcctgtaatcccagctgttagggaggctgaggaaggagaatcactgcaggaggtggaggttgcagtaaattgagattgggccactgcactccagcctgggtgacagagtgagtctccatctcaaaaaactaaataaataaaataaaaatattttcaatctgcggttggttgaatacatgcaaatactgaaaccgaacctgcagatatggaggaatggctttacccattttgtgtatgtaccatagtttattcagctgtgcttggacatttaggtaatttctaataattacaggttataaataatcttcgatgaataaccttgtgcatatatatttttaaatagttggagctgtgtcttcacggtaaatttctagaaatgggattcctgggtaaaagagtgaatatatatgtagtttt

SEQ ID NO: 208955 - DNA, 799 bp, Homo sapiens
tgttgtctaagctggtatcgaactcttgggcttaagtgatcgttccacctcagccttccaaaatgcaaggtttacaggcatgagccactgcacccagaaagaaaatttattattgatacataacactatgtaacctacagaccttatttaaatcttaaaattatcccaataatatatttattgtttttctgctctagagtccaaagattacacattgcatttagactcctttaatctgagttgctacctctgtttttaatgaccttgatatttttgagattattttgtagaatgtctcttaatttggatttgcctgaggtttccttacaattggatttaaattacacatttttttcccatgaggactctgtaagtggtgtgcagcacgtgaggaaacgaggtatgtttgtacctttataggtgatgttaacttggaacacttgattggggagggcggtgctgggtttttccactgcgaaattactatttttttctttgtaattaataattacaaaggcaactcctggggagacactttctgactctaaatagcttgtttttcagtaaattttcctccactagtttaagcattctgtaagtctggtctaaatcagtaattgctctgatggtgcgaaagtgtgatatattcaactttcatcattcctccaacacttgttagattgttgttctactctaaggaagtttcccttctgtcctgtttgcccatcatgtatttttaaataaattggagcacatctttactctgacacaatacagtgttccaagctcatcttgtacc

SEQ ID NO: 208956 - DNA, 1191 bp, Homo sapiens
ctggatgacaaaacaagactctgtctaaaaaatatataaataaataaaagaaagaaaattcatagtagagagaaaccttacaaatgtgtagaatgtggcaaaactcgttttaactaatgctcacatcttattgcatagaaaagcatttatacctgaaaaaaggtatacaaatttaaaaaatgtggaaaagccattaaaatctgttcacatcttaacaacagagagttgatacttaataagagcattgtaagtgcaattactgtcaaacaatcttgtagaaaatatcatcctttaaagtgaatgagactagtctgaggaaaaacattacaaatgtaaagagggttatagtgcatttacttgtatcacagatcttgttgtacacattttatactagaggaaaaccctgaagcagttgcaccaactttgttcaacatcagaaatttatattggagaaaaatccagcaagtgtaataaatttggaaaaacttttttttccccaaaaactatacctcaggaaacaatggagagtttatattaacatatatttttgcatatggccatatgtataaaaatatttaattcaaaattgaatttaaaaagtctacataaatatcatacatagatatgtatgatattgaatacatgtattaaatacatagaatatgatatttaatacatagaaaagtctacatgaatatcagaatttacagtagaaacaactaagacacaaacacttgagacattacactaaagtgctgagtatagaaaataaaactaaagttgttaaattatttgtatataacttttaaaagagtggaagatattttgcaaagttatattcaaagtgtactttttatttatttttttgagatggagtctcactttgttgcctacgttggagttcagtggcacaatttcagcttgctgccaacttcgacctttgggttcagggtacgagctcgaaaatcctcctgagtagctgggaatacaggcatacaccagcatgtctggtattattggatttaggcaagatgggattcccccctttgcccgggggtcccaaactttcctcaagtgtttgcccctggccccaatggggatgggctagcctggccccccagtgtttaatttttttttctccgcaggtttataagaaaaagggcggccacacggaagggatgggcaacacgg

SEQ ID NO: 208957 - DNA, 305 bp, Homo sapiens
tttgggagcaaatgcatataatcaaactcccagatcctcagaatagaattttataaatgtatttcttcatgtcaaattcaagtactataaatgaaaatagtaagagagataataaatgtagcatggaaaatagactaacaaatttaccaatttgtagaaatgtgtaacccaggacccagtttcatttcatataatattcaaaaagcaggatccggaactatagtgagctctttaaacatatggcaatcaataagacttgaatgatggtattatctcagtaggagactctaaggctctaatgtaaa

SEQ ID NO: 208958 - DNA, 705 bp, Homo sapiens
  misc_feature (612)..(612): n is a, c, g, or t
  misc_feature (652)..(652): n is a, c, g, or t
ggattcatggggggagcccatctggagcttgtcaggggagcgagcgcggggacctggactgggctgagcatggagtgaggaggacgagagcagagagacccccgggagcttcatcaggcctggcagctgactgcatgtggggtgaaaaaaggaagccacaggacagcgcacaagggtatggtgtggagatggaggtggagatggcacagcaggccacacagagaagaaacctacagggaggtagctgggtttgaggtgcttgaggggcagatgggtggtctgatgggcaggtagacagaagggtctgcagccggggaggagactgagatacatgagaccatccagggagaggggacccagggggaagagcaaaggaccggatcctgggaactggacagttgtgatttggccaagacagaaaagcctgtgaaagagaccaaaaaaacccaagtgcagtgtgaggagaggcccgcagagaagagtcttggaagctgaggggaggtgacctcagcagcacagtggacagcggtgccagtgacttgggaaggtcagaaaacagaagatggaaagtgggtttggaaaccagggagacctggggagagcaggttgggnattgtttgattgggggggggtaccccgagccttcgaaaanttccgtaaatcatggggtcattaaggcttggttttccccttggtgttgaaaaa

SEQ ID NO: 208959 - DNA, 514 bp, Homo sapiens
gcgcctggccagtaccctactttttaatacattcgaatcggcagtggagtagcaacttgtgagaatccgacatatacttttccaatgtcattaatgttttgagccgttgatggatgctcacacactttcagatgatactttctcaggtctggttctagcagagtataagaaacatgccatagagaagagacaatttctaagtatatttcaggtactgagctatgtaaaaaatggctgtaggaagttaatttaggactggcaacgcaggctttttcatattattgaatgaatgaaattgaaatatatatatgaagagttttgatggtaacaatttaaaactgaaaccggaaacattttaagtggtatgtatttaataaacattcttcattttttaatttcccataacagcatttaaaactgttttaacaaaagaagtcttaaaacatattatatattggggggaaattgctctttcgggaatttctgcaagtggaagcactttgaggatggtttt

SEQ ID NO: 208960 - DNA, 381 bp, Homo sapiens
tgcctgtgtcgctatcaacgtaggtctctactttttttgttcccccccaatggctttaatctcattttaatgaggtctccagagggagaaaagataaacttgtgtattatcaatcttgtttccctaatctgcttcctaaagatcctagaattttgctatagttgacaccacggatcccctttcaggcccaagacagtggagactgtgctagacaaggaccagatgcccatggtgaagctgctgctctgctcagcaagctgggaagcacccaacgtggcacacaaggaatgctggggaaatctggcccaagagctctcctaaaggtttactcaggcactagtgtaggctcacctttaggtctggaccatccggaaacggtgg

SEQ ID NO: 208961 - DNA, 314 bp, Homo sapiens
cagggtttggtaagcagcgggtaatgaactccttcccaggctaaggcaggattgttggcaattcccagaaaaggtgctcttgtcatctctggggctgtcatttgctatccaccatacttgtcttgttagacaagagcagctaggcctcaggatctatgcactggagctgaatgccaatgctacaggttagctagagagcagctacttctgacagcaaacactggagtgagagccaaaagtttgttaccaatttgtaactccctttggttacatgcaaggaaataacagtttttatcttccctgacttttgagtt

SEQ ID NO: 208962 - DNA, 342 bp, Homo sapiens
aagccattattctgcctcctataccgtgtaccataaaggaactttcctaggtttcctgtctgtcctcaacctttccagtaagcattcggtagaagcccaaggggaaaagctggcaattacagaccactcctgtgtctggggctcccaggtattctaaactgtcacattaaactacactcaacctttgtaagaatttgttaaaatttcagccattttcttgttacctactgaaatgccagagaactcttctggagttctgccacagatgaaataaattcatgtctcctatttggaaaggcttgtaatttttttttttttttttgatatggagtctcgctctgt

SEQ ID NO: 208963 - DNA, 412 bp, Homo sapiens
atagacgtggggctttgggtgttatcaatcagatgaattcttggggactgtggatatagcttgccacagtatcttatcagttaattgcattcttggatgtgctgggagtcagcttgcacaagttaagtccttgaggaaggggctgccagtgaaagagccaagatggagtctgtctggctctcttagctaagggagagtctaaaaacagagttagtaaaaaccagtttgggcattacaagtgtcccaattcagtcaggctttcttctttcgttccataaagtaccaaatgcctaccatgtgccagtcccagtgctaggctctgaaaataccgcatgaccgaggtagacctggttacttcctgtctggagagtacagggtagcaagggaatcagacattaaacacaagcatgca

SEQ ID NO: 208964 - DNA, 638 bp, Homo sapiens
caactttgtttcatgaagtgaagaatgtatagaacacaaactattttttataaccaccttcattggcaaaataattgctgaaaaattcctacagattccagcaagcatttgttaataataatttgttgctttgtgttgatgtataatctggctttcactgatattttagtaaggactctgcacaggataagtatggatagctagctagaagctattctcactcttctcttcagcatggtgacttgaatttccatggtatagtttcaacattgtcatttggtttcctcattatctttggcttttccaagagcatgctacctatattataaactgaaccttattttatgttctatagctccatagcttgtttctgcttcattcaacctgatttcatgctaaacatgaaagtagctataaaattcctactttaaagtgttaattgaaagattatgaagaaaagaacagggttttagtaaagactatatttaactgatggtaaagactatcatgaccaaatttatttggcaaatgtttgccactaatgttgacaggtaatgtaaatggctcatactataataatctgctttctttttttgtcttcttccaggttctggatgaagccttccaccattttaaag

SEQ ID NO: 208965 - DNA, 84 bp, Homo sapiens
aaaatcattgtagtgacacactccaaagtggtttactgtctttggaatgcacagttttgcccaatattattcagcaagaaggat

SEQ ID NO: 208966 - DNA, 453 bp, Homo sapiens
taaaatgttcttgtctcttcaactgtcatccccaaatcagcacgagcatgtctggtgctcacatttcccccatctttggttgagtgtgtgtttttgtgtgtctgttattgtttccctccccacccccctttaatcagaagaacactatcagagactccaacacattcagctgggtctgaactgactgtacccattaggaattcttaaagtgcagatcgactctccaaaatgactttttacagatgcaaaactgacttcatgggttgcctcacccccactccatctcccgacgtgtatggtttttcatcgctgttccaatttaaatttctcagtctaccactcaaaagagatgatttttttctaatatccatcctgcaaactccatctgggatcccccaaacaagctgtgttcttctgtttctctcacaggcaggaattataaaaagtctgcaa

SEQ ID NO: 208967 - DNA, 876 bp, Homo sapiens
ttgctagtacgaggctgcggttaatcggccgaggcagtgtttcagttcgaggagagcagcggccaacagaaccaagtggcagtggacgcaccctcagagcatggggtctattctttccagttcaacaagtaacagtgggattcccctccccatctttactgaatagaaatgaattcttggagatactcatgctcccagattccagagggttaaccaggaatggagaccatccgtcggccctgctaaggactaacacttagccatcgtttttcacaggcctgggcctggaaaaagaaatctctacgttcctgccctttactattgctgatggagcctgggggaaccatcactttttttgtgtgctacattcaaggagatcaaaaaaacttttcttcttttgcaaagaaagctttttgtttttaactgcaacgtacttttcccctaccttgaagagacatggtggtcgcagcttctcatctatatgaaaaagttttcgatgtattggaattatttgggaatgcttttaaaacaatttgtaattatttctttacaaaccaaaacagaacagaaaggtgtggtgctggaacatcgatgaaggagccctacttactgagcttagttatggacttttttgatgcatgtgtgtatgtgttttaaaaagtatgcaggctctaaaaatgttattttgtaaagctctcagctcatgcaccccatctcctcttcacccatattatgccttctttctcttgtccagattcttctttttctcttttctaaacagctgagcctgcctactttgcccttttacagcttttaattttatggatttttaaaaatgaaatttcatgtggaatttggggttggggggcaggctgg

SEQ ID NO: 208968 - DNA, 338 bp, Homo sapiens
attattttgataaatatacagtggaagaattaccctacctgtctgtcacctttcttgtagctgagtagtacctagagacaagtggagctaggaggaggccatgagggtgattttaagttgaaaggtgactaccttatataaactattaaaatgcatatgttgcctgatttcaatgataatatttggctgtttgagtttagggaaaaaaaatcttatgtgactgtatttttattaatatgagaaatgttcttgattatatgcacataatacatctctatacatgcagatatccttagttaacacttgaagaaaattggttttgattgaccatacattct

SEQ ID NO: 208969 - DNA, 379 bp, Homo sapiens
ggaaaagagctcctaaattgaacattgatttcaaactacagtaaaaactggctagaatgctaactttgcctccaagataaatcatagtgtagagttacttctaaatcttacttattaacccaaatcaacataatgacaacatctatcacttctggaataggacaagtttctattagatccttacaagcttccactgttccctgactaattagttaaaacttcatcaagaccaaattacaaggaaaaaaacttacggtttccaaatacttctaagaaatcaccagctcttccctctggaacaacacactcagtgatgacccaatagttcaggatgcatcacattaggccaagatccactgttagaccaatcatgatgccg

SEQ ID NO: 208970 - DNA, 387 bp, Homo sapiens
ccaacgctgctcacatttttgatagggaagtacgggtatagctttcttgagctttcaggcggttctgacgtccagaaaaggtagcaatttacttatcttagcccttgccatcattttataggtgagaaaactaaggctagataggtaaagtgactttactaaggtcatggaaaaactagtggcaacttttgtaaacctggagtcaagagaatctcttgaagctggcaggcagaggttgcagtgagccaagatggcaccactgtactccagcctgggtgacagagtgagaccccgtctcaaaacataaataaccaacgctgctcacagtgtaaccatcacacgaatagacctgtgcttttgttatcttattcaaaaactccttgcctg

SEQ ID NO: 208971 - DNA, 805 bp, Homo sapiens
atgtagaagatgggtgatttctgcatttccaactgaggtacctggttcatctcactgggactggttggacagtgggtgcagcccatggaaggtgagctgaagcaaggtggggcgtcacctcacccaggaagcacaaggggtcaggggatttacctttcccagccaagggaagccatgacagactgtaactggagaaacggtacactcctgaccaaatactgcacttttcccacagtcttagcaactggcagaccaggtaataccctcccgtgcctggctcagtgggttccatgccaacggagccttgctcactgctagcgcaacagtctaagatcgacctgcgacgctgcagcttgatgcagggagaggcatccaacattgctgaggcttgagtagctcacagtgtaagcaaagaggcccggaagcacaagttgggcagagctcatcgctgctcagcagggcctactgcctctatagattccacctctggaggcagggcatggcagaaaaaaacgcagcagacagcttttgcagacttaaacgtccctgtctgatggctctaaagagagcaatggttctctcagcatggcattcgagctccaagaacagacagactgcctccccaagcaggtccctgacccccatgtagctggactgggaaacacctccccatcaggggctgagagatacctcaaacacgtgggtgcccctctgggacgaagcttccagaggaaggatcaggcagcaatatttgctattctgcagcctttgctggtgatacccaggcaaacagattctggagtgg

SEQ ID NO: 208972 - DNA, 234 bp, Homo sapiens
ccttctgctgagaggactagtgccaagtgtggcagacaaattctgtgggatctgtgtacatgaaggtgttatttcttttgcctttaaaaaaaaattattttgaagtggaaaggactgcaattttatggactgctgtaagataacttgttttacactttgcatgtatgtgtgatggggaaataattccaatggctagctctgtgcaagctgaaggagtcaactttctacatgcgg

SEQ ID NO: 208973 - DNA, 385 bp, Homo sapiens
accttcctcaaagtagaatagcaaacttttaagttcccaaggtgtttacctacttagccacacataccatgggcccacttctcagtggctttgatatacctagcatggtctaaagaagtgtcagactaactcatcttacaaaaggaaccgcttaataataaaagagctgtgcaagtagcttgtttcatcttaattagcccaagatgatgcttctgaagtgctgtgctttcttatctatccttcctgctgcaagggaagaagactttgacatctttaacaactcagcctcaggaaccagaatcaggagtagcagatcttgcattggcattgtcaaagaagctgtaaaaatgggtgcctaaaataaatttgcctttgtattggaata

SEQ ID NO: 208974 - DNA, 352 bp, Homo sapiens
aaagaggaggaaacaggatgagacaagaggaaacagaatgagacagaaggaggcaggatgagagaggaggaaacaggatgagacaagaggaaagaggatgagacaggaggaggtaggatgagagaggaggaaacaggatgagacaagaggaaacatgaatcagggctttgatttccacctcttatcatttgcaagccgaggagccttgagccaagttatgtaaagagaaagtgaaagaggataaaaaagaataaaaaagggacctttctaggggaagggtacaagaagggacaatggcatttctagcaggtttttgttttgttttgagacagggtctcgctctgtctccagg

SEQ ID NO: 208975 - DNA, 553 bp, Homo sapiens
ggacagcttaaaggatagaaacaagatggagtaggttaggtctgatttctttcaccatcataatttcctcagttaaaattttgtaaaggtggtttcaatggagcctcactctgttgcccaggttggagcgtactggttccatctcagcttactgcaacctctacctcctgggttcaagcgattcttgtgtctcagcctcccaagtaggtaggattacaggcatctgccaccacactgggctaatttttttgtggatttttagtagagatggggtttcaccatgttggccaggctgatctcaaacttctgacctcaagtgatccacctgccttggcctcccaaaatgctgggattacaggtgtgaaccaccacgcccagccatgaatctttagattactcaagtaaatgtaaaattataagtgtggtaaatgacaggagatgtatagtagaggaatctcatctgtctagggataaagggctcccctgtggaagtgatatttaagggaagattaaaggattaagaacaattaatttgggaagggatggtgtctta

SEQ ID NO: 208976 - DNA, 108 bp, Homo sapiens
catcattgagggtaatgaaggaagagaaaggctgaaaagaaattaggactggggtagagagagaaccttgtgagtagagactgaaaatgccattacgttaatcttaaa

SEQ ID NO: 208977 - DNA, 640 bp, Homo sapiens
ctctgggtacagggtgatgaaagtgatcgcgatgacgtcatgtaactctgggattgctcagaaccactgagttgcaggcgttgggtgaatgggaggaggaccttccttctgccaaggtcacatgggggtggtggtgaccccacaccaaccctgctgaggacagctaaagcaatctggccaaaacagccacacttcttcctaaaagcctcaagagctgatgggacgaagttgcgtcccatcagcttgtttatatgggcatgtttgccacttggcttcctggccaagagactcacctcttatttgggaagcagctggatctttccaaactgactgttgcctgatgagctggcaggggagagaggcactgggaggcagtggcttagcaaagcttcctgactcctttcaccccttaactcccacctgctactttgtggcagcaaagagaggaatctgcctttcaaacaaccccacagctggggagatggaagacttaggggctatggatcagagtcctgcagtactgccatgctttgtgcagtgatctgcagagtgacatatgcaaatgttcatgtagtcaatacctggcatgccttagtgaagcatgagtttcttacgggctgactgatgggagcaagatgcg

SEQ ID NO: 208978 - DNA, 323 bp, Homo sapiens
aaaaaaaaaagaaaatatacaaaagttttcaaggaactgcacctacagtaagcaccatgtgtagattatgtcacagggaaattaccaaaccttaaggagcagatagtcttagtgctagttgagttgtagttcaacaatacccagcagaactttctgcaatggtggaaatattttgtatctgttctattcagcatgatcctcaccagccacatacagcaagtgagtaagcacttgaactggctactgtgactaaggaattgaattttaaattgtatttaattgtaacttaaaaggccttgtattagtccgttctcctgctgcta

SEQ ID NO: 208979 - DNA, 120 bp, Homo sapiens
ggcatgtgagagacagaaacagcctgtaacttctagaatttaccttgtttagggaacattcagccctccatttcatttaatgagaatctgcattcatgattcatttaattccagaaatca

SEQ ID NO: 208980 - DNA, 396 bp, Homo sapiens
atgacgttggaaagaagcaggagcccaatcgcaaagggctttgaaggacatgtcaaggaaattacccatgttatccttagtgtgatgagaggtcagtggagagtttaagtagaagaaagtactagactgattacttttgcctacctggaaaaaatactcacttgctccacctttgctcatcatctttctctccatctccccacattcacggccgacgttcatgagcgggcctgtacccaccacaccatttcctcaccaccagcctccaggcactgggtaatacgttcctccctgcctttcttcttcccttcctttcatagaaattaaacttttactctctaagatggtatatttggatttggcatatttgagtttaccaaaacaaaaaaaaaaatt

SEQ ID NO: 208981 - DNA, 252 bp, Homo sapiens
cctcaaagaaaattgaaaacaatttcactttttttttccttttatgaagcatgtgtgtgtcatttgttgtaagaaggatatggccctgacatcttcatactcgattgttctctgtgaagttattttatttattcacttattgaactcatttattgaacaccatttgtatgccaggtgctttgttccagatctgaggatatagagatggagacctggtttctgctttcacagcctggcgacataatggatagc

SEQ ID NO: 208982 - DNA, 311 bp, Homo sapiens
  misc_feature (273)..(273): n is a, c, g, or t
  misc_feature (276)..(276): n is a, c, g, or t
agtgaataagagtgtgaacaattctgtagaaaatatataaatcacctttcatattatgactcttcattcttaatgctgttaatagcgatgctattatgtgcttatatggccaatgggcttttgtcatgtgaatgcagaaaacctaggtatacaggttttgagttgactgttgagctgtgggcagtttaacaatatcttatttttgagtagttttttttttttttttttagacggagttttgctcttgttgcccaggctggagtgcaaaactcngtntaaaaaaaaagatttgcggccgcaggctgatccct

SEQ ID NO: 208983 - DNA, 504 bp, Homo sapiens
caggtcacccccaaatccaaaattagtgcaattaaacaccatcaagttactgcacttatttcttgcaatatggaaaaacttgttttccagctaaagcaaagtggataaatattccaacaagatgttcaattggtggcaagaattatgactttataagggcccatgcgtggttgaatataaacaggaagtctcctgaggcagtgagttggcatgcaagtaatcttgtcccatgagtccagacagaatgtcccgtgtgtatgcatgtggcaggagacgtacagtgtgctcagagaggaacgtgaaggcagagcagagtgtgcacacatacacacacacatacacacacacaaacacacacagaagacaggatagagattctcctcagcagttactccagggagaaatgttctagcaaagaaaagattatttttatttatgtattatttttgtttgtttttcttgcatgcacacgtgtgtgtgtgtgtgtgtgtgtgtgtgtgtgtg

SEQ ID NO: 208984 - DNA, 728 bp, Homo sapiens
aaaaaacaaagttaagtaggaaatgagtcctacaaataagaacttagcagcttttttgaaacatagaccaaacatgagtctgaaaaataagtttgatgaggtgagtgttttattgggaggaagaaagccaaattcttcttgagattccatcctttgtatagcttgagagggtcacataggctatagagtgatcaacagcataccattcttttatccaagaataagatggagtaaatgtgtttagtttgaaaaaattcactttcagcctgtctttgccctctttaatgtttttgccctctttaatgtctttgccatctttcacgggacattaaccagcaaacaccccaaatgaagtaagtccttttcatgaacttttcaccatctgagaactcacacagggaagaaacctcagaaatatgatcacgtgaggaaagacttctggcctaactcagtcttatcttgagaggattcatactggaaaagttcttacattgagtattacatctaagagcttctgaaaccatgagaatataattgctgtgggaaaggttttatgcatagctcccttattcagcatcacagaagttgtactagagattacctgagaacatagggctgggaagccttcgggtgtcccagaactcactggcaaggatccctctctgaacacagcattttgggaaccccttcagtaggagtcctcattgttttcagcatcagaggactca

SEQ ID NO: 208985 - DNA, 490 bp, Homo sapiens
gcgcccagcctaacccttctaatttttagaagttggtaattggttcagattataaaatgaaatgttttatacaaaacaccttgcagactgtgtacagtgtgagggcaggcagtttgcagctctagtcaggggcttaggctctgccactgttacatacaacacggcaataacagagtcggggaacaggagaaggaggggggtcccaggaccaagtggggcactggaaccaaagctccatcaaggttactgccaaggtctttcttggcagctgggctgtcttgtaagacttctgggtggagaaaatgagaagacaaaagaaagggaaagacagctgcccatccatggagggagaagttcaggaggcctttcagaattctatagtcttaattccaggactgaagctgcctgcctgtgggacaggagctggtgctagggagatgatgtgagagagtgatggcaggcattagtgctaactgcaaagtggctggta

SEQ ID NO: 208986 - DNA, 207 bp, Homo sapiens
agctatcgtagacactaactggaaatgtctccatcaatttatgttaagtgagagattctgccttcctttcaaccacccctatggcacggtgctcacagcagaaaggaggcaaatggagggtcttcatatctcttaagatagatctatggatcccataagaccagacacgggggtctacacaagatttgaatctctgccatccacatt

SEQ ID NO: 208987 - DNA, 701 bp, Homo sapiens
gccaagtgctgccggggagaacctgctgaaggtgctggacgtggctgtcctgcgagaaggccacgcgtgggagctgaactgagcagggggtgctgggtcaggttagtgctggccattgggtggacgcgggcccatcgtgggcttgtgagccactgtgggcttaaaaagtgcagagttggggggatccagagtgaggggctggagcacaatttcatgtgaggggtcattctgggacagtggcaccacaagcagacccgggtggccgctggtaagggcctgtgtgtgtggttgcctacgctctttccatctcttgtcggcttctcacagcctccacagaagacagggatagttacagggaggacagggaaagtccgaagtgtgcaggcgccctgcatccccgcagccaagttctgggcggacactgccctgagccaggacggtgaggtgggacgccttccccacccagctgccagatcacccctcctggagggtggggtggggccctgacaccttgttctttgtccctgccccaaactttggggcctgaatagaggaaggcagtgacattaacttcttcctggccatggatacaggtccctgaggacaccgtgtgtggggacagcaaagccttcctaatcccccagccggccaggcaccttcacacctaaatggaaacctgcatgctggtttccatgaagaaa

SEQ ID NO: 208988 - DNA, 233 bp, Homo sapiens
ctccttcctccccttcccattagcagttccctcctttcccatcctccagggtctcccaaaccagccactcccttcccatgatctatgacctcatcctttctaagccccaacttccaagcctccccaaaattgccaatagagacaaccaactcagctaagaccttgaagggccttgcccctggacaccctgttctcttggcccagctttaaaaagtgtacagtatgtcgggtgt

SEQ ID NO: 208989 - DNA, 534 bp, Homo sapiens
ttaaaaatgttcatacttcaaaggacactgtcaggaaagtgaaggataaaagataaccctcaaaatgagggaaaatatttgtaaaacatgtatcttatgaggatcagcagaatatatctagaatatataaagaactcttacaacttaataataaaaagacaactaatccagtataaaaatggtaaagaatttggataggcaagaaaatacacaaatggccagtaagaacatgaatagatgcttaacgttggccaggcatggtgtctcacgcccgaaatcccagcactttgggaggttgaggcaggaggattgtttgaggtcaggcattcaaaaccaacctgggcaacatagtgagaactctgtctctacaaaaaaattctaaaaatcaaccggacctgtagtcccagctattggggaggctgaagcaggaaggatcacttgagcctagagttcagtgctgtgatgatctaagattgtgccactgtactccagcctgggcaacagagtgagaccccaattcgtattaaaaaaaaa

SEQ ID NO: 208990 - DNA, 716 bp, Homo sapiens
gggtttgtgtcctggctctaccactttctagctgggagacctcgcacaagttcttaactcctttgtgtttcacattttcatctgaaaaattggggtaataatagctcattcagtcttcattaaaagcttaagaggtaggttttttaattattgttccaggctttgcttgagctgagagggccagcgagagtcaaggtataggagcaattgagcagagagagtgtatcagtcagtttttgctgtgtaacaaaaccatgaaatggcataagagcattcattcagatttcataggtctgtgggtcacatgtggtggttctggcttagtctttgagttgagttggccctgactggagggtcacaggctgcctgaagcatgtttttctcataatggaggtcagaagctccccgaaggacacaaagctcttatgattatggttctgaactggcatcttgacacttcttcccacattccattggctaaagcgtgtcacaacatccagtgggtgaaaaaatacactcccacttcgagagacgaggacgagggatagagacccttgtggctcccatacccagccttctgccagtccgtttgtacttgttctccagcaagaagctcaacagacatttctcaattggtcataaatctggtacctaggaatggtgctgacctcttgcaggcctccagggaggtcctgagagtcccatgagagtcgact

SEQ ID NO: 208991 - DNA, 937 bp, Homo sapiens
tctcgatggtgttctttgaagcacaaaaagttttaattttggtaaagtctgattcattttttaaattttgttgcttattttttcatgtcgtatttaagaaacaactgtctaagttcacaaagacttactcctatgtgttcttctaagaggattcagttagctcttacatttacattattttaatctataatcttggaacgaatggaatttaatgttaacactatttactttcttactccctccttctattacgcaggaaacaaatggcagtttgattctaagtgtattcactaatacaaggctggggactgccccatgagggatgagcatgagggccatgagagatactgctaggagcccactttgaaacaggagttggtgacagaagcaagccccagccactggcctcacttagagctggaggaacaagattttatccagtcctaagaggaagtatgggagaaacacaaagatgctgccaacacaccagtacaggctcaccgagaggggctatctattctataatacttaagtatatttccccaaccttcaggtggatatggttttcatatgctcctacagtaagtgactgcacattgtatgatgctatgaaattaatacctgttattttataaatgttgacactactaggtgacagcaaaatagtgactatgttattagcttgtatgcacttctgagcaattgttaaccttttaagcctttgaacctatcagaattcgcaagggcgcgaaagactggtatcattggacttaataaactaagggttccagggtgaacccagagaaatatcccagtatcctatcaccatacaaacggctttacacaccgtggttaaagcagacagggtcgcgggggccctgtaacgtgggtaggcccctggcggcaatatacacatatcgtcagcgcgcagaggagg

SEQ ID NO: 208992 - DNA, 313 bp, Homo sapiens
ccatttttatgatggaaagaacatcctaatgtttgattcatacttcaatcaatacacagtagctttgctttttcctctatgcattttcagaaggtggggggaaaaaaaccaaacaaacaacaaagaggtttagtgaaaccctgtctctactaaaaatacaaaaatcagacgggtgtggtggcaggcgcctgtagtcccagctactcgggaggctgaggtaggagaatcacttgaacccgggaggcggaggttgcagtgagccgagattatgcctctgcactccagcctggcgacagagcgagactccgtctca

SEQ ID NO: 208993 - DNA, 914 bp, Homo sapiens
tattttttagttctgtctgttgtgaggcacatcctgcatggggcacttctagtcaaataggcaatgataaggacctaattaaaatgtgataagtgtatactattactttaaaagcctttacagtcagtacttcagtttacaaggcactttcacagcatctcgtttgatcctcacagtcacaacatgtggtagacaaggcaggtgatttttatccccattttacagataaggaaacaggctgcgggtggggagtgaggggaggtaaagatagttagttgcctaaggtcacacagccagtaagtaatagagctgggactggaacccaggtttccttactctcatctattgctcctccatattcctcactcaaccatgaaaacattacttgaaaggactgatgaggttaaccagagacctaactgatattgtaactttctattttaaggaagaattgtgtctgtatttgagttctttggagcctccagtctgcctgtgtgttagaccagcacagcagtgctgtgtgatgcagcctgacctgtggcaggaaagtagtgcttctgtttggaagtcatgttcttttgcagccacacaggatccaaatatcagtactattcctgtagtcaatctggggtcacattataggtgccttatttccctaagggtaactgatctgaatatctgcaaataggatgaatctatttttcagaagttccatctttcatttttctttttttttttgagacagagtctcattctgtcgcccatgctggagtgcagtggcgcgatctcggctcgctgcaacctctgcctcccaggttgaagcaattctcatgcctcagccacccgagtagctgggattacaggcatgcgccatcatgcccagctaatttatgtatttttagtagagttggagt

SEQ ID NO: 208994 - DNA, 205 bp, Homo sapiens
ttcttattctaaatcactgggtattactccctaaggctccaagggcactcctgaaaatataaaatatagagtcaatccaatttagcttttagcaagaaattttgctgttatacatgcactcgtaatggtgggaaaatcaattatgaacatcttagcacagagcgggaaggtgggtttttaaggttgtttttgtatgctgtgatag

SEQ ID NO: 208995 - DNA, 227 bp, Homo sapiens
agggtataatcttaatttgtttctcacagaaataaacatggatatgtttttaatcaggtctctatgaaaataatttaaaaaatttaaagttattttacctgctacataataaatggattgtttattccacaggtatttagtacctcctctgctgtgcagtgagttgttttactagctgaaaatatttgaaggagataatggtatcattagataagtgatggattttg

SEQ ID NO: 208996 - DNA, 235 bp, Homo sapiens
agagcctatacttgccattctaattaaatagcaagtataataaatgataatagtagctatgacagagtgtgacagagtatatcggaggggtttctaatatagttgaggtagtctgggaaagtgacacttaagctaagcaagaggaagggagttctaacagccggcagctaagcctggaacctctgacagagatgagcgctcctccctgaaatactttctttggcttctgtaagat

SEQ ID NO: 208997 - DNA, 772 bp, Homo sapiens
taaaaccacaacagtaatgttttcttaaaacattgaattgagtcccgcttaacaactttgataatagcatgagatcagaaagtccttcctgaaaattccaagaatgaaagccgtgtgcatgagtttttgcgggagaatatttgcaacatttctgtgaagttcttgatagctagacttcctggtacaacatttaattgtagtccttagtaaacttttgtaataatttatgttgatttttcaataatactttcaagttttcaattttactaactcagtggaatactactgttggtatctattggtcacttacaaaaaaaaaaaaaacagtccgttgaatgcattttctttcttttttttcttttttttgttttgttttgttttattttttgtttttggagacggaatctcgctctgtcgcccaagctggagtgcagtggtgcaatctcggctcactgcaacctccgcctcctggattcaatcgattctcctgcctcagcctcctgtgtagctgggactacaggtgcccgccaccacgccaggctaattttttatattttagtagagacagggtttcaccgtgttgcccaggctggtctcaaactcctgaactcagacaatctgcccacctcggcctcccaaagtgctaggattacaggtgtgagccaccacacctggcctgtagaatgcatttcaatgtgcataacgctaatgaaaagacttgcagttttggttcagttaatggcccattgtgaggactctttaggtctgtata

SEQ ID NO: 208998 - DNA, 250 bp, Homo sapiens
agtgcgattttgagaagcattcaggaaacatttatttactgcgtgctttaaaggcagagtagaaagagcaagtactagcctgtgaactgagccgttgggcttagctttgaactacctcactgtgtgactgggtaagtccctttgcccatagttgtgtcctttgtgaccttctggagggagttggggtggatgatctcttagttccacatccataattctacaatattataattctgacataatggggaga

SEQ ID NO: 208999 - DNA, 461 bp, Homo sapiens
cttggcaattagaccagttgaatatgattttttttctttttccaaaataatagtcatgcaatagtttatgagtgttattatctggcatcatgctaacagttagtgcaattcttcctggaaggaagacctatagagattaaacaatgtttaggccccagtaagttaaattattccctttccgacagacaccctatatggagaaggcaaattaaaaaggaagtaaggtagctattagttgatatccaattttcttcaaatcttctaaagtgtgttttcatattttctggagatgtgtgggaaaattgagctctgactcagatccaactcaaagcctgtgcaagcatgagaggctaagtagtttcctgcgaagctctgcactaccaacctctgtttaatttgttttcttatgttatatctcagagtacaatattattatgatttggcagaaaaccttgatctgt

SEQ ID NO: 209000 - DNA, 516 bp, Homo sapiens
gtaccctaaaacttaacgtataattaaaaaaaaaaaaaagaagaaatagcatttcagttgttttccgtgttcctgggatagctgtattttacctgggagtgctcgtaaagaaattcgtatttaataatagtgtttcctttaaaaactaggtgattaatttagtgtccaacagtaaaggaataattaagtaaattatatacatccactcattgttgcatatgggaattaagagatgtttctgaagagtttaaacagaaaaatgtttatactaaacattaagtgaggaaaaacatcaaacatcatacaatgtgatccagttatgtcaaataatatacatagataacaaatcagaaagaaatacaaaaatgttgacggtattatctatgggtgatttttttttctccctccgcttgctgtatttttttttttacaatgaacataacagttttatacgtattataaaatgttattaaaatacacatgcacaaataacttattttattgcaaataatgcct

SEQ ID NO: 209001 - DNA, 546 bp, Homo sapiens
gcgcccagctgcaagttattgtttaaggtcaaatggcaagttggtgacagctggatctaaaaagcatttcttccttccacattgcatagtagaaataacttagactttggaattggttggacccgagtttgaataccagcattgccatttataaatgtgaccttgaatgagttacttattctctccgaacactagtttcttgagcaacaaaagaggaatgatattgtaaggcatttatgtagaatggatatactcattcagtcatttctcatgttcagctgatttcttgtaatgaacagaattcacggggtccgtgggtggcaaagagtatttggataaaattaagtcattaagctgggtgtggtggttcatgtctgtaatcccagtactttgggaggatgaggtgggaggatcacttgaggccaggatttctaggcagcctgggcaacatagtgagaccctctttctgcaaaatgttttaaaaaattagctgggcatggtggtatgcatttgtagttttagctactcaggggactgaggggaaaa

SEQ ID NO: 209002 - DNA, 803 bp, Homo sapiens
aattattatactgggattacaggtgtgagctagactgcctgacctaaaattttgttttttacaaagtaataaatactcaaaatttatcactccctaattatttaactacatttttactattatctgtgccattgaggttatttatgtctatttgtattaatggtaggaatgctaaaaatggcatgcaactatgcatttctttctaactctactttcggtaacttcgtgttgaaacttaaatttgataatggtgggagtatttacatgagggaaattggcaagcagcacagcttgatttattgttttgttgattatctaaatcaggattcagtaaaagagggcatgcttgctatgtgttgttataaataaagtttccctggaacacagccatgtccatttacttatgtactgtttgtgactagttttatgctaccatggcagagtagttttaacagagatgttagacccacaaagcctaaaatattcactgtttggcccattatagaaaatgtttctatacccttcatctagactttaaaaagtgatgagtaaatgttaaaaatgcaaattaaacttaaaagcatgtttttttagtagctattacattgtgattagcacacaaaactgaggaaatacttttttcaatattggaaaactgttatctgattcagtaatcacagtattgactattatgtttgaacttaagtgtgctgaaccaaaaaaaggttttaatttaatgaatataatctgtatgatggtggaagatagcttaatagtagatcacatgtcagacttaatgacaa

SEQ ID NO: 209003 - DNA, 1405 bp, Homo sapiens
gacatatctctgcatcagtcacctaggaaatgtgactccgtttttgcctgcactctgtccacaggaaacattgtgacttatcactaggcccaggtactagttgatgtgtctctggtaactgggccttgaccacagagaggattgttacctattgctgggctcagcccccatgtggtgtgactgtactgtctgtgtcctgctttcaggagaaggctgtaacatattcctggttgagtattcaggtgatgtgacactcctgtttggtccctgccttcagaaaagattgtgatgtactcctggccaaaaacccaggtgatgtgactcttatctctccctattcacaggtaagattgtaaaatgccttggtctagctcacaggtgtgatgatgttgatcctttttttttttttattttatttattttttttatttttggagatggagttgctctgtcgcccaggctggagtgcagtggtgtgatctcagctcactgcaacctccacctcctgggttctagggattctcctgcctcagcctcccaagtagctgggattacaggtgcacaccaccaatcccggctaatttttgtattttccgtagagacatggtttcagcatgttggccaggctggtctcgagctccgtacttcaagtgatctgcctgcctcagcctcgcaaagttctgggattacaggcatgagccaccgtgcccggccacaagtgtggtggtgactctcatacctcaaaccagccaataggagagatcctgtttcttatagctaggcttaaaatcatgagtatggtcatgggtcttcttgtacgaaggtcctagagaaataccactttcttttatactatataaatctcttactgtacagagattgccattccagcgttcagaacacaggtgagattgtgtttctcatatgcataccccagcaaacattaaaattgtcatcttcacacatggacagggtccactggtaagtcctgaatctcacacatggaaaaaatccacagttgaaattgtgactgtcatatatgaacatccggccagagttgaaatcatgagtcatttctaaattcagtttataggcaagtgagaatttttctatctgaacctgagagaataaaaggtggttttgaattagacaaaatagagctaaaagttcaaacaaatggtggaaggattgtaaaaatcttgcaaagaattccatgtgtggttatattgactaaattcaaaaaggtactacatggtttttctgtaaataaaaaattgaaataaaagcacaacaaggtactcgtaatgcactaatctgctttttagcaaactttgttaacggttatgacagattgttgcttctttaaaattttggagtcattgtaacaaaataaataatttaggat

SEQ ID NO: 209004 - DNA, 667 bp, Homo sapiens
atagctggcgcgtggtctagtgctggcgtgtggtcttgtgctggcttaaaatcatgagtatggtcatgggtcttcttgtacgaaggtcctagagaaataccactttcttttatactatataaatctcttactgtacagagattgccattccagcgttcagaacacaggtgagattgtgtttctcatatgcataccccagcaaacattaaaattgtcatcttcacacatggacagggtccactggtaagtcctgaatctcacacatggaaaaaatccacagttgaaattgtgactgtcatatatgaacatccggccagagttgaaatcatgagtcatttctaaattcagtttataggcaagtgagaatttttctatctgaacctgagagaataaaaggtggttttgaattagacaaaatagagctaaaagttcaaacaaatggtggaaggattgtaaaaatcttgcaaagaattccatgtgtggttatattgactaaattcaaaaaggtactacatggtttttctgtaaataaaaaattgaaataaaagcacaacaaggtactcgtaatgcactaatctgctttttagcaaactttgttaacggttatgacagattgttgcttctttaaaattttggagtcattgtaacaaaataaataatttaggat

SEQ ID NO: 209005 - DNA, 559 bp, Homo sapiens
atcaaagttagaagaccactgatcaatgtcatctccattatttcttctacagttggtgattggttgattgcagtgacctgcattgtgtcctccatgctacaggcaagcagtgctgggaaaggaagcattaggctggaggtagatttcccattaagccaatgaggcttaagtatcactgcccctcacttgctgggcattccaaagcccactacctaatcgtgtattcacaatttaatggttttttttcttaacaggggatcctaagttgtacaagcctcaggtcccatgagccctggattctccctagtgttagccccaatgcttcttaatgtgcagacaccactgcagacctgtcctaagtgacctgaaaacacagtcttagaacatatcagccatttggagtggggtgggagttgctttgcaagctcaacctaatcaaatgatggcaaaaccaatattatattattcctgcgaatgaggaacagatataaggtgtcagttattactcatttttcatctccaccaaaactttttatcagagtagcatatcttagaggct

SEQ ID NO: 209006 - DNA, 426 bp, Homo sapiens
cttttgagggtgagggggtcccttcgaccagtttgcctcatcttcaattaattctgataatgaatgtttttctgaaaaatagttcacctcatccatattttcacatttaacagcacaaaggtgcatgtgatattctctgttttcatctccaaatcttacaattgttttatttttaatgttacacatatatgttttctcttatgtccttatcataagtgccaaaaagttccaatatttaagtgacatttttcaaaggatcagctcatacttctttttataaagcacactgatttggtcttgctttgttttgtggggctgaggagttgcttggtcgttttgctcacgtgtctttagaataggctggacctaccctggaaagtctccaacgcagccaacatcagaaacaaagacacacagactccaccg

SEQ ID NO: 209007 - DNA, 176 bp, Homo sapiens
aaccagatagtgatgatgcttatacaaccttgtgaatggactaaaggccactgaattgtccactttagaaaggttaaaatggcaaattttaggttatgtgtctttcaccacaactcttaaaatctaggaacataaataaatagatggactgggaaaccacccagtagctcctcagc

SEQ ID NO: 209008 - DNA, 204 bp, Homo sapiens
cagaagaagtcaacggactgggccagatttcctccaatctacgacagaatctatgagtagcacgttactctgtgattcttaggaaacatcttctcttgtcctatagttcttaatcagcagacctgtgaccactgggagaggtctgtgattactgagcaaagttgaccacagaaagaatatccatattctcagaacctcatcatg

SEQ ID NO: 209009 - DNA, 286 bp, Homo sapiens
tatgtgtttttaatttatataaatgtgtttctgttatatatcaattacattttaggaatctttcccctatttccaactccctactgccataaaaaatacagtaataaacatcttcatcatgttgcctaatgaatctgtatggaggtttttgtaaaggaaagagatttttctgatgaaatgagattgctgagtcatacagcttacgtatgactctacactgtctaggttctctccagaatggctgtacccgtttatacttccagtatccacgtgtgaagctgcctgt

SEQ ID NO: 209010 - DNA, 365 bp, Homo sapiens
taaaaaaaccgcaattatctgcaaagcacaataaaacgaggtatacctatacatgcaacaaacacaaaaccggtaaactcaaaattcaggatgggcaaggaaatgaagtagggaaaggaacacacacaggaagcagaggtgactgaactggtcaggccaagtctcctcaagttgagtgacacaaatcagaatcactcaaaattgaaaggctaaccaaaacactgcaccgtcaatcacctacagcaccttcagtgaagtaagagcgctgcagggtgggtaggagcaattccctctgctgtgcttgaccctcatcagtaacaagcagagctaactctgacaggtggatggagtgcttctgctaccca

SEQ ID NO: 209011 - DNA, 785 bp, Homo sapiens
cccagaaaaggcctctcgtctaaaggctccatatttcagggcccaacacagtgcctggaatataaaaagtacccaacaaatatttatcatatgactgagtgaaaaaatgcagtgagtgaaagtgtcatttagcttccaccatcctctctataattctttctttcacgtcctctgggaaaagcctcaagaccacatgagactgaatttctaggctgtttttgcacttgaagtacctgccacataaactttccagacatcaaggagcaggtgatgctgtatgtttgaattctaagcattcgtttaattcataagtccccaaggagtaaagccaattgaatagtaagccatgttttcttttatcttgaaccttgaacccatgcactctggccctaaatctagagcgctttcccaggctttctcacaagctgtctccttcccactctgctgcttgtgcattttgggctcacttgatgtgattttattagttatcaatccatcttgatcatccccttttttccagtgcttgtttcccatccctccaatccgtagcagctttaaatctgttgctcccatattatatccacatatcagaaatacttttggctgcaagcaacatagttcatgattaccaatggttgaagttggggaatcagcaaacactgctcactggtcaaatcctgccctactgttgtgtattaggtgtctggaccccttaccctgttcctatgccaaaggtttgaccaggcaggttagggtgccgaacaggtgccacatttgtggccttg

SEQ ID NO: 209012 - DNA, 773 bp, Homo sapiens
agtgctatgtcctgtaatgtgatggagcgataagttatcatcaaggagaaaaaggccggggcctggagcgggacagttctaagggtgctgtttgaattggtcagggaaggtctctttagcaaatgatggtgaagcagaggagatggaacagaggcaagggaccctcattctgtcatcagagggaagagaattctaggcagaaggaacagccagtgcaaaggcccagaggcacgagcaagcttgtgttggaggaacagtgaggatggctgctgctccataaggaatctctgcggctttaatccaacttcaagtttggggtgaacttgaagtttaaagaggaaagaaagatgagaaagtaggggaagaactggtttctcctcctggctgtgccggtctggtctcccttgtgtgtggaagaggtcccaaggcagggtaaagtcgagattcagctctggcacactcttcctgtcttcatctcatgcccagtaagaagccctgattcaagccaccagcccaagcccaggcctctgtcccgacataataataattttagctaatgtttatcaagcacttactatatgccaggcactaccctaagtgctttacatactataactcattttcatctcacctgagccctatgaggaaatagtccaccattctcatccccattttacagacaaggaaactgaagcacagagaagtcaagtaactggctcaaagtcacacagctatttagtgacagagctgggcttcggacccaacacaccaag

SEQ ID NO: 209013 - DNA, 441 bp, Homo sapiens
aatgccctaaccattcatccatgttctatatagttcatgtcaacctgattcccttttattatgagatttgtcctctcagtgcctgatccctcagggaaccaattgaattcttttatttctaaataattgaggagacaatcttacattttccaatggtctattgatagccactgcttcaacttggaaacctgagcacatggcttggaagagatggtgaataccaaaatgatgtctgttttaacaattccttgcattacaatgtagcaaatagcaactatttattgctcacttgctatcagtcaggcaatgtaataaatagttctgtgatagcagtccagcgaggtaaggattattcttgttaactggatcatttgacccaacttactcttacggaaagtcaattttggtaattttgcatccagaaaaagataatacacactc

SEQ ID NO: 209014 - DNA, 503 bp, Homo sapiens
gatctggaaatcatcagtgggaagggttgcctttgcccaaggctaaagatgacatgtccctgcacactttcagccccaggttttcctaccttgtggggaggtgagaggtcagggtgagtgctgggtttgaggctcagctgtgctgtgtgaagattgagaggagcccacctgatcacatggacagaacgcacaggctcctgggtggccctgcggctccagtgacatagcacatggtcgggcatacaacagtgcccaggaaaggttagctggtggtgtttccagggtatcgtgctgagcttctgagatgagaatgtcctgtgaaagcctctgtctggaggtttcattggaagtaaagtttacatacaattaagggcctaaaattgtattttcatttaccttaacccagattcccagcaagctagagagctgccctcaccccaaagagttcctcatgccccgtcctggataggcctgtcagggccaggcagtgggcgcttgtccct

SEQ ID NO: 209015 - DNA, 372 bp, Homo sapiens
aatcaggtatagtggtgttccagctactcaggaggctgagtgaggtaggaggatcactcgagcccaggaggttgaggctacagtgagctgcgatcacatgactgaactacagcctgggtgacagagcaagaccctgtcccaaattaaaataaataaataaaaatttaaaaagagtgagtaagctccagcacctgcctgtttctgtattgctcacaagctaagaatggtttttacattttaaatagtttttaaaaaatcaaacaaataatcatattttgtgacatataacaattatatgacaatcaaattgtagtgtccacaaataaagctttattggaacacagccacacccaacctcttaggtattgccta

SEQ ID NO: 209016 - DNA, 288 bp, Homo sapiens
ttgagagaagtgttatttaataaaagattgctgaaaggacatttagttcatctcctctctgtattctgagctgtttctgtttcaagttagatctgtgaatgctactttcttaggaaatgcagtgtatgttctcaatttcatcaaggataaataatggaaaataaatcatataaaaactaattgctgtgtttgaaaaactgtcagggtgtcaggggcactgccatgatgtcattgaatttcccccagaaaagcttaccatgagaaatgtcctagaatctgtgtcagaaa

SEQ ID NO: 209017 - DNA, 201 bp, Homo sapiens
gcagtgggtggaaaatggtctgtcacctcagatcatctgttttccaaacccttactcttcccattacaagaagcaaggccaccaaagaatctataattccatatttacagacaacaccaacttcagtccatccttgcaaagttgtgttttagagtcagcttgctgaggaggaattgaccacatgattccggtctgtgcagg

SEQ ID NO: 209018 - DNA, 147 bp, Homo sapiens
tacacaaatccagggtgtccatttccagtttgaactgcctggaaaaatcaggtttgagtgattctaggatgtgattttatgcacctgcatagttcttcctcaaatataagtcatgtctatatttcaaaatacctgtgggtcttggca

SEQ ID NO: 209019 - DNA, 544 bp, Homo sapiens
ccattttaaagaatcaattgagaagcttaagtaagcattgtatttacttttttttacaaacagtttcaatatacaatgcataaaccatacaagatgctttctgataagtagaattactttgtgaaggcctcaacattttttaaaaatttttctacagagattcttttgttggattttagaaagttatgcatgtgcctctttgtaatatgtgcctctttgtaataattcttcattacactgattgattaattctacataacatggttgacagcatcagtttaacactttaactgcttaaaaaataacacatagaacattttcattatttattagtaacattcaactttgaaaactctatattcttttctccccctcaagtatagtcaaacgtttcaccatcttgtgatgtgtgaactttataaatctttatgtaatattgaatatttggctattaaagctctaaaaacttcttcacttaatttctaatattataattgaccctgcaaggacagccaatagtttgtattatttttagaattaacat

SEQ ID NO: 209020 - DNA, 449 bp, Homo sapiens
agccatttcttcttcatcccctgacacgtaaaattccactgtttcatcttcaatttctgctttgttcttagtattcacctgaagcactaatttctcaacctcaggagtaaatctgatgaatgaaattccttccatagaaatgatcttcacataacaagagatgctgctcttctgttatgaaattctttacttattaagctctggcaaatctgagtaccagtgctcttaactaattttattttcttcctcttctagtcatatcttagtttctgagtccagtcttctttgcatgaacttcatgtacagcaggttcttggagaacttggtcttgtgctcaggtgccatgctggcttcagcttgtgctgtgttctggccacctgctgtttcttagttaagagactagaatgagaaagttacatgtaaggatgtcaggggagtattattgaagg

SEQ ID NO: 209021 - DNA, 633 bp, Homo sapiens
gaaatttgccctgttcctacaacgtatgtgtggttttagatatttttaaaatcttaatttctttaactcaagaaacagctttgaaccaggtattctctgcagtgccagcaatgaagctttgttttatttttgtttttgtagaaacggggttcactatattgaccaagctggtctcaaactcctggcctcaagtaatctgcccaccttggcctcccaaagtgctgggattgcaggcgtgagccactgtgtgtgggcagcaatgaagctttaaatgttgcatttgattcaaatgtatttgtgtgatattttaacatttttattttatacttaccatccttttataaatcactcctgcgtgtttttggttgctgaaagtagggagctctacaggtttacttactagttcttatgtatattttaatttacctcattagctcacaatttctttggggaaaagtttatgcctattaatgtgtattctgaaaagttacattctctgttaaagagttacttccttgcaatattgaagatgatttattgcacctttaaatttctactctttggctccatgtacttgtctttgagaagctgagaaactgtagatttggttaagaactaaagttctctttccaa

SEQ ID NO: 209022 - DNA, 343 bp, Homo sapiens
gaaatttgccctgttcctacaacgtatgtgtggttttagatatttttaaaatcttaatttctttaactcaagaaacagctttgaaccaggtattctcgacaatgacaacgaagtagcgctctgttaaccttataggtttgcaggcgtgattcataaaaggatggtaagtattatataacaatgttcctatatcacacagatacatttgaattcaaatgcaacatgtgatgcttcattgcgcccacacacattggctacgcctgcaatcccagcactctatgggaggccaaggtgggcagatactatgaggccaggagtttgagaccagcttgtatataggaaa

SEQ ID NO: 209023 - DNA, 451 bp, Homo sapiens
tttttagctggaggtagaataatcaggaaccatgtttgcacagtgatccttaaacacaatgtggacccccccaccccaccaggcaaaggttgcattttggtgaggatgacagagcccccagcctctgctccgcctgaggtgaagtggggaatcgcttttgtcccttccctgatgaatgggtgtaaagtgttcactgaacctggaaacacctccttttgtgtccggtgctctcctaacacaggccgttaaacttggggcaatcgctcatggtgggggattgaatggggccattgtgggggggaggggtgcacactgaagccattgtgggcatagagatgccattgttttctcagtattaagaaaaggagtaggactctagggacctccaggcatcagtgtggccgaccactgcactgactgcttttctaggtttgcattatccctgaggaac

SEQ ID NO: 209024 - DNA, 668 bp, Homo sapiens
ccaaaaaagtataactgctatattaacagaaaagagaaaatggaattatattaaatgatcagttaaaaccaaagaagacaaaaaaagaaagaaaaaagaaatagcaatggcaattttatcaatggtctaaatacatgaattttttaaaaagggccaggctcagtggcttgtgcctgtaattccagcactttgggaggccaagttggggagactgcttgagcccaggagttcaagaccagcctgggcaacgtgacaaaactgcatctctataaaaagtacaaaaagccggtgtggtggtgcgtgcatgtagtcccagctactctggaggctgaggcagaggcaggaagatcacctgaccccaggaggtcgagcctgcagtgagttgtgattgtgccactgaactccagcctgggtgacagagagaccctgactctaataataataataattttgggttaaaagtaaaggaatggagaaagatgcatcatgctaacactaatcaaaagaaggctggaggctgggcatggtggcccagcactttgggaggtcgaggcgggaggatcacttaaggccaggagtttgagactagcctgggcaatataatgagacccccatcttttgaagtaagtgtttattcagatgatcaatcaagcaggaattgggtggcc

SEQ ID NO: 209025 - DNA, 612 bp, Homo sapiens
tgagaagtagcaaggccaagaacaggcatctaggttacacatctctatcttcgagtgcatttttctaaaacaaagggcttggacccacaaaccatcacctggaattgcatgtgtgactgaaagggaggaaactgcaaagaaaaagaaaatccttgggaaagacaattctgtggggagaatgtggtgggaaaatcaactgtgctccagtaccagttagtgaaaatgacagactgagctttaaatctttacctggcatttatagactcttctaactgtggcaagtttttttttttttttttttttttgagacagtctcgctctgtcgcccaggctggagtgcagtggcacaatcttggctcactgcaacctccacctcccgggttcaagcaattccctgcctcagcctcccgagtagctgggattacaggcacccaccaccatgcccagctactttttgtatttttagtagacacgggatttcactatcttgaccaggctggtcttgaactcctgacctagtgatccacctgccttggcctcccaaagtgctgggattacaggtgtgagccaccgtgcctggcctgtggcaagttttaaaactgaaatttgttc

SEQ ID NO: 209026 - DNA, 305 bp, Homo sapiens
gttaattttattaaatctcacccattgagtatgtctttttatacttcgtgtcatgtaatgggaagtaaacataaagttctgctctataccaaaatatgatggttctctcagggaaaagcactttggcaattgttcgagttctaagttgcaccagcctcccctttttcatggaatgtcattttagattgaaagaatgacagacaaactatgttttcagactgggattttgggagacattttcttgaaaattagtgaatgaggctgtctttgaaataaaataactgatagtgtttgttgccacttta

SEQ ID NO: 209027 - DNA, 794 bp, Homo sapiens
tggatatttcatttgtttgaagccctttggcaggttccatgccaaagcctatcccaagctggagaactgaaggaccctactgggttagaaaattgagtcttggaaaaactgacccagcagtctaaccatggagggatgttgcggaaacaatggaccctccactccaaaacatcatgagataacacacaacgataaacaagacacctaaatacggaaacgtgtttacaaaataacataaggagaaaagagaatgaaaacaccagatatgcactatgatctcagtggcaaggcacagagatatatatgcctgatgcacaaacatcaggactgtaatcacacatagacagttatgttagggtggtgggattatgggcactttgactttattttcaaattccgtatatgttgctattttaagaaaaattacacaattataagatgaaacactcaaataagtatatctgaaacaggtctataaatgtcagggggctggagtctgcatggctgtccgtggctttgcaccaaactgcacacgtatgcttagctgaccacagaccctcgttctcctgggcataaagtttgggggaattttcattcactcacgtctacccgccccccaggggaaatacaaacctggcatatggttgtctttcctgccaccactgttctcaagtttccccattccgtggtgacctcaacatcaccgtaaccagaaacctgatgggctgagctgggctgatggtaggggtcgggggagagccttaccttcagggccccctccccacactggcgac

SEQ ID NO: 209028 - DNA, 412 bp, Homo sapiens
tccataaaatacccaaccagcatttttccaaactgtcaaggtcatgaaggacaaggaaagtctaaaaccagtcacaggccagaggaggctgcggagccatgatgcctaaatataacgtggcatcctgaaggcatccggaaggagcagaaagggcattaagtaacaactaccaaaatcagcatcaagtgtggtcagaatcaagaatggcatttggtcaatggtaacatactgatgttgccttggttgtgacaaatgtggcaaagtaatgtaaaatgttaatggaaaaaaccaagtgaggggcatacagaaattctccgtattatctttgcaacttttctgttgagtcaatctacaattattccaaaataaaaaattttatttaaaaaataacccccttgggtacggtggctca

SEQ ID NO: 209029 - DNA, 222 bp, Homo sapiens
tatgacattgtagataatgaactagctctagccttagtttcatttaaagaaaagaaaaagacaagactctatcttcatcactggcaagaaacttggaaatcctttcccattagttgttaggttcccaggcccctactcaccatctcttccgacccagcagggtcctgcaccaccaccaacacagcacagggtttagacgaagaaactagcaggcccactccc

SEQ ID NO: 209030 - DNA, 374 bp, Homo sapiens
attttttttagagatagagtctcactgttacccacgcttgagtgcactggcatgatcatagctcactgctgccacaaactccttggtaacacaatcctagctcactgcagccacaaatcctggcctcaagcgatcctcccacctcagtcttacaagtatctgggattacagacatgtgccaccatacccagctcttatatagaatctttatatactatattatttattttagggaatattcttaagtttttaaactgcatatttgatttaacaagttttttttgtttgaaacgggagtttccctcttgttgcagtgagcggagatggcaccattgcatactccagcctgggcaacaagagcgaagctccatctc

SEQ ID NO: 209031 - DNA, 625 bp, Homo sapiens
agggctaaaaagaaatgaactgtcaagccatgaaaagacatgatgggaccttaaatgcttattagtaagtgaaagaaaccgatctgaaaaggctacacattgcaattccaactctgtaacactgtggaaaagcaaaactgaggagaccccaaaaagatcagtgactgccgaggactgggaggagcaggtggagcccaggggccttgcaggacggtgaaaccgccccgtacgatgccgaggactggaaggagcaggtggagcccagaggacttgcaggacagtgaaaccgccccgtacgatgccaaggactgggaggagcaggtggagcccagaggacttgcaggacggtgaaaccgccccgtacgatgccgaggactgggaggagcaggtggagcccagaggacttgcaggacggtgaaactgccctgtatgatgccgaggactgggaggagcaggtggagcccagaggatttgcacgacggtgaaactgccctgtacgatgctgtcatggtgggcgcatctcattctgcgtttgcttcaactcacaggatgtacgagagtgaaccgcaatgtaaactgcagaccggggtggcaacgtgtgtcagcgtaggtttattgattataa

SEQ ID NO: 209032 - DNA, 121 bp, Homo sapiens
ttagaagcaaatgtaactgtcccattaatcctctcattggccattaaatgttggaatttttccttagtatcaatagcttcaattagaagcaaatgtaactgtcccattaatcctctcattg

SEQ ID NO: 209033 - DNA, 290 bp, Homo sapiens
tttaatatattgttttggagctatgaaactggtttacagaggtagcagattggaaaaacagtataaaagtgtgcttccactgaactagaaaaataccagcctagctagggtattttaatgtgaatttatctgagacacgtcataaaagctaggctagttccaaattgcctacaaacattgaacaagtcagttatgtgacttttggcaagcaaggcttcttgtcctagagattgagttgtggctttgttttgttttgttttgtttttaatctgtcagtctgtagggaaggg

SEQ ID NO: 209034 - DNA, 141 bp, Homo sapiens
aactttctccagttctgttttcctttatgtagaagcaatataatgacttttgtccatcttctattaaatagagtcacttagacaagaaccgtctccctgaccatgaaaaatgggagggaggggattaaattctatttgtag

SEQ ID NO: 209035 - DNA, 375 bp, Homo sapiens
actttgcagtttcctttttgtatcctggagtcattctgttgttaatgttcaggtctgaaacattttcataggccctgacaagctcatagattctattctgggctttgtgcctgtaagtgcttaacaggaaagttaccctgacctagttaatcaaacaacaggcatttactgagcacctaatatctataaagtgctgtgctggagtcttcatcagattcattcattaggcagccatctaccatgtccaggcactgagtgtggtacatggctgctgggaatgaagataaagtcccctcaattcctgcctttgaggggtctgccttagccaaccaagggatggcccgaagtagagcaaattcaagaaactgtggagtt

SEQ ID NO: 209036 - DNA, 375 bp, Homo sapiens
agcttatggagtattttgcaggagcagcattcaacactgcatagattagttgtaagtgtctcaattacatttacatatcagtgtgtttggtggggaaagaagatgaaaaataaaacatttgaatataaaattaaaataaataaaatatgacatttatttatgatagatgtcataatttgatcatattcataggaaaaacattaatgaaaaatttaaatgcagaaaaatatatacacacattatacaaattaacaataacattactaccacagttacttattgaagtaatatgctgtctttaatatgtttcattataccatgttctctcagagttaacactctcatcctataaataaaagatatattctcaaattc

SEQ ID NO: 209037 - DNA, 183 bp, Homo sapiens
aatgatggaacaagcttgatttccagatgtgttgtacattttccctctagtgggaatgactggtatattttctcactcgttttcattgccctgtgcatattataaaatacttttataatcttctcacgctaatacttttattcttaggcaaaacacctatcttctaaagtgttcagacattta

SEQ ID NO: 209038 - DNA, 667 bp, Homo sapiens
ctttcaagataagtggacacaataccactgaatctgtaaacttctgatttgtatgtcattcttctctgtgagccagcgttgtcactggtttaaaaaaaataaaagctttggctgggtgcagtggctcacacctgtaatcccagcaccttgggagaccaaggcaggcggatcacctgaggtcaggagttcaagaccagcctggccaacatggcaaaacctcatctctactaaaaaatacaaaaactatctgggtgtggtggcaggtgcctgtaatcccagccttgggaggctgaggcgggagaattgcttgaacctgggaggtggaggttttgcagtgagccgagattgagccgctgcactccagcctgggcaacagagtgagactccatctcgaaaaaaaataaataaaataaaagcctcagcatgttgtcctctggcctgcgaacttgctgaagtattattccttgttgtatcccccaggctatgttgctgtctagcctgtgaataaggcaaattccatattatggaggtagtgggctgtgtgaaaagagcacagattttttatatgatgagttacacgacttaaggctaagtacctaatttgtaagtcctcatctgtaaaataagaataatatctagttcaaagagatgcgagaattataaattc

SEQ ID NO: 209039 - DNA, 488 bp, Homo sapiens
aaccttgactctcttctcatctctgtcatcgttcattctctaggtgactgttttagtcacatggccttgttaggagtcagaagcagatacccccaaatgtggtgcttttaaacgctgaactgaagaagcctcgaggtctctctggcatctccctactcctgacatctctcctcaaacctttatctgcctaagatctagacatgccaaaaggaacaattgtttcttcttcccctctctgtaagtccaagagtgtaatcacacctgaacagaaccttttccaaggaaatgtacaagttcatctctgttccctgagccactcattctccctagtaatcccctcaacagaatcgctcttccctcccctcccataacctgctccaccaggaaggtgtgtaagcttctgaatgctcttgaggggtgggcagtctctcggtggttctccccatgtatatacattaaataaatttgtttgccttttctccaattaa

SEQ ID NO: 209040 - DNA, 668 bp, Homo sapiens
aagttagaccttcaactttatctgagttttggtgacaaattaagaagagctcttattgtgcagtttctgaggttcttcaaaagagtgactttctctgtttccccagaaagactacaatgtgtggtgtgtgtgtgtgtaggtgcatgtgcacatatgtgggtgggtgtgaatgtgcctatatgtgtgtgtggatggagtacgtatacatgctgtgagtgtgtgtgtggatgcggattgtgagtgtgggtgggagattgtatgtgagtgcatgtgagtgtgtgtgtggatggagtagatatacatgcatgtgagtgtgtgtgtggatgtggatgtgtgtgggtgggagtttgtgtgtgagtgcatgtgagtgagtgtgtgtggtgagtgtatggaatgggttagctcatgcacagagcatttcttagcctacttaacagcttaggagccacctcttccaggaagccttccttaacctgtctttcgtcctgcccctcgggacccaggtgacactgggcatgcagttgctctattgctgcaggtttgcccccgactcatctcatctccaaacacagacacatgcaagaatgtgaccctcccttcccaatacaacactaggacattttattctctttgtattcctgatatctggcacacggtaggtcatcaat

SEQ ID NO: 209041 - DNA, 672 bp, Homo sapiens
ggtcatttcaagctcttctgtgtcgagctaaggagctgctctgtgcccggcttacagaactggaaggggtagccaccttccgcctgatggaggctggagaacggatggaacctggatccctggagcctgggacactacctcgctgcggttggtggtggccacagaccagtaggagggcggctggcagcgggagcttcttctgccgggctggaggattaggagaaggaagagggaacgccacatgctggaggctggagcctgtgccaccgtggctcacctcgctgtggttggtggcagctcgccttgctgtggttggtggtgacgtcggagactgcagctcggccacagtggtagaaatgtgttgggcttttgctgtgttgggcacttgctcccatctgctttcttctctagaatccactgccctagaatgagtaatttttcttagaagcagagttggaaccactgaggaagcacaggtgagccctccccagcacacactcgctagtccccaacagaagaactgttgctgcatccattgagatggactgagagcttgggatggaaatcccagtacacgatctacccctaccaacccctggctgccctgcctctccctggaagcatgctgttctggtctctcctgagacttcccatcgcagaagtctccactgg

SEQ ID NO: 209042 - DNA, 359 bp, Homo sapiens
atgcaatgtcacgtggaaaactgactctcaaatagttcaagaaggaagttctttggactatacttgcaacttttctgtaggcttaatactgtttcacaattttaaaatgtaaaataatagtaccaggtagtagttttttattaagacagattgtgctttttgaaagcattggtggaaagatttctcaaaatcatgcgcgaaagagtttataatgaaattgtgtaatatttgtttcaaaagaaagtgtgggccctgagaagcattttctgtagtttacacagtatttctgccaatttgggatactttcagtgtccctggaattctcatcatctgaatttcttactctttttccctttaaa

SEQ ID NO: 209043 - DNA, 799 bp, Homo sapiens
ctgcatctcccaaaactgtccaccgtagtccatggcatgcaatagcaaaagttacttaaactagcatcttgtgaataactgggatgaaatgccttcaaaagcaagtctttggaagaccaaatggctgctgaaatgctctactaaggcgagaattgtgaccaaggattttaagatggattagttgcttctgacggtgctgaagttcttattaaaagcttccattgtagctttaaaatatatatgtatttataactagtatacaaaactatatttatatattaatgttaattatattaatatataacctattatagctatgggactaagataattgaaagtcagacccaaattttaatcctgtgggtgcagaattacaatgttcgtagaaatcacaggtgccccaggtttcttacaggaaagtcagagcgttaaatgggaagaaatgggatcctgaaatatggaatggaaacatttggttcaccttggagaaatatgagaatctggaatgcctaaatcctcctgcactccagaaaaaataaaaaaagaagtttaagggcctgttttctatctaacttattggagaagaatgggaatgtgatcttttttaaaaaatccatctctgcctatgggcggtgctgaaacggtgcctgtgggagacaacacaaacctcgaggccagggctaaggcagcatccccagacatgggacccacgcgaacagcagcaataagccccaggaacaaatgggccgggcccacaagggtagccgccgggcaacggcgggaacaagaccctccccgg

SEQ ID NO: 209044 - DNA, 349 bp, Homo sapiens
gcggttcctcaaaaaactttacatgacaagtttcacttattctcaccttcaatcaaaagttaaaattcaaaaaaagaaacaaaaaattgtggctctcggccaggtgcagtggctcccatctataatcccagcactataggaggccaaggcccgcagatcacctgaggtcgggagttcaagaccagcctgaccaacatggagaaacgccatgtctactaaaaatacaaaaattagccaggcgtggtggcacatgcctgtaatcccagctactcgggaggctgaggcaggagaatagcttgaacccggaaggcagaggttgtggtaagctgagatcggaccattgcactcc

SEQ ID NO: 209045 - DNA, 273 bp, Homo sapiens
cacaggtgggagagacttgccttgtctcaggttgagactctggactttggacttttgaattaactcattccagcattaattcaccaacgctgctcacacttgtttcaggcagtatagcatatcacttaacaacacaggctgtggagccaaatgttgggtttgattcctggttctaccacttatgaggttccagtaagtcttaatttcctcaactgtataatacagataataatatctattacataatgtcctaactcacattgcaagaactta

SEQ ID NO: 209046 - DNA, 483 bp, Homo sapiens
gagatggaatcttactctgtcaccgaggctagagtgcagtggcacaatctgggctcactgcaacctctgcctccctggttcaagtgattctcctgcctcagcctcccgagaagctgggattacaggtgctcgccaccatgtccacctaatttttgtatttttagtagggacagggtttctccacgttggccaggctgatcacgaactctcctcaagcgatccgcccagctcggcctcctcccaaagtgctgggattacaggcatgagccaccatacccagcctgcatcctaatttatgattcctattttgtgcctggtgaacagtccccatatttaacaataatacctacacataaaacaatccactgttacaatttatatagtcacaaagcattaagtatcttctgtagaccatagtttttaaccataattttctgcatcaaatccacagccagaatccccaagatcaaaaaaatttgcaca

SEQ ID NO: 209047 - DNA, 378 bp, Homo sapiens
ccagccaaagatcaggaccactggagccactaggtctcctggcaggtgactaggctcttgtcacataggagggagggaccgtgactcctggcatgagtgaatcttcagcctctaaagccaagaactctgtcagacctcaggttgtggggagtcttccgtggaagctggagcacacggcagcttcctttgggctctggactagatcaggagaacgtgggctttgccttttaactccccatctgcctgctttacagcacacttagatcttaacatggatcaccgatgcttagaagcttcttccagggctttaaaaatctggctattgccaaatgagttgcaaaattttcacaaaacgcattaaaaaaaccccaaacctca

SEQ ID NO: 209048 - DNA, 337 bp, Homo sapiens
gtttgtagtttaagctctttcttgattcttatatgaaataaaatggaagaactagagcaggcttattcagagaatcaactgtcttcacttgtgatcacttgcataatggcaaaagtacttgatttgttatacaaatttactttgaaatttcttagcagcgaagacagagtcttaagttttcttgatgtctaaacctgataaatttggaaactcttagtcttaatcattttatctgttgtaatacaataaagtttacattttgcaactcattgaatagaaaaagttaggctttgttactacattttaaaaatgagcatgttaaagactttacttacca

SEQ ID NO: 209049 - DNA, 514 bp, Homo sapiens
cgtatgaatataccacaatttatgtatctgttcacctgatgatggacatttgagttgtttccagtttggggctattataaataacactactatgaatactcttgtgcatatctttggcagagatatacactcatttttaatacccaagagtggaattgatgagtcagagggtataagtgtcctctcctagcacttccctacacatgctgtgttcctactttaagtatcataaaaacaagtttccattgactttcttgctttattcagtcctacccgctctgctacagaaacgaagtttgagagctaggaaattgacacattcaaggttatagactgggacttccctgatttcccatcattttccccaaataattgctagtgactcagtaacaacatccactctttaagtaacttaggttaattgttaatgagtacagctagattcaaaacagttcagatttttgaagcacttaacctttttcttgcctattttaccttgcatcgtttcaaacac

SEQ ID NO: 209050 - DNA, 610 bp, Homo sapiens
agaaactatacagcctctggaggctgtggacagcatctacaatcaatggttggcctccagctgatagccagcaaaaagctaggaccctcagtcatacgaccaccaggatataaattctgccagcaatctatataagcctggaagcagattcttccccaattaaacctctagatgagaatgcagccaagacaacagcttgaccacagccttgtaagaccctgagcaaaggacccagtaagtaatgctgtatctgaactcctgagccacagctaagtttatggtaatttgttacacagcaacagaaaatgaatatatccagtgtgaagtattcatctggatccattgaaggggataaacatacctagagaagccaagccttatgatcacccacagtctctcttgactctatacaatggggagtcagtctcaatagggtcgggggttcatgagttaattagactttggctagagcaaatggcacattagaagataagagtaaaaagacagtctggagaaaataaactggtactctgtactttctgctcaattgttctgaaagcctaaaaaaatggtctacgaaaaaaattaaaataaaaacagttggcggccg

SEQ ID NO: 209051 - DNA, 389 bp, Homo sapiens
cagtgaggagatagtgcagggagaggcgcgggacagtatctgtgggccatcgtgtgccaaggagggcctgaaacaccggcatgagcacccaactgtgcagaggagatacagcgagacagcaggagggggctgggggtaggctgagcttcctgtgttcacagggagggcccatgcaccccaaatcagcctttcaaccaggctgtaacgtgcacagtggaatatgaaagctgacaaccgagccggtggtcttgcagtggctcgggggagggaagcacgcactggcccaggtccccgtgggggctgggggactgtgggccggaagcgcaggcactgcactcccaccagcagaagggttctcacagaggtgggtcggccattctgaaactaca

SEQ ID NO: 209052 - DNA, 202 bp, Homo sapiens
gcggcccagccttaagatcacttacatgccacaggctacactgggatgtttaaggtctttcatttgaaatgataaaattccatcctgagatgggacaccggggaccatatatttcatcctccttcattttatttttttattattaattgataaaaatattacaggaaatgtggaaaataggattttttaaaacccacctata

SEQ ID NO: 209053 - DNA, 828 bp, Homo sapiens
gtgagctatgatcacaccactgcactctggcctgggtgacagagcaagaccctgtctctgaaacacaaaaagaaagaaatggtagcaaaacaaagtattgaactatgaaaaatagaaaacctgagcagaccaataacaagtaacaagattgaatcagtactaaaagtctcccagcaaagaaaagctcaggacttgatggattcactgctgaattctaccaaacatttaaagaaaaactaataccaattcttatcaaactattcaaaaaaattgaagtagagggagttgatccaaattcattctaaaaggctaacattaccctgataccaaaaccaaagacacaacaaaaagcaaaaaggccagtgtcacaaattaacatacatgcaaaaatcttttaacaaaatactagcaaactaaattcaacagcacatctaaaagttcattcgtagtgatcaagtgggattcatccttgagatgcaagaatggttccacatatacaattcaataaatttgacacataacattaacagaatgaaggccaaaaaccatctgatcatctcaatagatgaagaaaaatcatttgacaaaattcaatgtttctttattataaaaaccctaaacaaatcaggtataaaaagaatgtatctcaacacaataaggaccagaaatgacatacccacagctaacatcgtactgaatggggaaaaattgaaacctttctctctaaaaatctggaacaaggcaaggatgcccactttcaccacttctatttgacatggtactgaaatcctagccagagcaattagagaagagaaagaaatacagggc

SEQ ID NO: 209054 - DNA, 235 bp, Homo sapiens
gagccagaagtaaaaagagaagacgcggaggagaccaggcaggggagctccaaaaaccaagaggtagagcccaaactgcagccgaggatcttgtgaactccaccccaatctgagttccctgagttactcctcatagtcagagtttactcaaaggcagatatggctgtactcacttccactatggtcccaagggaatggttgttcttaccagctagaagaaacttgtattagtttg

SEQ ID NO: 209055 - DNA, 336 bp, Homo sapiens
tttttttgtatttttagtagagagggagtttcaccatgttggccaggctggtctcgaactccttacctcaggtgatccacctcggcctcccaaagtgctgggattacaggtgtgagccaccatgcctggctggaattctgtgtcattctggatacttatcatgacttcaagcatccaggactctgtcctgggtatcctgagcctgagggtgtatgtgtgtccagctggcttggaggttgtctacaggcaggttgaacttggcctctgagtccatggcagcctcacatgggaaataccaccaaggagcctcatcctgtgcttttaggagatagtttc

SEQ ID NO: 209056 - DNA, 398 bp, Homo sapiens
agtgaaagctgagagtggaggagaggaggtcaaagaacaagaaggccagggtatcagaagggttatctatgtggatattgaattcgtgctcagaacctgaagaccttttctgttattttctaatgtcctttgttgctgttggactatctgataaggtttaggtttatttcttcgtcagagttttatatctgttctttcatgctttctgtttcttaatccatagtgctctttaaaatttctttggtattatctttcattccttctattgcatttctaattttaggaattatatttctattttctgagagttctttcttctgactaattttttatggcattattttctagaaaaaaattctaggttttgataattgcttgctttgttataataatataat

SEQ ID NO: 209057 - DNA, 364 bp, Homo sapiens
aaaaacagtacatggactcatttccatcagctagagatgagtctatttgcccatgctaatatttcagttctcaacttaatagcttaagatgttcccattatcaacatcacttacctacccacagcacttttaaattagccttgggaaaaatgagtaaacagaagcacagtttatcattctgccaagtgcagctacccctgaagaaggcagctttggatagcaaaacagacaactagattgaaaaacagaagtgtcagccttgacacatgctactaatttgctgcttcgtaagggtcatttgctgtgttgcccaagagtgagggagaaaacagttcaaaggtcaaggacaaatggcatttagatg

SEQ ID NO: 209058 - DNA, 566 bp, Homo sapiens
ttcatccaaaaaaatgaacaaatcaaataactttgaaaataaatgctttcactatttattactaacaaaattgaacagtataatccagaaaaattgagcaaaaataatttataaatctcaagattaaaaccaaatatggctttatgattgtattagtccattttcacactgctataaagatactacccaagactgggtaatttacaaacaaagaaggtttaattgactcacaattctgcagggctggggaggcctcaggaaacttacaatcatggtggaatggaaagcaggcaccgtctttacaaggtgtcaggagagagggagagcaggggaaaccaccacttataaaaccataagatctcgtgggaacacactcactctcatgagaatagcatggagaaagccgcccccatgatccaatcacctcccatcaggtccctccgttgacatgtgggcattatgattctgattacaattggagatgagatttgggtggggacacagccaaaccatattggtcaattaagcgataaatactataaaaattataaatagtggtcaaactg

SEQ ID NO: 209059 - DNA, 444 bp, Homo sapiens
tgagtacattctgattcaactctcctggtgtttcctttcatatacaaaggtagcactggttgtgtattatttaacttcgtctttttctatgaagtcttcgaagaactcatcctcagaattaaaacagcaagcagcaaaaaggaaactttagttacagccgaaacccactttgacttgagaataaaattaggatacttctgtaaaggacttggatttctgttcttattaggtcacagcaaaaatggtattttaaaaggctactaggagtagatgaatgatctcaatgagaaggaaaagctgacagtatatcagagagaactagaatatagcaggtttgccatttggcatggagagaaatcgagaatgtggacttgagccttgttgacttgagccatggctcttccacctaagtgactttaggtacattgttttctatatctgagt

SEQ ID NO: 209060 - DNA, 609 bp, Homo sapiens
gttgggcttgtcagagaatggcttggaccaatccagcttgaggagtagttgggtttgtcaggacttatattcagcgcactcctggacggcggcaggacagctctagagaaccgccccaccacctgtctctaaggtgcattgaagctcgttttctggctctttgcctgctgtgtttgagtgatgagactcttttccttggtgagttctcagatcctctctgggatatttgggttctgaggaacacctgctgggagacccatcccactacaagtgacacctacaaataaaaattagatgagaaactgatctgtacagtagcttgtgggttttttcctttttcctaaagctttttggtggcatgagcgacttagcattcctgagctactataacctggtaccagataggttaaatttaaatcaaagtgctgggattataggcgtgagccactacgcctggccttcctgaggaatgatattatgagaaaaacttgggactgtaatgtccccccacaaactaagaaggtgctgagagaccagaggatggctcagactagggaccaacccagtttgaggagtagttgggtttgtcagaagatggcttggaacaga

SEQ ID NO: 209061 - DNA, 396 bp, Homo sapiens
cccgttgagaaaaactgaataatgataaactcataatataatggcagcagaaaagaaaggctaggtttagtaactttttcaattaacttacaactgtaaaccagtggacacacctagcttcttcactattagaagccctaataaatctggctacagtttctaaatccaagccttcaagacaatcaaggatttctaaaacttcctatctataataggaaactgacagacaacccaatttcttcctctattttctcctgtggacatgattcaatctctcctaataattaacaacagaaactgcatcatttggtcctccaaaaaccccccactgccacttatccaaggcacaagagcaggcagcagtgttccggaagcagctggcgtcaccacaccaga

SEQ ID NO: 209062 - DNA, 411 bp, Homo sapiens
aaaagtttcagggaaaatgtgaaattttaaaaactattttgtcagtgatttgaggggtagaggaaatgtagcttgcaccaggactacagcaatgctttagagaaagttaataatgctctgagcaaaaagtgaaggcttagcctgcttcatgaagaaagtgacactaactggagccctatgaacggtcaagaggctttaacctatcctattccatctatgtttattaaaatccaacattttgtaaatgtagtagttataaacaaaatgcatggcaatttgattttcagggttctccacagatatatgtcaaattgacaattggaggattgtatcttactaaatctaaatcaccctcttacattgcaaagccaaaccaatctttctttggctcttgttccttttacacttaaa

SEQ ID NO: 209063 - DNA, 727 bp, Homo sapiens
gagcaggagggatgggaacagtgggtgtgtgtaatattacaccctacttgactagagctcctatttaaaccctggaaaagtagcctctgccaaatagacttccactttccctaccttttattttgagtgcctttaatatagtgctataggaagagaatatatatgtgtgcgtatacatatgcacacacacacacacacacacacacacacatacattccatatgttatatgtatggtgtttatatgaatgtacatacataatgtatgtgtataaatcctatagctttggaatatcagattgtaagaattctagactcttgcaattctagggctttacaatcttggaatcctagatttcaagattctgttggtatttgatgaagtaacggtgcctggggtgtggccctgcgttcagagccttttcctacagatgagagaattggggatcaggaaaggtcaaggtcacacagagagtatgtaacagagacagaacttgaaccctcatctcccaactccacatctggagctctgagtcagtggttcttaaccctgtatacacatgcacattagaatcgtttggaggggaaaaataatgcccaagcacagcccagagatgatcatttaattgatcagggctgggaaccaagcagcaatagttttaaaactcccaggtgtttgtaatgtgcatccagaattaagaacctctctacccagtgctgataatctg

SEQ ID NO: 209064 - DNA, 383 bp, Homo sapiens
ttgaatttcaacctttttttcccacacgagacagctagaaacagtaaagggaaataacttttggctctcccttcccccaccctgtggtaaaaagaatgaactgaccactgagatagcccgcagttagtggacagaaacccaggtagttcacaccgtgacctgagaaatggagagacgacagttactcaactacacacatacgacacctaaggaaatattgaagatttggtggtggttgtagatgacgggcccgtggttttttgttgttgttgttgttttgtctgtgccttgtagataatcatttttacctcagtcgtttgattttgaaaactccgaagggttcattatacagctgtaagtgacatttacttctacatggtttt

SEQ ID NO: 209065 - DNA, 1101 bp, Homo sapiens
ttgactgctcttccttttacctctctcctgttggctgttaggatgctctgctgtcccggatcactacctcttctgatgcttccagtttttaaactgctttcactttttcttccccttttgtaactgtggatgtcccacaaggccaagtccttggtgctctggttttaccctctatttcagctaattttgcttattctcatctttggtcattgctaagtccctatctgttcaccagggcttccccctcccctgagttctaagctacagatctgcttgtgacacgttccacttgatgccctgctgttccatcaaatttcctcccctttaatcctcccaaatgccattacagatatcattattcttagatggagtcttgctccgttgcccaggctggagtatagtggtgtgatctcggctcactgcaaccttcacctcctgtgttcaagtgattctcctgcttcagcctcctgagtagctgggattacaggcatgcaccaccacaccagagtaatttttgtattttttgtggagatggggtttcaccatgttggccaggctggtctcaaactcctgaccttcaagtgatcctcccacctcagcctcccaaagtgctgtgattacagaagtgagccaccatgcccagcctgttatagatatcatctttcccttagtttctaaggctcagaatcatacccttccttgattcctcatattttctccagagtcagttaattatacatcctatccatcctctttcctgtcatttcctctttttgccattgcacggctcacacacctgctatggtcccttgttatttcttcttttggaccattttggtattcttccagagaagcaggacagttaaatgtggcaatatttggactcatttgtgttcaaaatttgtgatatggattcttcccacatcccctgccccaataacaaaacttaccttataaatattcacagctttctttgctgccctctctctgacaccaaggaggaagaattctctgatgaatgagcaaagtttaaagactttgtgtttatgtgttctgggtaatggatttactttagaagagcaagaaactgttcaaaagaaa

SEQ ID NO: 209066 - DNA, 821 bp, Homo sapiens
ttgactgctcttccttttacctctctcctgttggctgttaggatgctctgctgtcccggatcactacctcttctgatgcttccagtttttaaactgctttcactttttcttccccttttgtaactgtggatgtcccacaaggccaagtccttggtgctctggttttaccctctatttcagctaattttgcttattctcatctttggtcattgctaagtccctatctgttcaccagggcttccccctcccctgagttctaagctacagatctgcttgtgacacgttccacttgatgccctgctgttccatcaaatttcctcccctttaatcctcccaaatgccattacagatatcattattcttagatggagtcttgctccgttgcccaggctggagtatagtggtgtgatctcggctcactgcaaccttcacctcctgtgttcaagtgattctcctgcttcagcctcctgagtagctgggattacaggcatgcaccaccacaccagagtaatttttgtattttttgtggagatggggtttcaccatgttggccaggctggtctcaaactcctgaccttcaagtgatcctcccacctcagcctcccaaagtgctgtgattacagaagtgagccaccatgcccagcctgttatagatatcatctttcccttagtttctaaggctcagaatcatacccttccttgattcctcatattttctccagagtcagttaattatacatcctatccatcctctttcctgtcatttcctctttttgccattgctggctgatgagttcgtggatcctcaagagtcagctctc

SEQ ID NO: 209067 - DNA, 934 bp, Homo sapiens
  misc_feature (31)..(31): n is a, c, g, or t
  misc_feature (83)..(83): n is a, c, g, or t
gactggaaagatctcctcttctccaagaaantcaaccactagtgacaatgaccagcctcctgactactccttctccaagaganagaactgatgaccaccccaattttacagcccactgaggccctgtccccagaagatggagccagcacagcactcattgcagttgttatcaccgttgtcttcctcaccctgctctcggtcgtgatcttgatcttcttttacctgtacaagaacaaaggcagctacgtcacctatgaacctacagaaggtgagcccagtgccatcgtccagatggagagtgacttggccaagggcagcgagaaagaggaatatttcatctaatgactcccaggccccaaggagcttattcctggctccatcgctaacacgttgactgcttattatgggaaagttttctctgaagccagggagaagcattgattgatgtgggcaaatccaagctccagccaggtcgcagtcccaaatgccgacatcactgactccagggaccagggacatggagaaagctgtttatgatatctttaaccaggccctcttactagagctggtgtttgtgactggccaacaagatgtggctatgccaggggacatctgagtatgtgcccagtcatcttttttcacaggttgaagggagagaaaagattttgagttaaggtcattggctgctctactctgtcccctacctggtcacctagtgatagccccagtggagatactgtccatacaaggtcttcccagaggctggataccacagtaaaaggccaggccaggaggggtaggagactatggagatcttacctcctgataaatgtgctacaccccctaatctgagcccttcctttccgtgttccccaacaacctcatgcttacgtgatttttattcaaattaaaaattttcattgctacagaaatc

SEQ ID NO: 209068 - DNA, 280 bp, Homo sapiens
catggctctcagtcaagtcttgacgctcctgcttctacagacaggatcttcttcgatgctcccgcaccggacatgcaaccttctggttttagtcctagaggattagagtagaaatcaagagagctgccgttcctcctcccttcaagaataatgatggtgggcatctggggggcaaggggctccccacaagcattctgatcaaaatcctctttgattatggggaaaagtgatgaatttgtgtaaaaaaattggagagaataaataagaaaatacagttaca

SEQ ID NO: 209069 - DNA, 149 bp, Homo sapiens
agtctgagggagctctggggtcctatttcctcttttggatgaggctgtgagcatggtggattagagacagccccttaaagtgagcccagatatctcagcaagttttacgcgtctctatttgggggagggattcgcctattgaaaacaag

SEQ ID NO: 209070 - DNA, 382 bp, Homo sapiens
tatatgtggcctaagacaattattcttccactgtggcccagggaagccaaaagattggataccctgatataaaactttttgtcctgttacattaaaattcattggcttttcactttgaatggatcttctgttcatgagtaatttcttactatttcttgctaagcaaccaacattggttgcttagaaaatactgattcagtgtcttaggatgatatttcaaatattgatatagtagcaactaatcacatttaattaatatcaccatgaatcttatcagaaactctcagaatattggagatgcttgtcaaggtttttttcacttgactgttgtctttgataacagatactattagatgtttgaagtgatgagtgcactttgttc

SEQ ID NO: 209071 - DNA, 172 bp, Homo sapiens
tctgctcaaaggacttcctttaatgtttcttgaggttcatatctgaattcttttagcttttgtatgtctgcagaagtctttatttcacctttgattttgaaagatattttcacagggtaaagaattctagattggcagtttttttctttcactgatttaaagatgttcctct

SEQ ID NO: 209072 - DNA, 287 bp, Homo sapiens
ggcagtgtgggggaatcagttgcataatacctcacctctgctttctggggtgcaaagtcttgggtaagaaacatgcttataaaatttatcatagtaacctctaggacagcctggcttacccatgatctcattgggtcccatggagacaggtgggattggtagggactcgtcccattttacaggtgaagaaactgaatctcagtgaagtcttgtccaaagccacacagtttgtaagcagtaaagcctgaaaccaaaccagatcttccgactacttctcatgtgtccaa

SEQ ID NO: 209073 - DNA, 143 bp, Homo sapiens
tcctggctcagagagagcacatgtactctctcctctccaaaagaacctggatgcccgtcccacatgttactttctccattctaagcagtgtggttccaagtccaatttagcatgaatatttcaaatgtaatatgtcccagatg

SEQ ID NO: 209074 - DNA, 573 bp, Homo sapiens
acacgcaatataaaaagcctatctctattaaaaggttaaaaaaggttacgcaattggtaacacatccattccttttctcactctgcagtcccatccatttctcattctacagtcccctcaccgctcctaaggaaccatcagtgttgagatccaacaattactttccatattttattttaaactacgcagaagccagtgtcttgtacagtgaatgccaactacggtgctgcaagagcctagaatagaggcaaacgtgaatttcaaccttgatttttctaaaacgtgccaatacaacatacttttctaaagtataaagaatggctaaaggaagacgcaaattctgagaagctactagctaaatttcaaacttttcgatttgaacacatcttttaaggaaacagggctatatattttaccatacaggttcttttgaggaatctattacccaatagaaatgttatccgatcttagctttgagagccactgctatagtaagtaaagcagccagggtgttatttgtattttcctccatttccagtactcagaacagtggccaggtggtagttcaaatca

SEQ ID NO: 209075 - DNA, 550 bp, Homo sapiens
atcttgatgtatgggtatctcagagaggtgctcacccttcccagatatagttgtttactaatatgggaaatgagaacttcatacaagaatgaaataaagtaattacaaaaccaactgtcagtgtcagatgtgttgcaaatgagtgacaaggaatagcggtgctgttctacaactccactccgaacagcattcttatggctcagaacagggagactacctcgtgagatagtggtttggtctattactagactcttccttgggtgctgtaaccgtggtctttattaactgacggccatcttgggccattggattgatatcccacattgaatgtaggacatcttgcctgtcattgacagaataatggataagggtcagacttttcccccagcatgttctatcccatgatcctgtgttattttcttcctaacccttatcactaaataaaattctcatgtacatttatttaatttacgtatacgttgacttgactcttacatccccaagctagaaccgtggagcagtccctggcattcactagggtctcaggtag

SEQ ID NO: 209076 - DNA, 536 bp, Homo sapiens
cacaactccaaatataaatgggaaatcttaaaatcttggggatttcctagaaagaaaaagaaacagaactttcacctgacatgaacaacattggatcctggacaacaatgaataacataacatcttcatagttagcaaggaagaaaagcttggtacaatctaaaccctgccgaagtaccagttatttgtaaaggcaatcgtagggcattttcagacatacaagaacttggaacatttactgttcatattccttggatgacaaaattattcaaacatattttccagcaaaaattaaaggagggtccaagaaaaaggacaacatgggatacaagaaattgaaaccccaaagaagtgaaagaagccagcaagagattaagaggattcatcattttcagatgcccaaaaggatttccttggaccaacatttcaaatggcatgaggatttacatttattaatattccctggctccagtcatattaattggttctttttttaatgggggttttccagtaaaaaaaaacaaaaaacaaacaaa

SEQ ID NO: 209077 - DNA, 689 bp, Homo sapiens
tgtgaccgcacacctacacacacacacattccaaactgtcaagtgtcacctttcttgggaatttttaaaataattttctttttacctagcagaatcaaacattttttaaagttcctggtggtatgaagaacacaataaaaagtggcactttgatacagttaatagtggaaatacaaattagcaaagcctttctagaaggcaatcagtaatatttatgaagaacctcaaaaatatttattttccttaactaagaaatgaccagaaatttatccgaagagaaataatcaaggattatgtataaatgttttcataaggaaaatccacagaagcactaattataatttaagtggtttacaactataatttgaaaacccagaagtcaagatgtggggaatatgatagtagcagcaaacaaggggttagggtagaattcaagataggttgtcagtaaggaaaatattctcacttgtgtctaccttgaaatagaccaagaaaaaaatgaagatgctaataataatttgatcagatgcttattaaaattgtgagagttatcaaatcatggacagtttctgaaactgtaatgccttcagcaggtctcccaaagtttgctagactgtatactctttgagtgctctcacagtgccaggaacatatttgttcctcagtaaatacttgttctgtgaaatcca

SEQ ID NO: 209078 - DNA, 368 bp, Homo sapiens
atggataaatacaaagttggaagggaggcattgagatggtcagggaagttacttttgtgcaaagacgtaaaaggagaggagacaggtcttgtggaaacctggggttacaaagtgttgcctgcataggaaatagccagtcccagaggctagtttggtccattgtgatgaaagggttgactgcttgctgtgctagtgccctgtagtgggccaagggcagaagcatggagacaagaggctgggacagtgatctggatgagatggaatggtgatttgaactaaggtgctagtagttgtctttgattctggatatattttaagtatcgccaacaggctttgctgatggattgattgcatgtgggttgagggag

SEQ ID NO: 209079 - DNA, 174 bp, Homo sapiens
aagatggtttactccctttgagttttattattgcaatctataaaaaaggaaatataatacctaactaacacctggttctctgaagattaaatgggactgtgactggtatttagcaagtacatgggctaaacatttttgccaaagtcattagagagaaaaatgtgtgctttctgt

SEQ ID NO: 209080 - DNA, 354 bp, Homo sapiens
caggttgtccccagggacacatttctttcaagtaggatgactggtatgtttagactgaaaagctgatttactggaagattgctatcaccccctggcctaccatgtcgttggtgtggccagtgtttatcagacagtggtgtttccagcttaggcctgaatggaagaagaaactgaaagaagaaataaaaagagagatgcgccgggcatggtggctcatgcctgtaatcccagtgctttgggaggccgaggtggcagaccatgttggccaggatggtctcgatctcttgatctcgtgatccgcccgcctcagccttctacagtgctgggattacaggcatgagccacctcgcccag

SEQ ID NO: 209081 - DNA, 381 bp, Homo sapiens
aaagctgatctagcaagtatacaattgatcaaatatctgagaatctttaaaaataataactcattggtatactagagactaagattgtaaaaaaaaattgagatgcactgagaacattcttcatagtcttcacttactctgatagaataaaatgctgcaagagtacaaagagtgccatatagttagaaaggttatcacttcgtgatacagaatagaaaataaatcttgcctatgatgagaagttctgagaacagatgccagcttatctactcaacatattttacaactttttttttttttggtgatttctgccatcctttttttcccccaatagagtgttaaatactattgattgtttctaaataactaaattagccttga

SEQ ID NO: 209082 - DNA, 1000 bp, Homo sapiens
  misc_feature (3)..(3): n is a, c, g, or t
  misc_feature (76)..(76): n is a, c, g, or t
  misc_feature (79)..(79): n is a, c, g, or t
  misc_feature (203)..(203): n is a, c, g, or t
  misc_feature (206)..(206): n is a, c, g, or t
gtnagagcaggcgtgaaagagcaagacacagagagagagagagaggagagacagagagagagagaagggggttggnggngggagagagagagggagagagagagagagaggagagagagagagagagagagagagagagagagagagagagacattcaatcagccctcaggaactctagcccctcacctaccatttgactgcnacntcatctctcctataccttttccggcctggctggagtcatcctcacaactgctgatactctcctaattccccactagctggcttcgcatcgatgatcaggcacccgtcagaatgactaatcgtgctgctcactgcctgtcggatgttcatccaagtcttcccctgccattcacagaattcacgctacagcatctggtcaccattacaacgtgcaagccaagcttgcatgctttgatgcacaagccaccatgttgaagaggatcatggagtcaagaactgactgtggctgaaggccaatagccatcaagaaactgaggacctcagtccaacgacccatagaaacaggaacctgccaacaaccacccattgagcaacacctcagatgaaaccttaattgcaaccggcaagaaatcttaaagcagtggatccaagcaaagcctgcctgcattcctgacctacagaacttgtgagataatggatgtaggttgttttaaagagctaaattttgtgatagtacgttacacattaataggaacctaacacaataacaatcaaacaaattaataagaattcaatatcatagatatctttttcttttaataagaattagatattctacattttagcaaaaggtatcagttgcttatgatcatatgtgtgtgaagggacaaagtgtcttagtggcccactggaagtaagaatagttccctgaactacaataaatgccataatcagtgtggtttcaattgcaatatgatattccaaaaaggacatttcataaagttttacaatttt

SEQ ID NO: 209083 - DNA, 1098 bp, Homo sapiens
  misc_feature (940)..(940): n is a, c, g, or t
  misc_feature (1024)..(1024): n is a, c, g, or t
  misc_feature (1039)..(1039): n is a, c, g, or t
  misc_feature (1059)..(1059): n is a, c, g, or t
  misc_feature (1079)..(1079): n is a, c, g, or t
taagaaactcccccactccacccctgccaatgaggacgttgcttagaggtatttctatcagtgttgagtagaagagatcatttcttgatgttgaatttcaggtaaggatgccagcttctgcatatcagggtggtgatgcttgggctgagacaggtctagacagcactgtctgaaagggggctcaaggaagtagctgtgaaaggcccctgggatgttttctgctccccttcctgcaaatcccctggagggagatcctgttagtcactacgggatgtgtgtgtgtgtgtgtgtgtgtgtgtgtgtgtgtgtgttcatcacttgttgcttgggtgtgggaagagacaacaacaacctacagaatccagagttctcagttcatctcccatcctagtccaatcatggcctaacatccttagctaccgatcgcagaggagactgcgcatttgtgttcatgtggccttggatgttggcagattcagattggtgccccagacatctgtgcctgtaactgcagtttcagcgggctcaggaccaggctaaagggcctccaagcttcctccagtttcctggtgcatgcatgtgcaatatactcccgtggcctgggtctttcctgccgcttcttgccagttgggtcagaactagcttattaaccagttttttctgagctttaatcgaactggctccaaccagttggagacttgaaaagggctacgtgatagttatagatttttaaagatatattattattttagagtagtattgagtgtacagcaaaatggagtacagggtccagagatctcatatggcctcaattcctgtacactctcaggtcactccaccaataacctcctacacctctctttccttcttttgttgttggggtctgtgactgcggatataactgacggcaacagtgaacatctcaagccgggacaattcnctcattaagcccctaccaaggggtcggttccagctctatgcccctctgggactttccagggcagcactatgctcacggagccantacgtaccgtctganccctgaccagcgcagaagangaggggtctatcttgggaancaccagcccgttgcttcct

SEQ ID NO: 209084 - DNA, 350 bp, Homo sapiens
ttgcagtgagccaagatcactccactgcactccagccggggctacagagcgagagactctgtctcaaaaaaaaattatatattttacctgagtaaggtgctcagaccttatggtgtaaagtccagtgagtttttataaacagatgcatacatctctgtaaccaacactccatccaatctatagaacgtgttcatcaccagagaaagttcccttttgctcttttccagtcaatcctccacttccttgtcttgagaaaaacacttgtgttttctaccaccatagcttaattttgcccattttagttttcatatagatggaaccacacagtttagattctttttttttttttg

SEQ ID NO: 209085 - DNA, 299 bp, Homo sapiens
cattggtgaggagtgttttacttccaactatgtggtcaaattttacagctgggtctccgggggtgacatcacatgtcagcaggttccatgatgcccctgagccacaaaaccagcaagtttttattagggatttcaaaaagggaagggtgtatgaatacagagtgggtcacagagatcacatgcttcaaatggcagtaaaagatcaccaaggcagaagggcagagcaaggtcacaaggccagggcgaaattagaattactgatgaggtttcatgtcccactgtgcacacattgtcgttga

SEQ ID NO: 209086 - DNA, 172 bp, Homo sapiens
aaaatgttgctttacaaggaagttaagtttaaaagtagaaagcaaagaactgaacatactgacatattgattctttgaagaggaatttagaactaatccatccatccatctacccattcgtccatttacccaaccaccaatctatctatttgcccacccatccatccaccct

SEQ ID NO: 209087 - DNA, 795 bp, Homo sapiens
aaatgagtgcaatattgtcccttcctccttgtcacctacttttattcctcttaccagtttcttttcgatcacaaggtagatattctaggctagagtcttatataactctcttaccattgcctttcaattctaatgaaattcatttgctcatccctttaatacatattacttgaagccctgttctaggtgctagggataaagaggaaaacaaaactgacaaaaacgctgcattcataaaacgtgtattctagtagttgagagagacaataaagtagataaataagtaaactgtatagactttgttagggttaaagaaaaacaataggtagggtgcgggacatggagcattgtgttggagtcttgcagtggcagaacctgtggtcggagaaaacgtcgaggtgattttacctcgggaaagtgagggggtgggaggagtcacataacatctaggagaacattctaggcagaagaaactgaaaggaaaaaggcccggagtgagaggcccctgaggtgttctaggagtagtgaggctacaatttggtaaataagatcatcccatgtttaagtatgtttttcctctgacatttggaaccagcactaatgtatgaactgtgtatgtttttacaaagagcacgcctccgtgtgtgtcattatccccatagcatttcctccctgttacctgtattactaaaacctactcaatcttttaatttaataagcctgtcggaaaaacccctgggcacttggggcacaagggataacacttgtggaaatagaacacaacaatagcgcccc

SEQ ID NO: 209088 - DNA, 499 bp, Homo sapiens
atggtggtggtcacatgtagtccctgctacacaggaggctgaggcaggagggttgcttgagcccagtaggttgaggccgcagtgagccatgtttgcaccactgcactccagcctgggcaacagagcaagactcaacaacaacaacaacaacaacccctaaaactgtcttgtagttgactcgtcttctccctggaaagtggatcttattggtctcattctctgagagtgtcttctccttgactcctaatgtttgatcttttttctctctttcatgcctatagttttgagattccttggctgcattcagtacatgagcatgaaaaacaaataattgttaagtaccttcctcctttgtgcttggctttctgatagggtcatgcatgcttttgttcttgaccgttggagcacactgtgacatgggtactgttatgtccccattttacagttgggcaccctgaacccacagagggttagcaatcaaggtgtatctgggatttga

SEQ ID NO: 209089 - DNA, 495 bp, Homo sapiens
agcctgttgaagagggctcctgccctataaaatgggaggatatgccattgacactggagactaattaaatgctatctcctggagttataagaaatagggaagttagtaaacactggaattaaagaagttgtgaacagagtgtgtaactgctagcactttgataaatcttttctctaaaataaaactcttatacaaccaatctgaaacacaggagaaagattctgggatccagagggacacagcgagattgaccctgagttgaccatggctgagcgcagaagccaaagtgagctggcttttaatgtcagaacttagtgatgaaggttccccacagagaaattcagtacattcccaaccactctagactatgttcgcattccttataaaatatgataaataataccttacttacttgggttgtcgtaaggattaatggaattgtatttgtaattatttctagcacaataaatactgatgtgttttcttcttcttaaa

SEQ ID NO: 209090 - DNA, 505 bp, Homo sapiens
aagaggaggaagatgtacattgatgccactttgagaagaagtggactgtggtggatttgtaatgtatcagttttgccaagctgaatgcacatttcccagatttgccatctttagatagctctaggttagcctgggcaacaggagacacttggaagatagaattcgagtggctgttacactcttttgtatactgggaagggcgttgttacagctcaggcatgatcttcagcttccctgacccttggactggtgggtgttttgcttcttgatctaacattaaggttagaagttgcaggattccagcagggttttgtcacatccaatctggtttaagttctcatattattaggaaagctttagggtgcttcaggaaaacgctttttaaaaaatcaaatttggaaaatatcaaatggaattataggcaataagcataacccagtggaaccatgaatcaaaccctctagagcagggttgtctaaattttggcttccttgggccacactgg

SEQ ID NO: 209091 - DNA, 426 bp, Homo sapiens
ttgcaaaattctaaacaagatgattatatgtatatagttactacagtaggagttattaatctagggttcatgggaaaaattcaggggaggttcgtgattttggatgagaagaaaatgatatcttttttaatggaattctaactgaaatctagctaaaggtaggtaacaaatcacagtagtattagcagtaactaactgactcggtcaccagtaggaatcatctattttcctgtcacattatagttggtgcagatacctctaaatatcatttatgctcaccactacttcaaaatttcaggagttaggccaggcgcaatggctcacacctataaccccagcactctgtgaggccaaggtgggtggatcacctgaggtcaggagttcaaggccagcctggccaacatggtgaaaccccatctctacctg

SEQ ID NO: 209092 - DNA, 262 bp, Homo sapiens
tttgagtggtaaaggccgattaacactcagcgcggtaacaaagaccaggtgggctaacccgaaatgaaatgagaagcctgtggtgatgaggaggcagagaagtaaaatcaagtttgagcatttcgtttaggagagtttgggctctgattacttgcacatgcaaacgaactggaaacaaacagatcagatgtctaccacttcttcgagggaattgcattgccaaagaagtcatgaaagcagactctatactgattaggcatta

SEQ ID NO: 209093 - DNA, 312 bp, Homo sapiens
agattgctactgcactccagcttgggcgacagagcaaagagttcgtctaaaaagaaaaacaataataaataaaagttgtgtttatactatattatagtctaataaatgtgcaataacattatgtctaattacattagacattgcatacagtgttatgcaatgacattttgtctaaaatgtaaataccttagttaaaaagtactttgttgcttaaaaatctgaacaatcatcagagccttcggtgagtcatagtcttttctctggtggaggttcttgcctcagtgttcatgattactgactaataagggtggt

SEQ ID NO: 209094 - DNA, 141 bp, Homo sapiens
agtgatgaaatggtagtggagctcattgagaagaatttggagacccccttgtgcaaaaatggttttcttctggatggcttccctcggactgtgaggcaggcagaaatgctcgatgacctcatggagaagaggaaagagaag

SEQ ID NO: 209095 - DNA, 597 bp, Homo sapiens
accccaaaaatagccagaccaagaagtctaccaaacatttaaagagaattaacaccaacattacacaatctcttctggaaaaaggaaaaggaaggaatatttctaagctcatttatgaggccagtattacccctaatacccaaaccagataaagacagtacaagaaaaggaaaactatgaaccaatatctctgatgaacttaaactcaaaaattatcaatgaaatattagcaaattgaatccaacattgtataacaataattatgcaacatgaacaagacaacattgctattctcacattttatttaggagtatggatgagggtgagagggagggtagggaagatacaagcagtaaacaaataagtatccaaatgaatttcagaaataagtgtcttgaagagaattaaactaagcaatgggggttggagaatggagaagaaggaaacttttgagaaggttacacttaaaccgattcaagaaggagccagcctttcagagatctagaatcttctcaagagacaccattaatgaaatgaaaagcctagctacagacttgggggaacctggaaaaaatattcacaaatgccaaaagtgtg

SEQ ID NO: 209096 - DNA, 508 bp, Homo sapiens
agttgtaccattttacactccttccagcaatgtatgaattttggtttgggagcacatatatttaaatcaggaatctgaaagatcgatttcaccatagtgtaaatggatggagtggaaggaactgaaggtaaggggtcaatgcaggagtccacgcatgagctactaagggtctgcactcaagcggccacacagggtgagaaacgaatgagctattttgggagtgaaatttaagtgaaattctatagaaatagaggaatcaaagttatctcgatttcaagcttgagggaagcctctgttggcggaaaagatgggtttcttctggggtgtgtttacagtgaggggccatctcactggcaatgtggaagaggtcggatctagagaccaatctaaaagtcacctggctagagaagacaatcaaatccagaagttcatagaacaaaataaaggtgaacatagggcagctaaagcctaaacattttgtaattagaaagcagttagggtgtgttaa

SEQ ID NO: 209097 - DNA, 248 bp, Homo sapiens
ctgcatttagaaaggaggcggggtcagaggaatagaaagggatagggctgaagaacacaggtcgctgcatttagaaaggaggcggggtcagaggaatagaaagggacagggctgaagaacacaggtcgctgcatttagaaaggaggcggggtcagaggaatagaaagggatagggctgaagaacacaggtcgctgcatttagaaaggaggcggggtcagaggaatagaaagggacagggctgaagaac

SEQ ID NO: 209098 - DNA, 641 bp, Homo sapiens
ggaaagaaggagagaaaagagaaaagaaaagaaaaggcactatctatgccatatgcttttgtgagactatcaaggcctgcatgcaaaaaaacccagtgcagagttggtggtcaattagctggagtgctttattatttttaataatcagccatgcttagtgggagtctctgaatctgtagttatgactgtagtaaatgggacacaaagggagcagctggacataccggcaagtattataatgtgcagacaacctgcaaatatgaaccttcttttcaaataagaatctcagtgctgtcactatttgttttaggaagtgctggttttaactgaatgaggaagttaaacgcatgttctgttttttgttttcattgcgcccacatgggttgactgtgggttcggttttctctccagattgaacacttagtacttaatgggggaaccaccttggaaaagcagaactgatttgaggtggcttcatccctctcttctcccaccagaaagagatgggagcttccacttcaacctggggtgaagacagagaacaaggtgtcccagcattttgcacagaaccaaagccctggaaattctggtggaagctagacattcagagtcatcaagctaacagtcacttcctgctatgt

SEQ ID NO: 209099 - DNA, 555 bp, Homo sapiens
acatgttaaacacttgaagacttatattttgtggtaagaacatttgaaatgtatactcttagcaattttgaaatatagtataattcattattatcaactgtgatcaccatgctgttcaatagatctcaaaaaacttatttttcctatctagcagaaattttataccatttgaccacatctctccatttttcccacccccagccttttaaaatgttttttatttttaatatgtctgaggttgggcatattttaatgtgtttaaagcattcatatatatatatacacacacatatatgtgtatatatatatttctttaaattagacatgtattttgtttgcctttttttatttaaaaattgcttttaaagaaattatttctatattaagaaaattggtccattgtcatactgggttttgacttttggggttttttttaaacatgcagaatctatgtaatttttacattgtcaaatttatctatataaatatctattttatatctgctgggtatttttttgtattgattaaaatttccttccctcctccaagataata

SEQ ID NO: 209100 - DNA, 697 bp, Homo sapiens
cttattcccagtttgttccagatactgtctactgacagtgatcgttcttttcttggttatgatataaggaagtagataaaagattttagtttgggtttttcattgggttctcatgttctaaaataaatgaccaggaatcaggaagccaacaaaacaaaaaaaacagtccacctgtaaatattacataactcacaccttccatacccttaccctcatataatttaatgttcatttatttgccttggtttagtactccatatagaaggaaagaacacatgctttgttttggtgggtcgttaaattttttcttcttcggaacatgaaaaaggaaggaaggaaactgtattcatttttgtctaagcaaggataatggcctgttaatgcaaataaatggaaaatattctccattatgtcttgaaaatttgtttttcttaagttttattacagaaagttttagtgctatcaaaaaagatttatatggagtacgtttggcttactacctttcattccccctctaagcaagacatagaaaatttctatattaatttatatttggggattaggtttgtttcttaggagaaaagggatcatttcaaagtttgatagtgtcaaagaagaagtttcctatttacaagaaggcatgcggtgtggcatttaattgtgtgtgcatgtgtgtgtgtgtgagatgtgtgtagga

SEQ ID NO: 209101 - DNA, 436 bp, Homo sapiens
ttgggaattttgccaatctgtatgcaaaaatggagctttgtcagctactctgtgtttatgtacagagctatgtcagctactctttgtttatgatagtcttcggtgaattgcactaatcaattagttattgatcatgagccttaaaattctggtacagtggaccagaaggcatgcgcttttcttttgagagaatcaaaaggtacctggagaacatttactaggtggcttggaaggggatctgaagatattctaagaatagcaagaaaaaataataatgctgtaagtaaaaatgcagcttattgcataagagatactgagattttcacaaattacataatacattttcaaatatatttgaatatttttctgatttgtgcatgcctttgttgtactaaaataaacatgtgctgtctaaggtattaaatccaaaaattac

SEQ ID NO: 209102 - DNA, 493 bp, Homo sapiens
atgtctgaacactgcttccaaatgacccctgaaaacacaaccacatcctgccttatccatcttaacctacagttacagcacttcgtcaaacatacttagatttctggaagaatatgcagcagtgcatattaacaggttttcttaactgccaatttaaaagcatatagatttatgtttacccactctgatgaaaggactcacaagcagagaaattgcaggtgataaaaatgtgtgtactaccatgcaccacacagtagaatttaagctttctgcatcaaattattgtccattcataggtatttttgtcctcaaattgtagcttggaggaggctcagttaatgctatcgctgaagtgtgtgttgagaaaagtgctctaaatgattagaatttgagcttcccccaacccagcttggacatgtgacttcacctcctctcgtatgcacaaaacaacctagggccggagaatccaatctgtcagtgatgtccttgtagt

SEQ ID NO: 209103 - DNA, 121 bp, Homo sapiens
caccttagattacagaggaaaacatttcataaagtactccttgtacagtcaagaaattttagaaccaacagaaacatcaactaccctgaccttttaaaaaataaaaaagttggccgggcgt

SEQ ID NO: 209104 - DNA, 320 bp, Homo sapiens
ttattaactcactatagattcatggaccaaggaacactactgagagggccacattttttggccttggagcaattagggtaataagaaatcatgggttcttaagctctgttttcttttaacagtcaccagcctagcagatgtcatcactgactctgcttatttacatggtagggaaaaaatgacaaatatttaactgctttacactctggtatttaggtttgtacccagtcttgaggcctttaggcatttccttagcaccacctttttatcatataatcaatcaagtacatacccaccaatcacaccagtgtttgatatat

SEQ ID NO: 209105 - DNA, 656 bp, Homo sapiens
aggtattcacttaacaggcctgttcagtatggaagacactatttatccccctttaactctcgccaaaggactataccaactgcatgaaagtgaacttttacatctacttaaatggtagatggagcaccttgatcactatgtgacaaccttggttgtcatttttagttgctatttgaattgatttgagcagccctatcttcaccggacatacctgaatttgttcctaggtacccactttgttcctagaaaagggctaactttctactatggtctgaagagtgttcaaagtagactagagcttgggaactcctaacctagaaccatctgccatcccacaaagtgattagatgcaaaagggatactagtcatacctagtgtttctctttctgaaaagagaacttatcctaaaagtagccatgggcctgggacaaagtagccctttccacccccaaaatgattattagattgacgtgagtccaagattgtggagttttttgttttttgttttaaaacagataccaagaataaatgaaacctatttagggattcattctctaattaatagattctaagtaatagaatcggagagagactttttcctctaaccaaactgccaaagttgtttttggctaagaatttcccaatgatctttgcac

SEQ ID NO: 209106 - DNA, 837 bp, Homo sapiens
atcgggcgcaaagttgacagccatcagcaccagaagatgcagttcaagcctgatggggtcacagtgggcacagtcctgggcctgaccgcgctggccgccaccattgccgtggtggtgggtggtgtacctgattcatattgggtgctccaagaccaagagcaagtcagcactcatcacgttctacctgtatgtcatcaccctgatgaagcttatgggggctgcggggctggctggaatccggatttacaggacagatgagaagtcactggatgagtccaaaaatccgccccgcaaactggactcggacctcttggtgggcactgcctcaggctcctggcttatctcctggggctcaatcttggccatcctttgtgccgaggaccacccccactacacctggtacaacctgccctactccatcgtggtgatcgtggagaagtacatccagaacctcttcatctttgaatccattcaccgagagcctaaaaaactctctgaggacatccaaacccttcggatggtcacagtctgcaatggcaacaccatgccccttgcttcctcctgcctcaagagtggaggtgtggccggagacgtggctccctggggcagggacatgccaccagcagccaatggaaatgtgtgcctgagagaaagctgtgacaaggaggagaagcacgaggagagcagctggggagggaacccaagcccagtccaccttcctcgtttcttacagggcaacgccaagagaaaagtcctgaggaatattgcagccttcttgttcctctgcaatactttgctttggatacctcccgcttttggctgtcgacctgagtatga

SEQ ID NO: 209107 - DNA, 364 bp, Homo sapiens
aatgctgggattacaggtgtgagccaccacacccagcctataactatttataaaaagttattaaatcctgttcttgaatttctaattattccaaatgacttgcttcattaattcttgtgttcttcttgaatggcttattttgaatacgtcatggtaactctctgaagccatagattagtagtgtgaatgattcacaagttaaaccaaaatgatccttctcaagcagatgttcatcttttagatgtaaaggaaaaacttaagaaggagaacttttatctcagcatttctgtaagaagttgactgtgtggtcttcttgacctttaaatgaatttttatttaaatataaccattattggatatacac

SEQ ID NO: 209108 - DNA, 229 bp, Homo sapiens
agacaaagaatcgagctcggtaccgtcagacgctgaactatgtgggacagcagaaggtgctcagactgaggggccaggcaaatctcagttgaatctcacttctgtacccactggctagcaagtcacctctgtgagccccaactgccacacctgtaaagtgggcctagtaagactcactgcatggggtgactgcaagtgtctcccgatggcacatagttcagcgtctgac

SEQ ID NO: 209109 - DNA, 900 bp, Homo sapiens
aattaggaagaactgtaggggtgcacctccccgaactttgccaactttgcctctcctgctctgtctctaagccttgtctctgtccttggtcggggccctagctcctagaacagagagtttggtgaggagacgtggaccagtggtcagagttattttgttcctgctatgggcttggagcctgggaaggctgggtctcttgtctccttgccagccaaaagagggtgcttgtcctggtgggaaatgagctgccttcatgcctgtgtccctggaaggatgaatggatgagttagtgtcctgggggtgagagttcagcattcgggagcagtactccaggcactaaattgagagtccagacatgatcaggatatggtcttaaccactcacaagccgtgtgacactgagcaaattacataacctgcctgtgcctgtttcctccactgtaaggagacatggagatgagcagttagcatgcccggtatgatggcggcttttctgctcacttgggggtagtgttcttatttctcactccctcctccaccccgtccacttcttgctttagagacctccgtcctgtgagctcccgagccgtcctgtgtgctcaccttcctgtgtgcactccttccttgttatctcacagcgtggaaacttttgttcttggcagctgacaattcccaggggaaacctggtgggtattttttcaagttctcaattctcctcctcacagggagggtttcccctcagaggagcccctcacctggatcttcaccccattatctttcttcctttgtgccctacctgggtgctcaaggtgtacgggagaagacaggtagagctgtggcctgggggtacagaagggtctgcagtggagggaggctgggaggccctggggacaaggacagg

SEQ ID NO: 209110 - DNA, 583 bp, Homo sapiens
gattggattaaaccaataaagtatgaagtaaagtaaaaatgttggaggagatgcaaactaagctgagtcaggtttatgcaatagagtatttgatgagctgcagaccaagaatactttctaaactggaacttcattatgctgaggttgcagagatgaatgagacttgattcttgccctcctaatatggagatagatatgttaaacagaaagttatggtgaatgaagtttctgaactctatacaggtttagaggaagagataatgcattctattaatatttgaaggaggtggggaggtaacacagggaacaactaaacctcgttttgaaaaatgagcatgaatttgccaaagagctaagagacagtccaggctgagggaatacaatgttcaaagacatgacagtgtggcaagattggcatattcagagtattggtatattgcagaagtacaaaatacaggaaggatgtaaggagtagagaaagatttgctaagacctaattatgaagggctttgtatgctgtgtcaggaccatgaacctgatgcagcatgtgggtaagccactaaagagtgttgcaaggataaat

SEQ ID NO: 209111 - DNA, 525 bp, Homo sapiens
gacggcttcaacggaactttgtgtccctttaaaaaaaaaagaaaagtaagcttaggatatctattagtgttcactgttcgggcaagaggcctaaagggaagcaaattatttgtttgtggttttaaagtggccagaatgccttcaagcacaagtataagaccattagcaaatcacaaggaaccaaagcagttcatcttactcaacaaagctatgatcagttaggaacagccaaactgaatgggacttgccctgggccggaaggtcagtaaaccttagcagtttgtgtttctgagaatcaagaggctcttcgtcccggagtgcaggccataagtccacaggttctgctgtcatgtttccaaaaacattcaggacaggtgagagaaacgaagcacagtgcgtgtgtgtgcgtgttcttccctttgtctttagtcagcacctctaagtcaaaccatccccacttttgctatatacagactaactagaggagaacccaaacaattaaaaagttccgtttaagccgtttat

SEQ ID NO: 209112 - DNA, 493 bp, Homo sapiens
aaacaccattgaagagcctaaggggttttataaacctcaaaatcagcatcacattcatatacacatgagtactagtcacatatagccaagtaatgtgcgttagaccagggggtggcaagctttttttgtaaaatgtggaatagtaaatattttaggttttgcaggtcaagcgctcgctgtcaagatgactcaaccccatccattgtagggtgaaatgactgtggctgtgtgccaataaaactttatttatggttccagttttagtatatttgctgctgaagcaagcacaatttatggacactgaaatgtgaatttcagataattttgtatgtcctaaaatattcttcttttgatttttccaactacttaaaaatgtaggaaaaaagcattcttagttcatgggctgtacaaaaacaggcagtgagttggatttagcccatgggctagtttgcccactctgtattagactcagatgtttggactcatgtcttta

SEQ ID NO: 209113 - DNA, 483 bp, Homo sapiens
ttttctgtgtttagatatgtgtagatacacaaattataaatagtactcagtatattgacatactgtgcaggtttgtagcctaggagcaatagctagaccatgtagccttggtgtagagtaggccataccattgaggattgtggaaatgcactctgtgatgtgatgtttctcacatggatgacattgcctttcacagaacgtgtcctcatcatcaagcaacacgtgactgtactaattttaaaagtatttgcttcttacaaatagtgaagtgtttgcagatagcatggtttatacctagaatttgcttcagaatagctcagtacaaggaagaggtgtgggtaggaataaagatgaaatagatgtagccatgctttcataattagtcaagctatagcgataggtgcacagggttcattcttctaatgtctacttttgttgtatgcttgaacttttccagactaaaagataagcaaaaaaaaaaaa

SEQ ID NO: 209114 - DNA, 369 bp, Homo sapiens
aaaggttagcagaatgattaaaaaatatgactgactacacactgtccactagaaactcagttcccacataataatataggaagattgaaagcaaacagatgtaaaagaaatgccatgcaaacacggattaaaaaaaaaacacctcaaagtagcaacatcaataagataaagtagatatcatagtagagaaaattaccatgaacatatagggacacagcataataataaaataatgaatatactagcaatacataggaatttcaaatatgtaccaaaaaagttacaaaatatgtgaggcaaaaactgatggaactgaaaaaggacagaaaaatgagaattctaatcaaagatttcaacagttctctctca

SEQ ID NO: 209115 - DNA, 527 bp, Homo sapiens
taacttcatagagaaaaattcaatgaacccttggaagaaaatatatggaagtatggttactgacttgggaaagaagagaaaggtacaatgtaactgcacatagaagccagtcctgaaaagaagcaagccggctgaagttatctgcaactcagaagcacttggtaccacccaaggggagataagaggagatctcatcagaggtgcctgaaaagcacctcagccgaaggcctcacatagagagacctaagaatgaaggcacctggactaggaatgtgaatatgtgaaagaacatgaccggccaggggccctgagttattgaatgcaacccccttcagacactgcaacgcacaggctgtgcaccaagcctagtatgggaaggacagcttttcttcatgaggcctgccaggtaaagccagctatgaaacaggaagttgaccttcaccagacactgaacctactggcaccttgatcttggacttcccagccttacaaactgtaagaaataaatgtctgttgttcataagcca

SEQ ID NO: 209116 - DNA, 618 bp, Homo sapiens
cttcagagaagatgaacacttaacatgaatttaggcaagtaagaagttgagtttagcgaaggaagctgcagtcagaagagttcggccctatacgtagacaggctagagaagccaaggtcagaggttcaatcaggcaatcagacagacctaacaacgtggctcaagagagagcaggggactttgcctgcaaatgtggtttatgctcttcccagtctcccagctctttttgccaggtgcctctgcagccagaacaagtttagagacttatcggtgagccctcccttcccccaagagactgaataagcttcacttttacttttatcccagaataatatacatgcatccttctaacaaacataggtaatgagcacccatgtccacaagtagatgtcatggagaatgagacaaataagtgatagacctgtcccttggaaagttgacagtcaggaaggaaaaatgagacacgtaagcaccactaagtaaaacacaagtttcgacctggtacatgccagatgggaataaaggcaaagtgcctgggtcatcttccaaatgccatcatcctcttgtgtccagtctctgaagaaggtcctctgaccttggattacatgaccatctata

SEQ ID NO: 209117 - DNA, 338 bp, Homo sapiens
ccgagaccgcaacactacactccagcctgggcgacagagcgagactctgtctcaaaaaataaaaaataaataaaagaaagggaataaatagtaattttcccaaaccatcaaaagtatggaaaaaggagtaaaataaaccatttacataaaataaagtggcataaaaatgtcagatccctcagttgttccagcaaaatcagactgctttagactgggttagaaaacaaaatccagatacagttgtttacaacaaacatctaaaagaagatagtaagaaaaggttcaaaactacacattgggcacagtggctcatgtctgtaatcccagcactttgggag

SEQ ID NO: 209118 - DNA, 764 bp, Homo sapiens
tatttatagtgctgtggaaatagcgacttagcagcaggcagtcctggctggaagtctgcatctgtggctgccctgacgcactgtcagggctcattgttatcagcttggagaaccaaattatgttgccattgtgtgctcaagccttgggaaaattcaacaactggaataattcgtatcaggagaaattctttctggttctagcgataaactgaatcctctaaaatgtggggaacaaaaagcaagattaagaaaaataaataaataacagtgctaggaaaccagggaagagaggacacaagttgaggtggtgcgtgcacacctgcctacaggtgcacaatctcgtggtttttcctaatccattcagaagttctccatttaagagcgcagtctggttctgctgttcccaaagcgcctttcataccaaaggattccaaagtttcacacccacatccagacatatggggctcttcaaaatagaaatatcagcacagaaccagcaaagtgagtctgaaacgtggccaagggaaccagaatttgaaggactcactaaaaagacatctagattctatcaattttaggagtccacaactgaaatggcactaaggaattataataataaaagcaatagtagtcggtgagcaatgagcagtgctctgtgtgcagtaagtcaatcaggcacaccccacgcagcagtctgatgtgcatgatcctgttccatctcctcactaccttgggaggcacgagctttaacacgtaccttgtag

SEQ ID NO: 209119 - DNA, 388 bp, Homo sapiens
aggctcaagtatatcgggcatatgggaagcatgtaaatgttcaaagaggatgtccagtaatgaggaatccaacatttatcccaatagcaacatgttaaatgctcccactcccttctgaccattgctgctcaagtgtttccttctgaggtaattccttgaaagtgtgtgtacatgaccagtctccatggctaacacatacacatgcatggaacctagaagcattaaggaacaactctgaggtcattagaagctaaaaatactgaaccttcacacttgcccttgagcaagtattctttagcagaaaagccaaagggattataataaaatgaacaaacaacaagcctactcataaagcatgttatgctttatggatagtgcccccccatta

SEQ ID NO: 209120 - DNA, 765 bp, Homo sapiens
aaatgatcactacatttaatacccataagaaaatctgaggctctcaaacaaaagcaggaaaataaacaaatctaataatataggcttcgtataggactatattgtcatttatactcagtttaaaggagagaatctccatatttggtttctcctttgaatagatctttgacttactctagtactaccatgaaaactgaatttattcttttttgaaatttcttggtttctttgcctcttgcagagtgacatttcactttttaatctttcagctgaataagccatataaccaattttttaaagttactgaattttaaacaattatttgtccttttgctttctctttcaggtaaacaattatttgtccttttgctctctctttcaggtaaacaattatttgtcattttgctttctctttcaggaagttgatggcaataaagttatgtcttcatttgccccacacaactcatctacctcacctcagaaggcagaagaaggtgggcgacagagtggcgagtccttgtctagtacagccctgggaactcctgaacggcgcaagggcagtttagctgatgttgttgacaccttgaagcagaggaaaatggaagagctcatcaaaaacgagccggaaggtattgtatttattcttcagtttcatggtgctaccagatgaaagcttccaagagtagaacatcaagttaacagtactgatgagctgatgttgggcaaagcatgctttaatgagcccttagtttcgctcatctgaag

SEQ ID NO: 209121 - DNA, 742 bp, Homo sapiens
gagcgtgcgtgagtgagtgtgtgtgtgtgtgtgtgtgtgtgcatgcgtgtgtgaagaatgcacactatctcctgttggttcagttggagacgatcataggtggctgctgtgacaaagggaaattgtgcttttccagcatgcttactgaccctgatttacctcaggagtttgaaaggatgtcttccaagcgaccagcctctccgtatggggaagcagatggagaggtagccatggtgacaagcagacagaaagtggaagaagaggagagtgacgggctcccagcctttcaccttcccttgcatgtgagttttcccaacaagcctcactctgaggaatttcagccagtttctctgctgacgcaagagacttgtggccataggactcccacttctcagcacaatacaatggaagttgatggcaataaagttatgtcttcatttgccccacacaactcatctacctcacctcagaaggcagaagaaggtgggcgacagagtggcgagtccttgtctagtacagccctgggaactcctgaacggcgcaagggcagtttagctgatgttgttgacaccttgaagcagaggaaaatggaagagctcatcaaaaacgagccggaaggtagctctcattaactttcaagtggaaacaaacaagtattttggcaatactaaacgtaaagtatttccagtgtttaattcacttcaggacaatcacatataaaaataaagcttatctaaatctt

SEQ ID NO: 209122 - DNA, 425 bp, Homo sapiens
gtttctgattgtgtgtgctttgcagtggtatttggatggtttcctgctctctgctagcacaaaaaggcatttctgttacaatggcccctaaccacacaatgacggcattaaggatttatgtggaggtttcattattttctcctcttttgttccttccaggatgtcttccaagcgaccagcctctccgtatggggaagcagatggagaggtagccatggtgacaagcagacagaaagtggaagaagaggagagtgacgggctcccagcctttcaccttcccttgcatgtgagttttcccaacaagcctcactctgaggaatttcagccagtttctctgctgacgcaagagacttgtggccataggactcccacttctcagcacaatacaatggtaggtttctcatggtttattgtgcctacactca

SEQ ID NO: 209123 - DNA, 637 bp, Homo sapiens
gagcgtgcgtgagtgagtgtgtgtgtgtgtgtgtgtgtgtgcatgcgtgtgtgaagaatgcacactatctcctgttggttcagttggagacgatcataggtggctgctgtgacaaagggaaattgtgcttttccagcatgcttactgaccctgatttacctcaggagtttgaaaggatgtcttccaagcgaccagcctctccgtatggggaagcagatggagaggtagccatggtgacaagcagacagaaagtggaagaagaggagagtgacgggctcccagcctttcaccttcccttgcatgaagttgatggcaataaagttatgtcttcatttgccccacacaactcatctacctcacctcagaaggcagaagaaggtgggcgacagagtggcgagtccttgtctagtacagccctgggaactcctgaacggcgcaagggcagtttagctgatgttgttgacaccttgaagcagaggaaaatggaagagctcatcaaaaacgagccggaaggtagctctcattaactttcaagtggaaacaaacaagtattttggcaatactaaacgtaaagtatttccagtgtttaattcacttcaggacaatcacatataaaaataaagcttatctaaatctt

SEQ ID NO: 209124 - DNA, 439 bp, Homo sapiens
ctaattcgtacattagttattaatagttagcatttgttttaaatttgcttatgcttcttccccaaagacatttatgttaaagggcaactttttctgccactctcaatggaaaattgggaccctctgccgcatgaaaggagtaggaaaaaatgaggcaacaactatatcttaacgccggccagattctgtcacctgggaagggcatcatgcctgaacactactaagctgtccattaaaaatggtaatcaggccgggcgcggtgcctcacacctgtagtcccagcactttgggaagccgaggcaggcagattatctgaggtcaggagttcgagaccagactggccaacatggtgaaaccccgtctctactaaaaatacaaaaattagccaggcgtggtggcacatgcctataaccccagctattcggaggctgaggcagga

SEQ ID NO: 209125 - DNA, 383 bp, Homo sapiens
tcattttgtatttgtatgtgagttataattcaccttctaaaaaattatacttgaaataagacaatcacaaaatggcaaatattgtatgattccacttgtatgaggtgcctggcatagtcagattcatacagacagaaagtagaacagtggttgtcagggcctggagggcaggaaggaaagaatgcggagttattgcttaatgggtacaggatttcagtttgggaggatgaaaatgttctagagatgggtggtggtgatggttgcacaacaatatgaatgtacttcatgccaatgaactgtacacttaaaaatgattaaaatgataaattttacattatgcatattttactataattttaaaaattaaaattaaaaaattttaa

SEQ ID NO: 209126 - DNA, 578 bp, Homo sapiens
accgcaccactgctaaaggctacggtaaggatattagataatatttgtcaaacttttcgaactgcctgacatatatattattcttgctattatcttcagtagtataattattatgatcattcctgtaatgagggcttgaactctgactgccacaatgagggaggtacagggaggctgctactcacaagcagagccccaaagggatcaagaggccaacagggtcctggtctgattcaagtttctgaggaatccaaaactacacagaaaaacaaaaccaattccattaaatcataatggagcacatatgtgaattcctatataccccaagtaacttttactcctcaaatatatctttttgaagtggagctgcttcaacaccctgcctcaggcactgaaacatcagggtagcactcatcctcatgaatctgaatctgcaagcctcatctgtgctctcctatggtttcctgtttggccagtagtcacttctccttccttatataacacagatttgactccaaagttctccctgtaggtgcaaaaacatgaccacatatgtacaacatacacagcttaatact

SEQ ID NO: 209127 - DNA, 616 bp, Homo sapiens
gttattaataattaaactgggacagcaggtgtaaaccaaggtggctctaggatatatagtcatcctacttatgtgtcatcctattattttgacaagtgaacatttattgactattgttatactctgagggccttacatataaataacctctcctactactaaaattaaacctgcagtatagatattactaattgcattttgcaaaagaaaaaaataaagctcagaattactaagtaacatgatgaaggctgtaaggctagtaaatgatagaagcaagatttgaaataggcatggttcaaaattcatgctgctcccaccataaggtactgtttcttctgtgatgttatgtaataatttatgtttccatctctatagcaagggtcagcaaacatttcctctaaaggatcagacagtaaatagtttaggcttacaggccatatgatctctgttgcaactattcaactctgtacttgcagcacaaaacaggcatggacaatatgttagcgaatataacatttgttccaatgaaacttgatttacaaaaacaggcagcgagctgtatttggcctgagggccattgttcagcaacccctgatctatactctagaccctataa

SEQ ID NO: 209128 - DNA, 293 bp, Homo sapiens
  misc_feature (77)..(78): n is a, c, g, or t
ttttttcccctctactgtaaaatgagagtgttcagttttaagaggcacattttcggagcatggatagagtctttccnngagaaaacagtctgtctggtgatggagtaattaaaatgatttgcctgcctctgcctctgaaagcgctgggattacaacaggcgtgtaccactgtgtctggcctgatcatgcattttcaatgaaggcaaaattgcccccaatgggaaaaaattggttctcgtgaaatgaaaaaattgtgctctttatgtacaaagcacaataaacgcacaatacat

SEQ ID NO: 209129 - DNA, 471 bp, Homo sapiens
caaagttccagctaaatcctaaggcattcacaagggtgaggtgcaggtgtctgaatatttgggcattaataagccagatagcactattctgtggctttccaaggtcaattaaattctttcccccagtgagaaagaacatcagccttagaactcagctttagttctagcttcaaaccaattggctttggacacttcttaattttacagctcctggtttttctaaccactcttagggctctaaaaaccatttactgtttttttagagaaatcaactaaccattctacgtcctagcattatatttttcaaaaatttccccagtagaagtaaaagcaattttaccagtaacctttactaacttttctgaaattgagatgcctccctagacctaaaaaaagttatttctaaatttagagtcagctactagtagtcgctgtctttattcagagtgatcatagttcattgtagaccag

SEQ ID NO: 209130 - DNA, 148 bp, Homo sapiens
taagtcatgtgacctcctttaaactaatcacagtaagaggaatgagactaccattagtagagactttcccttgagctgggaaaaggatgacttacttgaggtatggatattgaataaaaggtgatttctgtttgtgaagaacatgatt

SEQ ID NO: 209131 - DNA, 285 bp, Homo sapiens
agttgatccagtcggacgctaggatttgcctgggggcccggcctgccagcagtacaggtgaggggacgcaggcttggtcacaagcacccctgctgaccttccctacagacctggcacatttaatcttcttctttggggaggagaagaggatgcattcagaaatgcctttgctgatgaggccctcaggagcttgtactggaatcactcaaaattcccaagtagcctgagtgtcctaattcatttctgtgtacatctgcctaattctcaatccacgtctaaggttag

SEQ ID NO: 209132 - DNA, 182 bp, Homo sapiens
ctctgacttcaagccaggaggaataattctactacaactatgtttttcttttgtgaaagactgctcagaacatgagtagtcaagactacagagttttcatagtctggatgatggtgcaaataaaaggtatgcttctataaaataaagggaatagttaaattactatgataaagcgaggaaat

SEQ ID NO: 209133 - DNA, 558 bp, Homo sapiens
aagtcaccccctttttttgccagcccttagccaactctacattccagctgtgcagaagctccagctgctttcctacaccccctgcaattctctatgtctaggactttgcttgtgcctttccttcaccccctgcaattctccatgtctaggaatttgcttgtgcctttccttccacctccaatgtcctccctccaactggctaagtcccaatgtatgtatataagaatttagaggatacctcttctggatttatcccaggccccaacttcagcccccagccttccccatcaccttgaagctgagtctggctgaaattcctctattccctaccctttccagtcacaacacctaccacactgtttagcaagttcctccttctttttctgtctcagcagctagaccaggagctccctgcaggtcaagaccatgtgttctctgatgctttctcatggcaaggggagacatagggttgcagtagtgagtgggcatctgttctcagaaggcagtgcctggagcactataagtacttaataaactcttgtgaaattaaaaagtggg

SEQ ID NO: 209134 - DNA, 718 bp, Homo sapiens
ggatcacagcgagaaggcaacattttagttcgtggaacagatgttgaagtacaggcagacatagttggttttgcagttgtagattgcattttccttttcaaatctgcctattctggggtacttggaattcagctgcttactaatgcatgagacacataggagtttcctgtggttctgtgacaaatgaccaaaaacctggcggcttaaaattaatttcctcacagttctagaggttggaaatctgaaatcaaggtgttggcagggctccatgtcctacaagggtcttggggattccattcctcaccgcctccagctgctggtggttccacgtgttccttctgtggctgtcactcccctggcttccgggtcacatggccagctcccctgactctgtgtccagttccctctgcttctctgtcatgaccgtggtcattggctttaggacctaggcagatcatccaggaggatctcatctcaacatctttactttgagtctctgcaaagactggttttacaaatgaggtcccagtctcaggttctgagggttgagacgtggatgttgttatttgcagggtgttattttttggtggccacagtcccagccccagcaccgtggaaagcatgttgctttttggtagttagcggcctcttcctggtgtcctctcatggctgtcccacccctgtggcacacagatgacctcctgaataaaacaagacc

SEQ ID NO: 209135 - DNA, 1572 bp, Homo sapiens
gaaaagaagaaacctgagtgagtcagcatgaccaaatattaaaacatcttataaagctacaataattaaaacaatgtggtgctgatatgtggagggtcaatggaacaagatgaaatggccaaaaataaatttaaaatacatgttgaaatgtattaacagcatatgttaaagttaagttatgttaactttatatgttaaattcaagttaattggggaaagatggattattcaatatatgatgaacaactctgtcacccagctaaaaaaaattaagcttgggccatatgccagactagataccaaaataaattccaggaggaccaagtttttaaaagtaaaaatatggaatcatggaagtgcatgaagaagaagtagcacttaaaaaaataataatctcagcatggggaaggtctaagtatggccctcaatcagaaaccaggaaggaaaatattgactattttaaacaaaattatctctgtaccaaaaacagcataaaaggtcaagaaacaacacactggaaaaagaattgcaatgaatatcacagccaaatagttaatttcttattttcaaaaaatagcttctacaaatcgaagagaaaaattctaaggtctcaaaggaaaaatgagcaaaggatttgacaggtggtagaatacagaaaaagaatttaaaatagctcctaaagatatggaaacattactcatgatagcagaagtatcaattgacaaaattactcagattggtaacaaactttaagggggaaagcacttccatgcattgctgtaaattggtacatcttctactgagaacaatccggcagtagttaacaaaattgtgaatgcatatatctctttctctagaaatttctcttttgggaatttattctacatatatattcaaacatgtgtgaaatacttctatacaggtgattgaatttcactttattcctaagagcagaagactgcaaaatagtaaatatatacccaaaagggtctaatggattagtttttggcatatcagcacatgataatactatgaagccataaaaaagagagatctctatatgtattgatgggggaccatctttaagatatactgtggtgttgaacaaaacaacatgctgaaaatgtctcttattcttttagaatcaatataagtctgtgcttgtaaatgcagtaagtatctttggaagtatacctaaaaattggtaatagtgtttgactccagggaagaacagatgggtgccagagtgaaaaaaagatagcttttgctttttatgacttttggattctgtaccacgtaataattttgatgtaaattttgctgtgtgtgtttttacttgttcatgtagtgattttataaattactcttttaattttctatcaatgaatatcctgggataaacccctcatgatcataatgaataatgatgtgtggagagtggggagggtttacatatgaaaaatgtagaaaatacaaaaagtgtctatatatacaaaaatgtaagtgttaacatttttatatttgcttcaagctttttttttaaataaaagaaatgcaatattgcaattaaat

SEQ ID NO: 209136 - DNA, 809 bp, Homo sapiens
ctactactactaaactcgcggcccgtcgatcttctactgagaacaatccggcagtagttaacaaaattgtgaatgcatatatctctttctctagaaatttctcttttgggaatttattctacatatatattcaaacatgtgtgaaatacttctatacaggtgattgaatttcactttattcctaagagcagaagactgcaaaatagtaaatatatacccaaaagggtctaatggattagtttttggcatatcagcacatgataatactatgaagccataaaaaagagagatctctatatgtattgatgggggaccatctttaagatatactgtggtgttgaacaaaacaacatgctgaaaatgtctcttattcttttagaatcaatataagtctgtgcttgtaaatgcagtaagtatctttggaagtatacctaaaaattggtaatagtgtttgactccagggaagaacagatgggtgccagagtgaaaaaaagatagcttttgctttttatgacttttggattctgtaccacgtaataattttgatgtaaattttgctgtgtgtgtttttacttgttcatgtagtgattttataaattactcttttaattttctatcaatgaatatcctgggataaacccctcatgatcataatgaataatgatgtgtggagagtggggagggtttacatatgaaaaatgtagaaaatacaaaaagtgtctatatatacaaaaatgtaagtgttaacatttttatatttgcttcaagctttttttttaaataaaagaaatgcaatattgcaattaaat

SEQ ID NO: 209137 - DNA, 864 bp, Homo sapiens
gggtttatcccaggatattcattgatagaaaattaaaagagtaatttataaaagcacttccatgcattgctgtaaattggtacatcttctactgagaacaatccggcagtagttaacaaaattgtgaatgcatatatctctttctctagaaatttctcttttgggaatttattctacatatatattcaaacatgtgtgaaatacttctatacaggtgattgaatttcactttattcctaagagcagaagactgcaaaatagtaaatatatacccaaaagggtctaatggattagtttttggcatatcagcacatgataatactatgaagccataaaaaagagagatctctatatgtattgatgggggaccatctttaagatatactgtggtgttgaacaaaacaacatgctgaaaatgtctcttattcttttagaatcaatataagtctgtgcttgtaaatgcagtaagtatctttggaagtatacctaaaaattggtaatagtgtttgactccagggaagaacagatgggtgccagagtgaaaaaaagatagcttttgctttttatgacttttggattctgtaccacgtaataattttgatgtaaattttgctgtgtgtgtttttacttgttcatgtagtgattttataaattactcttttaattttctatcaatgaatatcctgggataaacccctcatgatcataatgaataatgatgtgtggagagtggggagggtttacatatgaaaaatgtagaaaatacaaaaagtgtctatatatacaaaaatgtaagtgttaacatttttatatttgcttcaagctttttttttaaataaaagaaatgcaatattgcaattaaat

SEQ ID NO: 209138 - DNA, 242 bp, Homo sapiens
tcataatggtcccctaatcaaggaaccctagattttaagaacttttctcagaaaataatgtcttctaccaaaacatactatgtcctcttcttctaaacatacaaaacctctttggaaaagttctttcacgtgggatccatgaaagcagggaagttgtttgcattattcagtgctgtattcttagcatctagatccatgccgggtagaaggtactttataacatttgttgaatgactgaatga

SEQ ID NO: 209139 - DNA, 427 bp, Homo sapiens
gtctgaataaaagataactgtacaaaaatcaattgttttttctgtattctagcaataatcaactagaaacagtatcaaaagaaaaacattccatttacaattgcaacaaataggtatatatatatttgctcttctacacataacctatttctggaagggagcagaactgggcaattcagggacagcaatggaaggggaacactgctatgttattttaaatactttttagtaagctttgaaccatattaatgtattacctgttcaaaattatacttaataaatttaacaagaaaaccatattgaagggcataaaaataagacctgacaagtgaaaaaacatcaagttttagaaaggatgatttaatactaaaatatacatttcttaatatataacttaatgtaaacctaataaataatttaatacaaa

SEQ ID NO: 209140 - DNA, 168 bp, Homo sapiens
atggctaaattgctaaacttaaaataattgccttatgaacagtcacattgattatgactaaaaaggacagaggatttgtgttctatttttagagtagatatacggcctttgttggggaggctgagggatgcatttaatcaatcaatcttctgaaagtataaactgtgt

SEQ ID NO: 209141 - DNA, 367 bp, Homo sapiens
tgattttatatcacttttggatgagatgaataccttcctaaccaaaacaaagaacaaatggaaaaaaacaactcaaaagcaaatcatgtattattacaacaagctaagaacggcttggatgagtaagtgcctctgctaattaaacacggcttccaattaattcctcagaaatcaaagttatcttctgtggtgaatatttccctacattcaacaggtttagagctataattgtaggtaaagcattcagttacacacttcatagccaatttaggaaggtccacctgatgtctcacagcaattacactttatgagcattttactgggatctcctttttgatggagagatgagtatctgtgaacactgaga

SEQ ID NO: 209142 - DNA, 804 bp, Homo sapiens
aagccaagcatttctattttgtccaaatgtgtcaatcaggggtctgtgcctcgttgtgtgtgtgtgcgctgcgtggctccacggcccccatcctagactgtggtccaggccagggctctgggctcagcagacagccaggctgcttccactggtctgtgaagcttctgtctcaatgctcaaggtggcctcagtgttcagcatggttgccagtgccccggtcattatgtttccattccagaggggagagaggagggagggatggtgggcggtgatcctctgggtagctctctgcccacctcttctgagactcccacgagggctgtgccgtaggccacacccactttgcattgctggcccccagctgcaaggggagcaggaaagtcaccttttagctgagtgcgtggccacacagaaaaatagtggggacagggagaggagaagtgggtttggggggagccccgccctcctaaccctgcctgctgccctctgtccccagcaggagctcccccgaggccatccaagcgcggtgcacccgccacccacagcgtcctccgcgcccacgttgccctaaaccccactgtgctgtgctctctcgcagttcctgcaggcgcgcgttctctctctgaatttgtttcatttcactgcgagttggggtcgcgggggtagatcggagctgcctcttgagaatagcagtgcccaggctttggcccaggtggccggaacgccccttggagcaccgacgccatcggctccgggaaatgcagcgagcacagagcccagtcccttggtctgaccgggggcgct

SEQ ID NO: 209143 - DNA, 575 bp, Homo sapiens
ggtttaattctcagaaaggaaggactgggacttattgctagtgaatcaccatttctcctgttacacccttgagctcctgctttagctcccatctcctccatgggggaacccagctgttctttcactgtagaagtgaagcttgaacaaagatgtcatgtggccagaatcatcttttagtctcaccactccacactgatggtcacatagaggtgtgagttgggaagttgttaaatacaagagggtttgagcttctggagaagaggaaaatgtaaaaatattttttcctttaagaaagataaaaaggtaagcctaaaccttggcggccaccgaagtcagctgttacgcatgtgtagttaaatttcactgtaaatatttcataagggttcttagaatggagccaggttgacatcacagccccaactgtaccaaaggaaccatttcattaaaataagccaacatttccaaagaaacacgaatgtctatggcagagttaacataaggtcagaaaatcctctggaagaaatttcggtatcaatgtttataatctctgcatttatggatttgcagtttgtgca

SEQ ID NO: 209144 - DNA, 255 bp, Homo sapiens
cagagaagttggctactcgggactgggactccttcttaatgaagcacttgttaatacttctcttattaaaaacctcacccatcaaatcataaatacagatcctgttattaatttcaaagatctactatctgtggtatatatatctcacagagcacatataaatgttagagtggccatctgcagaaaggttttgcaaattttgcagttccagccagatgcagcacatcaaatatcacagcaagtgggttggcaaga

SEQ ID NO: 209145 - DNA, 424 bp, Homo sapiens
tgaacctaaatctgggcttggtctgcagccaacctggaaattcactactgcaactccgttttctttttaacgagagcttcatacggttcttttaaactagaaacttctctttcttgtaattgtctctaatggcttccttgttcgaacaagcctttgctagcttctgtctgacccctttggctttgctttctgcctccttttatcctccagcctttcgtatagattccagaggaatcttcctcaaaggctgtgccactccctgttcaaaggctttctgtggctcctcattgcctagaaagcaagtgagtaaggccagatattgttagtggctcacttaccgcattccaggatcttgctctaatttccctttacaacgtcatcaaaacagctcacccccaagctccgacctcaactcccacttgcg

SEQ ID NO: 209146 - DNA, 240 bp, Homo sapiens
agtcttcttctttaattaactttggtattagtgtggacattttattttaggctttctctgcacctgcagctttgctcaacagctgaaggctttgcaaattttagagaggtttgaaaccactaaaccaaccactacaagcactaacagttctcacttttgcaggattcagctttgtctctttaagatcttcacaggtagatagttgctcaccctgctaggcattatgaaccaggataatga

SEQ ID NO: 209147 - DNA, 147 bp, Homo sapiens
  misc_feature (100)..(100): n is a, c, g, or t
cattttagtataaggccataggcaagtcacttaacctctggtatctgagtaaaactaacaccttagaagagtggtgcattagttaatgtttagaaacggnttcaaacacacaccagacttcttcttccaactgcggcaacccttttg

SEQ ID NO: 209148 - DNA, 568 bp, Homo sapiens
cttccagtgatctcactaattaggtaattttaggcttggctcggccaccataattaagaggaaccacacaccaggacatatgcagtagcgtagtaccagtgccattaggtccgtgattgctgacatcagcactcgtgtgtattctgatcattaaaacatttctttttaatgtttccctctatagcaccgtggtagctaagtcagagtggggggttttagtttctctgaattccatccttagaagttttcgctgaactagctcccagctagctgtaggagagatcacagaatattaaattattcagcaaacatttattaaactgcttctatgggctggggacccagggacacgaagctgacgtagatgtggtcccatcttgaaggggcctgtggtaccctgggaaagacggtgaaagaaacaactcaaatgaggtggaggaagggctggctggggatcctgcacaaagtgctgtgccagaggaattcatgtctgtccagtggacagggatcacagggatcaagaaggcacccagagagcttaggagagggcagagaagggcaccggttg

SEQ ID NO: 209149 - DNA, 368 bp, Homo sapiens
cgcaaaaccagtccctggctccaaaaaggttggggagcactactctaggtgttctggagaatactgaaatgattaaagggagaactaggggcagaaactagtaaatgactgtgtcaaggtcacatacagatatgccttattttattcttctctgctgtaatgtattttgcagatactgcatttttataaattgaaggtctgtggcaaccttcatccagccagtctattatcacaattttttcaaaacgtgctcactttgtgtctgtgtgtcacattttggtaattctcacaaaatttcaaactttttcattattattacatcagttaccatgatgtgtgattagtgatatttgatgtcattattgtaa

SEQ ID NO: 209150 - DNA, 698 bp, Homo sapiens
ttaggagtgtgatatggctgcaaagtccatccaagagccccttagacagctcccaggtctgccagaaaaaagcaattcatctttcctatacaggagtttaaggtcattttgaagtggatgaattgggaaacattatttttgtgaattgaatatattgtaggaaatcttgtatgctctaatctgctagttaatatactaatcaagaaaaggtaataaaaccacatagctaaaaagaaacatattgatttcagcgacttctgctaaagccagattatgtgaagattaaatctaaaatgtcagcaaaataatactgaatcgatctttcatcatctgtgtggcctgttttattgactcatttctttattgttattataccaatgaagcatggaaatgctgtcatggaaaaatccaaatggcttattgtgttgccaagcattttattagagtcccttgtcaatttttccttgaaaataaagttatttttcaggaagaatgccttggctatgtccataattctaaccatatcaacatcgtttttaggttgattgattttaacagtgttagatcaatgaggcatagctcataagttaatgatcacaaggttggggaaaattgatctcttctgaaaaacgtgttatcacacctagtgattgattagtgttctacaacaatcttccatgcagcataatcttctgtga

SEQ ID NO: 209151 - DNA, 192 bp, Homo sapiens
ggaaatggctgcaattatttagcttgtgttgagactcctttaaaataagactttgcagctcattccatcaagaggcacagactacttctctacctcttgaatttggtttgggccttgaccaacagaatatagcatatgtagaaagccatgtctcaaaatctcctgtatgctgctttctctctccttcccctc

SEQ ID NO: 209152 - DNA, 393 bp, Homo sapiens
ttcatcatgtaaagcacttgggcctttctaaaagatgcaaatcactctttattattttgatgagctaacaagatgaattcatctctagaacactataaaaactaaattgtgaaaaatggcgccaaccatataacctgtccttgatcatacctattatttggtaactctgtggggaaactagaatcttttagaagtattatttgtgtcctaactatttaagtggatgatttaccctcctctaggaaacttaatattgagagtaggctgagaggtgatcacgttaatctggaaaatttttcataaattaaggaaattgagtttaatagttacagcaaattctccacatgcatcatgtttctgtactgagtgctgaactatacaataaacaaggaa

SEQ ID NO: 209153 - DNA, 516 bp, Homo sapiens
attttgtgagttggtacatattttggaagctgtcaaaatctaagtagaaaacaaatcacaaaggaagagaaccaacttgagaccatcttcagaaaaaaattacaaattcagttcaagagtcggaagtgatgtcaaaggacagatgtttctccttagtaaacaaactagagctgaggtttcccatcgtgcgacaagaaaggtgcatggaaatgagtaaggtgcagataactttaactgggtgcctccatttcctgaattcctaaaaaggcagccccagcatcactcatgagctcagaagtgaggatggggcaagtcctggggcaatagaaatcagctgcggaccaagaagagagtgggagtggcaccacgcccaagaggagtctcagaaatatacaatagatgaaggaagcagggttcccacctcactgccattgaaacaatgctaaatttacatatttttacacacattttatggatattttggtgtagcaaatgatctacctcctctggcctcat

SEQ ID NO: 209154 - DNA, 284 bp, Homo sapiens
gttggtgctagtgttcccatttacagaggcagagactgaggcttggagatggagaatcacctatccagagtcactactgggtttggaatccaggcctgtggggtgtgaaactgaggtccccccagcactcctgctgcagggatgtggcatccccccccggggtgtggctggggcatgctgggacctgcaccctctcctctccgccacactgggccttgctaagccttggagagccccctagacctacctgcagtgacttgttccaggaagcgcgtcctggccag

SEQ ID NO: 209155 - DNA, 534 bp, Homo sapiens
gtgtctggccaacaagcattttaaaatgcctactgtgtgccagccttatgcctggcacttgggtaaatagtgttaaatgacacaatgtccctgccatcccgatgctggtaatcatgggaggcagatgacaaatgagtaaacacatgccaaatgtggtaagtgcacactgatggaggcagattgtttgctgttaaggagaataacagtgaggaaggagacccactttttttttttttttttttttttttttgagacagagtctcactctatcacacaggctggagtgcagtggtgcgatcttggctcactgcaatctccgcctcctgggttcaagtgattctccttcctcagcctcccgagtagctgggattacgggcgcccgccattgcgcccagctaatttttggcatttttagtagagacagggtttcaccagggtctcaatctcctgacctcgtgatccacccacctcgacctcccaaggtgctgggattgcaggcgtgagccaccgcgccgggcctggggtttaaatggt

SEQ ID NO: 209156 - DNA, 863 bp, Homo sapiens
gggtgggaggagggagaggatcaggaaaaataactaatgggcactaggcttaaaacctgggtgatgaaataatctgtataacaaacctgcatgacacagatttatctatgtaacaaacctgcacttgtacccctgaacttaaaagttaaaaataaactttttcaaattctcaaaaataaatgagaattacagaattagaagccaaacacattgatatttactatgaaatagaagatcagtatattagtttttatagtgagaaataaaatataaagcaaagtaagcattcgggtcttctagtgttctgatatcactgtaattgaaatttgtttgcatgtggaatttatagtagttaataagcgcagattatttttctggctggcattgtgctagttatttaacatatgatatctcatttaattctttcaacaaccctagcaggtagttgttatccttatttcacttaagaagaaacagactcagcatgggttaaataatttaccaatggttaaaaagccaagtaaggggcagaaacaggattttgctcatatatatgactctaaacacatacttattctcttgtaatatgctgttttctcaacattgcatcactgatacttagagctacaagaattattaggtacatgtgttctgaaagaagtctgaaaatttaccaatttttgtatatacaatgcttgtgaagtatttaaataaaatgtagtgggcacattcaaaaaaaaaaaaaaaaattttgggcgggccgaaaattttaaacatttggcgcgcgccggagaaaggtgttcagaaacggcgaagggggtcccaaaaacgggggcggaacaggtgggttgtaaaggaaacgg

SEQ ID NO: 209157 - DNA, 550 bp, Homo sapiens
cttaaaatttttgtttatgtattacttgtgtacagaattgctcttttcatatgagataagtggtatatgaaagtagcaaaaatatgcactaagtcaattaccaaccaaactttgaacatcgtgtgttatttcattccagcaatggctagatgcctcacctccaagatcatcagtgaaatctttaaagtacactataagggaaattttaagctagctattttgaagctaagcctatatttatcacaagcaattacattctttcttactgtacttcaacttgttattccttgtcacacatatatgaaatttttatatcatccaaactatactgtactaattagaactagctacaaggatggcctttgaagtattatttataaaagctggaaagaaaaattagaaacaacataaatatctaatggtaagggatgggttaaatgaacttgagtatgttcatgcatggagatactatgcagtcaacagtgaaaaatgttcaatatatacttttaagtaaaaatgctcatatgtttaaaatactggtacacatttc

SEQ ID NO: 209158 - DNA, 782 bp, Homo sapiens
cattgctcccatcagcgatctggatactctaaagaaaatttagtgttatattctaaggaataatcctgccatatttctgggctctgacctgatgggagcaagactggcgccatcgtgctctcatcagtaacaacatgacctactgtaagtagtaacaattctgatttatgagtcctggaacgaggtttttgctttataatgaagttacggaatctttgggttggaaaggaccttattaaaagttatggctgatttttttttttaaagaagctgctaagcattggagctcagaatatatgctttttaattcactgaagtttaaaaggctagtctactagaaaagactcaaatagagaaaactctccttgctgcttttcaatctaggtgtgcaagctctacagctactactggctccatagttagcattcataccaatgcatacagattatccagtagatagcatagttatctatctactattactagttatctgtaatatctactattatccagtagaaagaatctgctgacatctgtattgttttctgtgtcctttaccccttctgaagttgtcatctctaattcttgtttatgtccagtaagttattttattgaaaagcagcctgttttgaaagatgtgtttttctcccacagatctcctgtgtctcatgatcaggtgtggagttgttaaatatttggtctaattcttgtttatttctataagtcattttattgaaaagcagcctgttttgaaagatgtgtttttctgccctggatctgtt

SEQ ID NO: 209159 - DNA, 288 bp, Homo sapiens
gcaacaagttttatcaagcagaaaacactatatagtaggcatgtgacaaataattattttacgtaaatctcagtgtgtcaaatttgcttaacaatgtccatcaactgactaagttctctagcacttctaaatacttccttaatttatattcttgttcaaagtttggtgaaagattcagcttaccccaatttcctgaattagaaagaatcttttgcctttagatcacccctcaaaatttcttaaaagtcttcaagattttaattattcacaacttaaaacagagattat

SEQ ID NO: 209160 - DNA, 554 bp, Homo sapiens
acgatcaggatggagagaagcagccagatatgagatctttaggaaacagaatgatcagaattatcaggtgataggttagatgtgagtgcatggagagggtaaggaggccaggtagattcctgggtttctcttgaacaattaggcagacaatggggtaaagttagtaccgtttgctgaattagggtagccaggagcagaagcaggtttgtgagagaaagagaaggtagggctgcattattgccaagtagatatcaaagtggaggtgtccagttttacaaaaacgtcctttgtagcttaggaaagagatcagggctgcagacgttaagatggttatctgccagtgctatctaaataggcaacaacaatcattataatagtattcaaggggaaaaactggtagcctctcactgaggcccaagaaatcacaaggcatgaattctcacattaaaatgcttgtttccaactcaccaggctgtatacattcaatatgtgtagcttttgtatgtcaatcttagttcaataaagtagtttttaacaatatggtgcacaaggta

SEQ ID NO: 209161 - DNA, 642 bp, Homo sapiens
caaaaaatgtagttggaaagaatgaataagacttagtatttgatagcacaacagggggacaatagtcaatagtgatttaattgtacatttaagaataactaaaaaagtataactggattatttgcaacacaaaggataagtgcttaaggaggataccaaattttccatgatatgattattacacattgtatgcctgtaccaaaatatctcatgtaccccataaatatatacacctactatgtacccacaaaaataaaaatttttttaaatgttttaaagaatgggtaagagtctaacctaccaaatgagcaccaaagtttctacgcattaaacaagaaaaccttgttgtatcctagatcatatattgaagttcatgcaaaaaccattgctctctagagcagaattagagacaaaacacctgaagaaacacaaggaagcaaaaccagaaactgctgcaacatcctcaagccatctaagaagctccagcgttttttcaatgtggttctaacagtgtgtgattaggatgctgcaaaattctcacacttggtcagactactcagttcttcaacatgacaatttactatttttagtttttttgtaccaatgttctattcctatttggcatgatacctaaaggaaaac

SEQ ID NO: 209162 - DNA, 110 bp, Homo sapiens
gcttaatgctgtgtggcttgactaccaaaagccttgctgcttccactctgtggctttgttaacagaagctttccttcctccacgtcctcaccccaccccgctgaaggcag

SEQ ID NO: 209163 - DNA, 1017 bp, Homo sapiens
tgtcctcatgaatggggttggtgcccttataacagaaacccaagagaactgtcttgctgcttctattgcatgagaaggcaccacctatgaaggagagcaagccctcaccagacactgaatctgctggtaccttgatctgggacttcctagcttctggaaccattaggaaataaattcctgttgtttataagcctccctgtttatggtaatttgttatagcagcccagcagactaagaaaggggaaagagtcctctttgtcataggaaaaagtccaagagagaccagatgcaagcttccagttgttctcctcaactggagttatacgagcagtgcctaattctccttgcaaggatgtgtgacaacacacttagggtattgccacccaagaagactcacctgagccttggtgtccagcatagttagaggacgttggtcatatagtcatggctgaccatctgggtagctgagcctccttgcagaggtagcttgcagaggtccagctaatgttgagtggcccaaggtcctcaccataaatcacagttagcacagacaagctggcatggctcaggcaggaagctgcaggtgcttgaggaaggacactatctatagaaaccatgagtagcctccaaggtgggctgaggggtaggcagggcaccaacagccccagctacactccctcagggacagtcttgccatttcccgtttttcattcttataaacaatgccctggtgcaggggtcagcaaacttttctataaggagtcagataatcttttttttttttttgtattcccttttggcaatttgtttaattgagataaaattcacataacttaaaactcacccttttggtgtatacgattcagtgctttttagtatattttcaagattgtgcaaccaacaccactatctaattccagaacatttttatcaccccaaaaaggagccctgtgccaattagctatcacaccccattccctctttcctctatccttgataaccactaatggtaatttc

SEQ ID NO: 209164 - DNA, 345 bp, Homo sapiens
cgtgaacttcaaaacctgattggctcgctctccccagtaaaaaatctttagtattttaaggaaaggtacagttaacaatttcttacccaaaatatttgatgctagatgtgacattttttggattttaggaagataatgtggtgagtatatctgtttatgtaacacccccagtgggtcctgggcagcaacccataatcaaatgtactaatatttccattaagtgagatgaatggggactataaagcttcacatcaattttggccaccaaattttgttactaaaacttttgcttttcagagccctttggatttctgaattgcagaccacggatcgcggacctgtatg

SEQ ID NO: 209165 - DNA, 225 bp, Homo sapiens
ttaaagcaacaaaagaacatgccacatgtagagttaatgtaccatatattacctgaaaacgatagacttctattgccgtgaaaactacttgacagcattttccaggaagccaaattgtttggtttttaatttacaaaatcatgatataggaagaaaacaaacctcacacatatgtaggcacagaaaatacttttatgactgttgacttgggaactggaagtaaca

SEQ ID NO: 209166 - DNA, 230 bp, Homo sapiens
taatacccaacgggagcaaatcttactgaaatgttaagatcgagatgtcgctcttagaaaagccttggaaaattgtcacagcctctgaataagccgctgacaatctgcattgtcaattttcattgaatatgtagagtttttaatatttccttaatactcttttttttttttttttttttgggaaagtgctttcaccgttgtcccagggtggagttgcgggggtgcttccc

SEQ ID NO: 209167 - DNA, 521 bp, Homo sapiens
agctaacaataggcaccttcagaattatgatgattaattggctcgtgttttctcaacactgtcaattgttcttgaggtcactattgttacccctacttctatgcacccaccatgtatgcatggaatgtgctagaaggggaagaggtagtgggaggtgatcctggggcaaatacagctaagacctccccccatcctacatgcactcattcttctctttcctctgttagtctggaaggggttggggctgttggaagaaaaggaacataaagcagagagaaggatgcagtgagggtgtctgggactgttggcaggcagcagtcgggtttgggggctacagggctctgcaattgaggaagccagaggtggatgaagagttggccacacctctcccctaaagctgcagaatcttctgactataaaaagagctggtgcattcagaatcctctacaaccagtccttcccctgaccttcccagaagcttcgaaccctcagtgctgagctgccaagacgagctgggtgac

SEQ ID NO: 209168 - DNA, 298 bp, Homo sapiens
aaacatgaaccaagaggtttatttgattgtataggtcaaaagacttgtggggcttgagggcctttcaaatcggaagtccagcttatctatttatagcaagaaagaggacagaaaataccatgggcatctgaaatgtactgttttataaggtggcatttgtgatttttctttagaagaaaaaaaagagatagagctctaggcatagtgtttgactgaagtggaataccacatgtgttttttttggtgtgtatttgctttagcaaagtaataaaacaaaaatttataaagcgaaggtttt

SEQ ID NO: 209169 - DNA, 316 bp, Homo sapiens
tctgttcatttcaccccatccccaactctgaacccaaacaggtttctacttgtcttttcctgtattctacttattcttttatatcgttactttaaaaatcttctctaacatagtgagacattcctcaatcttcaaaaatttctggaactattaataatccttaatatctaaaacaaaatataaactctcaaagagggcaaaaacccatgttatttgatgacaagtgactaaaataaatcctggatcataatagatacttaatttaccaatgttgaaaaattaaaaaaaatattgatgaaggaaggaaggaagaaag

SEQ ID NO: 209170 - DNA, 377 bp, Homo sapiens
tcaaatctgtatatcaggctagcagagaagtgtttcccaaagcgctgcaccagagagaagctgatctgagggcacgatgggaaatgtatcacgaacactcactggctccccagtgtgtatttatccagatgtccttttgggatgggacaggaccggtttttaatgactctgagctgccttccctaggcactaggagcctacattttgctgactgtggaagctctttgtgtgagctccacgggcagctgtgtgcaaggaagatccagctcttgtctcatccctggaagcttggacaagtcagtttccccatctctgtggggattataacctctctcatggggacttggttgtaacagattcttgtggactattttgtt

SEQ ID NO: 209171 - DNA, 442 bp, Homo sapiens
ctaagataagtaagaggaccatattcttagaaattgaaggaagggatacgggctgctttcaggacaaggatataaagatcaatttgtcatatttcattttgcaagaatttgattccatgtcttacagttgggtaaaatgttcaaggggtgccaggtatggtggctcacgcctgtaatcccagcactttgggagggtgaggtgggtggatcatttgatgtcagaggttcaagaccagcctggccaacatggtgaaaccccatctctactaaaaatgcaaaattagccgggcatggtggcaggcgcctgtaatcccagctacttgggaggctgaggcaggagactcacttgaacctgggaggcagaggctgcagtgagccaagaacgtgctactgcactccacccagcctgggcaacagagtgaggctccgtctcaaaaaaaaa

SEQ ID NO: 209172 - DNA, 441 bp, Homo sapiens
cacaaaaggtagcaaaggatagacatataaatcagtggaatagaattgtgagtccataagtcaacctgtacatttctggtcaattgatcttcaacaactgtgccatgataattcaacagggaaataagaggcaattcaacaaatggtgctgggacagctggatatccacatgcaaaaagaataatgctggaccactatcttcacccaatatacaaaaattaaaatggatcaaagatctaaatagaagagctaaaacaatacaactttagaagaaaacataggggtacatcttcatgaccttcaatttggcactaatttcttaaatatgacatcaaatgcacaagggagaaaggaaaaaaaacagataaattggatttgataaaaattaaaaacttttgtgcatcacagcacattatcaagaaggtgaaaataacctacaga

SEQ ID NO: 209173 - DNA, 351 bp, Homo sapiens
actccatcggccactgacagtcttattgcattatttcaacggcacaagcaatcatttacacttgttattacccaggggcatttcaaactgttactgaaatgcatccatccctggagtaaccatctgtgaatggtaatgccataaggtagagagactaaatctaattgatatgcaaaaaggagaatttcagctgtccagctatggagattcaaattcaacctttaataggctgaggatttcagctaaatttttaaaatcatgatatctagttcaggcactcatcttttaggtttctcacagattaaagtacagccgtcttccttgaagtaagaacatctcaaagtcaaaaat

SEQ ID NO: 209174 - DNA, 549 bp, Homo sapiens
agcagggctatcctctagtggccagtttgggaagcttggccaatctgtataaacagtccttacgtcttttacttttgatcgtcaccttcatgagagagacagagacagcaaaagtggaactaaagattccacgtggggcagtagtagtcaaatgaactagaaatggaggaggagggtacatttcttatatagcaatactctatccaacaggactttattcctttgactcttgacctaaatgtcccctaagtaatgacttcccaggccaccctatcaaaattttttacctccccacacctgatacttcctgtatttcctcccttatttaacttctatccttagcacttattactatctaacatgctatattttactcatgtatttgtttcacgtctaaagccctctttagaatgtaagctacatggagaatagggatttttgtctctttcattaccaactatatctccatagcatctggaatagcacatcataaaccttcatgaatatttaattgacaaatgaattgtataattataataagtgcctatt

SEQ ID NO: 209175 - DNA, 547 bp, Homo sapiens
tccgcggacgcgtgggcgccatcacgcccggctaatttttttgtgtttttagtagagacggggtttcacctgtgttagccaggatggtctcgatctcctgacctcatgatccacccgcctcggcctcccaaagtgctgggattacagagttttgtgctatcatcaccagagccagcaattcaacctaaattctgagtgtaatggaagccgttaatcactatcaagttcatcatttttttttcatggctggagtgcagtggcatgatcatggcttcctgcaacctcgacctcctgggctcaaggaatcctcccacctcagcctcctacacagctgggattacaggtgtgtgccaccaccagaagctatatatttttttttttttttggaaagttggagtctcactgtattgccagggctgatctgtatctcttgccctcaagtgatcctcctgccttggccttccaaagtgctgggattatatgtgttaaccactgcacctggaataatttttgatgcagatgcaaacctaatgaaatataaaaagat

SEQ ID NO: 209176 - DNA, 4956 bp, Homo sapiens
  misc_feature (2865)..(2865): n is a, c, g, or t
gctcgcgcgcacctgcgggtcggacccgctgcctaccgcgtgcccggcgtcctcgtcgcgcgagttgccggtcccgcggggcctgggctgcgggcccacgggtcccggggatggcgtcggagccgcgctaactccgtttctccttggaccaagatgactgatggaaaactctccacctctacaaatggcgtagccttcatgggtattctggatggtcgaccaggaaacccccttcagaacctgcaacacgtcaatctcaaggcgccccgactcctctccgcgcctgagtacgggcccaagctgaaactcagggctttagaagaccggcacagcctccagtccgtggactcggggattcctaccctggagatcgggaacccggagcctgtaccctgcagcgcggtccacgtgaggaggaagcagtccgactccgacctcatccccgagcgggccttccagagcgcctgcgcgctgccatcctgtgcgccaccagctcctagcagcaccgagcgggaacagagcgtgcgcaaatcctccacgtttcccaggacaggctatgactcggtaaagctctatagcccgacctccaaagccctgacccgcagcgatgatgtctccgtctgcagcgtgtccagtcttgggacagagctgtccaccacgctgtccgtcagcaatgaggacatcttggaccttgtggtcacgagcagctccagtgccattgtgaccctggagaatgacgatgacccacagtttaccaacgtcaccttgagctctatcaaggaaacccgtggcttacaccagcaggactgtgttcatgaagctgaggaggggagtaaattgaaaatattggggccatttagtaacttctttgcaaggaacttgcttgctagaaaacaaagtgcaaggcttgacaaacacaatgacttgggatggaagttatttgggaaagcgccactccgagagaatgcccagaaggattcaaagagaatacagaaggaatatgaagacaaggctggaagacctagcaagccaccctctccaaagcagaatgtgaggaagaatcttgactttgaaccactttccaccaccgcactcatcctcgaggacagaccagcaaatctcccagcaaaaccagctgaagaagctcagaagcacagacagcagtatgaagaaatggtggttcaggccaaaaagcgagagctgaaagaagcccagcgaaggaagaagcagctggaagaaagatgcagagtcgaggaaagcattggaaacgctgtgctcacctggaataatgagatcttacctaactgggaaacaatgtggtgctctagaaaagttcgagatttatggtggcagggaatccctccaagtgtgagaggcaaagtctggagcttagccattggcaacgagttaaatatcacccacgagctctttgacatctgtcttgcccgagccaaggagaggtggcggtcccttagcacaggaggctctgaagtggagaacgaagatgctggtttttcagcagcagacagagaagccagtctggagcttattaaactggacatttctagaacatttcctaatctctgcattttccagcaaggtggtccatatcatgacatgttgcacagtattttgggcgcttatacttgttaccggccagatgtgggttatgtccagggcatgtccttcatagcagcagtgttgatcttgaacttagatactgcagatgcctttattgccttttctaaccttctgaataaaccctgtcaaatggcgttttttagagtggaccatggccttatgttgacttattttgctgcatttgaagtattctttgaagaaaatttgccgaaattatttgcgcatttcaagaagaacaacctaactccagatatctacctaattgattggatctttaccttatatagtaaatctctgcccctcgacctggcctgtcgtatctgggacgtgttctgtcgcgatggggaagagttcctgttccgcacggccctgggcatcctgaagctgttcgaggacatcctgaccaagatggacttcattcacatggcccagttcctgacccggctgcccgaggacctgcccgccgaggagctgtttgcctccatcgccacgatccagatgcagagccgaaacaagaagtgggctcaggtactgactgcattgcagaaagacagccgggaaatggagaagggaagtccgtccctccgacactgaggctgcagcgggaattcgcactcggcaccaatcagagccccatgccgcggcccctctgttgtttcagactgacacccgggcagccgagaagaacagacgctctttaagtttgattcctaacactggagttggccttaaacaaaacaaacacaaaaacttttaaagaattaaaccaaggcttagccttaagcagctcagtggaaggatgagctgctgcggaccacagccagccactgcatctgctgcacagttgaacgatgggcagtggctcacccccactcctttatttcagcaaaagctaattaaattgtaatgtttctatgtcaactactgggaagtatgttacagtcttagccaggatgcatgagagatgttatttgggagacttgagatgctttggctgatatttacatgttttcgataagaaagggatcgctgattgagttattgagatagtttttccagagctggaggtcacgtttctaaaactcacctacgaaagatagcattaaaggaacaggggctctctgaggatggccactgatgtgtgtttgtggatacctgggcatcgacccagcctgcaggtgagctctgggccatgttgccttgacacagtcacagtgtagaggntgcaggtgcacacgtgggctccagtgggactgcgctctgggagactgctccctggcatcggtcctgcggaggtggaaagttcgagaggaggagctatttgcgaggaagccctgtggcaatagagataggcttaaaagcggagagaacacagagtggaatcagccccctgtaagtaaaagggtagagaaagagatgtgtggctgggccctctcccacctgcctgttcagtggaggccagggcagcagcccagaacagcacatgtgggggaggtggccccttgtgccagcagtggctcctctctgcctttgagccctgcacagctggacccatcctaagtgccagtgagtccctcacacatttgactttagaacgtgtgcttcatgacccgttgtacagacggaggagcgagcaacacacgtctaacagcctagacaatctcgtcagatgctcatactggaccatcagcctccccattttagctgactttcccagggtcgttggcaaattttttgttctgtcttttccttgactaattgtagaactttgtgtgaggactttggttatccaaaatcacagaaatgaaccgttttgcagctgcgcagtctaaagggcaggccagtgtctggaagcagggcccacgtggcggtccgctggcaggctggtcctggggagcattctgcggacccggtcacgggcttggttagtcatgcgtacatgtgtgccttggggtgctctgcactccacggcccttctcagccacacttcccaccccagggggtgcccccaggctgatctcatttctgatgttgagggctgtttggctctgtctgtatagcttgtaacaggagccttgggctaggggctggggaaggaaagccgagctggcattcgttctctggactttttatgcctgccatacccgctaatgctcctcgaggtgcaggagcaggttgctgagccagtggctgccccgtgccctccttcccagcactatcatgtgtcacgtttcccggactctgcccctacatctcagctgaatctccagggaggctgcagagcatcgtggagaccactttctgcctcggcctttaaatgctgactcacctcctctcggaggaggcgtcctgtcttcacgggggggtcccggtggcctccagacgtagccatttcctgacatcaagatgttgaatgtaatctggtctgagctgggcctgtgggaggggccgcctgaggcctgtgcgctgttgtcctcgcagatgtacttatttttgttcatgttacgggcgttccgttccttaaagatgtatatattttcttactgtacataaagatgttccttaagtcgtacagaaggtggcgcggcaaagggcctcgtgcagtgtgttcagattgcccctggggatcttctgtgtcttcagcgcccagccctgcgtgttcctggtgaagcagtttcacatcagtctctccagatagcactacgatgtattccgcttctgaacaggatcccatgccagtgtggaacaccttcccaatcttagttcagaagtggcttgtatgacctgttcaggggtcacatgaggtctcgccagtttcctgggtcctcttcagaggccagaaagttctaagttctgagtccccggccagggtcccttaacacctcggcacagaggctgttggcaagtgtagaggctgcctctgtgtgtggtttaagtaaactggaaatgagacattgacgtgctgctcctccagaggtctgcacactccacttcacatgccgttgactctcacagtctaagacttcagggccgggacctttgtccagcctgcacagtagagtgaggctgcctctcccgccaggcattgggatcccatttagaaacggcattcacttcagaaggtactttttaactgctcagtttttgactattttaaatagtttgctgaaaactcctgataacacttgctacatatcatgttttaattgcttgtacagttaacctttaattttatttagtaaagtgtatcaaagtaggacttttttgaattgtaaataggtggttttattaaataaaagtcaatgtaaaattgtt

SEQ ID NO: 209177 - DNA, 4048 bp, Homo sapiens
  misc_feature (1957)..(1957): n is a, c, g, or t
tatcatatcgtcgaccaggcgtcgcggacgcgtgggcgctgggcatggatgcctccgtgcgcgcgcctctaaggacccggcgtacatggaatatgaagacaaggctggaagacctagcaagccaccctctccaaagcagaatgtgaggaagaatcttgactttgaaccactttccaccaccgcactcatcctcgaggacagaccagcaaatctcccagcaaaaccagctgaagaagctcagaagcacagacagcagtatgaagaaatggtggttcaggccaaaaagcgagagctgaaagaagcccagcgaaggaagaagcagctggaagaaagatgcagagtcgaggaaagcattggaaacgctgtgctcacctggaataatgagatcttacctaactgggaaacaatgtggtgctctagaaaagttcgagatttatggtggcagggaatccctccaagtgtgagaggcaaagtctggagcttagccattggcaacgagttaaatatcacccacgagctctttgacatctgtcttgcccgagccaaggagaggtggcggtcccttagcacaggaggctctgaagtggagaacgaagatgctggtttttcagcagcagacagagaagccagtctggagcttattaaactggacatttctagaacatttcctaatctctgcattttccagcaaggtggtccatatcatgacatgttgcacagtattttgggcgcttatacttgttaccggccagatgtgggttatgtccagggcatgtccttcatagcagcagtgttgatcttgaacttagatactgcagatgcctttattgccttttctaaccttctgaataaaccctgtcaaatggcgttttttagagtggaccatggccttatgttgacttattttgctgcatttgaagtattctttgaagaaaatttgccgaaattatttgcgcatttcaagaagaacaacctaactccagatatctacctaattgattggatctttaccttatatagtaaatctctgcccctcgacctggcctgtcgtatctgggacgtgttctgtcgcgatggggaagagttcctgttccgcacggccctgggcatcctgaagctgttcgaggacatcctgaccaagatggacttcattcacatggcccagttcctgacccggctgcccgaggacctgcccgccgaggagctgtttgcctccatcgccacgatccagatgcagagccgaaacaagaagtgggctcaggtactgactgcattgcagaaagacagccgggaaatggagaagggaagtccgtccctccgacactgaggctgcagcgggaattcgcactcggcaccaatcagagccccatgccgcggcccctctgttgtttcagactgacacccgggcagccgagaagaacagacgctctttaagtttgattcctaacactggagttggccttaaacaaaacaaacacaaaaacttttaaagaattaaaccaaggcttagccttaagcagctcagtggaaggatgagctgctgcggaccacagccagccactgcatctgctgcacagttgaacgatgggcagtggctcacccccactcctttatttcagcaaaagctaattaaattgtaatgtttctatgtcaactactgggaagtatgttacagtcttagccaggatgcatgagagatgttatttgggagacttgagatgctttggctgatatttacatgttttcgataagaaagggatcgctgattgagttattgagatagtttttccagagctggaggtcacgtttctaaaactcacctacgaaagatagcattaaaggaacaggggctctctgaggatggccactgatgtgtgtttgtggatacctgggcatcgacccagcctgcaggtgagctctgggccatgttgccttgacacagtcacagtgtagaggntgcaggtgcacacgtgggctccagtgggactgcgctctgggagactgctccctggcatcggtcctgcggaggtggaaagttcgagaggaggagctatttgcgaggaagccctgtggcaatagagataggcttaaaagcggagagaacacagagtggaatcagccccctgtaagtaaaagggtagagaaagagatgtgtggctgggccctctcccacctgcctgttcagtggaggccagggcagcagcccagaacagcacatgtgggggaggtggccccttgtgccagcagtggctcctctctgcctttgagccctgcacagctggacccatcctaagtgccagtgagtccctcacacatttgactttagaacgtgtgcttcatgacccgttgtacagacggaggagcgagcaacacacgtctaacagcctagacaatctcgtcagatgctcatactggaccatcagcctccccattttagctgactttcccagggtcgttggcaaattttttgttctgtcttttccttgactaattgtagaactttgtgtgaggactttggttatccaaaatcacagaaatgaaccgttttgcagctgcgcagtctaaagggcaggccagtgtctggaagcagggcccacgtggcggtccgctggcaggctggtcctggggagcattctgcggacccggtcacgggcttggttagtcatgcgtacatgtgtgccttggggtgctctgcactccacggcccttctcagccacacttcccaccccagggggtgcccccaggctgatctcatttctgatgttgagggctgtttggctctgtctgtatagcttgtaacaggagccttgggctaggggctggggaaggaaagccgagctggcattcgttctctggactttttatgcctgccatacccgctaatgctcctcgaggtgcaggagcaggttgctgagccagtggctgccccgtgccctccttcccagcactatcatgtgtcacgtttcccggactctgcccctacatctcagctgaatctccagggaggctgcagagcatcgtggagaccactttctgcctcggcctttaaatgctgactcacctcctctcggaggaggcgtcctgtcttcacgggggggtcccggtggcctccagacgtagccatttcctgacatcaagatgttgaatgtaatctggtctgagctgggcctgtgggaggggccgcctgaggcctgtgcgctgttgtcctcgcagatgtacttatttttgttcatgttacgggcgttccgttccttaaagatgtatatattttcttactgtacataaagatgttccttaagtcgtacagaaggtggcgcggcaaagggcctcgtgcagtgtgttcagattgcccctggggatcttctgtgtcttcagcgcccagccctgcgtgttcctggtgaagcagtttcacatcagtctctccagatagcactacgatgtattccgcttctgaacaggatcccatgccagtgtggaacaccttcccaatcttagttcagaagtggcttgtatgacctgttcaggggtcacatgaggtctcgccagtttcctgggtcctcttcagaggccagaaagttctaagttctgagtccccggccagggtcccttaacacctcggcacagaggctgttggcaagtgtagaggctgcctctgtgtgtggtttaagtaaactggaaatgagacattgacgtgctgctcctccagaggtctgcacactccacttcacatgccgttgactctcacagtctaagacttcagggccgggacctttgtccagcctgcacagtagagtgaggctgcctctcccgccaggcattgggatcccatttagaaacggcattcacttcagaaggtactttttaactgctcagtttttgactattttaaatagtttgctgaaaactcctgataacacttgctacatatcatgttttaattgcttgtacagttaacctttaattttatttagtaaagtgtatcaaagtaggacttttttgaattgtaaataggtggttttattaaataaaagtcaatgtaaaattgtt

SEQ ID NO: 209178 - DNA, 1887 bp, Homo sapiens
  misc_feature (1817)..(1817): n is a, c, g, or t
  misc_feature (1826)..(1826): n is a, c, g, or t
gctcgcgcgcacctgcgggtcggacccgctgcctaccgcgtgcccggcgtcctcgtcgcgcgagttgccggtcccgcggggcctgggctgcgggcccacgggtcccggggatggcgtcggagccgcgctaactccgtttctccttggaccaagatgactgatggaaaactctccacctctacaaatggcgtagccttcatgggtattctggatggtcgaccaggaaacccccttcagaacctgcaacacgtcaatctcaaggcgccccgactcctctccgcgcctgagtacgggcccaagctgaaactcagggctttagaagaccggcacagcctccagtccgtggactcggggattcctaccctggagatcgggaacccggagcctgtaccctgcagcgcggtccacgtgaggaggaagcagtccgactccgacctcatccccgagcgggccttccagagcgcctgcgcgctgccatcctgtgcgccaccagctcctagcagcaccgagcgggaacagagcgtgcgcaaatcctccacgtttcccaggacaggctatgactcggtaaagctctatagcccgacctccaaagccctgacccgcagcgatgatgtctccgtctgcagcgtgtccagtcttgggacagagctgtccaccacgctgtccgtcagcaatgaggacatcttggaccttgtggtcacgagcagctccagtgccattgtgaccctggagaatgacgatgacccacagtttaccaacgtcaccttgagctctatcaaggaaacccgtggcttacaccagcaggactgtgttcatgaagctgaggaggggagtaaattgaaaatattggggccatttagtaacttctttgcaaggaacttgcttgctagaaaacaaagtgcaaggcttgacaaacacaatgacttgggatggaagttatttgggaaagcgccactccgagagaatgcccagaaggattcaaagagaatacagaaggaatatgaagacaaggctggaagacctagcaagccaccctctccaaagcagaatgtgaggaagaatcttgactttgaaccactttccaccaccgcactcatcctcgaggacagaccagcaaatctcccagcaaaaccagctgaagaagctcagaagcacagacagcagtatgaagaaatggtggttcaggccaaaaagcgagagctgaaagaagcccagcgaaggaagaagcagctggaagaaagatgcagagtcgaggaaagcattggaaacgctgtgctcacctggaataatgagatcttacctaactgggaaacaatgtggtgctctagaaaagttcgagatttatggtggcagggaatccctccaagtgtgagaggcaaagtctggagcttagccattggcaacgagttaaatatcacccacgagctctttgacatctgtcttgcccgagccaaggagaggtggcggtcccttagcacaggaggctctgaagtggagaacgaagatgctggtttttcagcagcagacagagaagccagtctggagcttattaaactggacatttctagaacatttcctaatctctgcattttccagcaaggtggtccatatcatgacatgttgcacagtattttgggcgcttatacttgttaccggccagatgtgggttatgtccagggcatgtccttcatagcagcagtgttgatcttgaacttagatactgcagatgcctttattgccttttctaaccttctgaataaaccctgtcaaatgcagagattaggaaatgttctagaaatgtccagtttaataagctncagactggnttctctgtctgctgctgaaaaaccagcatctttcgttctccacttcagaggctcctgtgct

SEQ ID NO: 209179 - DNA, 261 bp, Homo sapiens
tctgtcgcgatggggaagagttcctgttccgcacggccctgggcatcctgaagctgttcgaggacatcctgaccaagatggacttcattcacatggcccagttcctgacccggctgcccgaggacctgcccgccgaggagctgtttgcctccatcgccacgatccagatgcagagccgaaacaagaagtgggctcaggtcagcgggctttgtgttcttggcttcccacagcgtagccggcaagtggcgtgactcaggaagg

SEQ ID NO: 209180 - DNA, 3887 bp, Homo sapiens
  misc_feature (1796)..(1796): n is a, c, g, or t
tacatgagtataactaccgcaactacgtttctacatctagtgagtttacactgaagatgtttgagatcgagcagtgatatatgtgtgtgtgtgtgtgtttatgcttggagtttctttgtgtttattctcctacttgtccttgctttccactgatggttattgatgagaggcaaaatgttagattttgatttcagactctggcaactctctcatgatactctagaattagctggtgccataagatattttgttctctcagacaccctgcactctgttcaatactctgaagctgcactctgagtcaagatgtgattaggtcagtgtgcttctgaaaaacttttttccgtgttttgttcttgtaaaacttcaaaggctcgtaattgtcctacattcgtgcccttgaggcatgtccttattttgggcctcttttgacagatgctggtttttcagcagcagacagagaagccagtctggagcttattaaactggacatttctagaacatttcctaatctctgcattttccagcaaggtggtccatatcatgacatgttgcacagtattttgggcgcttatacttgttaccggccagatgtgggttatgtccagggcatgtccttcatagcagcagtgttgatcttgaacttagatactgcagatgcctttattgccttttctaaccttctgaataaaccctgtcaaatggcgttttttagagtggaccatggccttatgttgacttattttgctgcatttgaagtattctttgaagaaaatttgccgaaattatttgcgcatttcaagaagaacaacctaactccagatatctacctaattgattggatctttaccttatatagtaaatctctgcccctcgacctggcctgtcgtatctgggacgtgttctgtcgcgatggggaagagttcctgttccgcacggccctgggcatcctgaagctgttcgaggacatcctgaccaagatggacttcattcacatggcccagttcctgacccggctgcccgaggacctgcccgccgaggagctgtttgcctccatcgccacgatccagatgcagagccgaaacaagaagtgggctcaggtactgactgcattgcagaaagacagccgggaaatggagaagggaagtccgtccctccgacactgaggctgcagcgggaattcgcactcggcaccaatcagagccccatgccgcggcccctctgttgtttcagactgacacccgggcagccgagaagaacagacgctctttaagtttgattcctaacactggagttggccttaaacaaaacaaacacaaaaacttttaaagaattaaaccaaggcttagccttaagcagctcagtggaaggatgagctgctgcggaccacagccagccactgcatctgctgcacagttgaacgatgggcagtggctcacccccactcctttatttcagcaaaagctaattaaattgtaatgtttctatgtcaactactgggaagtatgttacagtcttagccaggatgcatgagagatgttatttgggagacttgagatgctttggctgatatttacatgttttcgataagaaagggatcgctgattgagttattgagatagtttttccagagctggaggtcacgtttctaaaactcacctacgaaagatagcattaaaggaacaggggctctctgaggatggccactgatgtgtgtttgtggatacctgggcatcgacccagcctgcaggtgagctctgggccatgttgccttgacacagtcacagtgtagaggntgcaggtgcacacgtgggctccagtgggactgcgctctgggagactgctccctggcatcggtcctgcggaggtggaaagttcgagaggaggagctatttgcgaggaagccctgtggcaatagagataggcttaaaagcggagagaacacagagtggaatcagccccctgtaagtaaaagggtagagaaagagatgtgtggctgggccctctcccacctgcctgttcagtggaggccagggcagcagcccagaacagcacatgtgggggaggtggccccttgtgccagcagtggctcctctctgcctttgagccctgcacagctggacccatcctaagtgccagtgagtccctcacacatttgactttagaacgtgtgcttcatgacccgttgtacagacggaggagcgagcaacacacgtctaacagcctagacaatctcgtcagatgctcatactggaccatcagcctccccattttagctgactttcccagggtcgttggcaaattttttgttctgtcttttccttgactaattgtagaactttgtgtgaggactttggttatccaaaatcacagaaatgaaccgttttgcagctgcgcagtctaaagggcaggccagtgtctggaagcagggcccacgtggcggtccgctggcaggctggtcctggggagcattctgcggacccggtcacgggcttggttagtcatgcgtacatgtgtgccttggggtgctctgcactccacggcccttctcagccacacttcccaccccagggggtgcccccaggctgatctcatttctgatgttgagggctgtttggctctgtctgtatagcttgtaacaggagccttgggctaggggctggggaaggaaagccgagctggcattcgttctctggactttttatgcctgccatacccgctaatgctcctcgaggtgcaggagcaggttgctgagccagtggctgccccgtgccctccttcccagcactatcatgtgtcacgtttcccggactctgcccctacatctcagctgaatctccagggaggctgcagagcatcgtggagaccactttctgcctcggcctttaaatgctgactcacctcctctcggaggaggcgtcctgtcttcacgggggggtcccggtggcctccagacgtagccatttcctgacatcaagatgttgaatgtaatctggtctgagctgggcctgtgggaggggccgcctgaggcctgtgcgctgttgtcctcgcagatgtacttatttttgttcatgttacgggcgttccgttccttaaagatgtatatattttcttactgtacataaagatgttccttaagtcgtacagaaggtggcgcggcaaagggcctcgtgcagtgtgttcagattgcccctggggatcttctgtgtcttcagcgcccagccctgcgtgttcctggtgaagcagtttcacatcagtctctccagatagcactacgatgtattccgcttctgaacaggatcccatgccagtgtggaacaccttcccaatcttagttcagaagtggcttgtatgacctgttcaggggtcacatgaggtctcgccagtttcctgggtcctcttcagaggccagaaagttctaagttctgagtccccggccagggtcccttaacacctcggcacagaggctgttggcaagtgtagaggctgcctctgtgtgtggtttaagtaaactggaaatgagacattgacgtgctgctcctccagaggtctgcacactccacttcacatgccgttgactctcacagtctaagacttcagggccgggacctttgtccagcctgcacagtagagtgaggctgcctctcccgccaggcattgggatcccatttagaaacggcattcacttcagaaggtactttttaactgctcagtttttgactattttaaatagtttgctgaaaactcctgataacacttgctacatatcatgttttaattgcttgtacagttaacctttaattttatttagtaaagtgtatcaaagtaggacttttttgaattgtaaataggtggttttattaaataaaagtcaatgtaaaattgtt

SEQ ID NO: 209181 - DNA, 1584 bp, Homo sapiens
gctcgcgcgcacctgcgggtcggacccgctgcctaccgcgtgcccggcgtcctcgtcgcgcgagttgccggtcccgcggggcctgggctgcgggcccacgggtcccggggatggcgtcggagccgcgctaactccgtttctccttggaccaagatgactgatggaaaactctccacctctacaaatggcgtagccttcatgggtattctggatggtcgaccaggaaacccccttcagaacctgcaacacgtcaatctcaaggcgccccgactcctctccgcgcctgagtacgggcccaagctgaaactcagggctttagaagaccggcacagcctccagtccgtggactcggggattcctaccctggagatcgggaacccggagcctgtaccctgcagcgcggtccacgtgaggaggaagcagtccgactccgacctcatccccgagcgggccttccagagcgcctgcgcgctgccatcctgtgcgccaccagctcctagcagcaccgagcgggaacagagcgtgcgcaaatcctccacgtttcccaggacaggctatgactcggtaaagctctatagcccgacctccaaagccctgacccgcagcgatgatgtctccgtctgcagcgtgtccagtcttgggacagagctgtccaccacgctgtccgtcagcaatgaggacatcttggaccttgtggtcacgagcagctccagtgccattgtgaccctggagaatgacgatgacccacagtttaccaacgtcaccttgagctctatcaaggaaacccgtggcttacaccagcaggactgtgttcatgaagctgaggaggggagtaaattgaaaatattggggccatttagtaacttctttgcaaggaacttgcttgctagaaaacaaagtgcaaggcttgacaaacacaatgacttgggatggaagttatttgggaaagcgccactccgagagaatgcccagaaggattcaaagagaatacagaaggaatatgaagacaaggctggaagacctagcaagccaccctctccaaagcagaatgtgaggaagaatcttgactttgaaccactttccaccaccgcactcatcctcgaggacagaccagcaaatctcccagcaaaaccagctgaagaagctcagaagcacagacagcagtatgaagaaatggtggttcaggccaaaaagcgagagctgaaagaagcccagcgaaggaagaagcagctggaagaaagatgcagagtcgaggaaagcattggaaacgctgtgctcacctggaataatgagatcttacctaactgggaaacaatgtggtgctctagaaaagttcgagatttatggtggcagggaatccctccaagtgtgagaggcaaagtctggagcttagccattggcaacgagttaaatatcacccacggtgagtggcctgcatgatcctggggagtccacctccaggccctttggcttcttctctcccttttgccctgttggaaagaatggcagccattgccacgaatctgtgtcttttgagagaccaggagactgtgtccttcaggagagaggcagttgggaggcctg

SEQ ID NO: 209182 - DNA, 390 bp, Homo sapiens
atcttaacaaacttaaaagaattggaatcttacaaaatgtgttttctaaccaaattgaaattaaactagaaattaataacaagaaaatttccaaacacagaaattacacacacttctaaatattatgggtcaaaaaggaaatcttggtagaaataaaaaatacattgatctgcaagaaaatgaaaatacaacattgttaattttgtgggatctaattaaagcagccccaagatggaaatttataacagtaaatgaacattgggaaacagaaaaggtttcagaacaattgtctaatctctcgtctagacaaaaagagcaaaataaactcaaagcaagcaaaaggaaggaaatagaaaagataagagcagaaatcaatgatgttgaaaatat

SEQ ID NO: 209183 - DNA, 405 bp, Homo sapiens
accctcaagctcccttgcagactagtgggcaccaaagtttgggaaataactgtgggagaaaaccttaaactttagaaattttattatgtagtgatttttttctgcatattgggaggagattgccagcattccttttctgggcgatcccctagccccgtgggatgatgtgaggacacctagagcaggaggaaggacccactgtgggaaaagggtgtgtggacagaggctgcgcagaggcgggagggcctccagaggaggacgtgtccgcggggttggggaagcacctcttgtgtcccatgcagcctgaaccctcctgcagctggaagggtttaggtccaactgcccaacaacatggagtgactcagagaaagctgatggagaatacagggtaccagggcatcacct

SEQ ID NO: 209184 - DNA, 344 bp, Homo sapiens
agcactatgtctactcactaaggccaaccttgctatggccactgttgagtgcccagtctaccagcagaagagaccaacactgagtgctttatatggactcattcgttaagaagagtgaacatcacccgaggactttgcattgtcttctggggaaagggccttcagggcagagttgaggctttccagaaggagaagagattctgccagtgggcagccattcaattcatgcccaagaggtccagcctgcccttcattagggcttgccctgcagacttcagacttgtccaaccaaccccacaattgtgtaagccagtcatttgcaataaatctgtttatatatctcc

SEQ ID NO: 209185 - DNA, 371 bp, Homo sapiens
caatcaaacttaatctagagtgttgctgtcattgaagaattttgtagatgtagtaaaagtccgtagtcagttgactttacgcaaggaaacttgacttagaaaacctggatagattgcttctcggccttttggctaagatcaagtgtagaaaacctgggtgggactgattaaatgtgtttgaaaggccttcagggcagagttgaggctttccagaaggagaagagattctgccagtgggcagccattcaattcatgcccaagaggtccagcctgcccttcattagggcttgccctgcagacttcagacttgtccaaccaaccccacaattgtgtaagccagtcatttgcaataaatctgtttatatatctcc

SEQ ID NO: 209186 - DNA, 1160 bp, Homo sapiens
aactcctggcttcaggtgatccatccacctcggcttcccaaagtgcggggattacgggtgtgagccactgcactttttaattttttaaagacatgacgtcttactatattatccagtctggcctccaactcctgggcttaagcaatcctccttcctcagcctcgctagtaggtgggattacaggcatgagccaatgcgcccagcttaaaaacttacttaggaaggaatgtctgggactaacaggagatgtatctgtcttccttaaaacaggttttgtagtgagtccctcttgctgtgtatctgctgcttcattgtggtccccttcctctaccttttttttatgactgagcttttttgtactgtcagagtttaatttaagagaaggatagcagttggactgaacattccaggatggagacaataaagttaatttgtctctcacattcagaggtagaagtggcaggctttgtcagtgtttcagcaggtaagaaatcttgactagtaggaataagtcagaatctcagggactctttatacctgttcaccctgtcctgggaccccgctcagatttctccacaccagagtggccttctctggccaccttctaagagagacctccccatctcacctgtttccccttcttacgtagttttatgtttccttagcaatggatagcagttgatgtatcaaaataaagacttgcactgttcgcttaatgccttcctcgaccaacaagcaagttctagaacagcaagtgctgtgtcttgtttcctacggactcccctgagctgtggtgcctggcacatgattggagatgggcaggtcgttgttgagtgagtgaatgaagccatacaaatacgaacccagatattgaggccactttattgttaaatgttttatcaacaattgacacttctatcctattttcatgttgttatataatatgactatatatgtactcagactcccaagtaaatatttgtgcttactttactctgacctaaactggtgcctggcaccagagtaggctcacaaaatgcttttctcacagtgaccgcctaacaaacctagacattagctgaggtttatagagcactgtgtcattctaaatagcctgaagacatagtttctattattcctgtttccagttctctttctaa

SEQ ID NO: 209187 - DNA, 1060 bp, Homo sapiens
  misc_feature (93)..(93): n is a, c, g, or t
gggtcctcttcctctaccctttttttatgactgagcttttttgtactgtccgagtttaatttaagagaaggatagccgttggactggaccttnccggatggagaccataaagttacttaggaaggaatgtctgggactaacaggagatgtatctgtcttccttaaaacaggttttgtagtgagtccctcttgctgtgtatctgctgcttcattgtggtccccttcctctaccttttttttatgactgagcttttttgtactgtcagagtttaatttaagagaaggatagcagttggactgaacattccaggatggagacaataaagttaatttgtctctcacattcagaggtagaagtggcaggctttgtcagtgtttcagcaggtaagaaatcttgactagtaggaataagtcagaatctcagggactctttatacctgttcaccctgtcctgggaccccgctcagatttctccacaccagagtggccttctctggccaccttctaagagagacctccccatctcacctgtttccccttcttacgtagttttatgtttccttagcaatggatagcagttgatgtatcaaaataaagacttgcactgttcgcttaatgccttcctcgaccaacaagcaagttctagaacagcaagtgctgtgtcttgtttcctacggactcccctgagctgtggtgcctggcacatgattggagatgggcaggtcgttgttgagtgagtgaatgaagccatacaaatacgaacccagatattgaggccactttattgttaaatgttttatcaacaattgacacttctatcctattttcatgttgttatataatatgactatatatgtactcagactcccaagtaaatatttgtgcttactttactctgacctaaactggtgcctggcaccagagtaggctcacaaaatgcttttctcacagtgaccgcctaacaaacctagacattagctgaggtttatagagcactgtgtcattctaaatagcctgaagacatagtttctattattcctgtttccagttctctttctaa

SEQ ID NO: 209188 - DNA, 242 bp, Homo sapiens
tgagatgaaagccatctctctgtccttgaatctctgccgtgatttagaggaaagagttaaatagacttatttcaaatcccaactctgcctcttccctactctgtggtcttgagcaagtcaggtcctcaatttccttatccataaaacgggcagataacagtgcccacctcatggggctgttgtagggatgaaatttgaacatgcaaaataaagccctcaacacagtgcttagcacatagtaa

SEQ ID NO: 209189 - DNA, 412 bp, Homo sapiens
ctatttcaactcttctttcttagatctttgaattatgggatattaaaaataaacctagaggatattgcaatgaatttttggagcagctggaaaagaaaccataaaacgagtgattacaatcagcaaagtgtgataacagctgaacgcattagacccatccttaaaaagccagaccccaccccctcccctcttgagcctgttcgatagagaaggggatgtcacacaatacaatccaaacacatactctgtccatattgggttaagaaaatatagtgctggtcattgtccccaaatgacagacatccacagatggaaagcaggagaatctgacttccacggtgcttctcattccaccagacagattctgtttggaaaacacccacctgcactaggatctggcctgagtactatt

SEQ ID NO: 209190 - DNA, 356 bp, Homo sapiens
cccagttcaagagtttgataacatcatagtccctcattctgagttgcttgatttattaccagtataattgaactaatctcagattttactcccccttccctatccccagtttaatatgtaggatagagagagtggtcaacctcagaatccgaaaaagaacagtgcatatttgccatgtgtgtttccctttaagcattataaacatccagagttttagacaaattattacgttggtacaaaagtaactgcggtttttgcagtctttatctttgctaaaattattcagcgtttctggaaagtatttgccttatgttcctaggcctatcatgaggttttaaaaatgtatactaattact

SEQ ID NO: 209191 - DNA, 433 bp, Homo sapiens
gacaagagttgcactatgttgtccaggctggtctcaaactcccgggctcaagtgatcctcctgcctcagcctttcaaagtgctggtattacagagagatgccaactccctgtggcgacgtcacagaagcatttaccaagatgcagagttgaatttggcctgtgagcagtattcactgaactcagctgggtctttggcgatacacactgatgggtgatttttaattataactattaatcttctttaaagtcaaagaaaggacattttgtctttttgcaaaaatatttgctatttcatctttgatatcagtggagaccttccttccccagtcttttctgaaatgcctatggcattaaagtgtaatgattaccaacattcatactacaagaatcaatttcgagagttgtaaacttattaaacattaaaataaagca

SEQ ID NO: 209192 - DNA, 510 bp, Homo sapiens
catgaaccaccgtgcctggactcctcttccccttttaaagatcatccatcattgtatttctcagaaatttgtttctaaagactcttatctctcttatgtcttccccttagggtgtggtggctctcaaccaggggtgcttttgcccttcaagggccatttggcaacatctggagacatatttggttgtcatgactgagggaaggatactgttggcatctatctactaggtaagggcctgggatgcagctctccaccctacagtgcccaggacagcccctcacagcaaggaattagcacaaaatgttgacagtgccaggtaccatggggccagcctatagacccagcttctcgggaggctgacatgggaggattgcttaagcacaggtgtttgagtctagcctgagcaacattgtgaaactctgctctatttttttttaagtgccaagatgaagagatcctatttggggcaactttgtatacctcgtaatcacctgaagtgctcggtaaaaa

SEQ ID NO: 209193 - DNA, 247 bp, Homo sapiens
agttcaaaggccaactcatttgctactgctggagcgggcaaacaacgcacactcacagaaactaaataagtgaatgaggaaaatggagtgcacaaagacatgagaggacagaccagtgagaccagaatgcagtcaacaagagaggggttagggtcgaaaaggcccaggaaaggggtggggtgctaccgaattctgacttttttcctttataggtatttacttatatctggtctcagagacacacagg

SEQ ID NO: 209194 - DNA, 797 bp, Homo sapiens
tccacctcccgggttcaagcgattctctgtctcagcctcctgagtagctgggattgcaggcatccgccaccacgcccggctaatttttgtattttttgtagaaacgggatttcaccattttggccaggctggtctcgaactcctgacctcgtgatccacccgcctcggctcccaaagtgctgggattacaggtgtgagccaccgtgcctggcttcttttgatatctcgttatctcctgttgggaccacagcatttcactaatcagccacttgtagtttttgattctggcttccttcagggaagacatgctacagtcatcctgactagaggctctggagatccctcaagccttttctaaggatgcgtcctccgtggactttttgattgtagcttaactaaagagcttgtgccagtttgtatgcaggaatgcctctgttgtctgccggctgttccgcagcctcgctggtgtcctagtaagctgggggctgcaccgccacctaatgtctgcgtacgttactacaagctctggtttatgacggatggctttgttctcagtagcttccttacctggggtcctgttacttcagtgtttatattcaggcaagacagaaacttgtcccttagcagtgccctgaaaagtcagaacgttatgagccttgtgttgtgttacaggaaaaaagagaaaaaaaaagtcagaatgttagatggatattcccatactttctctccccaggagaaaatggaagtgtggttttctcacagtgatactacatcatggcaggatagggcctcaggtg

SEQ ID NO: 209195 - DNA, 540 bp, Homo sapiens
  misc_feature (468)..(468): n is a, c, g, or t
aagtgtttagctacgggaagatgatcatcttctccttgtctaatgacatggaaatcagaacaagccaacacagatggtgaaataaaaagataaagcaaatttggttggttgaacctacattttgcaatgctacagatttatgaacacttttggttaagcagccattcactgtgattcatagagatctaaggtaccggtcctcaaattccatacttctgtctttcccaaagtgggccagtgaatacttcttcacctgttatacacaaatgtcaatcaactgccaatgttctccacggacaagtcagttagtaatatgagacaatgaatgaaagaaacagttacactaaactgttgcatgtaactgaacacaccatctaagtgccagcaggcatactgaggaagtgaccttattcagcaaatattttttaagaactcatgacactgaaggataggattccatttggggantccatttggggattccatttggggattccatttggggattccatttggggaatccatttggggaatccatgg

SEQ ID NO: 209196 - DNA, 488 bp, Homo sapiens
  misc_feature (416)..(416): n is a, c, g, or t
aagtgtttagctacgggaagatgatcatcttctccttgtctaatgacatggaaatcagaacaagccaacacagatggtgaaataaaaagataaagcaaatttggttggttgaacctacattttgcaatgctacagatttatgaacacttttggttaagcagccattcactgtgattcatagagatctaaggtaccggtcctcaaattccatacttctgtctttcccaaagtgggccagtgaatacttcttcacctgttatacacaaatgtcaatcaactgccaatgttctccacggacaagtcagttagtaatatgagacaatgaatgaaagaaacagttacactaaactgttgcatgtaactgaacacaccatctaagtgccagcaggcatactgaggggattccatttggggantccatttggggattccatttggggattccatttggggattccatttggggaatccatttggggaatccatgg

SEQ ID NO: 209197 - DNA, 1820 bp, Homo sapiens
ctcattcttgtatgcttttctcagaaggaaagaaaacaagaaggcttttgaggggacacttgctgggacaggcactaagccttctacagtttgatagctctaaccagcagatacagacttctcagtaggaaggggtgaggcagctgtcctgagccaggagctccaccatatcgtgtcccatcctgttaaggcaattttgagaggctgctctggaatatgtctcaatggtggatgtagggaaacttcacaggctttgatgggactgaggtggtgtctgttgtgtgaagacaggagctgaatgctcaggatctaggctgcttttcttgtggtcagttgggttacctgtttgggaccaagtccatgtttactaaggaggctgaataaattctacagaggaaagtggagctcccaggatgaccgaggaagggtaagaaaagggatctcctttacagaaaagggctcagataagaagagacaattcaaacaaaaagccgagaccccctcctcccattccagtgagaagcacaggcaaagacaggaaccagagtcgagctcacatgagggaaactccaagaaaaggaaaatcggttccaaggacagctgccaagacagagctggtagaattttgcctttttcccccaaagggaaaataagcagttgacttttatagagggtttgagcagcaaggtgactgaaaaaatttttgagatcctggcactcagagaatatttggggactcagaaggtgttaaatttcacttcatttaagtactaatatggtcaggatggaggggaagattcaaatgttcacctgaaggtgcatgggaggttttggaaatgagggtcggtgggaactgtgctggcgagtatctcactcacatgcttcttttgcggggatctgtccaggagaggagcacagcttgatgttgaaaaagaaactaaagtcctccactttgcacagcaataaactcaaggagacctgtgatgcccaccacagagggcctttcatgactcacactgggtgcaccaagcagcacaggtctcagaccctaggagttcaatggctgtcatttcagaaaagcttggtgactttacaagctgtgtcaaggccatttatcaagacctatactgggtatcggtgcagcaggtccattctccactgacctgggagcagctcactcagcttgcccggttctggcggcctctatgtgctcaggtgcagaccttctattttatagccacccaggtaggttatgtcttccctgctaagaactggcttgtttcagccacattgcctggcctggggatccagccctggatagagaagcccatcccttgcctgggcaggagataactgagcctgtcagtgggtcagatgaggcttgagctgggtgcaccctgaccccattcagcagaaattgcaggtcttggaatgagagcaagaacctgctataggaaagtagcttgaacaatatactcaaaatggtgaaccctgcatttcacagagggctaagattataaacaaattttatgtttcttgttagacatttgatgtctttcagatgtctggtgacagtcatgcatttctatataatcagacaaatattaggatgtaatcattcatatgcctttgcaaattttaaattgtagaaaaataaataaaaagttatatgtttctcttttaattcagaaaaggctgtagcctctaactttcccacgctgagcccatggaggactaatatccacaaatctttaattgtactccctgtgggaaaatgttaatatatttttacagtttaataaaattatggtgaaatcact

SEQ ID NO: 209198 - DNA, 1720 bp, Homo sapiens
ctcattcttgtatgcttttctcagaaggaaagaaaacaagaaggcttttgaggggacacttgctgggacaggcactaagccttctacagtttgatagctctaaccagcagatacagacttctcagtaggaaggggtgaggcagctgtcctgagccaggagctccaccatatcgtgtcccatcctgttaaggcaattttgagaggctgctctggaatatgtctcaatggtggatgtagggaaacttcacaggctttgatgggactgaggtggtgtctgttgtgtgaagacaggagctgaatgctcaggatctaggctgcttttcttgtggtcagttgggttacctgtttgggaccaagtccatgtttactaaggaggctgaataaattctacagaggaaagtggagctcccaggatgaccgaggaagggtaagaaaagggaaccagagtcgagctcacatgagggaaactccaagaaaaggaaaatcggttccaaggacagctgccaagacagagctggtagaattttgcctttttcccccaaagggaaaataagcagttgacttttatagagggtttgagcagcaaggtgactgaaaaaatttttgagatcctggcactcagagaatatttggggactcagaaggtgttaaatttcacttcatttaagtactaatatggtcaggatggaggggaagattcaaatgttcacctgaaggtgcatgggaggttttggaaatgagggtcggtgggaactgtgctggcgagtatctcactcacatgcttcttttgcggggatctgtccaggagaggagcacagcttgatgttgaaaaagaaactaaagtcctccactttgcacagcaataaactcaaggagacctgtgatgcccaccacagagggcctttcatgactcacactgggtgcaccaagcagcacaggtctcagaccctaggagttcaatggctgtcatttcagaaaagcttggtgactttacaagctgtgtcaaggccatttatcaagacctatactgggtatcggtgcagcaggtccattctccactgacctgggagcagctcactcagcttgcccggttctggcggcctctatgtgctcaggtgcagaccttctattttatagccacccaggtaggttatgtcttccctgctaagaactggcttgtttcagccacattgcctggcctggggatccagccctggatagagaagcccatcccttgcctgggcaggagataactgagcctgtcagtgggtcagatgaggcttgagctgggtgcaccctgaccccattcagcagaaattgcaggtcttggaatgagagcaagaacctgctataggaaagtagcttgaacaatatactcaaaatggtgaaccctgcatttcacagagggctaagattataaacaaattttatgtttcttgttagacatttgatgtctttcagatgtctggtgacagtcatgcatttctatataatcagacaaatattaggatgtaatcattcatatgcctttgcaaattttaaattgtagaaaaataaataaaaagttatatgtttctcttttaattcagaaaaggctgtagcctctaactttcccacgctgagcccatggaggactaatatccacaaatctttaattgtactccctgtgggaaaatgttaatatatttttacagtttaataaaattatggtgaaatcact

SEQ ID NO: 209199 - DNA, 1432 bp, Homo sapiens
ctcattcttgtatgcttttctcagaaggaaagaaaacaagaaggcttttgaggggacacttgctgggacaggcactaagccttctacagtttgatagctctaaccagcagatacagacttctcagtaggaaggggtgaggcagctgtcctgagccaggagctccaccatatcgtgtcccatcctgttaaggcaattttgagaggctgctctggaatatgtctcaatggtggatgtagggaaacttcacaggctttgatgggactgaggtggtgtctgttgtgtgaagacaggagctgaatgctcaggatctaggctgcttttcttgtggtcagttgggttacctgtttgggaccaagtccatgtttactaaggaggctgaataaattctacagaggaaagtggagctcccaggatgaccgaggaagggtaagaaaagggaaccagagtcgagctcacatgagggaaactccaagaaaaggaaaatcggttccaaggacagctgccaagacagagctggagaggagcacagcttgatgttgaaaaagaaactaaagtcctccactttgcacagcaataaactcaaggagacctgtgatgcccaccacagagggcctttcatgactcacactgggtgcaccaagcagcacaggtctcagaccctaggagttcaatggctgtcatttcagaaaagcttggtgactttacaagctgtgtcaaggccatttatcaagacctatactgggtatcggtgcagcaggtccattctccactgacctgggagcagctcactcagcttgcccggttctggcggcctctatgtgctcaggtgcagaccttctattttatagccacccaggtaggttatgtcttccctgctaagaactggcttgtttcagccacattgcctggcctggggatccagccctggatagagaagcccatcccttgcctgggcaggagataactgagcctgtcagtgggtcagatgaggcttgagctgggtgcaccctgaccccattcagcagaaattgcaggtcttggaatgagagcaagaacctgctataggaaagtagcttgaacaatatactcaaaatggtgaaccctgcatttcacagagggctaagattataaacaaattttatgtttcttgttagacatttgatgtctttcagatgtctggtgacagtcatgcatttctatataatcagacaaatattaggatgtaatcattcatatgcctttgcaaattttaaattgtagaaaaataaataaaaagttatatgtttctcttttaattcagaaaaggctgtagcctctaactttcccacgctgagcccatggaggactaatatccacaaatctttaattgtactccctgtgggaaaatgttaatatatttttacagtttaataaaattatggtgaaatcact

SEQ ID NO: 209200 - DNA, 1532 bp, Homo sapiens
ctcattcttgtatgcttttctcagaaggaaagaaaacaagaaggcttttgaggggacacttgctgggacaggcactaagccttctacagtttgatagctctaaccagcagatacagacttctcagtaggaaggggtgaggcagctgtcctgagccaggagctccaccatatcgtgtcccatcctgttaaggcaattttgagaggctgctctggaatatgtctcaatggtggatgtagggaaacttcacaggctttgatgggactgaggtggtgtctgttgtgtgaagacaggagctgaatgctcaggatctaggctgcttttcttgtggtcagttgggttacctgtttgggaccaagtccatgtttactaaggaggctgaataaattctacagaggaaagtggagctcccaggatgaccgaggaagggtaagaaaagggatctcctttacagaaaagggctcagataagaagagacaattcaaacaaaaagccgagaccccctcctcccattccagtgagaagcacaggcaaagacaggaaccagagtcgagctcacatgagggaaactccaagaaaaggaaaatcggttccaaggacagctgccaagacagagctggagaggagcacagcttgatgttgaaaaagaaactaaagtcctccactttgcacagcaataaactcaaggagacctgtgatgcccaccacagagggcctttcatgactcacactgggtgcaccaagcagcacaggtctcagaccctaggagttcaatggctgtcatttcagaaaagcttggtgactttacaagctgtgtcaaggccatttatcaagacctatactgggtatcggtgcagcaggtccattctccactgacctgggagcagctcactcagcttgcccggttctggcggcctctatgtgctcaggtgcagaccttctattttatagccacccaggtaggttatgtcttccctgctaagaactggcttgtttcagccacattgcctggcctggggatccagccctggatagagaagcccatcccttgcctgggcaggagataactgagcctgtcagtgggtcagatgaggcttgagctgggtgcaccctgaccccattcagcagaaattgcaggtcttggaatgagagcaagaacctgctataggaaagtagcttgaacaatatactcaaaatggtgaaccctgcatttcacagagggctaagattataaacaaattttatgtttcttgttagacatttgatgtctttcagatgtctggtgacagtcatgcatttctatataatcagacaaatattaggatgtaatcattcatatgcctttgcaaattttaaattgtagaaaaataaataaaaagttatatgtttctcttttaattcagaaaaggctgtagcctctaactttcccacgctgagcccatggaggactaatatccacaaatctttaattgtactccctgtgggaaaatgttaatatatttttacagtttaataaaattatggtgaaatcact

SEQ ID NO: 209201 - DNA, 455 bp, Homo sapiens
ctagaaacagcactgctagattaggtaaaatttgactctttcaaggtaaaaagagaaagggctgcaacacagtctcccctggcaaggaaactgggagctctttggcagccagggccatatagacatggattctggagaacagaggagagctgggtttgatagctacttcagctcctttgtgtccaggatgaactaaggcttctagggtgtttggttggagacacttactcaaactcttattttatcaacagaaccagagtcgagctcacatgagggaaactccaagaaaaggaaaatcggttccaaggacagctgccaagacagagctggtagaattttgcctttttcccccaaagggaaaataagcagttgacttttatagagggtttgagcagcaaggtgactgaaaaaatttttgagatcctggcactcagagaatatttggggactcagaa

SEQ ID NO: 209202 - DNA, 390 bp, Homo sapiens
cattgatgttttctctatgttagaatatattgggataaattgcaatttgttgtggtcatagaaaaatgtgtgcacatgcatgtgtgtgtaattgtgtgtatgtgctgaagaaagaaaaaggccataaaatcaagctgctgttataccattaaagcctcttaacagaaaactattactgagcatgaactgccagccaaaggtcttggcttggcttggtttgcagacagataaagaatttgtgatgggtacttagcttagattctgtagaattaatctacagaacacttgtgcagaccgtaaatagagatgagtgcttgctctctgatttggaagacagctaattagatattatgaaagcttacattgttgaaagaaggtaaattagaaaca

SEQ ID NO: 209203 - DNA, 174 bp, Homo sapiens
aatgttcattcatgtggattaaaaaaggtagagatccactttacaaataaaattttaaatcaaattaatttctcaaattttcattacatacaaagaacagcaaaaaagaaataatctctttctctctaaaccaaacaaaaccctgccttatttaccgctactattctagcatta

SEQ ID NO: 209204 - DNA, 211 bp, Homo sapiens
taaaccgggcaataagaggtatcttgtgtttttttaatgtactttctgagcatagaggagcaaagagcaccttccaattacccaacagagctcagctttgaagcttcagtgtggcctcaaggactatccatgtctcataaactacagcaggcagaacaataccttccaagatgaaagtgacagtctccatgctaaagagaggtgaaagagc

SEQ ID NO: 209205 - DNA, 412 bp, Homo sapiens
atcctaggacctgccatcttttccagaattcgccttatcaatgtactgtcctctctatcttcctccctaactaaaaattccttctctttaacctgcttcttcagatgtccatgccttctcacttctccttgccaaacctctcaggggtgacggtccaccccgactgccttattctacctctccttaacctcttgcaatttggattctgccccagtcactttgtggagagttttcttgagaccagcctctcagagagaacatcagctgtcagatccgacagcctcctcattttccattattttcagctagctcaagacaggacccagccctgctgggtgaccatctcctctcgaccttcctccctgcccttccggcctgcaccatctcctacccatgcctcggggcattccct

SEQ ID NO: 209206 - DNA, 437 bp, Homo sapiens
acagaacccactgacagatgaaggagccagatctaacagggcagagcagtgatgttccaggccaacagtctccaattttctgatcgcacactctatgaacagacgtatatttagaccacctcccacacacatatgtattaaaatgcttacttaggaattacatgcatattgccgtacagatttattgatacattctaaatgaaatgggatagttcccttgaccccttcacaggactcagcccacagctctcagcccctcatgggaggagcagcatgcaggtgagtgggtgcaggggctggggtgagtgcttttgggcatcggcaggagtagaactctgtgcagccccccggcagcatctgggtggggctacctgtgacccctggagccctagagggcatatgttacagtgtgctcttagatttgctgtccacagatg

SEQ ID NO: 209207 - DNA, 247 bp, Homo sapiens
ccattattttccaggaaataaaatcaaatttatttttagaacattttaaagcaatagccccagttagagccctgtgctatgactagaatagtttccctaatctaatattcatggatgactgactcatgttcaatattgaattttataagtttctttctctttcttgtaattataacttaggcatcccaggataaaaaagcaaaaacgagagtgaatgtgaagtaaatgaattgtatttccagtgaca

SEQ ID NO: 209208 - DNA, 505 bp, Homo sapiens
agtcatgagacacgggacacatcccatcagttctcatcttttcagtagacacagtcgtagtgccaaatacaggctttgtttggagggtaatgcatacaccgtgctcagttccaagttggccacatagtgagtgctcaagatgtgatagagatggctttggttctttttatagggctggtttgggctcatactttgttagtatagctcatgattaaaggtttggggattctgtgaagtgccttatgcctgtaatcccagcattttgggaggctgaagcggaaggattgcttgagaccaggagttcaagaccagcctggagaatacagcaagactcccacctctacaaaaaatgagccaggtggtggcacgtgactgtagtctcagctactcaggaggctgaagtgggaggatcacttgaacccaggaggtcaaggctgcagtgacctatgcttgtgccactgtactccagtctggcgacagagggagaccctgtctcaaaaaaaaa

SEQ ID NO: 209209 - DNA, 642 bp, Homo sapiens
aggagacggtaccaggggcagagggcaaagccaggcctctctgggcaggtttggtttcttgaccacacagcaggcaagggccgactcacgttctgggtgaagtcttggtgcacagccacacccacccactcatgtcacctggggctgacacttgccaccgtgatgaccacagagggcccgaggagctggaagtgttgactgcctggccccgtcagggaagttgccagcctggcttagagtcctgtcgggggatgtgttatgtgagctgcacatgccatcttaagtgttctagtcagcacgttaaaaaaaaggcaaatttacttcatggaccccaatgtgttcaaaataccatcctttcagtagtggcactctcccatggctggtggctgctgtgtggggcctgggtgatgagcggtgggcagccacgcagagacctctgagaagagtggtccaggccacgagagcagccagtgcaaaggccctgagccacctcgagcggcacaggggccctgagtgagggggtgtttgcggccaggcctgagtccccagtggcaggagggtgaagagtcagagcagtcgcgtgttcctcataagtgcgtaccgagtgcctgctgggtgctgagatgtagcagcagagagggg

SEQ ID NO: 209210 - DNA, 573 bp, Homo sapiens
tgacagctaccatcaagtaagtaaaaaacccacgcttctaacaattttttgcttatacccggctatgcatgccagagcaaatatttagagtaaattgtgggaactaagaacacaaagtatgttgatttctttattacagctagcagatatctaagaatattatcacaggtctttgaataaattttgcttctaagagaagttactatttattcttaattagatggggaggaaaatctctttgaagaggagcctctacttcactatttgcagtaagaatcatgaaagtttaatttttgtaccaacatccatgttctctatcacctgcataagctaagtgaggtggacattccactgcaaactaatagcagaaataaaaactccctctctccacagctcctagttataaggctgtcttctcaagaggggcagtatgtcaacatttctcatccaataagtgagggtctctcttctttctctcagaacccactcatagaacagaagaaagcccttcacctctcggcctcatatacacagatcatagtctagcaacaggtagctgaggtcaggatgcac

SEQ ID NO: 209211 - DNA, 150 bp, Homo sapiens
ttgcctgctcacatacatgtcaatcagcatgtgttcctgggggccgtggtcctgttcctggctccctgtgcgctcatcttggtctcctacatccgcattgctgcagccatcctccggattccctctcctacaagaaggcgcaaggcatgt

SEQ ID NO: 209212 - DNA, 337 bp, Homo sapiens
attttgaaaaatgagtagacctcactttatctgtagcgtcgcctaaatttcccagtcatacagtcattgctctaaaatattctatgttggacatagattctgtgacacaattaataacaaattaaaattaaagtaagcttttggcacttacaaattggcttgatcaaatgaggccccttagtcccccagttaagataatttattacggcccaatagaagttgaaacagcaccttcaaggattaaaatttattatataaaaccgaattaataaaagcgtgattatcgacaccacatctccatttagcaacccaaaagttcttcctgttcccaaatctg

SEQ ID NO: 209213 - DNA, 547 bp, Homo sapiens
tacagtgaagccaagcgtaagataagcagtgttaaatcatcatctctgccaaatataaatgagacagacgtagggcaggttgtttttctttagagcagctcttcaaaggccatctagagttggacttttatagaaaaaggaagatttctctaagatctccagatctaagatttcacagtgctatcacttaattattttgattagttcattttaattttttcttagaaaatattctaacagattttaaaataagtagaaagagacaattagcctcttggtcatcataataaaaaaagtgagttgagttcattaaggaattgaatagagatgaaatattcccggcaggagaacattctcttatagttcagtggcataagataaagatagaaacaggagcttttaaagggactttatgggtggctggcttgggtgattttatccacatgtggcctccattgcagctggccccagagtcacatttctagctctgtcctttgtcttgggacctaaactttttttaaccccatcttggcagctccaactgata

SEQ ID NO: 209214 - DNA, 748 bp, Homo sapiens
aatgattatagcttcctttcagatttgcaacagattttgatctaaatattgagtataaaaaaaaaaagttaaatttaaaggatgagactgataacaatcataacttctcaaatctaaatgaatatttcctgcagataagtcaatatatatgacctcaactgggcagctttactcactcttctctaacataaagacacgctcttcccatgaaggttcacatctgtatacattacaattgctggcattttaagaggctaatgaaacactctattttgcgctattgacagaaggcagatttctaaaaatcagagttaagatgttccataataaacacgggttaactttgtaaaataaaaaggggtgggggcagggatgatggtagggggagaagtattggttagtggtcaagaatgccttgatttggattcttgctccgtccaccgggtgacctgacctctctgggagccagctcctttagtgtaaaatagggataatagcgctgttgctgttcaattctggagggttaaaagattctgcgtgaaaaggactgtagcagcactttaacacaataaatgttgaataaatgtaagctattaatatgaaattagaattgaaatcctgtctcgagataccattttgcttaattgagagaacttgtcatgtctctgtccagcacttgatctgactcttagctagaaaggttcatactatcagctgtgcctatctcactggcttagagaaaggataa

SEQ ID NO: 209215 - DNA, 361 bp, Homo sapiens
cccctttctcacaaagttcaatggcatatctaatttttaggtttagaaagagagaaattaagaagatcctcgtatgtttctctcatttaatagcaccacctgtatcttgcttgcacctcctcagtgaacaactatagagaatagggctgctttggtaagttctttactcaatacacacacgatgagcacctatggcatgccaagcactatcctaggtaataaaagagccaaggggccacgccagcttcttctccactctccctctctcactggattcataagtccacatggaaatgctgtggcctcaggactaaagaatgaagtctgggccagcgacaggccaatgctcatacagccctaa

SEQ ID NO: 209216 - DNA, 348 bp, Homo sapiens
  misc_feature (322)..(322): n is a, c, g, or t
  misc_feature (324)..(325): n is a, c, g, or t
  misc_feature (329)..(329): n is a, c, g, or t
ttggtgggtgggtggatggatggatgaatgaatgggtgggtggatggatgagcagttttagaggacaaggattgggtattccaagccatgcagaaggtgagaggaaagatacagagataggaaatctttgttgaagagcatgagtacaaccagaaagttcaaggaagccaagaagagggttggggaataggagaaaagatctgtattagttcactttcatgctgctgataaagacatacccaagactgggaagaaaaggaggcttaggccgggcgcggtggctcacacctgtaatcccaccaagggggagggaaggtacttncnncttntatttaaacaggcagcaag

SEQ ID NO: 209217 - DNA, 307 bp, Homo sapiens
acagtaccccttggaggtttgctttaatttctgacataatttatacgtcaggaaaagactgatgctcctctagttaggttgggtcaaaatccccagtcgatgccctgtggcagttcaaaggcccctgctgagactccatggctttccaggagctcacaacattccaagggtcactttccgatctatgtcttacttccacacacctgaggtctccacgttgatcctggatctatgtcttacttccacacacctgcggtcttcaagttgacctaggtgtacaggaacccttctgaatattataaaatta

SEQ ID NO: 209218 - DNA, 784 bp, Homo sapiens
ttgaggtcaggagttcgagaccatcctgaccaacatggtgaaaccccatctctactaaaaatacaaaaattagccgagcatggttgtgcatgcctataatcccagctacttgggaggctgaggcaggagaatgcttgaacctaggaggcagaggttgtagtgagctgagattgcaccattgcactctagcctgggcaacagagcgagactccatctcaaaaaaaaagaaaagaaaagaaaaaagttgggcagaggatttaaatagccatttcttcaatgaagatatataaatggccaataagcacatgaaaagatgctcaccttcattagttattgaagaaatgcaaatcagaaccacacctaattgaatggcaataataataaggaaaaggaaaataagtattggcacagatggaaattagaaccctaatgcattgctggtaggaatggaaaatggcacagctgctgtggaaaagtttggtggttcctcaaaatgttaaacgtagattgaacctgcaattccacttctagctgtatacccaagagaactgaagacatatgcccacatcaaaactcgtccaaaaatgttcacagcatcactattcacaacagccaaaaggtagaaacaacccaatgtccatcaactgatgaatagataaacaaaatgtggtagtacatccaaagagtggaatactaattcaggcataaaaaatagttcagccaaaaaggaatgaagcactgatatatgctacaacatggatgcatcttggaaatactatatact

SEQ ID NO: 209219 - DNA, 552 bp, Homo sapiens
aagacatagtcttgctctgtcacccaggctggagtgcagtggtgcaatctttgctcactgcaacttctgcctcccgggttcaagtgattctcctgcctcagcctcctgagtagctgggattacaggcacacactaccaggcctggctaatttttgtatttttagtagagacagggtttcaccatgttggccaggctagtctcgaactcctggcctcgtgggattcacccactttggcctcccaaagtgctgggattacaggcatgacctgctgtgcccagcctggtttttttgtttgtttgttttgttttttaaacagctgttccacttggacttgtgactgcccttaggagcagtaaggctgagcttggaaaaccctgcagaggtggggaagcttgcactctccaagcatctctagggggttttgggcacaagtccagcaggaaaacaggcctcagaaggacaggtcctgacccagcacccactgtgcaaccctctcacagctgtggttaccatttcgaggagcccagccttcacagcacctgttcccttg

SEQ ID NO: 209220 - DNA, 1189 bp, Homo sapiens
ctgaacagaggactcagttaaactgtacctggactcctgacccataggactgtgcgataataaatgggtgttgtcttaagccactaattacatgtcaatttgttacagagcaatagaaaacgaccacagactttggtacttggagtggagtgccactgtaacaaatgactaaaatgtgaaagggggctttgaaatcaggtactgaattgaggctggaagaattttgaggagcatgatagagaaagcccaaattgccttaaacagactttcagtagaaataaggactttaaggacgctgctggtgagggctcagaaggaagtaaggaacagattattggaaagtagaggaagggggactgtagcgttgtagttagcaggaaatttgagatttgagtccttgttctgaattatttgaaagatgttattcagacttaccatagtgtgcaaacaactatttattcggaatgtggtagcattccaataagacatcttttggaggcaggaaaaaggtatagagtaattttttacacttgcagaagggaaaactgcagccatatttaagttttaagtcacaaaatttttggtaatttgttacatcaataataggaaattaataaagaagacatgctgagcactaccccaaaagtagagacattcactgcactgtcattgtttattttgaaactgtaaacacagggatatgtcgtaccagaggactgaagacataacctgcatacaaagtgagcttgaatggttgtaaaccattttttaatttactctccacaggaactctatagctgagtttgtgtgtgttgggtggtattggtataactggaagttctctaaatttacctttatggacaataggattcttattaaagagaatgtgctaatttgaagctgacgtatacatattaataaaactcaacagtaacttcatcgattgtatagagcttggaccaagaaaatatttttctggggaaaagtattttatcattaacattgtttaaaattgccaaagcatgatgaaaatttaagcagacaaagttggtttttctgtttttaaattttctacagagaatacaccttttttatagcctgcactcagtgtggacaattctcattacccaactttgctacatcattattgttttcacaaatttgtcattcagataaatagtatcataac

SEQ ID NO: 209221 - DNA, 472 bp, Homo sapiens
atgctctttagctgttcatcaccatattaatactaggaataatgacagctaattttaattgagaacttcctaactgtggcccagttacagtaaaataaacactattagatacatcccatcgattattacagcaagcctatgaaacatactgtattacacagccagtattagaaatgaaaaactcatgggaaggatatgtataaaacttgctcaaagttacccagctaataagtggctaggacacgattaaacacctatgtagttttctttcctgagctgaaatcctaaatccttggctgtatggcccctcattcaaaagtcctaaactggctaaaatttatataacagaaaattcacagaatcatttccttctacttttccactaccagggctgttaacagtcccaagcaaaagggcaaaaattttttctacttgagataagaaaaatatagagtgtgacagaaggtattct

SEQ ID NO: 209222 - DNA, 255 bp, Homo sapiens
taagttgtgttaaggaaaagcagaaaacagagttgcctttggttaagagttccactatttttataagcaactgactttttggggaaagttgctttaagcatttttttttctgtgtgtatgtgtgagatggggtctcactctgtcacccaggctagaatgcaggagcacaatcatggctcactgcagcctcaaccttctgggctcaagcaatcctcccacctcagcctcccaagtagaagaggtatcacagccaca

SEQ ID NO: 209223 - DNA, 496 bp, Homo sapiens
agctctattttcaatccttcctttagtgagagccgctaatgatttcctccctagtttacttaagaagcaagagaccatgacaatgtctttcttagaggtagaccaacgtggctaacaaaggtgtgtagaaattgtattccagttactcttatatgtatttatgttatccattgtggccaaagcaatgtaaaatataacagacactaatgaaaaacatgacaacggtgcatgtaaatttaactgtggggcctggcgtggtggctcacgcctgtaatcccagaactttgggaggctgagaacaggcggatcacttgaggtgaggagttcgagaccagcctgggtaacatggtaaagccctgtctctataaaaatatgaaaattagccaggtgtggtggtgtgtgcctatagtcccagctactcaggcggctgaggtggggtttgaggctgcagtgagccatgattgctccactgcacagagtgacaccctgtctcaag

SEQ ID NO: 209224 - DNA, 274 bp, Homo sapiens
gttgttcctccacatatttgaatatttgtgcttgctagtgccatattccatattccatttcatattacctctctgttcccgtatataataaactcactaaagaagactgtcccatgcaagtgatttgtattgagcaaagccttcccgtacatgcactattttctagattctcaccatttgatgcctttcacttgccattcaattttgtgcaaaacatattgatgtcaaagaataatgttttctgaggagttggtctgccaaagttgtgggagtt

SEQ ID NO: 209225 - DNA, 440 bp, Homo sapiens
agaatcacttcgtgctgagagagattcagttttgcctcattcttgccattgccctcaaatggctaaatactagattcagagaagtaaggctgtacacccaggcataagtgcttgcattaatggacatgccacactcagtgccctacagttttgattccatctcttcctcatgtggttgtgacttacctggctggcaagtttattcatctgttctcacgctgctaatagagacatgcccgagactgggtaatttataaaggaaagaggtctaattgactcacagttccacatggctggggaggtctcacagtcatggctgaaggtgaatgaggaacaaagtcatgtcttacgtggcagcaggcaagagagcttgtgcaagggaactcccatttataaaaccatcagatcttgtgagacgtgttcactaccatgagaacagt

SEQ ID NO: 209226 - DNA, 429 bp, Homo sapiens
acttcccccaacttaagatgatcttaatttgcttacttgtttactgtccatttagctgctgtaaaatgtgagctccaaatcagtggccatgtctggttagttacccatttcctgggacctagaacgggcctagctcagagcatgtgctcactattgatggaatgcatgttgaaagaacgcatgaatctcatctccttttgtgggtgaaaaactcatcctattctcactcctgattaactttccttcttttttttttttttttttttttttcaaaacggagccatgatctgtcacccaggctggagtgcaatggtgtgatctcatctcgctgcaacctctgccttctggattaaagcaattctcctgcctcagcctcccgggtatctgggattacagttgcacgccaccacgcctggctaattttttgta

SEQ ID NO: 209227 - DNA, 560 bp, Homo sapiens
aggttttaaaactagcaaaaattatataacaattttctaatcttcatgcagtaatgcaaggttgtaggcaattttatgcttctgaaattcagcattatgcctggtactttattatcctattatgagtatcttttaaattgagatattataaaagaacattatttaaagtaaattatagatagatcagtatttaatagaaattaatccaaatcttatttgttgctcttaaaaaacttcttttttttctctaaaatcgttaggcatactatgttctttactgtgtgtatgtaattcttacctcaagggaaaacaccaattagacttgattagagagcagattccttggagacaactagagaaaccctcattaaagtcaatgattataaagatggcaacaagttaaagatggtttctcccataactggtatcccaagtcagtaaatgctctctctcagtaggtgttcccatattggtgcttctctatggaagacacatttttatagggaaactcagctgaagttgagtctgcctgtggcagttgtccccagtcccacaacaca

SEQ ID NO: 209228 - DNA, 346 bp, Homo sapiens
taggtgattgggttgggatcttttatgtatgaaaacccagtttttaattttctcttgtgaaatccatcgtctttctccttgcaccccatctgtgatgcttcctctgccacacgaggctttctgtgtgagggggggctcttcctggaggctctcttttgctccattgatcgatttgcctgttctcttggttttcagttaacttcatggatatgccattaacttctctccatggttagaaatttaggttatttccaagtttttcatatttggttaatatctttgtggccaaatctttacatacattctccttaaaaatcatgtcactgaggcggaaggattacatgag

SEQ ID NO: 209229 - DNA, 290 bp, Homo sapiens
acggaaccacagcatagaatactataataagcgccggcggtgatactaacacgaagattatgtatgttcatcaaataaggagttgcaagaagaacacagaaaccagatttattgtatacatgaaaaaataaaaagtactactcaaggaggatggcgctctgaaggaagactgacatgttcctggaaggaaaggctgaaaactggggtccatatgtgatattttctcatgtcaattcctctacattaactcagtttcctaagttgccctgattccagtctagtattttctt

SEQ ID NO: 209230 - DNA, 585 bp, Homo sapiens
tccccttttcccaacccctctcatctttcttgaatgtgtgtgctcttttgatcttttatttcctgccatgggatgatacagcaagaaggctcaccagattctcgtactttggtattaaactaggcgtccaggatattaagaattcaaggagattggaaccacctggaccatctggatatcccacagaagaccacactgacccattattacactgatgatatcatgctgattgggcaagagaagcaagaggaaggaaggcccacagaagttgctgtgtgaacatgtgtggagatgtgaatccatatagctcaaagggtggactgtgacacctatgagagctacaaatgaagacttaggagtgttcatcaaataaggagttgcaagaagaacacagaaaccagatttattgtatacatgaaaaaataaaaagtactactcaaggaggatggcgctctgaaggaagactgacatgttcctggaaggaaaggctgaaaactggggtccatatgtgatattttctcatgtcaattcctctacattaactcagtttcctaagttgccctgattccagtctagtattttctt

SEQ ID NO: 209231 - DNA, 517 bp, Homo sapiens
gatattttagcagctaagtgctttgtcattgcttttgtgagttgtatatagagccaacgttacctaccatatgtaaaattagaaattttctgtttgatccaatctttcctccatccccccgatatacatatatatatatatatttatctctgtgtatatatatatatttgtgtgtatgtgtatatatatatttgtgtgtgtatatatatatatatttgtgtgtgtgtgtgtgtgtgtgtgtgtgtgtatgtgtgtctctgtctgtgttacatatgtctctatttagaggctatttaataatttaaaagctcctttacatagtatctccaccagttgagactgtaccagggccctgtatgagggctcctgcttctttttaaaaagccaaaatctgggacctttgtggctgccattcttattttctcagaatattgtccttgagaggattaactgcccaattttacctagaataaaccttatctttgccttttcagcttttgtttggtgggagagcgtc

SEQ ID NO: 209232 - DNA, 325 bp, Homo sapiens
atgacaaattaccttagaagagaataagaaacttaaagtgctccccccacaataatagtcctggctcaaaaagtttagtgatgaaattctacctaacctgtaaaaatcagattacctgtggttcttaaactttactagaacattaaaaaagaggaaattgtcaaaattgatattataaagtacaacattgatctaaaaccttaaaacctattgtactgcagatcattctcactcaatgagtatcagtgtaaaaacttttaagtattagcatgtggaatccaaagcacgtttttaaaatactatatcatgaccaagtggggtttat

SEQ ID NO: 209233 - DNA, 492 bp, Homo sapiens
gctgtctggagactattacagccagtttacctccacaattcaaattccaaaccttgcaaaggagatcaagtcagtctttaggctcagcctactagcaagaaacagcaagagtgcaggacacttcctaacagcgctgtaggactcgggtgacagcaaaataaagaaaatccaaataaatacgatcccaaaagatcaattttcactggtctgctatcttactggatttgctgaataaaatgcatgcctaatccatgatcaaaataagttcaattgatccggaacgtgctcctttcacatagcctgcctgttgaaggtgactccctgcaagcagcccgtaagcccaataatggatttccctggctattctaaggaacgaatcgatgtattttacaatattgcacctccatgtcgttgtaaattttgttattattcctaccagcaaacgttcgagctcgaagcccgcaccgagtgtctctgaatggctctccctaa

SEQ ID NO: 209234 - DNA, 237 bp, Homo sapiens
taatcactagaaccatcctaatcatatgaccagcaaatttttcaaagtactgtccttatgtttcatctcagttcatcttgactttacataatatgactgtgaaataaatagattttactatactcagttaaaagaacaatgtgacatagcttatggaggagtgaaaatggcatgactaggtttcaatgccagggtgtgcgggaggtaggattagactcacagtctatgagacccact

SEQ ID NO: 209235 - DNA, 326 bp, Homo sapiens
ctctaatttttctctctgtggacaggataatcacttcaaacaatttactactttttaaaatttaaaaacaacgcatgaatatagttaaaaaataaagccaaattcaaaagtgagcacaatgataagtaggtctctctactaagtcagctctttatttctcaaggatctcttcctataagcaaccacatttaccagttgattgtatatttttcagaaatagtttatatacatatatgtataagatatataatatgcatttttgataattcatttcttctatataggaatgcttttaatatatagacttgatcataacatacaacaaa

SEQ ID NO: 209236 - DNA, 384 bp, Homo sapiens
aaagaaaaggaaaaagaaaacaaaataaaaattacgttgaaaggatttggaaaacctgaataaaaggctagttgtgtagaaaaaagaaaaattatcaaattggttatgagacagatgactgaaaagactaggtaaaattgtgaaattgtgcaaaatgatgtgtttggattttcatggtctttttctttctctaaaatcaaacaaacaaaagtagaaactatagaccaagatttatagaagaaagatggggcagaacttcggtcagtgggtacttacaaagaaaaggcctaggccctatgttagatgactggcagatgtttgtaaatttatgtattttaagttaaataaaatgttttagatagtacatgttatttgtaaagcatt

SEQ ID NO: 209237 - DNA, 671 bp, Homo sapiens
tggccatcctcgtctgccaccgagtcctcctatgttctctttgcccttgtaggttaagacttttataaaactttcaccttgtttgtggtaagagacaggaattcacctttgtttcctccagacagtcttcatctccggcctctgcagctcccctgctccaggcttttgcatcagattaaatggtaccatcctcttcccagtttcttaagccaaaaatgaagacgtcatccttgactttgctctttctctcatgcaccatttccaatccactggcaaaatcatgttaattgcaccccgaagacagcacgagtctttccattttccactgcatatgaagtcaacacctaacccaaagccattgcctctcctggatgaccacggtgcctcctaaccaccctccctgcatcccctccagctccaggggacccatgctccatgctgcctttgcagtgatctttcttaggtgtacctcgggtcacacctctcctgtgcctgagcttccaggggcttcccactgctcttggaatgaaaacccaagctcttcatcggggctcacgggtccctgcatgacctggacctgcaccaacctatggatctcctctcatgctgcccctgctcagccaccccagcctcaacccactctcagaacaggccagcctccttcccactca

SEQ ID NO: 209238 - DNA, 406 bp, Homo sapiens
taaagcccttaaataattccagacatctgtgtcatctcatcattgatgtttgttggttgtctttcctggtttttcatatgctgaataatttggggttgtatcctgaacattttcattaggtttttttttttttttttaataagactctgggtcttgttttaatctgccagttttgctgtcattcaaattcagtcttcatcagtatgcctgtttctatttacttttcaaagtaaataactatgaatatccttaaataactacactacccatctctccaggttttattgctactttcagtggaaaagatagagtggaatgtgcttgctccattgtacctagaaccttccttccagagaggattttacttttgctttattcaaataacactagctcctgaacaattttt

SEQ ID NO: 209239 - DNA, 173 bp, Homo sapiens
tcttgattttaggtgactgtttgaatccactgtttttcctgataacctgcagctaggattgaagattatacttcctgtttaccctgagtcaggggagaaatgttcagttcattgtgacttgactctagacctttaatggggtttgtttggatattcaaactgtgagtaggtga

SEQ ID NO: 209240 - DNA, 413 bp, Homo sapiens
tggaacttccgggggaactattagaccgcctgcttccaaagctggtcaagagatcagggataggaacatgctctggaaactacacagtcctggaaagacgggagggctctgtggccaccagattgtcactctgaggacctggtttctcacttctcacaagatgcctcaggggcgaagcttccgaactcctcaggacgagggaggaagctactccccggtgtttctctggagtcactagtgggtttttatctcatgaactctgtgaacctggccactgatctcatttcctttttgctttggccaccatgaagctcagatcagaatttgcagctcactccaagcaattctgtagcactgggttctaattttaccttgtgccctttaacaaatgccacctttattttctctttttt

SEQ ID NO: 209241 - DNA, 249 bp, Homo sapiens
gatatttcagttcatacacccccttgaaacttggagcagagagcagagcttgcaagggtaggatggtaatcactgaggagtatgataactgagggggcagaagaaacattacaaatgtaattatcacactgtatattaaacagtgattggggtttatttatttattcatttatttatttattttgagacagaatcttgctctgtcacccaggctggagtgaagtagtgtgctcatcatggctcactgca

SEQ ID NO: 209242 - DNA, 202 bp, Homo sapiens
aggcggatcggtgtctctcccactctgcagtgcccccagtggctggaacatagaatgcactcagtaaatagtgctgtaatgaacgaacaaatcaatgagtctctgtctcgtctcttctctgtttgctctgtgtctccctttctgcctcgctctcactctcgctctctctccccatgtgtcctgcaggggtcttgtgcctgga

SEQ ID NO: 209243 - DNA, 186 bp, Homo sapiens
gtgacaatgctgagcccaatcactgtgccttgcagagcagatgccctgtgtacctccctcctgttaagaaaccagagggtttttaattgcctgattattaagaggctgttcttgctgctcctgctttcctgggaagtttcccatctagccgccagtgagtattcattatggaaatgaagtgcacat

SEQ ID NO: 209244 - DNA, 239 bp, Homo sapiens
cagctcactggggagacaccaaatggtagaaacttggtctctgagcagcatcgcctttgcagcagcttctcctcacctcctccatgcctcgatttccctgccccatcatcccatcagcttcactgtactgctggagtaacttcctacttaaaaattattgataggccaggcacagtggcttatgcctgtagtcccagcactttgggagtccaaggcaggtagatcccttgaggtcagga

SEQ ID NO: 209245 - DNA, 661 bp, Homo sapiens
ttttatatccctcctaataaactgaaatgctgggtttcatctaggaaatctcatgccctgcaagttttttcatataactataaaatatcagaatgtggtagattttttatgtgctgatttcatgaatctcattagaaaatcctgttacttttttgagattgaaattttacactgctacctttgttacagaagatgattttttaaaatgcgtttttgattatcatgtagaactacagaaatagtgatgaatagagacatctgccagcacacatacagattgataatgactttatttgtactttggcctaatgtgtatcctgacagatcatcaaaacaagaaaagaaagagctcagcagacagtaagaaatggccagatgctcacagaatgatgaaaagtcattgtctcttatcttttaatgttcaaattatgcaaagaagacacttttattataaattttaaaaggaatctaacttatcaaacttaactgctacttcagggatatgccaaacattctggtctcgaaatgtttggttctcttcatcttctgtgttcatcctctcctttttcactatcagcctttctgcaaactagatgttatctctacctgggaaccttgaagatctcaagggctcccagaccattttgtaactgtttcccta

SEQ ID NO: 209246 - DNA, 206 bp, Homo sapiens
gggtggcagccgccacttcctgatgtgacagggaggcgataccttgcctagattaggtgcttactgtgagagacgctgagatgaagaacatggcctagaaaggggctcgtatggctttgtcgaaaagccacctcgatgtccaggcggagcaggtctctgcgatgcctctgccctttggactctaaatccagatagttcacgtttcc

SEQ ID NO: 209247 - DNA, 502 bp, Homo sapiens
tgccagactgattagccttctgcatctggaacataaatgttttcaggcagcataatgtgcaagaggtcagagcctaaagctttgttattttttaatttctccaccatgtcaactctgttacagggaagcccagcagagggaattgtatccattttggggctacactaccccaatgctatgctgcagccaagctgaacttctaagtttctaaatgtaactcacttaccttcaggcctttgtacggggagttctttttgcctgaaataccttctgacatcttaacattacgcttagatgtcagttacaaaaaagctttttctagactctctcacatgtcccactccacacccctatatctcttcccaccaatgtactagggtaggtatcctgctaggtacttccactgcaccctctacttttcttccctaatgattaccactatattgtaattgcttaatttctttttcctatacccagataaaaatgtgtatgaaggtggagc

SEQ ID NO: 209248 - DNA, 255 bp, Homo sapiens
ttagaggcggtgagccatcgcgcccagcctgaaatggaggttttttatgttttatttattttgttttgtaaggcagggtctcacgctgttgcccatgctggagtgtagtggtgcgatcaagtatcactgcagcgttgaccttcctggggtcaggtgatcctcccacttcagcctcacaagtagctgggactacaggtgggcaccatcatgcctcactattttttgtatttttttgtagagatggcgccatgttgc

SEQ ID NO: 209249 - DNA, 520 bp, Homo sapiens
tgggcagccagtcatcaaagcagagagacgtggcggcatgtgggcagcatgcccaggttccttgctgactcagcacttatttctgtagttttaaaaaagaatttaatgtttttggttgtatttttttgggggggtgagggtgggcaaaaacatggggggagttctgagttgttagaaatgtttctgaatcaagtttgtttgaagacacgtgtgcctttgtacccattataagatggtcataagacccaagaactgataagctttggttttttttttgttttgttttgttttttgcttcatttacccattcatgcctagggttccattattggaaccctaagcttgtgggagttatttctatcctactgctcaaggtcatcaccaagatctgatttttcataaaaaacatttgtgaccttcggcataaatgggttaaggtgccatccctgaaactgcaatgcagatatgttcagataacttttattttttaattaaaaataaatctttcaaaaggaaagag

SEQ ID NO: 209250 - DNA, 130 bp, Homo sapiens
ccagagtttaacacccagtcctggagtcacctcctccaggaagctttctgtaatcctacaaactgggttagatgtttctttttagtgatgctatgtttccttacgaatattgctgtcccttcattttaaa

SEQ ID NO: 209251 - DNA, 318 bp, Homo sapiens
caaggttggccgtttccttcagcactgtaaagatgtcattctattgtcttttggtttccagtttctgttgaaaagtcagccatcagttttattgctgctcctttgaaggtaatgtgtcttctcttcctgtgactgtcacttttctcaggtttttcagtagtttgactataggatggtaggcgtgtttcctttgatttatcctgctttgggtttctgagattttaaaatctgtgcgttgatgtcttctcataaattttggaatattcttggccattatatcttctgccccatgtattgcttcttctctggtctcttgct

SEQ ID NO: 209252 - DNA, 327 bp, Homo sapiens
aggcaaaagagactgtagccttgacccagatgacactttggactttgtaactttgagttaatgctgaagtgagttaagactttgggagactgctggcaaggcatgattgtattttgcaatgtgagaaggatatgagattcgtggggtcagggacagaataatatggtttttctctatgtccctaccaaaactcatgtggaattatattctgtgatgtcagaggcggggcctaggtggaaaaagatttagtcataaaatggtgcaggtagatccttcacgaatgataaaggaccatcaccttgataaaggaccatcacctcctgatag

SEQ ID NO: 209253 - DNA, 953 bp, Homo sapiens
cctgtcttgtctgaagccacatttccccagcaatgtcacatatgcatttcttgatcctggtcatttctcctcttgggagatgaatcataaagaaaatgagatctgtgtgccctggtgactatggatgcaagagtctgctgccctggagggaacagctggaaaagtagatggtgaagacgtgtgggggggaaacagtggagaaggcatctttgcaggggatcaaggtgacagagtgattagttacactgttttgacatgtgagaacagggggttataaaaatggatacaggaagagggagagaaagtaaggaccaaaacatgaagccagtcatgaatgtttttacataaaaagcagcagatttacggcaaatatgtgatgtttccacattttctgcctctagttagcaggggcagcacaaagagcattactgtggagctgaactttgggtaaaagattaacagccagtcctttctctccagtgtctgcttccttctgggcttgccctgggggaaaaggagggctggcatggatatgcctgcagccctcaccctagatgttcttccacgcctctctgttcattcattgcttagtcattcctcaggcatggattgagaccactgtgtgcccaggaccgacctggcctaggatggacatagagatggaaaaggcacagggagcaggtgacagagacaaatcaaggtcatggagaatagcagagtaagatagaagatgaaggcaggagatggggttcttgagaaagcgagagcaggactgacccgtgtctgcctcacctgttattgctgtagcctcttctccttggagtatccctcctgctcttgcatcaccttaggaacttggatcagagaggaaagttacggcctggatatgttgtagtaggaggggacaaacatgtttggagacagaaatgcttggggagcgggtgtttttgggg

SEQ ID NO: 209254 - DNA, 455 bp, Homo sapiens
agaatcatcatccaatattcaaataccagctgccttcattttttttcttaaactctgtgtcaatgagctataatatctacctcaaaatattttgtttataaatctcttctatcccaatgtcagatgctagaccacctgttttcatttctattaactacctacacattttctactcgttaattctgtacagtatcaataattctcatttctctgcttcttaccctgactgcaaaatgagtggttagtgtgtctggctcttgcaaaaaacccaaatctaccttctgatgagtcacctagagatgagaatacatgtagggcagagcttttcctgccaacctggtcatctgctggaacgtgatgccccagtcaacaacacagggattaataattttattattattattattgttattgttattattgagacagggtctccctgtgttgcccagggtgga

SEQ ID NO: 209255 - DNA, 239 bp, Homo sapiens
gaatgctatggctgatgagggaagttatgtctgcgggatggtagggctcatggtttgttgttttctctgcataacagggagataatttgccaacccaaccagagcactcagtgtcttcatgctgtcatgtgccccttcgcctgtcaccatgcccttccctcttctcgggctgtcctgtgtgtctcttagttctcattttagatacagccttctccaggaagcctgccctgattccttca

SEQ ID NO: 209256 - DNA, 323 bp, Homo sapiens
tacgcgcacaggatatcgcaccccagacctcagtatcacgcagttgccatgtaacaaacctgcacatgtaccctctgaatctaaaataaaagttgtaattttatttttatctgtgtttgttactgtaatagccatctctcccacctaagagtaaagtttatctgggcaaaaaccatgtttatttttgtacacttttgtaattctggcatatagctatgtgtctagacacatagcaggcattaaaaagtatctactgaatgaatgttaacttcctgctggataaagtggctctttcctataatggccctaaagagaaaaattat

SEQ ID NO: 209257 - DNA, 522 bp, Homo sapiens
gactgatttgagctgatagttgccatgcaggaacgcaggccaagtgtggctagttcttccaagttttcaaggggatctggaaatagggatataagaaatctcttcagttttacaagttggcagcatcttccattttttaagaaacacactgtgtgagccaagcaaaacacgtctgcaagctggcagtggtccacagtgtgccgatttgtaaactctgtcctcagactttagcattcactatagcaagaacagcaaacacatacctagtgcttactctgtgcctggcactgttctttttctttttcttccttttccttttcctttcctttcctctttctttttctttctttcttttctttcttatctttcttttttttttttttgagacagagtcccacactgtcacccaggctggagtgcagtggtgcgatctcggctcactgcaacctctgcctcctgggttcaagcaattctcctgccttagcctcccaagctcctgagtagccgggattacaggcgcac

SEQ ID NO: 209258 - DNA, 828 bp, Homo sapiens
tgctgtcagcaggcctgggttttagtccccacactgcccctcactgggctgtgtgactctcggtcagattcttcctttttctctgattgtcagtttcttcatttgtcaaataacccaccctccttgagagtgtcgttttattcccattttacagatggcccagagaagggaagcaagacagtggcacccaggagcccagcaccaagcccagggctgtttcccctacacctggccatcatctttccaggggtctgggcagtgccagtccaaggggactaattgtaggcaatgtggatggtttttgtagaggcccagacttctaaagacaggcggtccaggggctctcatgataggagaatgggaatggccaatccaaagaagagaaagcgcgaccaagaactggtattcagattgggtggcccaggggctctcatgataggctggctggagagagttgcagactgagcccctccctgtccctgcactcatctctgggcctgcctgagagctgattgtgctgcggccgcatctgatctgggcagactggtccctgcagacaccagcgtccatcagggccacagcatttcccagggccacatacctagatctctgcttcccacgtgcgtgtgcgtgtgtgtgtgtgcatgcacatgtgtgtgtgcctacatgtgtgtgcgtatgtgtgcatgtgtgtgtgtgtacgtgcgtgtgtgtgcgtgtgcgcgcgtgtgtgtgtgtgtatgtgttttgggtcagggagggggctgagttaggaagtctggagcacagcactgcagcaggggtgggggctctgttgaggtgtgtctt

SEQ ID NO: 209259 - DNA, 475 bp, Homo sapiens
gaccccagcgctccggaaagtacctctgcttcctgccaccattccactctggccaaacaggctctactctcttctgatgggaggaggccgcaggcaggtggttcagtggttagggccaaccatctacttcagttcctgtctggcccagatctctgaccttgaccatgccctagtgggtgtatgtatacctttagtgcaagggtggtgtgacagttaatactgagtgtcaacttgattgggttgaaggctgcaaagtattgacctactggaagtgtctgtgagggcattgtaaaaggagataaacatttgagtcagtgggctggggaaggcagacccacctttaatactggtgggtaccatctttctaatcagctgctagcgaatataaagcaggcagaaaaacatgaaaaggtaagattggcctagcttcccagcctacatctttctcccatgctggacacttcctgccctctaa

SEQ ID NO: 209260 - DNA, 803 bp, Homo sapiens
  misc_feature (732)..(732): n is a, c, g, or t
  misc_feature (743)..(743): n is a, c, g, or t
  misc_feature (747)..(747): n is a, c, g, or t
  misc_feature (763)..(764): n is a, c, g, or t
  misc_feature (770)..(770): n is a, c, g, or t
  misc_feature (773)..(773): n is a, c, g, or t
  misc_feature (776)..(776): n is a, c, g, or t
  misc_feature (785)..(785): n is a, c, g, or t
agtttcagtctcatctgcgtccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacccatagaccaacaggggagtttatgtttgaatttgatgaagatgagcagttctatgtggatctggacaagaaggagaccgtctggcatctggaggagtttggccgagccttttcctttgaggctcagggcgggctggctaacattgctatattgaacaacaacttgaataccttgatccagcgttccaaccacactcaggccgccaatgatccccctgaggtgaccgtgtttcccaaggagcctgtggagctgggccagcccaacaccctcatctgccacattgacaggttcttcccaccagtgctcaacgtcacatggctgtgcaatggggagccggtcactgagggtgtcgctgagagcctcttcctgcccagaacagattacagcttccacaagttccattacctgacctttgtgccctcagcagaggacgtctatgactgcagggtggagcactggggcttggaccagccgctcctcaagcactgggaggcccaggccatccgatncctgcacgganctgngcttttgcctgggccnngtgctnggncgngggatattngggcccgcctctcttgtg

SEQ ID NO: 209261 - DNA, 849 bp, Homo sapiens
agtttcagtctcatctgcgtccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacccatagaccaacaggggagtttatgtttgaatttgatgaagatgagcagttctatgtggatctggacaagaaggagaccgtctggcatctggaggagtttggccgagccttttcctttgaggctcagggcgggctggctaacattgctatattgaacaacaacttgaataccttgatccagcgttccaaccacactcaggccgccaatgatccccctgaggtgaccgtgtttcccaaggagcctgtggagctgggccagcccaacaccctcatctgccacattgacaggttcttcccaccagtgctcaacgtcacatggctgtgcaatggggagccggtcactgagggtgtcgctgagagcctcttcctgcccagaacagattacagcttccacaagttccattacctgacctttgtgccctcagcagaggacgtctatgactgcagggtggagcactggggcttggtgcaagcgggtctccagactgggaggccagaagcaatcacatgtctgagaccgggaaggggcttgcccgggccggatgggcgaagcgcaacgagggcgcaccaagcgggggggagaacccgccagagcgcgggacgagagcctacacaagcagaccgtcg

SEQ ID NO: 209262 - DNA, 288 bp, Homo sapiens
agtataatgcaggtagaccacacatagtctaagaaattcagttttagatattgccatccttccagcttctgttccagtttttttaaactctgtacatacacctgagcatcagttaccatatgtatgctgagagtatctgcattccttttgtaacttagtttttttctccagagttgtagatttaagacctttttttttttttgagatggagtcttgctctgtcgccaggctgtagtgcagtggcgcaatctcggctcactacaacctccgcctcccaggttcaagcaa

SEQ ID NO: 209263 - DNA, 336 bp, Homo sapiens
cgaggtcttgctgttttgcctgggctagtcttaaactcctggactcaagcagtcatcccacctcagcctgctaaagtgctgagattacaggcatgagccgctgagtctggcctaagaatttattaattccagtttttttgtagatcccattgggattttctacagtagactatcatgttgccgtaaaaatacgaacagttttatttcttccttttgatctatatgccgtttatttcttttcctatttttattacactggctagatcttccagtagtttgttgagtaggagaacacactgccttgccttgtccctgatcttaggggaaaatactgag

SEQ ID NO: 209264 - DNA, 454 bp, Homo sapiens
ggaaagggacgaatcagaatggcaatatacatggagaggagggactctttagtcttgggtgtgttaagaatgacattcagtgcagcctctttaccacctccccacttacactgcagtatgtcccaagacctaccaaccatgtaggattattcctggattgtgaagctagaactgtgagcttcgttgatgttaatcaaagctcccctatacacaccatccctaattgctccttctcacctcctctcaggcctatcttttgctgtgttcacctctgaccagagacaaatcagatatgtgttcatctgctgtgggaacccctttatcccagaaagccctcttccttgtgccttatcaaacaggacaaatacgttctgttttatgtcttgaattgcattctaatgttattaaaactcatttattgtgttactattaaatgtggtaaaaacactaaaaa

SEQ ID NO: 209265 - DNA, 581 bp, Homo sapiens
ttctggcaattattagtatagggataatattgatttttgtacatgaaccttgcatctagaaaatttgatgaattagtttattagcattaatagaatgtatgctctctagagttatcttggtaggcaattaagtagtttccaagtagggagagtggcataaatctttcatagtttatttattatgaaggattattttaatattatcttgaagctttaattataagcatataatcttattatttttatatcttctcggtatatttttgattttgttgttatgaagtttccttttcatccttattcattgtttctgagtttataatcagacaacaactatcatatactaacttcttatcagacattgttctaagttctacaaatgtacaaaaccacttaattctcacacagacccattagacaaatactattattatactatgcttattaaaaaagccaaggcaggtgtaccacctgaggtcaggagttcttgaccagcctggccaacatggtgaaacctcgtctctagtaaaaataccaaaattagccagccatggtggcgggtgcctgtaatcccagctact

SEQ ID NO: 209266 - DNA, 268 bp, Homo sapiens
ctaacttgaccttccaacagatgagatgaccgaggagcagggattcatttaagagcccggctccaacctaatcagctaccaagctgctatccaggcaaagattctgccagtcctaaaccttggctctaggttcattttttgatgcacacgagaaaagccgcatctgtatctcagtcaggcggggtgtgtgatcccatgcgcttctctctcatcttccttcaaacctcttcatctttcaattcattcattcagcaaattatgtgccagg

SEQ ID NO: 209267 - DNA, 531 bp, Homo sapiens
tctgcctcaaaaaaaaaaaaagaaaaaagaaaacgtctgtttatattttttgccaattttgtaattgggttgttttcttgctattgagttgtttgcgttccttatatatttaaaatactaaccccttatcagatgtatggtttgcaaatattttcttccattctcgagattttcccttcattccgttgattttttttcctttgctttgcagatatttcctttttattttgatataatcccatttgtcagttttcattttcatggcttgtgctttttggggtcatatccaagaaatcatttaccagaccattgtcatatagcttttcccctatgttttcttctagttttatagtttcaggtcttacatttaagtctttaatttattttgagttgatttttctgtatggtgtgaaacaagggcctaaattcattctgtatgtggatatccagttgtcccaacctgtttattgaagaagctgtcctttccccgtgtcatgctcttttcatcattgtcaaaaatcaattgttctg

SEQ ID NO: 209268 - DNA, 226 bp, Homo sapiens
acacaaaaggacaatattgtatgtttccactaatatgaggtaactggagtagtcaaattcatagagacagaaaatagaagttaccaagggttacggggaagaggcaatgatcagttactgtttaatggatacagagtttcagtttgggatgatagaatagttcagatctggaaatggaccgttgcacattgtctattaatgccacttaattgtacacgtaaaaatg

SEQ ID NO: 209269 - DNA, 260 bp, Homo sapiens
tatagcattccaccgcatgaatacaccacaatatacttattaattctcttactgattggctttctcaactgattggttgtttccagtttggggctattaaaagaatgctgctgtaaacttcttgtacatatctcttgggacatgctccaaaagtttctctagggaatatacctaggagaagaattactaaacaatactatgctgttttccaaaatcatcataccaatttatactttcaacagcctggcggtaacgtgcaa

SEQ ID NO: 209270 - DNA, 443 bp, Homo sapiens
acacacaccctcaacataggcctagcatagtgtgtcctcagggtaggtattcaagtcaatagctttatggacaagggacattagaagcccttcttcagattaacgattatttctttattggggtatggtaatacctctgaaatgtatgaagcattccaaatatagatacatctttaaaaaaaattttttttttgagatggagtcttgctctgttgcccaggctggagtgcagtggcataatcttggctcactgcaacctctgcctcttgggttcaagcaattctcctgcctcagcctcctgagtagctgggactacaggtgggtgccaccacgcctggctaatttttgtatttttagtagagatggggtttcaccatgttcgccaggctggtcttgaactcctgaccttaagtgatccatctgccttggcctccctcctggga

SEQ ID NO: 209271 - DNA, 445 bp, Homo sapiens
gccgagatcacaccattacactctagcctgagctatagagcaagactctgtctcaaaaaaataaataataaactgaatttttgtaaataagtatctggtgaggaccactgtaaactgcaggaggataggagattagcatatctggctccttgagacccataactatattttatttagaattatctctctggtacttcacatcgtgtcacaaattaggtaatacacgtagtggaatgaattagcaaatgatgagtgcattttcataaaccttcggaggatgagatgggtgcccttggggggtggtgagtgctccctcccagaagtgccaggcgtggtctggccaaccagcgaggcagtggctgagctggctttaatgtctttccaatcctggcagtcagttctatgaaattcaatgagtatttaaaatgtcttgttggatggtttg

SEQ ID NO: 209272 - DNA, 222 bp, Homo sapiens
agggctgagggccactttgctctggccaccacatgctgggagcacttgctgaacttctctgcaccactcaacactgttggccattctttccttcctgaggctttcatggcaccatacccccaagtttcctcattaatctatggttgctctttctcaagatacttcactgacttatctcttagttctttgagtcttaggattctctagagttttgtatttttc

SEQ ID NO: 209273 - DNA, 271 bp, Homo sapiens
ttttctgaatccctcaaagaatgcttaaccttgaaaacaattttcagtaattattcagggcagatataggggcatggctccagcataaaatcctaaaaatctatctttaacttctactagagtgaagagtctcgtttttgtttcctataagctagagagaaaccacaaaacacaaattctgaaaatacttttgtggtcaaaagtgtatgctggtcgggtgcagtggctcacgtctgtaatcctcccactgttaaatttgactggctttaaa

SEQ ID NO: 209274 - DNA, 520 bp, Homo sapiens
cagactctggatttcttccccttagctattttccccctgagactgctgatattagaaaatggtaccgctcaattgttcaaaccaaatatctcctagttgcctttgattccttgcattttgatatggtttggctctgtgtccccacacaaatctcaccttgaattgtaataattcccaagtatcaagggcaggaccaggtggaggtaattaaatcacaggggcagtttcctctgtgctgttcttgtgatagtgagcctcaccagatctgatggttttataagcctctggcatttcccctgctggccctcattctctctccttccaccctgtgaagaggtgccttccactatgattgtaagtttcctgaggcctctagccacacagaactgtgagtcaattaaacctctttttataaattacccagtctctggtattttttcatatcagcatgagaatgatctaatacacatcccctcaccactccacatccaggtcattcccatatttctccatctttata

SEQ ID NO: 209275 - DNA, 543 bp, Homo sapiens
tcaaagtcatgaagccataaaacatagcttcttattggcacatccaaaaataaaaaagataactataaaaacattaataataaagacctgtaatgatgataatagacgagtgcttgaataggaaaatcacctgctccttgtataaaataattggcctgagaaacctagatctgtggtttagagaaagaattggcatacaatttagactgatcaacaaatgaattctctagttgtggagaagctgtgaacataacctctttaagagttaattctactgttttctaccggatggaacgtttgtgtcacaagaaacaagccgccatctgaggcagagccaccctcttgaccatgacaatcactgccccaccaagaaatacatttgtgtgaatctttctaagagacaaaggcccactactttcaggtcaaactctggggatcattaaatagcctcagattccctgaaatcacaccagtgtttattctttagaatttccaagttgagtatggggctgggaagaagtaataaagatttttgcacacact

SEQ ID NO: 209276 - DNA, 496 bp, Homo sapiens
atacagaatgtgagatcccgttccagccagtggaaaccggacacagcagtagggtggacgcgtcaggttataaatgaccctgtctcctttgttcagtatactcttgtggcaaaactcctggcgagtgtaccctttctgcaggaagtaaaaatggctttactaaataaattaaatttatgttcaagtgctatttctttatggtaccgaagaacaaacatttcagagatcagtaagatctagtgctcaagaccgattggccctagccaagagtacgtgacatttcatctatacaggagaaaaaccagagtgtatgggtgcagatgcagggaaatgtccaaatgctacagtgggaactgatggaagtatctaacttgtcatgaaataggaagcaggacatcagccacaagtgaggatggggatggagatgctggaggtttgaagagagaagagaaataataataatacaattatttaggggagagggagaatgatgaaa

SEQ ID NO: 209277 - DNA, 914 bp, Homo sapiens
agaaagtccatcaacaggaactccgtgagatcgcgaatgcctgcaaaatcctccaagatgtacggcacgctgcggaaggggtcggtctgtgcagacccgaagccccagcaggtgaagaagatcttcgaagcattgaaaagaggcctcaaggagtatctgtgtgtgcagcaggctgagctggaccacctgtctggacgccacaaagacaccaggaggaattccaggctggctttctattatgacctggacaagcaaacgcgctgtgtggaaaggcacattcggaagatggagtttcacatcagcaaggtggatgagctgtacgaggactactgcatccagtgccgcctgcgcgacggcgcctccagcatgcagcgggccttcgcccggtgccccccgagccgcgcagcccgagagagcctgcaggagctgggccgcagcctgcacgagtgcgccgaggacatgtggctcatcgagggggccctggaggttcacctgggcgagttccacatcaggatgaaaggcttggtgggctacgcacgcctctgtcccggagaccactatgaggtgctcatgcgtctgggccgccagcgttggaagctcaagggtcggatcgagtcagatgacagccagacctgggacgaagaggagaaggccttcatccccacgctgcatgagaacctggacatcaaggtgacggagttgcggggcctgggctcgctggctgtgggtgcagtgacgtgtgacatcgccgacttcttcacgacgcggccgcaggtcatcgtggtggacatcacggagttgggtaccatcaagctgcagctggaggtgcagtggaacccgtttgatactgagagcttcctggtgtcacccagccacacgggcaagtgttctatggacaccggaagggtctccat

SEQ ID NO: 209278 - DNA, 296 bp, Homo sapiens
ctgcagggatggttagaggccctcgtggcctagccccaggcagccagctgagccacctccggggctttgcaggacatgtggctcatcgagggggccctggaggttcacctgggcgagttccacatcaggatgaaaggtaacagggctgagagggggtgggcggaggcctttctggaggccctgagacttctgctgaggggcacgggaattggccagaatcccaggggtctgagcccagccctggcttttgcatccatgtgacatgtgacttctggcaagtcccacccctctctgag

SEQ ID NO: 209279 - DNA, 566 bp, Homo sapiens
  misc_feature (514)..(514): n is a, c, g, or t
  misc_feature (517)..(517): n is a, c, g, or t
agtgttgggtcttgttttttcattcattcagtcaccttgtgtcttttaaattggagaatttggtccatgtttacattcaatgtaattaatgataggtaaacactactgccattttattgtttgttttctggttcttaagtcctttattttattcttactatctttctctgtggttatcttccctggtaatacattttaattcattgctttttatttttactgtatctattataggtttttgctttgtgattgttatgagacaaaaaatcttatagttataataacttgttttaaactggtaactttcatcacaaagaaaagaagcaaacaaccaagttttttagttgtttttagaagaaactaaaaaaccctacaatttaactcatcttcccccactttttgactttttaatgtctccatttttaactttttatgttgtttatctctctctcgctttttttttttgagatgtaatcttactttgtcacacaagctgggttgcagtgagccgagntcncaccattgcactccagcttaggcgacagagtgagaccctgtctcaaagg

SEQ ID NO: 209280 - DNA, 373 bp, Homo sapiens
gtgtacaaatctgaaatataagggtctggtcttatatttactaatacttaggtcatgtctaccttaaatgtgtctgagtgtttatgacagagagggacaaagagaaagagaaagagagagagagacagagagagagagagagagagagaaagggaggcagaggggaagaggaaataatacaaataattatgtaattgatgataatcatttttaatcaaccgcgagagagagggggaaagggagatttccagaaaagaggtttatcatagtttcaagcaaaaaacaaacaaacaaacaaaaaaccctctgagttgaagtttatcaaaagatggcatcagacatacagcctccataattaaacctgctgcgtgta

SEQ ID NO: 209281 - DNA, 568 bp, Homo sapiens
  misc_feature (14)..(14): n is a, c, g, or t
  misc_feature (19)..(20): n is a, c, g, or t
cgacttagaggatnccccnngcaccactgcaataagacgagtcccaaattgtttggtttcctggtgcatataaaagttatgtttacattattccatagtctattaagtgtgcagtagctttatgtctaaaaaaaagcacataacttaattaaaaaaagcttttgctaaaaagtgctaatgatcccctgaatcttcagtgagtcatctttttgttggtggagggtcttgatattgatggctactgactgattggggtgatgggtactgtggcagtttctgaaaatgtgacagcagtgaagttgctgcatcagttgcttccttcgacaaaaaatttctctgtagcatgtgctgccgtttgatagtattttacccacagtagaacttctttcaaaactggagtcagtcttctcagaatttgccgcaattttatccaccaagtttatgcaatattctaaatcctttgttgtcatttcaacagtgttaaaagcatcttcagcagaagtagattccatctccagaaatcactttctttgctcatccataagaagcaacccccctccctttaatg

SEQ ID NO: 209282 - DNA, 389 bp, Homo sapiens
catctccattgcaacaaagcagataagatgttaaggattaagtttaacaaaaaatgtgtaaaccctacatgagaaagagtttaaaacaatccttaaagacaacaaaagtagatgtgaagaaaggagaaaaaaaaagagctcttggttttgaacttaagataactcaacatcataaagttaatttataaacagcataatgtcaataaaaacaccaacgagcttttttgtggagttagataagctgatactaaacttcacatggataaacaaacaggaaggaagacccaggaaaacactaaaaatgaacgtttctgaaaggagactaagccctatcaggcattaacacataccataaagcctctgaaagcctttacaaaacagtcacattc

SEQ ID NO: 209283 - DNA, 348 bp, Homo sapiens
aaatgtcaaaatggtctgctaaatggagaagcattgagaataatcacttctttattagttgggtttcatgtaataagttttaagctttgcagccctcattttagcttacattgggccatatgaagtcttttaactgggtgttcatggaatcccattccatcaagccagtttttaacagccaaagatttgctttgactttaattcattatttgttgtgtcagagcatttaattccaatatggtatatgttacagcattgggtactatgactatgagaaatttaggcaaggcaacaaattaaggcatatctatttttctctattatatttagttaccattttaagaatat

SEQ ID NO: 209284 - DNA, 848 bp, Homo sapiens
agcggggggggcggcccgggactgcaccgggaccagcgcctccccgcttcgcgctgccctcggcctcgccccgggcccgggtggatgagccgcgcgcccgggggacatggaagcgctgacgctgtggcttctcccctggatatgccagtgcgtgtcggtgcgggccgactccatcatccacatcggtgccatcttcgaggagaacgcggccaaggacgacagggtgttccagttggcggtatccgacctgagcctcaacgatgacatcctgcagagcgagaagatcacctactccatcaaggtcatcgaggccaacaacccattccaggctgtgcaggaagcctgtgacctcatgacccaggggattttggccttggtcacgtccactggctgtgcatctgccaatgccctgcagtccctcacggatgccatgcacatcccacacctctttgtccagcgcaacccgggagggtcgccacgcaccgcatgccacctgaaccccagccccgatggtgaggcctacacactggcttcgagaccacccgtccgcctcaatgatgtcatgctcaggctggtgacggagctgcgctggcagaagttcgtcatgttctacgacagcgagtatgatatccgtgggcttcaaagctttctggaccaggcctcgcggctgggccttgacgtctctttacaaaaggtggacaagaacattagccacgtattcaccagcctcttcaccacgatgaagacagaggagctgaatcgctaccgggacacgcttcgccgcgccatcctgctgctcagcccacagggagcccactccttcatcaacgaggtaggtcatgggggcc

SEQ ID NO: 209285 - DNA, 214 bp, Homo sapiens
gcagcctcaacttcctggactcaagcaatcctcctgtctcagccttgagccaccctgcctggcccctaaggcacagttttaaaaataagtaaatagcgaggcgcggtggctcacacctgtaattccagcactttgggaggccgagctgggcagatcacttgaggccagtaattcgagaccagcctggccaacatggcaaaacctcgtccctact

SEQ ID NO: 209286 - DNA, 367 bp, Homo sapiens
cagagcttccgctctacccacttcactatacttctcttactacaggtacacagcccttttatctctgctttcctgaagcagcctttgtaagtggaaggattgtactgaaggctcagcagcaatagagctaatgaaatggaagctgggcagtgctgagtccctgggtcacagttaccgagaggaaaagtgggctggctgagatttcatcccaggctgcctgctacaaagctcctcatctgcctccctcgaatcaagtgctacatccaataatagggactaaacccacatctgtagcttctgagtcgagagatctgaatagagaaatcagcagttaaaataaaattaaaatagctctgaacatttaaaa

SEQ ID NO: 209287 - DNA, 420 bp, Homo sapiens
tgtattaccgtctccttcattgttttttggccaggtaaggatttctagattagacattgttttctctcagaattggaagatgttgctgtcttgcttttcagtttctagcttccagtgttgacactgagaggtccaattgctgttcagatttctgacccttggtttgtgaactatttttctttctctagaacttttggagtccttttattcctggggttctaacatttccaatatgctttgatgagtttgttgttgttgttgttcattgcgctgggcacccactgggtccactgaatatggaaattcaaatcttgcattttagtaaattttggataaatttttttgattattttattctctttcactctgtgctctctttttggactttttttttttttaacttatactttaagttctggg

SEQ ID NO: 209288 - DNA, 554 bp, Homo sapiens
taccaggcagtcgggcagtgtagcagctgaggaatacagatggataagttacgttttcttccctcaagaaattcactttctattaagaagatcgacattttaaatagaaggcagtgaagacacttccgagctagaagtatgtattgggtacaagaaggcccaaaaaagggggaggtcggcttttcctgaaggtgggactttccccatgcccacctctggacattccagagagattgataggacctaatttggcatcccacaagaggagaggagaatgctttctctgtctttggttgcctctcccattcccatgctcctctcccatttggtggctgctcttaagtggcctctcactccccccagcacactgggacgctgccactgactggcatctctggagcctctttcctggaggctcagattcccatcctctgggtgttgtctggcccttttcttcctaagtgcattgtgttcttgcccattttcctgcccacttacaaaggcttatacggttaagccctttgcccaaggtcacagctggttagtaacaaaag

SEQ ID NO: 209289 - DNA, 390 bp, Homo sapiens
aggttctcactatgctgccctggttgggtctgttcttctcatgtggctgtgtggtatttcctaagtatttttaaaatttttctctcattgataccctataaaaatgcaactgttaaagaatttgtctttctttctcattatattctttccagagtatataactaatttattcagcattcattcattcagcagatatttgttgagcactaactatgttcaggcactgggcagggatatcgggataccaagatgaaaaatagtttttgaagataaaatttttaaaggatcaatttccattaggtgcacatttgaagagctcatcctatgctaagcatcatgagaataactgaaaagaggtagaatagttccttcctttagtaaacttactgt

SEQ ID NO: 209290 - DNA, 472 bp, Homo sapiens
ggagacgaccaagttgatagcatggagcaggtctcttcgccaccaaccagcaggaaaagcatttctctggacctcaacatgtagtctgacgcaggactgcggaaaattcctcatctgaatgccccgccccttagggaggagggagcagccacgcctcctagagggaaccctcccagatctggatggtgatggaagcctccctcctatctcccagtcgctcttcttgatacattctttttaagttttttttcagtattatttaattaagtaacagagttcttatagcattttgtgaaaactgaaactctaggataattttttttttaaatgatttcctttgttacaaaatttcatcagattttcctattatgggtaaacttaaaaagccttttcttaatactatactgaagttttaaacagaaactaaagatagaaagttttagaggatattattctctgctctcagccaaaa

SEQ ID NO: 209291 - DNA, 683 bp, Homo sapiens
ctggtgctaaaacatgtgaatccactgcgaaatcatgttacttcatggaagaaaatcccaaagctctcgcagcctcttgtaaaatagaggtttcattaaaggatggctctaagccttatagatagaaacgtggtattgcatttgtacacacttgcagtcacacatgtgcacaaatacacacacacacaacctccctccactccccaattcctgcgcagtccaattccctactccagacagaggatgccagctccaggggaagttgcctctgaacgcccactcaccagaaaaaaaaggtggctcttgccagcaattgcacccacacttcccagcagtcctggctgttgccattcattggtcaggtatgatgctgcctgctcacctttgacagccttcccagcagccaaccagcccagagagtctccaaaccagagccaccattcttgcgaagtgagttcccacccacccgagagggagatccttagctcctcatcatcgccagtcatgatgatgagatactctggaagacatccattctgtggaaaccccacaaggtgaggccacgtctaaatagcttacaggtgagtgtccttcctccctgcctgaccactggcttggatggagaggcggttgcatggccaggtgagggggccgcggggctgtgcactcccacatcacatttc

SEQ ID NO: 209292 - DNA, 2408 bp, Homo sapiens
ctggtgctaaaacatgtgaatccactgcgaaatcatgttacttcatggaagaaaatcccaaagctctcgcagcctcttgtaaaatagaggtttcattaaaggatggctctaagccttatagatagaaacgtggtattgcatttgtacacacttgcagtcacacatgtgcacaaatacacacacacacaacctccctccactccccaattcctgcgcagtccaattccctactccagacagaggatgccagctccaggggaagttgcctctgaacgcccactcaccagaaaaaaaaggtggctcttgccagcaattgcacccacacttcccagcagtcctggctgttgccattcattggtcaggtatgatgctgcctgctcacctttgacagccttcccagcagccaaccagcccagagagtctccaaaccagagccaccattcttgcgaagtgagttcccacccacccgagagggagatccttagctcctcatcatcgccagtcatgatgatgagatactctggaagacatccattctgtggaaaccccacaaggtgaggccacgtctaaatagcttacaggctggagtgctgtggtgttatctcagctcactgcagtttcaagctcctgggctcaagtgatcttacctcagccttctgagtagctgggactccaggcatctgaaaaccagcagtaatcctgcctctgaagtttatcaggaaaggagcttaaaagagaaccaaattcagcctgtgttggaactctcagtcccagaggggtgtggtttgtagctctccggcctgctgttggacttaggctgtgacccacagaaggacgccagaaagtactcaagacattcacggtgccccggtcagcactcgccatgacgaagacttctacatgcatataccacttccttgttctgagctggtatactttcctcaattattacatctcacaggaaggaaaagacgaggtgaaacccaaaatcttggcaaatggtgcaaggtggaaatatatgacgctgcttaatctgctcttgcagaccattttctacggggtcacctgcctggatgatgtgctgaaaagaaccaaagggggaaaagacattaagttcctaactgccttcagagacctgcttttcaccactctggcttttcctgtatccacgtttgtatttttggcattctggatcctctttctctacaatcgagatctcatttaccccaaggtcctagatactgtcatccccgtgtggctgaatcatgcaatgcacactttcatattccccatcacattggctgaagtcgtcctcaggcctcactcctatccatcaaagaagacaggactcaccttgctggctgctgccagcattgcttacatcagccgcatcctatggctctactttgagacgggtacctgggtgtatcctgtgtttgccaaactcagcctcttgggtctagcagctttcttctctctcagctacgtcttcatcgccagcatctacctacttggagagaagctcaaccactggaaatggggtgacatgaggcagccacggaagaagaggaagtaattgcacaccattttccaagaaccaagaaagaagaaaacacaagagatttttctcatcttttttttttttttttctggtggagggaggtggtggaggaacatagcaaagtaggagggacagagagtgatacttaaatttaataagaggttcgtgaaggtagcttaacttgagaactcttggttttttgaaaggttgactgcacatgccaaaaacaactcctgctatctcagaattaattatctttgaccttcgtggaggatggtctctggttaaaatctggccaaagaaactcacataaacttggtgttagagaacatctagagagagagagaggaacttagagtcatttaaactcttcagtttacagagaaggatgctgaggacctagatgagaagttacctgcaaaaggcaaaagggttacttagtgtcagaaccaaggcaatgacttctctctcccagatctcctagctactggtcctgggccatttttttttttaaataatcccaacttttctttaaaagacaagcatttcagtaagctagttattttcatgggttgctcatccatttttttcagtgatctaaaaatgtagggagatggctactactgaagttgtctgtctacttgggataatagcaaattaattgaagacaatgggaaagtaagttataaaaaatactgggaaatctgtttctcttctgagcaagcattcagggcaggtataaacatcaaacatagtgacattgtcaaaacctcttccatttgaacattgattaattcatcaaataaatggtatagtaataaattttgcttgcagaagaaaaaaaaaa

SEQ ID NO: 209293 - DNA, 1427 bp, Homo sapiens
ctggtgctaaaacatgtgaatccactgcgaaatcatgttacttcatggaagaaaatcccaaagctctcgcagcctcttgtaaaatagaggtttcattaaaggatggctctaagccttatagatagaaacgtggtattgcatttgtacacacttgcagtcacacatgtgcacaaatacacacacacacaacctccctccactccccaattcctgcgcagtccaattccctactccagacagaggatgccagctccaggggaagttgcctctgaacgcccactcaccagaaaaaaaaggtggctcttgccagcaattgcacccacacttcccagcagtcctggctgttgccattcattggtcaggtatgatgctgcctgctcacctttgacagccttcccagcagccaaccagcccagagagtctccaaaccagagccaccattcttgcgaagtgagttcccacccacccgagagggagatccttagctcctcatcatcgccagtcatgatgatgagatactctggaagacatccattctgtggaaaccccacaaggtgaggccacgtctaaatagcttacaggctggagtgctgtggtgttatctcagctcactgcagtttcaagctcctgggctcaagtgatcttacctcagccttctgagtagctgggactccaggcatctgaaaaccagcagtaatcctgcctctgaagtttatcaggaaaggagcttaaaagagaaccaaattcagcctgtgttggaactctcagtcccagaggggtgtggtttgtagctctccggcctgctgttggacttaggctgtgacccacagaaggacgccagaaagtactcaagacattcacggtgccccggtcagcactcgccatgacgaagacttctacatgcatataccacttccttgttctgagctggtatactttcctcaattattacatctcacaggaaggaaaagacgaggtgaaacccaaaatcttggcaaatggtgcaaggtggaaatatatgacgctgcttaatctgtctagctcaagaacaggactgctgggtttgacatctaccagccaggaagctttaggcagctcttgcagaccattttctacggggtcacctgcctggatgatgtgctgaaaagaaccaaagggggaaaagacattaagttcctaactgccttcagagacctgcttttcaccactctggcttttcctgtatccacgtttgtatttttggcattctggatcctctttctctacaatcgagatctcatttaccccaaggtcctagatactgtcatccccgtgtggctgaatcatgcaatggaattctgttccaaatgatcgttaatgtagaggacgggagctgctgattgtgggcagggttaataaaattcatcagatcaatggccagtataatg

SEQ ID NO: 209294 - DNA, 1827 bp, Homo sapiens
agcctagtccggcatgctgcctagcccagccacgtctcatcctattcatggcagagcggggactctcaccctctcccagcaatgtctaaagtcaggcatctgaaaaccagcagtaatcctgcctctgaagtttatcaggaaaggagcttaaaagagaaccaaattcagcctgtgttggaactctcagtcccagaggggtgtggtttgtagctctccggcctgctgttggacttaggctgtgacccacagaaggacgccagaaagtactcaagacattcacggtgccccggtcagcactcgccatgacgaagacttctacatgcatataccacttccttgttctgagctggtatactttcctcaattattacatctcacaggaaggaaaagacgaggtgaaacccaaaatcttggcaaatggtgcaaggtggaaatatatgacgctgcttaatctgctcttgcagaccattttctacggggtcacctgcctggatgatgtgctgaaaagaaccaaagggggaaaagacattaagttcctaactgccttcagagacctgcttttcaccactctggcttttcctgtatccacgtttgtatttttggcattctggatcctctttctctacaatcgagatctcatttaccccaaggtcctagatactgtcatccccgtgtggctgaatcatgcaatgcacactttcatattccccatcacattggctgaagtcgtcctcaggcctcactcctatccatcaaagaagacaggactcaccttgctggctgctgccagcattgcttacatcagccgcatcctatggctctactttgagacgggtacctgggtgtatcctgtgtttgccaaactcagcctcttgggtctagcagctttcttctctctcagctacgtcttcatcgccagcatctacctacttggagagaagctcaaccactggaaatggggtgacatgaggcagccacggaagaagaggaagtaattgcacaccattttccaagaaccaagaaagaagaaaacacaagagatttttctcatcttttttttttttttttctggtggagggaggtggtggaggaacatagcaaagtaggagggacagagagtgatacttaaatttaataagaggttcgtgaaggtagcttaacttgagaactcttggttttttgaaaggttgactgcacatgccaaaaacaactcctgctatctcagaattaattatctttgaccttcgtggaggatggtctctggttaaaatctggccaaagaaactcacataaacttggtgttagagaacatctagagagagagagaggaacttagagtcatttaaactcttcagtttacagagaaggatgctgaggacctagatgagaagttacctgcaaaaggcaaaagggttacttagtgtcagaaccaaggcaatgacttctctctcccagatctcctagctactggtcctgggccatttttttttttaaataatcccaacttttctttaaaagacaagcatttcagtaagctagttattttcatgggttgctcatccatttttttcagtgatctaaaaatgtagggagatggctactactgaagttgtctgtctacttgggataatagcaaattaattgaagacaatgggaaagtaagttataaaaaatactgggaaatctgtttctcttctgagcaagcattcagggcaggtataaacatcaaacatagtgacattgtcaaaacctcttccatttgaacattgattaattcatcaaataaatggtatagtaataaattttgcttgcagaagaaaaaaaaaa

SEQ ID NO: 209295 - DNA, 1247 bp, Homo sapiens
agcctagtccggcatgctgcctagcccagccacgtctcatcctattcatggcagagcggggactctcaccctctcccagcaatgtctaaagtcaggcatctgaaaaccagcagtaatcctgcctctgaagtttatcaggaaaggagcttaaaagagaaccaaattcagcctgtgttggaactctcagtcccagaggggtgtggtttgtagctctccggcctgctgttggacttaggctgtgacccacagaaggacgccagaaagtactcaagacattcacggtgccccggtcagcactcgccatgacgaagacttctacatgcatataccacttccttgttctgagctggtatactttcctcaattattacatctcacaggaaggaaaagacgaggtgaaacccaaaatcttggcaaatggtgcaaggtggaaatatatgacgctgcttaatctgctcttgcagaccattttctacggggtcacctgcctggatgatgtgctgaaaagaaccaaagggggaaaagacattaagttcctaactgccttcagagacctgcttttcaccactctggcttttcctgtatccacgtttgtatttttggcattctggatcctctttctctacaatcgagatctcatttaccccaaggtcctagatactgtcatccccgtgtggctgaatcatgcaatgcacactttcatattccccatcacattggctgaagtcgtcctcaggcctcactcctatccatcaaagaagacaggactcaccttgctggctgctgccagcattgcttacatcagccgcatcctatggctctactttgagacgggtacctgggtgtatcctgtgtttgccaaactcagcctcttgggtctagcagctttcttctctctcagctacgtcttcatcgccagcatctacctacttggagagaagctcaaccactggaaatgggtttctgttcagatcttgcaaagatggaggctagaatctgttggaatctgcttccagtggcccgattggaagtcaccagccaagcaccaactggtcaagaatatcaggtgaaatatcagggctataaaaatatttctagcccttgctactatctgacagcagttaaaggaataaaacaagtcggggtgaatctaacttcctatctgccaactaggatactttctactgggaaaaatgcttctcaatcaagaaaatatttataataaacataattttccaattacaact

SEQ ID NO: 209296 - DNA, 512 bp, Homo sapiens
ggatgagtttgagtttaggggtagcggagcctcttgttcccaactgaaggcactcacgaaacctgaactgcacccacttggaggaaagtgagacggggcttcccagtgagaacccagggagatgcgtcaaaggctacagagggaacaaacaaacaagcaatttagtttagattttttaatgcagaaatgaagtgttccgcttgtttgcttttaaaatggagaacagagaacataaaatgacttcacaaatgaaggaagtaattagaaaaaattcctccagttctatgtgatggccagtaaaggaagagagagcacagaaaagatagaacgggaagggcagatgggaaggaaggagagtacgacacagagatgatgacgcaaagagagagagtgaagaagagatgaacatggaaccatccctccacacacacacattttgatcttatggaaaacctgctttgtaaaattaaagtttgtcttttgttgtttttacactgtaagagagcgatttg

SEQ ID NO: 209297 - DNA, 538 bp, Homo sapiens
cgttatttgccaaataacaactaggccagaattccagccctaacattgtattaaaatacctgacaatactagtaaatatagtttatgatgtcccaggcactgtgctaatggtttgacaagcattttctcatttaatcctcctcactaccctaccaggtagatcctattttgctttccgttatcaaatgaggaattgataaagaaaattttgtttaaatatactactaatgtaaattggcatatagcagtgctaggatttaaacccacgcctgtctgatttcaggatccacacgatgaccaacatgttggaagtatgcaatagagtttgcccagctcttcacacttccattttgggatcttggccccatatctgctttgattcctctcctcatatgtttaatccctctcagagtttagggaatattttaaaaatgaagttggggatttccttgctctcacttttggtctatgccagttaagatcacattttcctgagccatctctcctatttttaccgaagtataaaatttgatataaa

SEQ ID NO: 209298 - DNA, 493 bp, Homo sapiens
gatctgagggaattttttcccatttaaaatatcttaatgataatgcaatctagtgactattcatggtttactattaaaattatttgtaaatgaattgaaaaataggcagggagtttgttacatattcccggaatacttatataaatgacatttttttttcaagagtgcatttaaaatttattaggtatctacatcttaactaatgtagatttcttccacttttgagaaccttttgctcattaactggaaacaagaaaaataagaacttcagtggctttctttcagaagataggcagctggactcatgtttctcagaatctcttctcctcactccagtgttaatcactgtaagaagttgaccacaaggctgagagcagtggctcatggctgtaatcctagcactttgggaggccgaagtgggaggattgcttggggtcaggaattcaagaccagcctggccaacatggcgagaccctatgtctatttaaaaaaa

SEQ ID NO: 209299 - DNA, 201 bp, Homo sapiens
gactgggcataagataaaagtaggattgaagatggttgtcttgcagagatacatttcagccaggaactgaaatgtgggtaagatttccgcaagggaaggggtagggatggctttccaggaggtatagacaagcagataacaagtttgagcaacaggaagatcctgtggacttcatggcttgtatcttgtcatatatgaagg

SEQ ID NO: 209300 - DNA, 250 bp, Homo sapiens
cgtgcctggcccagttgggctattttcattgggaagaggagtctcaattatctccggtaaaaggggacacatactgttaaggatataggtggtgcagaattggaaagccttctggaggggaggcagccctgggaattcattatcctggggtctctgcttttctttacatgtctgcccagggctactctcactctcccagcagattttgtcctgcatactatagtttatttactcaaaacttcagtttgca

SEQ ID NO: 209301 - DNA, 272 bp, Homo sapiens
ggctcaagagatccaccctcctcagcttcccaaagtgctgggattaacaggcctgagcactgcgcaacaactattgaaacccttgtgagttaattggataattttgcctttttctaaacctttgagttgagactcctttatcactctcatttccagcacctcagtcttcctttttccttcccatcacctaatcttttcttcttcttctttttttttttttttttgagacaaggtctcgctctgtcacccaggctatagtgcaatggtgtgca

SEQ ID NO: 209302 - DNA, 494 bp, Homo sapiens
tcatataattctgatgtcagccccaactcactggcagctacatgcacctggtgcttctaattttctttcacctctgtagaggacatttgggcttcaattatttgtttttctgctctattaattagtggtcatggtcaacaatctattttatatcttctacagttttgtggatttctttccccttcactcacttcttcccttgttctcattgcccttatgagtttataccatctttattcctttactggtattttgttagactttccagaaagagtaaaggtaaatgagtgtgttcatgctgtcatatttgaccagtagcttaaactttttctctatgacacaattagaatgataacattacaattcatatattaaagatgcctataatcttcaagtatttgagttttgtggtttttgccttttttaaaaaattgccctattaagtagtcattgatacttgttaaatttaaactgttaaaagaaagaaaaagata

SEQ ID NO: 209303 - DNA, 278 bp, Homo sapiens
caccttgctgctatgtcctcccggggggaccagtgctgtgtcttcaagtgacagagggatgtaagggcaatgaaagggcctagctcgttcctgccaacctttttatgaggttactaatcccatgccctcatgacttaatgatgccccacctcttaatactaccagactggtggttaagttttaacatatgaatcttggggaacacattcagaccacagcagatatattgtagaaaagaatagtccgtaaattcccagcagtaacacttcgcatatttt

SEQ ID NO: 209304 - DNA, 404 bp, Homo sapiens
ttcccctttcctccgtgttgaaactgttcagcgttgatctactacctttctatacagaaacaaccaagatattttaaacggcacaattgggtacttacctatctatcactagctatttatctatcaatccatccatttatcttacctatcgatctcatctatcgatcatctatttatctatgaatgatctctttacctatcaatcatctgtctcttgtttacctatccatcacctatctactgtttatctctacttatttatcaatcaatgtatcttatccatcatccatccattcatctatcatctacttacctatctagctatctatttatcaattatctatctatgctgtgtctccctattatctgtctagcctctatggtctatctctgactacctattt

SEQ ID NO: 209305 - DNA, 673 bp, Homo sapiens
tcactgcatagttagatccttagcactgtgtgtctgaactcattgctaatagcttaagtagctccgcatccccactcctcttgcctgaactgttctccatctgcctgtgactgccagatcaaggcagcagcatggtgtggtggtttaagagtgtggcctcctgacccagatagcctgcattcatattggctctgccagttactgccttcttgggcaacatgtacatccatttgctcagctataaagcagggataatagtaaccgcatgaagttatcgagaggtgaattaatacctgtaaaacacttagaatgtgcctggtacgcagtaagtactatgttttacctgcaatcattatcattattcagtctttaaaaactttatatggattggccgggcgcagtggctcatgcctgtaatcccagtactctgggaggccgaggcgggcgaatcacaaggtcaggagatcaagaccatcctggctaacacagtgaaaccccgtctctactaaaaataaaaaaaattagccggacgtggtggtgggcgcctgtggtcccagctacttgggaggctgaggcaggagaatggcatgaacccaagagatggagcttgcagtgagctgagactgcgccactgcactccagcctgggcgtcagagtgagactccgtctcaca

SEQ ID NO: 209306 - DNA, 506 bp, Homo sapiens
cgccatttacaactatcttaaatatttttataactccagagcttggcaaatattcaggtaatgcttatatgaatttaaagggagaagccaggatagtataaaagcaaacattttctaagagtgcaaaagaagccttaaaagcagtgcctatcttactaggaataagaaaaactattacctaaaaggcaaaatctagagaaaatagaaaggactttaatatccaagagaactaaaaatactggttctgggatagcctgaggtaagaagcaaggggacaaacttaaactataaaaaatctatcttagtgacacgctacggcaaaataagagcaaacatcaaatagataggtgtaatggcaaaagtgtgttgggcacctatctgccatgcactgcactaggcatatagtagccaactattctgtgagcactcattacctgccaggtctatccagcactttacatgcattatctcatttaaccctcagaactcttgtgagcagacactat

SEQ ID NO: 209307 - DNA, 819 bp, Homo sapiens
atccttagagattttgagataattgcgtccgataaccctttctccctcaagttgcctaggtactatctaggttccataccacagggcttgaaaaaccacggagaatgtgaaataaaccttgataatctgtagtttatatttgctgttcgttaaaaatggcttctgtagtgtgtcaggaatttggaagactttatagttaatctcatcccttaaattttaaaagctttaagtcaaatgaatggtttttattttctaaattctaaaactatattgattcaggtatctttgtgtataattctcagtaataacttatgccctcaccaaatttgtggaattggaaataacaaattttaagaagaatttttgtgtctgtgattctgtatattggaggtacattttatggaagattgatttatgcatatgaaacttatcagactgagttgttagtattaaatgcttcaatttaccataataagccattttaagtgtgtatttggctaatactgaatgtgcatcttgcttttaaaatttgactttaacaagcacatgcgtagcaattttgtaataatcttactttagtaaagtgacttgagcactcacatactatttttttactctaaaacaaaatgttgctagtactagattggcatgtcttttattacagataatttagaaactattacaatgttcttgttatctgcagattaaaatttgtggtttttctattcttttgattttaaatatttaaaaagactcttgagtgtaaaaactgtggtataagcactcaggtaagttataagaagtatctaataagatgat

SEQ ID NO: 209308 - DNA, 417 bp, Homo sapiens
gccatgagccaccatgcctggccaatctaaactttttaagcacagagagacaagtggaaaattctacacttaacctcatgtgatggggtcacagtcaaaatgcaggcacataatacacaatttattccgtgtccccaagggaaaaaaaggaccctcccagctcctttctgctgcaaaatagcttttctgagcatgccagatatatatgtcatattttttactaagtgctcttgtgtgaataagtgtaagaaaatgattgcttgtcagtagcgtataaattcggaatcaggaatgaaagacaactacagagtgtccttgtgggtggctgagacagggacaccttgcttcctgatggttcaatgtatacaaactttgttttatgtggaaaattattaaaaatattgtgtaaatttacct

SEQ ID NO: 209309 - DNA, 215 bp, Homo sapiens
caccctcccaaggtttcggcgccaacagcctcagcattgacagtggccatgacatgcaagaatggcacactggaaaatgaaagggaagtagccaggagagaggagagccgagtttaaataaaagccagactcaggagagcttagcttctgagacggagttcatcccacgagcttggaaccgtcaaaaagaaaagaaatatttctgtgaaaaatga

SEQ ID NO: 209310 - DNA, 2079 bp, Homo sapiens
  misc_feature (1881)..(1882): n is a, c, g, or t
atccccgggtcgcgctctaagtgaggcgccaagcggtctccgcctcagggtctgaggctgcgaaaggggcgtaacgatgagcggttcctgccagaggtctggggaggataaaaagcaggaggaagaggcgacggcggcctgtggacgtcttgcaggggtccccgaagccaagcagggtcccaaggccgattcagactccgacctagagacggaaggtgctcggggcaggggccaggcccgtctcctccccttgggggcttctcccgcaggggttgtgggaggtgggctggcgccgccgaggaggcaggagacctctgtccagcagggcacgtagccctctgcggggcgtctccagccccctgccctctcctcggcgctcctggcggcatcaggaactttaccatgagaaggcgcttctagaaggaggttaaaatggaaaatcccgccagacagtgcaccaaaggctgtcccgccctgaaatgcaatcagagctgggttttcccaatccacaggcacccatggacttggagaactggtcggggacaccctgtacctgaggtcttgctggatccatagcattgtgcccatcttctgctttctgtgccaagggagtgccccagagctgaacctgctgcacggtggcctggggccccagatgtggacctgttggagaaccagctgggagtggcaggagcccaggccctctgtgccgccctcacagtgaaccaggccatgcggaagatgcagctgtcagggaatggcctggaggagcaggcggcccagcaccttgatgaactcctgctggcccacacagacctgaagtccctggacctgagctacaaccagctgaatgaccaagcagatctgtgcatgggactgcagggcttcctcatcttccacagctttgggggcggcactggctctgggttccgtgtctctgctcatgaagcggctctcggtggactacgggaagaagtccaagctggagtttgccatttgcccagccccccaggtctccatggccatgacggagccctacaactccatcctgaccacctacacgaccctggaacattctgactgtgccttcatagtcgacagcaaagccacctatgacatgtcagcacaacctggacatcgagtgtcccatgtacaccaacctcagtcgtctgggcagatcgtgtcctccatcacggcctccctgtgattcgatggggccctgaatgtgtacttgacagaattccaaaccaacttggtgccatacccccacatccacctccccctggccacctacgccctggtcatctcagccaagaaggcctaccatgagcagctgtccgtggccaagatcgccagtgcccgcttcgagccagccaatcagatggtcaagtgtgaccctcaccatggcaagtacatggcctgctgcatgttgtacagaggggatgtggtcctgaaagatgtcagtgcggctgtcgccaccatcaagagcaagcacaccaaccagtttgtggactggtgtccgattggatttaaggtaggactgggtgatgtggagtccttgtgccatcaggaagcaggagacctgcagaataatgctgcccctgaaggcccgcatcctttatggagacaaccccttttcacgtcagctaggttgcaaggataataattttagtaatttatttcctaccgccttatactttaccaaatactttatgttccctcataccttaaccactaccctttaaagttcatggggcaatattaccagtatcttacactttagaaaacagaggctgaggctgggcacggtggctcatgcctgtaatcccagcactttgggaggccaaggcaggcagatcacgaggtcaggagattgagacnntcctggctaacacggtgaaaccccggctctactaaaaaatacaaaaaattagccgggtgtggtggcagacacctgtggtcccagctattcgggaggctgaggcaggaggatggcgtgaacccgggaggcagagcttgcagtgagtcgagattgcaccactgcactccagcctgggcaacagagcgagactacatctc

SEQ ID NO: 209311 - DNA, 1936 bp, Homo sapiens
  misc_feature (1738)..(1739): n is a, c, g, or t
atccccgggtcgcgctctaagtgaggcgccaagcggtctccgcctcagggtctgaggctgcgaaaggggcgtaacgatgagcggttcctgccagaggtctggggaggataaaaagcaggaggaagaggcgacggcggcctgtggacgtcttgcaggggtccccgaagccaagcagggtcccaaggccgattcagactccgacctagagacggaaggtgctcggggcaggggccaggcccgtctcctccccttgggggcttctcccgcaggggttgtgggaggtgggctggcgccgccgaggaggcaggagacctctgtccagcagggcacgtagccctctgcggggcgtctccagccccctgccctctcctcggcgctcctggcggcatcaggaactttaccatgagaaggcgcttctagaaggaggttaaaatggaaaatcccgccagacagtgcaccaaaggctgtcccgccctgaaatgcaatcagagctgggttttcccaatccacagatgtggacctgttggagaaccagctgggagtggcaggagcccaggccctctgtgccgccctcacagtgaaccaggccatgcggaagatgcagctgtcagggaatggcctggaggagcaggcggcccagcaccttgatgaactcctgctggcccacacagacctgaagtccctggacctgagctacaaccagctgaatgaccaagcagatctgtgcatgggactgcagggcttcctcatcttccacagctttgggggcggcactggctctgggttccgtgtctctgctcatgaagcggctctcggtggactacgggaagaagtccaagctggagtttgccatttgcccagccccccaggtctccatggccatgacggagccctacaactccatcctgaccacctacacgaccctggaacattctgactgtgccttcatagtcgacagcaaagccacctatgacatgtcagcacaacctggacatcgagtgtcccatgtacaccaacctcagtcgtctgggcagatcgtgtcctccatcacggcctccctgtgattcgatggggccctgaatgtgtacttgacagaattccaaaccaacttggtgccatacccccacatccacctccccctggccacctacgccctggtcatctcagccaagaaggcctaccatgagcagctgtccgtggccaagatcgccagtgcccgcttcgagccagccaatcagatggtcaagtgtgaccctcaccatggcaagtacatggcctgctgcatgttgtacagaggggatgtggtcctgaaagatgtcagtgcggctgtcgccaccatcaagagcaagcacaccaaccagtttgtggactggtgtccgattggatttaaggtaggactgggtgatgtggagtccttgtgccatcaggaagcaggagacctgcagaataatgctgcccctgaaggcccgcatcctttatggagacaaccccttttcacgtcagctaggttgcaaggataataattttagtaatttatttcctaccgccttatactttaccaaatactttatgttccctcataccttaaccactaccctttaaagttcatggggcaatattaccagtatcttacactttagaaaacagaggctgaggctgggcacggtggctcatgcctgtaatcccagcactttgggaggccaaggcaggcagatcacgaggtcaggagattgagacnntcctggctaacacggtgaaaccccggctctactaaaaaatacaaaaaattagccgggtgtggtggcagacacctgtggtcccagctattcgggaggctgaggcaggaggatggcgtgaacccgggaggcagagcttgcagtgagtcgagattgcaccactgcactccagcctgggcaacagagcgagactacatctc

SEQ ID NO: 209312 - DNA, 2806 bp, Homo sapiens
  misc_feature (2232)..(2232): n is a, c, g, or t
gtttgggttcctgtattttcaccagagggagttagtcctgccccagttcagctggtcctcaaagtgtatatagctctttaaccatcagcaagtgtctatcagaacataatcttgatttcagctgctactaaatatctaccaggagactgcttgagagaattgcctgatgggtgctgagtccaccattcctgagatactttgaaatcagtggcttaacccaagctgtgtatcgggaccctctcaccgtggtcccaatggagtcacttttcttaggcgcccccctttaccttgggctctgagcttcctctgcctttcatctctgtgggatgaagccccaccgcccttcaggatgcaaagccctcttctctaatgtgagtgcagggccaggtgcagtggctcacgcctgacctcccaacactttgggaggccgaggcagggggatcccttgagcccaggagtttgagaccagcctgggcgacactgtgagaccctgttgcctgaattgccctgggagatttcctcagcttgtgctgggggcatgtggccccatgaagcccgtagtcactgttcaccctgagagacgctggctttcgggctcacacacctgctgcggggcagccccaggaaatggccaccccatttctcctggagctgcgcgtgttctcagaaactgtggtggccgttctgttttgtttgcatcttataaacgtttacctgatgacattttcctcttcaatttagctgctagaaaatttaaagtcaggttggtggctcaccagtaatgagagtttagagtagaagtaaactttatgacatagtcttagactcttcactttcttctcaaccaatatgattcacatttactttattttgctgtaccgtgagtgtctctgtgtttcctgaattccttctggaataaggcaggttgttagtaagcacaggtttctggtccatctcacagcctcaggcagtgggcattgctgtcggtgctccctttccgggttacctgtggtagctctcaagttgcagggctgcgatttgaagcctgatttagtacaccgtgtttctgttgtgttctgtggtggtttgctcctcacatgtgagcattcaccgtggccctgtgtttttccaccacacctctgcctggtggcatcctactggatgtctcagccgagccactctgttctgaagatgcccttgtcctccacccctttgctttgggctctaagcttcttctgcctttcatctctgtaggatgaagccccacccgcccttcaggatgccagccttggcaacattgtgagaccctgtttctacaaaaagtaaatgagtgtagtggtgcacgcctgtattcccagctacttgggaggctgagatgggaagatcacttgagcctgggaggttgaggctgcattgagctgagatcaagccacggcactccagcctgggagacagagcgaaaccccatctcaaaaaaacaaagaaagtggatgcgcgctgctcctgccattggatcatcgcagcatttttcttttctctgatatgcacctttttcctcatcgtgggggctcacgttttcatagttccctctcactactaggttgtgagctgcgtgaaggaaggttcatagttgtgttgtatgtacaggcacacaaaatttgtccttggataaacacatatcctcttccttcttctctctgaatttctttattttaagaaaaaaattagagatggagtctcactgtcttgctcaggctggtctcaaactcctaggctcaagtgatcctcctgcctcagcctatactaatatgaattcctatactaatatgattgaaattagtttgatttctataataattgtgctcccagattgggcttctgttttgatagtagaactaaattattaggctatttcaagaaattaatatattactggtagaaaaactgaagctacaaaatggcctggtttctcacttcagttaaatttgtgcttctgagtgcttgtattctaggtgaaaccacactgagaaggtatttgtggcccatacactgattccttcatgagacttgtttgcacaggagagctgctaaaaattactgctctcagggaggtctgtggtgaacaggtatgaagaagaagactgttctctgcccttctttttgcaataaaatgttccaaactatcttgagtttgatcccttttcgggtgtttggggtttttttaacattcanagtatgacacagccgcatccttgccagggccggagggagggtggatggacttataggtgttgcttgtggctgggtgacttgcttctgccaacgagattttcacagacacggcacaagcagaagcctggaatgtgtggcactgccaggcctgccctcttaggctcttgattttccccacgagatatgcgtgccccagggaacggcggctctggctgtggaatgagaggcgtgtggagcaggcatggttcccaccctcagcctagagtcaaggccagactagatcagcctaagcccagccacgccacgggtgcagcagtgaagagcaaatgccaactgtccatgacagtgactttcaaaggggcgtgtcatgtgcctcatcccagcaacagggaaggcacttctctatcagtcagttggtaaatgattattgacaatgtgtgggaaggtggagttatttgagtagatttggcctctattctcatggagcttcctttctagaggggaaggcagatgatggatgaataaatataaatgattctaataggttggtgcagcagtcattaaaagtaatggc

SEQ ID NO: 209313 - DNA, 596 bp, Homo sapiens
ggaggggctggggacatgggaggggctagggatgcaagctttcctgagttcccacagttctctgcccctctcctgtctcacggggtgtgggccacctgtggcttgcggttgtttcgcgccaagctaatatcttgttcttcccaacagagaggcccgttgaggcttctctgtcctccatggggaacagcattggcctaaacctgcagacaccattgcaaagggaagtcagctcaggcaaacccgctggtgaagaagaattccagtgtggggacacagagactgacatttcttgccatgggtgatttaattttgggcctcagtttttcattcccccctaagagtatgacacagccgcatccttgccagggccggagggagggtggatggacttataggtgttgcttgtggctgggtgacttgcttctgccaacgagattttcacagacacggcacaagcagaagcctggaatgtgtggcactgccaggcctgccctcttaggctcttgattttccccacgagatatgcgtgccccagggaacggcggctctggctgtggaatgagaggcgtgtggagcaggcatggttcccaccctca

SEQ ID NO: 209314 - DNA, 1725 bp, Homo sapiens
aagggattttcctgcctcagcctcccaagtagctgggactacaggcgcgtgccaccatgcccgactaatttttgtatttttagtagagatggggtttcaccatgttgcccaggctggtcttgaactcctgagctcaggtgatctgcccgcctcggccttcaattgcagaagtttttgaagggagaatatttgatcctcacataaaatgtccttgtttctgaaagaaaacatggtaaaaattgttattgagtccatgtctttgccaccttgttggacttgatttccctttctctgtgttcctcccgccctcagtctctctcagtctgtccttttttgtgtgtggagttgtgggcaggtcattggactgggactgactttaccagttttcaggctgtggggctagtcagtcattctctctgagccttctacctctaaagttgagttctttttttaaattctttttgtttggtttttattttttccttgccactatacaagcaaggatagataaagctttttattattattgttattattattatttcgagacagtctcgctctgtcatccaggctggagtgcagtggtgtgatttcagctcactgcaacctctgcctcccgggttcaagcgattctcctacctcagcctccttagtagctgggactacaggcatgcgccaccacacccggctaatttttgtatttttagtagagacagggtttcaccgtattggccaggctggtctcgaactcctgacctcaggtgatccacccaccttggcctcccaaagtgttgggattacaggcataagcgaccgtgcccatccccgataaagttgagttctgaatttcctctttcactgtattctcggcagctactggttggtttattctttttttttaatcttttttggtttattcttcttttgatctttgaagagaaggagaaaaaagatctgagtttggctctcccatcttaagtgcagcttttagttgttttatagtcatagacgctattgcactggacagcatgcatcctggatgtaaacaatgcggaaaaatcaatggagtgaccatcttggggtcagtggtgttgcataaagcaccagtggtgtgctgttctgtgtcagtttcctctgcgccacgtgctttcacagtttgaattaccagcatctctgtggtggcttcagtacattctccattgtgcttcaacctggaagcacattctgccgttcagaaagactgattccaatcatgtaatgggaccacacgagatccatgctccaattatatgaatagcagaaggtccatttgactcttgtagttcaagagctgtttctaagtaaacagactttccagagctcgatgaagtgaagaagcccttctttcaattcctgggcagaattcagtggttttcatatcatctgaacctgctgtgctgctgtttattctatcactgtcagccttgaaaggaaaaaaggaataatcttaccctcctgcccttcttattttatatcttccatcttatccatctatatccatgtagtcattccttccgagttccctggttttaatccaaaagactctgtttaacagcaatgtcttggcagaccaggtgccgcttccgtgccatttgagggctctgagtctttgcttcgtcttaggaagataaagataatttggcagaaagtcagagatggaaatagcagtttgggatgataaaagat

SEQ ID NO: 209315 - DNA, 628 bp, Homo sapiens
  misc_feature (479)..(479): n is a, c, g, or t
  misc_feature (512)..(512): n is a, c, g, or t
  misc_feature (553)..(553): n is a, c, g, or t
  misc_feature (574)..(574): n is a, c, g, or t
  misc_feature (627)..(627): n is a, c, g, or t
atttctaagtatctgtacttcttaatatcttaagtgaattctgattctaacattccaaatatattctatttaaggaagtgagcacatggttttctatcttcattacctcctaccttcattacattattttttgatagttttaccataaaaatgtgttcattattacccatatattttctcttcaactaactcatctgaaaaggctctaatcaatgttcacctgtaacctatacccgtagttctcttagtgtggttcacagatcagcagcaatatcatcgaggaccttgttcaactgcacattctagagctctttttaggcttatttaataaaaattccaggtcccagcaatctgtgttctagcatgtcctacaggtgtttttgatggacactaaagtttgaaaatcaagctcttgtccaaagctactggtcaatgtcacatcttcatcttgcttggccttccataaaaaaaaaccccantttttaattttaaaaaaattttttggggggggnaaaaaaaaccttcacttatacattggaatttgatataaaanctccaagcaaaaaaaggtccnaggaccatatgaataccatgtctacccaccaaagccatggggaccttaaagcna

SEQ ID NO: 209316 - DNA, 463 bp, Homo sapiens
tgcaagcttagtgttctctgaagtcctctataatttatcatctattgcagctcacatttagcataagctacaagcttatattgttaatcattcttctatgtttatgtgctgactcacaaataaatgggcctatgtggactttattttcataatcttaataatatctacataacttaataactttgttataaatctgatgtttcataaaattttgtgttatcaactatgttctggtagaagaattacacatttttgcttaactttttctgactttctattgcctatcaaatacagtaagtccttacttaacgtgaggatttaatatgttcttgaaaactgacctataatgaaaccagttgtaccacaggctaattgatataaataaatagttatgtttctatggcacatttctggtcacaaaaacatcaccaaactcagaaagacccaaaacacttccaatgtt

SEQ ID NO: 209317 - DNA, 215 bp, Homo sapiens
ccaacatatataatgcttactgtgcgccaggcactatctaaatgtagtaattcattttttccccacaaaaccttcaggaggtaacattgcacagcaagtccagtatcccacacagcttctttctgtacctcctgctgctcttaaaagcagagaagacagtgttggttgcattccttactcttaatggaagcattacaaatgttccatggaagcga

SEQ ID NO: 209318 - DNA, 444 bp, Homo sapiens
cagggttcatgctcctatgacaatctaatgctgccgctgatctgacagaaggcagagctcaggaggtggtgcttgcttgcccactgctgtgtggcccgtttcctaacaggccatagactggtaatggtccgtggctgggggggttgttaaaatttatcttaaaaaaaaaaatagctaacgtttgttgggtatttaagtgccaggcaccagcacttagtatgtattaactcatttaatctgcataattatgtgtggttggcactttgccgttttagagaatttaaatagcttgctcaaggtcacacagctaactaaagcgggtgggagaagcagacagtttggctccaggacctgtgatcttagccattgtgtaaattgccaagtagcctgtcttaaagctgtgttgctgaaaggaccatggaacattttaaaatgtattacatg

SEQ ID NO: 209319 - DNA, 766 bp, Homo sapiens
tatgcacctccctttctgtgtgtcctgggaaatcaggcatctgctctgtgagatcccacccttgctgaagttggcctgtgctgatacctccaggtatgagcttataatatacgtgacaggtgtgactttcctcttgctccccatttctgccattgtggcctcctacacactagtcctattcactgtgcttcgtatgccatcaaatgaggggaggaagaaagcccttgtcacctgctcttcccacctgattgtggtcgggatgttctatggagctgccacattcatgtatgtcttgcccagttccttccacagccccaaacaagacaacatcatctctgttttctacacaattgtcactccagccctgaatccactcatctacagcctgaggaataaggaggtcatgcgggccttgaggagggtcctgggaaaatacatactgctggcacattccacgctctagggaaggatcatggcttgcctctcaccattcctcctccagataaaattctctactcactcattcctgctccaaataaaattctctactcactcattcttcaatactgtactctgagatgatagatacattttttaaattttacttttattttcaactgtgaatctggtgtgtacaatgatcttgagttaaactcatttggcacacatcatcctgactttggaaacccatgttataaaaataaccagatgggggaaaagccttgaatgggtgttgtagactcactctgtggtaggcatcgtcctg

SEQ ID NO: 209320 - DNA, 387 bp, Homo sapiens
tgggatgtgatgtcactttcaagattaggttataaatagactatggcttcaatcagagggttttctctctgtctagctctcttttgggtagttcattctgaggaaagccagctgccacgttatgatgtaggcctgtgaggtccacgtagcaaagaacatatggaagatttctaccaccccctaactaagcctttagatcagaccgcaaccccagccaacaaggtagctacaaactcttgagaagccttgagacagaggtactcaatagagccattcctatgagaaacgtaagtatctgctgttttacaccgctaaggttttagctaatgtattatgccataatagataagttatatacaacctttatcaaataataaaagtaaccat

SEQ ID NO: 209321 - DNA, 376 bp, Homo sapiens
gccatttggaaagcctgctagattctgcacaagccttaagaaggcagcactcaaatgcaccagcaatcaaatgcgccacctgtagacatctttagctgatgctttcagcaaggcatgctgaaacccaaaagacaggcgacctgcacagaggctcaagaagagacagagaacttcaatcctgtgagcctgaagactcaaggccagtgagggaaagagaaaggcaatctctgagacttcagttttacttaaaacaatctgttttaaatggaaatgggactgagatggcattcataggaagttaactgttttggaatataagctcatgaagatgattattagatcagttataaaaaataaaatgaagtcaacgttttat

SEQ ID NO: 209322 - DNA, 275 bp, Homo sapiens
ggggaacggggaacattagtggttggaaggagaggagcctgacagcagaaatcagaaagcaaggaactcacgatacaggctagaagagccagcttaatgaagggacaaacactgctttctattagcaccaaccatcttctagtgacaactgtactaggaaagcctggcgtgggtttttaaggaatgtggatataagaatgcagaaggagaagcagtcttgaggcacctccttccagagcaccgctcctctggctctcccctgtgagaggcctcaa

SEQ ID NO: 209323 - DNA, 798 bp, Homo sapiens
agttcaatgttggcatctagggcatgtactcttgccacttatgttttattacctctctgaatagttgtgtcttaattgatgtactctgttgccatttacattaatcccatgactcaatggtgagcagaatgagaaaagactagaaaaatcaactcatcattccttttaagaaatttgttaactgttttatttatttttgttaagctcctgtggttggacagtacaattagttacttaatattttattttctcctctacaaaattaatctttttaataactaccctcttttgactagttacttctattcccaaaacaaaatgtattcactaagttcctatgttcttgtcaaagaaaacgtcagacgtttctgaagaagtgattggggaatcagggtgggaggaaaaacgtattcctgacagtataagaaatatgtttgcattccagtaaattatttttaggtatattttgatatcactttgttctgtaacctacttttatctttttctagccaagaacacactgatgccaaaatattattataagtcgaaccatattctaatttaacttttttgaaaaaaaatgataatatatgcaaaatgagacttagagttgtcttaacatcactgatttttggaattctaatagtcgtgaataagagacattcatgtcatttgataaaataattaaagtataaatttaaggtataacaattaaagtatgaatttaagccagtattatattccataatcctgaaaatatattggttacctcataatggcataatgtttatttccagt

SEQ ID NO: 209324 - DNA, 803 bp, Homo sapiens
tctagaacaaggagttgatgtcctgctgctatcaccgtttcttctccccggcacatagccaggaggctggtgggcactggcagcccggtggtaaggagatggggaccatttcttccctctcttcctctgtcacttcattatcattctgtagttgagctcatcttgctcaatcatttaaaatgccctgccagcatttctcaaatttatattccttgccctgacctctgtcccgacctctagatgatgacccgacatctccatgaggcattcagcaggcatcacaaacttgctgcctcctccccgccactcctcttgcggccccctccttccagtcactctggcacctccttgggccatcttgacgccactcttcctcttacatcccacatccaaccccatcaggaaatcctgtcagctccaacttggacaagcagccaggatccggccacttctcacctcccatgggtagccccgggtctcagccaccatggtctcctgctgggactcttgcagtcgtctcctcccttgtcccatgcttccacccttgcccctggttctccacatgtaccctgcgtaaatcaggttagggcgacaggtgagacctggcctggcatcgggagacctggttctaatctgtgttttgtcaccagtttgctgtttgacctcagaccagtgtctcatactcttggtatctccattaagtgggagcttgttggagatggcaaactcatcatccttctaaccctctccctgccaccatccatggcaagtacactcatgcagggatcatcatagaacagacc

SEQ ID NO: 209325 - DNA, 1230 bp, Homo sapiens
tctagaacaaggagttgatgtcctgctgctatcaccgtttcttctccccggcacatagccaggaggctggtgggcactggcagcccggtggtaaggagatggggaccatttcttccctctcttcctctgtcacttcattatcattctgtagttgagctcatcttgctcaatcatttaaaatgccctgccagcatttctcaaatttatattccttgccctgacctctgtcccgacctctagatgatgacccgacatctccatgaggcattcagcaggcatcacaaacttgctgcctcctccccgccactcctcttgcggccccctccttccagtcactctggcacctccttgggccatcttgacgccactcttcctcttacatcccacatccaaccccatcaggaaatcctgtcagctccaacttggacaagcagccaggatccggccacttctcacctcccatgggtagccccgggtctcagccaccatggtctcctgctgggactcttgcagtcgtctcctcccttgtcccatgcttccacccttgcccctggttctccacatgtaccctgcgtaaatcaggttagggcgacaggtgagacctggcctggcatcgggagacctggttctaatctgtgttttgtcaccagtttgctgtttgacctcagaccagtgtctcatactcttggtatctccattaagtgggagcttgttggagatggcaaactcatcatccttctaaccctctccctgccaccatccatggcagacatcactaatcaattatgatgtggcttcctgctcagtctagagctctggggaccctggaaacactcaggctgggagctgagtaaacagtctctctggtccttctcttatgccccagaagacctggatatacatttagaggaacttgaacgcctgggctcgaggaaacatgtgcatcacctagaggaacttgtatacccataccccagtcgacgagagtatacagctgaaagaacttacacctgagtgccattgtttacagtaaggatgtttgaaacaagtgtctgcagcatggcagtggttacttcatgctgtgattttgactagtaagcaatgaaatgaacaacttgaggtctgtcttattgtggattccccaaagaacatgacccgagactgattcaagggcaagtagcatacttgggaggtcaccccaggaagcatcaataggagagtgggggagtg

SEQ ID NO: 209326 - DNA, 356 bp, Homo sapiens
gtcctgtgcactgtagggtgtttcgcagcatccctggcctctacacactagatgccaggagcacccctgtcctcagttgtgacaacccaaaatgtctctagacattggcacatgtcttctagggggtaaaatcacccccaagttgagaaccactgggctcaggttagggcgacaggtgagacctggcctggcatcgggagacctggttctaatctgtgttttgtcaccagtttgctgtttgacctcagaccagtgtctcatactcttggtatctccattaagtgggagcttgttggagatggcaaactcatcatccttctaaccctctccctgccaccatccatggcagacatcac

SEQ ID NO: 209327 - DNA, 321 bp, Homo sapiens
cctttgggtattcccagaaataactggagttggacatattcaaagacaaccaactaaacatccaggaaaacatgacgccatgagtagggctagcagacaaaagaaacagactcacagaggtttcagatattcaactcactatacacagactaaaacaattctagctactcttttcaaagaaatagtcaacaagtttgcaaattctaaccaggaactggaaactataagaagtgtcacagaagaacttctagaggtgaaaagtacaataactaaaaattaaagagcatataagtcgctttaaccacactttgaacacagctg

SEQ ID NO: 209328 - DNA, 1147 bp, Homo sapiens
ctcaagaccagcctgggcagcatagtgggctccacctctacaagacattaaaaaattagccttgtgtgctggcaagcgcctgtagtcctagctgctcgggaggctgaggcaaggggtttgcttgagcctagagatcaaggctgcagtaagctgtgattgcaccactgcacttcagcctaggtggcagagttagaccctgtctccaaaaatacatttttttaaatttaaatctggcagtttctaggccagtggttcttaatggatattacagatcagacttctctgtggagtttataaatatacagatatgtaggcactgctttggacttcatgaatctctttgcttgatattcttggtattaaaaaattatgtctgaggattattatgttatatcctaaaaatttttctgcatagaaatttgtccatttatctttatataccagatccaatattcagacttatttgaaaataggcttaatcattatcctgagggacattttgtctaaaatttgcttgaatggctttattatctttgttttgcctgccacaaaaacaacaaaatctcctttcaattgagttatttttatcatgaactctctttagactgttcacatttgaaaattataactaatatttgcctccagaaaagtacatctgtttgctaatattagttcctggtgactttcagtgaacgttttgcaaacttgaattaggcaacattttaaagaagaaaaaaacatgactaacatgctaaatttaaaacataaaagtagatctcttagagccttgaagcttgtaatcaatagaattttcctaattaaaaagcattgggtaaattatctactacttccaatgacttttgcaggtacagcctctgtatggaaataatctttaattttttataggtataacagagaagaacgcattaacatttaagatgtttaattccaaataggaaataattcagttttctgtgttaagaaatgtaaggccatcctagagtataggagttacgtgattttcttctgtataaaaatctcatttaatagtggctgtattatcagatacttatttgattatagtaattcatcagacacatctccttcgtttggtgattatctcattgatctttgtcacacgtgagtg

SEQ ID NO: 209329 - DNA, 773 bp, Homo sapiens
agacttccttgagtcctcaggtttgggagttcccctcctagagggagtctctctggctcccaggctcaggcataacttcattctttccactcgtttccacgcatctcctaattgggctaccagcacccctccttgatgcaggcagggagaagtggacagggcagaaagggctgggtaaattcatgagcagtaaatgactccatcaacagtggccatcaagggaaacaggccatgttccagccatggaagctgggaagggacactaatcctctccagagatcagtatccctcagccacttaggcttgtggcagaggcactgtggccctgtccccagtaagttccaaatacactgatcttgccagctgctggtaagcaccttgcaaaagaagagaatgagagcccccgcttttccttgagtacagtgaaagctccttttggagaggtaggttccttatggtttaccagcaccgcagctggcccagggttggtggttagcacatttgtggaatgaactaagatgtagtgaaaaccagtccacagctcgtagccacgtgtctctcagccagcccacacctgaggccaccactttgtgtttaggagtggattcactgtactttggttatcagagattaaactcccttggagaattacatcatcaaatgaaaatgtaaatgtgtttaaaatgaaaggcgatgcatatccgtgttgggttgcgccagatccgtaagtgtgatcctctggtccgggagcgagggttccgcgactttctgtg

SEQ ID NO: 209330 - DNA, 541 bp, Homo sapiens
aaacctgtggaaatattcgttagggaaaagaaaatgagaaagaataagtgaagactttaggtttaggatgctttaggatggggcagatgtcctcaaagaacaatggggacagagtagggagaaaacgtacatgcagcctggggacctgatccccttccacggtcatattgcctctgctccttctgtctgatttattccgcattgggacatttgtctatcattctccaattgtttcgtgtttatgtgttctgtataccctgatcgtcagtatgtttttcaagggaaaggatgctgtcttttactttgtatatgtacccgtcattttgccctaaacaaccttgtatgcaacaagaactaacagtctatctctaagaccatagtaattctaagcacttagattctgagttttgtgttgaaaccacagttgatcctccattgttattgagtctgtgctttctaagttcaagctgtgacaccgagaactccacaccctgccacatctggaagcatcccactttctgctgtcattttctggccctcc

SEQ ID NO: 209331 - DNA, 803 bp, Homo sapiens
cagggtagaactgctttccattattgattacaaaagaatcagccttccagaagataaatctactcccttcatggaacctcctcattgcagcagctgcttgggcactattttctcctgtaggcaggtaaaaatatgtgcaggcttttctggcttggatcgtacagtctctttaaagcttatagactctgattattattattattattattattattattttgagacggagtctttctctgtcgcccaggctggagtgaagtggtgcaatctcggcttactgcaagctccgcctcccgggttcacgccattcccctgcctcagcctcctgagtagctgggactacaggtgcccgccaccacgcccggctaattttttttgtatttttagtagagacggggtttcaccatgttagccaggatgatctctgtctcctgacctcctgatccgtctgcctcggcctcccaaagtgttgggaccacaggcgtgacagactctgattattaaaagaaaattgggagatcatctagtcgaatcctattttaccaattaagacacagtggggatgggagttagttaataatttttccatagtaacagacatagtaacacagtacgtttgtagggaagctgaactcagaccttcaggcttatttcactgagccacgctacttcaggtgttctcagcaaagcatgggaagtaacaagtgttcgaaaccctaagacactgcaaccttagtgtagctttgggtgccatccatccacattcagagaattcagggtctacagaaacagtgtggatttgg

SEQ ID NO: 209332 - DNA, 589 bp, Homo sapiens
attcaatttgccttctaagatgtgttcatatttctattaaggtccagctagaaatgtctagatgcatagctaaagcatggagactgcaatctgaaggccgcatggctgccctgctggcacggaggttttggaatccgactgcccctagtgggctctgactcctaaatggctgctgcacatcataccttggtctcctctgtgagttccctccatctatggcgtgtagagacatattccaaaactccatttacaaggtctatttggactgcaaaagactgaatgataaggtcactggaacagtcagctggcacaatcataggaaagcacgaatttcactcccatgctgataaactgagagaggtttcagtccacactgacagactatcagactagaatagccatccaacggtcctacacaaactcgtacaacccacaaccagcttcaacagaacagtcagtgtatgagacaaaggcacaatgacaaatctaaaagacggcctctctcctctcgctcacgcctctgcttgtgttaccttccaaatgtgtgcctttgcccacagacctcgatgggtgacaatcacaagtgtac

SEQ ID NO: 209333 - DNA, 467 bp, Homo sapiens
agttattaccagagctattcagagttcacaactggaccatttgaatttcctcttttttgtgtgctctacctacctttcaatgaaagttttagtaataatgaaatggtcaatagtaggcaagaggatgaaagaagagaagtaattctcaatggctttctcagctattgattaaacatttccatttaaaaatagaagccacatccatgatgccttaacaaagcattgtatgtcaaaatttctgtaaaatggttttagtttcatgcagagtattcacaccattagtatttggagtggttttagatatttaagtgaaaataggttatttcagattcagacatttctgggaaaataagttactttaatataatctgccattataaattataaatacatatgtattttttaaagccatatagcatttagctaagggaagatggaaaacataaaagcacaccacaagactaaat

SEQ ID NO: 209334 - DNA, 345 bp, Homo sapiens
atgttggtggggttgttaaagagtttttctttcccaagccaagaaatgagcaaggctttgaaactatattctcttaataccttttcactaaaattttagtcttgaacagactgaaacaagcacataaaatgcccagaattcatcaccttaatggcatcttgaagacactatgtattaatttgttatagccagacctgcataaaggctctggtttacttgaaagtcaatgtctcagaattttcttcagtgctgtgagctatcctgtctcatcaataaatttctttattgcttatgtcatgcaccaccagtttctattgctgacaaccaaattaaactaacttatat

SEQ ID NO: 209335 - DNA, 308 bp, Homo sapiens
tgaggaggaggaggaaagggagtaggcaagaaacattttaattccatctcttattaaatatgtccacatcatcatcatctcattccactctacccacagacacacaatccaccaatcagaaagtcatttccaatagcaggttcaattttagattgcacagacctcaagggagaattaagcctttcagtcattcagattagtggaacaaactttcactccactatgtaatccttgaggcctaaaacttcagtttaaaacccgtgaatagttgggacactatgggcacgcgctaccacacccagctaatt

SEQ ID NO: 209336 - DNA, 332 bp, Homo sapiens
tgtgagagagacaagaaaagaatgatgcaaggttttagcctgagcaactggaagaagagagttgccgtcagctgagatgaagacaatgaaagcagctttgcggacgcggtaagtttgagatgcccgttaacgagacatccaggtggggatgctgagtaggcgggatgcaaggctctggagttcatgggaaagctccaccaggaggtagaaatctgagagtcatcagtgaattgatggtatttaaaatcagaggagtagatgaaatcagcagtgaagtgggtgtagatagaaaagacagggggccccaagactgagtccagggcagtctggag

SEQ ID NO: 209337 - DNA, 610 bp, Homo sapiens
ccatcacgtctggccatttggtagttttctgtagtggttacatttgagtcctcttctctttctcatttgtgtgtctgctctctaccaatgaattttatactttaaattttttttttttgaaacaaggtctttgctctatttcccaggctggagtgcagtggtgtgatcttggcttactgcatgcctctgcctcctggctcaggtgatcctcccacgtcagcctccctagtagctaggactactccatgtactcagcctccctagtagctaggcaccaccattcctaactgttgtatttttagtagagacaggatttcaccatgttacccaggctggtctcgaactcctgggctcaaatgatctgcgcttgttgacttcacaaagtgctgggattacaggcgcgagccaccatgcctggccactttaatgtgttttcatgacgatagattttattctttcacttccagatgtaggacctccttaaacatttcttgtagagctggtcttgttgttaagaattccctcagtggtgacaggcaggaggtgtcaagctgattctcaggctcttggatggtgcacgcagccactgatagtgcgttgcagagttggg

SEQ ID NO: 209338 - DNA, 490 bp, Homo sapiens
taatttttgtttaattatactctaaattctggaatacatgtgcaggatgtgcaggttttgttacataggtatacacaggccatggttgtttgctacacccatcaacccatcatctacattaggtatttctctggaattttcaacagatgtaggggccaacaggtatgggggttatggtggcaagacagggtttgagactgggagaagaggaggcctggctaacaaaggtggtctttctctgtagatgaaacatcacaggtagcagccctcagagacaatagatgacaaatgtttctttcagacctttaaatgtgtcagacactcagccgggtgctggtggctcatgcctgtaatcccaacactttgggaggccacagggagtggatcacgggatcagaaattggagaccagcctggccaacatggtgaaaccccgtctctactaaaagtacagaaactatctgggcatggtggcgggcacctgtaatctc

SEQ ID NO: 209339 - DNA, 740 bp, Homo sapiens
cagcccaggccgtgcttttataggcaatgcttgggtaatggagtctcccttagcagcgatcctgtagcatctgctgctctgaaagccctgcctaacacattctgctttgtctgcagcaaggtttacacacacccctggactccaaagactcttttttatgtactttttaaaaaactaactccaatggaaaaagaatgtgtcatggcatgttaaactttatggaaattcttctggagaataacataatttcacggtgcattactctgaaatgacctagtacttgaacaattaatttttaaggtgtagcattgacttccccttgctgtatttaacccatatctgaaattgtcaacaatgccaagggttggacaatgagttgggagaagagcaggagcctgaaaattactccctatctactatgttttcttttatcagacataatgcttccctctttggttcaaaaatgaaaagagaagggagcaggtactttagttagggacacttcataggcagcacagcctggcaggtaaatagtgcagtcctggagacataaactcgacgtcttacctttgtcattaatttactgtgtagccttagagaaactcctttttctctctgtagctaaaatgggggaaggagaggttttgtttgttatgcccccaaaaggaattcagtgatagaaaatgaatagatgtataatatatcctctgattccttgaaataaaagctctgaatgtttt

SEQ ID NO: 209340 - DNA, 230 bp, Homo sapiens
tgaaaaactcgttctctaaacttttacaggaagtttaaataaattacatcatgaacaaaactgcagtatgccagttcctatcctcatgacctcacgattctgcctgagctccacatcaatgaaaggaaaatcggataatgaagcacttagtctaatatctcaatagcaaccaccaattaggattactttttagaaaagaaaaaaaaacctaaccttatatgtaaatgtat

SEQ ID NO: 209341 - DNA, 607 bp, Homo sapiens
caagtccttggccgggcacagtggctcacgcctgtaatcccagcactttgggaggccgaggcgggcggatcacaaggtcaagagatcaagaccattctggccaacatggtgaaaccccgtctctgctaaaagtacaaaaagtagctgggcacggtggcgcgtgcctgtagtcccagctacttgggaggctgaggcaggagaattgcttgaacccaggaggcggaggttgcagtgagccgaggttgcgccactgcactccagcctggcaacagagcgagactacgtctcaaaaaaaaacaaaaacaaaaacaagtcctctgggtgattacaaggcatgctgaagtttgagaatcactgtactaggagttagtcctatatactacatacctcaaatttaagaaacatatatacacataatcagagaaataaattacaaataactatagggctggaagataattctgttaagtgatatctggtacaagtatataagcctctttttaaaaatatacataatttgtatataaaagcaaccctaagcttataaatgagatttgttaaagaagtgtaattgtaaatacattatttggaactaaggtcatattca

SEQ ID NO: 209342 - DNA, 267 bp, Homo sapiens
gattatttacagatatatagtattttggtgggtagaggcatggggaactatttagctcagctggcaaaaagtccaagcaaaacaatccaaatgcctagagtggtgacagttgtgcaatgggtacttcaaagctgtacaacattcaaatacttaaacattgaaggcagtaggtagaataaacatcaagagtttctgcctttatgctgaatagcattagctttctcatctgggaaatgggagatggtagtacctgctctatttatctca

SEQ ID NO: 209343 - DNA, 324 bp, Homo sapiens
tttaaacctgaaggtaagcagtttgttgtccaagaatgcaaacatatacataaaagaataacccgccaggcgctgaggccccctgcctgtaatcttagcactttgggaagccaaggcaggtggtttgcttgagtctaggagtttgagactggcctgggcaacatggtgaaaccctatctctacaaaaactacaaaaattagccaggcatggtggcgcacacctgtaatcccaggtactcaggaggctgaggtgggaggatcgcttgaccccagagggcagaggttgcagtaagctgagactgggccactgcactccagcctggg

SEQ ID NO: 209344 - DNA, 548 bp, Homo sapiens
gtccttcctaaaactgaagtggaggtgccgcaaaaatcatctggtaaattgtttaaagtaatcccaaatgcaactcaaatctacagaatcccaggtgaagctcagtaatctgtatttttatccttctccccaaataattctgatgtgcaggcaagtttgaaaaccactgctttaaagaaaatggatactccccttaccaagcagaaagtaggattttggaaactgatgcaagggaagcaaaaagatgcctcaggaggcacgattacaacaggattgatgcaaacggaagctgaagcttaaccaaagacattaatatacgcccacaaaagaaaatgctaaggaagtcaagtggtctgcatgaattctgaagaaaaatggagaaccaaagaacaaaatttgtcaatgaatttccagcacagtctaggttaagggagtgaatttcttgactgaatggcacagactctgtaccacctgattggctgttaccttaatggaggaattatattacaatgtataggtactttaattagaatgacctggcagttact

SEQ ID NO: 209345 - DNA, 142 bp, Homo sapiens
tacgcctatcgtgatggtactaaataaagtctgccttaccatcttgaacgagtgtcatgagtaattcctctttaataccattttgtccctcctgatacagaagcacctgagactgcagagagtgccatgcaacaggaagatc

SEQ ID NO: 209346 - DNA, 463 bp, Homo sapiens
ctgtggaaaacagtagtaacagaactacttaatccagtaattccaatcccaagaatatatccccaaaattgaaaacaggtactcaaatacatgtacatgcatgtttgaagcagcactattcacaatgccaaaaggtggaaacaacccatatgtccatatgggttgttccagataaacaaaatatggtatatacatgtgatatggtttggctgtgtcctcacccaaatttcatcttgaattgtaccccataattcccacctgtcatgggagggatccggtggaaggtaattgaatcatgggggcgggtctttctcctgctgttgtggtgatagtgaataagttttatgagatttgatggtataaaggagagttctgcataagctctcttgtctgccgctttgctctccttgccttccgccatgtggaactgtgagtcaattaaacctcttctctttataaatta

SEQ ID NO: 209347 - DNA, 267 bp, Homo sapiens
tggctaaacagtataaatgttctaagaaacagaatcattagactcttcctgcactagatctcagttctgaaaaccagtaaaaacattccacaagaataacttagaacatttggaatcatctttttatccctgcttttacccaaaatacacttaaacaatattttcatgtcttgatcgaaaatacacattaccaagatagtgaactaccacattttaaaatattttcccaattaaaattctgcttttaatggacgtggcctttgtatc

SEQ ID NO: 209348 - DNA, 612 bp, Homo sapiens
tggaacagaagaccaaaaagtaacggcacagtgacaatgacagctctaaatacttcctacactccccacaacacggaaaaccagtaccttactcagcagaaatgtaattagtttatgaatctggaattgtagagcatcgtttgcctcccaactaagagactcaaacacaagagaaagttattcattcgtagatatttgttttacaggagcgcttctgaaactgcaattttaaaatgttcagaaagaaggaaaaagacttaaatatgggtctagaggatacatactttagaaaggaggaaaaaccacacacacagtccctatgtgcaggcccccttctgtgcaccacgcaggtggctaagcatactccctacactggcattcttcttctaggtgtggtcacttgtccaatgacgcacttaataaatgctcactgagcccccatttggggtttgtttctgttctatgcacagggataccccagtgaattgttgaaacagacacaatctgcactctcatgaaacagacattctagttggccagagaggcaagcagaaaagaaagatgaatgtgatgaatggttctgaatgtaagatggccacactgttaactgat

SEQ ID NO: 209349 - DNA, 337 bp, Homo sapiens
catatttgttctgggctctggttgtgggtttatttacgtgtgcacacacacacacatacgaaagtcatggacaaatgatttcatcagatcgtggttcccaataacccgagacaccccagggtgccataggaaactcacagaagtgacatggaattactaaacatttcttagggaagcccagcaatgcttgacatccgtacaccgccacacagtattacctcagcagtgtcaatgttctatagtactgtttttagtttttattttttatttttttgagagagtctcgttctgtgccactgcactgaaacctgggtgacaaagcgagtctctgcctctt

SEQ ID NO: 209350 - DNA, 573 bp, Homo sapiens
caaatcaatgagtaaaactggcccactacaaaaacattactacttaccaacctcatacccattaaaatggctattatctagaaggaaaaaaaaaacaaacccaggatagaaaataacgagtgttggctagaatgcggagacactggaatcctggtgctttgtgggtgggaatgtaaaacggtgcagccactatgggaaaacagtatggtggcccattaaaaattaaaaatagaattcccatatgacccaacaattccacttccgggtatatactcaaaataactgaaagtagggtttcaaaaaggtatttgtatactcacattcatactggcattactcacaatagccaaaaaggtggaagccacctatgtgtctattaacaaatgaacaaacgaaatgtggtacatacatataatggaatattattcagccttaaaaaggaaattctgggccaggcacagtggctcaggcctggaatcccaacactcagggaggacgaggcaggcggatcacgaggtcaggagatggagaccatcctggcaaatgcagtgaaaccttgtctctactaaaaat

SEQ ID NO: 209351 - DNA, 300 bp, Homo sapiens
caaagtcctcatttaatgtcattgatagattcttagaaactgtgactttaagtgaaatgatgtacagcaaatcctcaaataatgtcattttgctcaatgtcatttcattgtaatgttgatgaggaaaaaagtggttttgttacacatcatttcacttaaagtcacaatttccaagaacctcttgatgacattaagtgaagacttactattacttagtatgtgataaggatgggcttacggataggttattcattatatgatactaaaataattactagactacttaaaaaatagcaaact

SEQ ID NO: 209352 - DNA, 540 bp, Homo sapiens
gagaatgataaagaaatgaggtaaaatgttaagtactggggaatctgggtgaagagaatgcagggattctttatactatttttgccacttttctgttagcttgaaattatttcaaaataaacactttggccaaattagcaggtaagaaaacattattagagtggttttcctttgagttcattcatgtgttcaataaagttgaacacatggatgttaatgaaccattcggattatatggttcatattttttgctcatttttatgtcatggtgtttttccgtgttgatatgtaaaagctatttttaaacccttcatctgccgtatatgttacatttctttcctgatttctgccaccttctaatgttgttaccaactttcttttccaaccttgggccactggcatatacactcatttctaaatatcagaacttgtagtgttctttgaaatgcaaacagcctatggttcattttgcaactgcatattagttaacaggcaaaaataccttagtaagagaaagtgtcttttccttctaatgaaaaa

SEQ ID NO: 209353 - DNA, 518 bp, Homo sapiens
ctctttctcttagtccttgcatctaaactaaacatcgggctctatccacctagctaaattttagttgagtattatgtaatttagatttaaaaactatgtgaagagcaagactacttagtatttatgcaaaatatccaggtagttatattattttcatctttggcatactaactatggcatactactattcaatttaattctacagaattttaaatgtctagtatttcattaattggctttgtgattgctgaaaaaagacctagactgttttctgagtgctatcctgatttttctgattaactacattgcttgtacagtgactgacattcaaagctgatttgactggctccttaagtttctctgttttgagcttctgggattacaaaactcaatcatatgcagatagtttgccattcatactgacagttctgccaggtcagatggtgcaattatcgtgcatgctgccaagatcattgttattgctaggtgtttggttttcttcttttcaccccttcttc

SEQ ID NO: 209354 - DNA, 115 bp, Homo sapiens
cattgccatgctattggtctttcattacttttaggaaggaagtattactttgaattgcatcctgtgctgtgcaagggttgttggcccaaggacttccaggaacactctgtggccc

SEQ ID NO: 209355 - DNA, 182 bp, Homo sapiens
tttttttcatagtaaatgtatttaatttttgtgaagtccagtttatcaatttattcagtttaccagtttttttcttatgtttttggagtcctatctctgaccccaaatcacaaagattttctttgctttcttttatagtttgtttctttgttttccccagagacagagtgacactctgtctc

SEQ ID NO: 209356 - DNA, 565 bp, Homo sapiens
ttatgcagggagggtggaaaagaaagaatgcttaaacactgaaaaggggattccagttcattaactatagggctctcatggactgcacagattttgtgacagtatagtaaagaaaaatagttataaagactcctcctgttcagtgataaaattcctaaatattgaaaagagttttgcaactgtggatgaatggccattgctgaataaagctaagtgatgacgtgccagctcccttcatctgctgtgaatgtttttaaagggaagtggcagacttagtatgtgtattttttaaagcataatagatgattcaaaatctgatcatgttttctatagtcaatatccatagctactaaagcattatcatattttaatgttccttattaataacaatcagaacttaacctcaaaatccattgtttattgattatttacatgttcaataatgctttcttgaatagctacacaatcaccacaccgtgctaggcactgtttatgcaaaagtgaattaagtaagttttgtgtccccaacaggttgctctatctagtcaaggatataaatatgtga

SEQ ID NO: 209357 - DNA, 324 bp, Homo sapiens
acccccaaagtggagttcttccaaggcacctgcccccaggtggacagtatgagcactatgacagggaaggacggagatccaacgccgcgaatgagcgcagccaagctgctgctcctgagatagcgttcaacaggaagctgtgtttccacacttctccatgagcccagtgaatatggccccaaaacaggcaaatttaatttttttttttttagacaaggtctcactctgtctcccaggctgtgagtgcagtggtgtgatcacagctcactacagcctcgacctcctgggctcaagcaatcctcccacctcggcctcccaagtttc

SEQ ID NO: 209358 - DNA, 623 bp, Homo sapiens
acctgggggagaaatgtgagtttcaggagtttggttgacttctccagggggcggaacattggggcctcaccctgtgtgatccagggaggacactggaatcaggcagatctgggtttggatcctgcttgtatcattttcaactgtgcaaaggagtcaccccatctctctgggcctcaggctcctcatctgcagaatgggggcactaccatagcttccgagggggctgccaggactatctggtgagagggtgcatgtgaagtgcccatctgggcgacgggcacaaagccaggactcatggcagctgctccccctccagctctgtggattctgggcggctgaccccacagtcagctgggggatgacctttgagcttgcagactaatggggattcctcagactccaaacccctatcatttcctacccaagtttgccccagtgccctagacgggggatccctgatggacagactgtggtagcctcatctcttccctgggtctcaagccctcgcagagccaagccagcaagaggtgctggatgagtatttacagaacaaaggatgctggtgacaaccatgtggtaggagccactgcagcttctccttgtacagcaccccggaagttcca

SEQ ID NO: 209359 - DNA, 280 bp, Homo sapiens
tactgatactatgggtgtgatccagtcttactccaaaaaataggtattaagggctgggcacagtggctcatacctgtaatcccagcactaagggaagccaaggtgtaaggattgcttgagcccaggagttcaagatcagcctgggcaacgtggcgagaccccatctctatttaattaaaaaataataaggtatatgacctaccacgcctggggtccctggggctttagcctttacagttacctcagcctggaaagctttttcacagagttctcttcccta

SEQ ID NO: 209360 - DNA, 770 bp, Homo sapiens
cactcctcccacctttcattaaatagaattttccttatctttggtacatgtggtatttcctcataattagattcaagctgtacgttctggccagaatatcacagaagtgatgtgtctttctcagggcatcccatctggaaatacgtcatgtccatctgcccccctattcgtgatgctaattttgattatttggtcaagatattttctgatattatcactctgcagttaattttatatagttactattttttccccacgcaattaataagcaagtgctggagagacattttaagattctgtaaatatcctgctgcacatgaaaagtttccccctagattgagcgtctgctgatgattcttgtgtgatccagcatttactatgttggttgtaaaacaatgcttttctgactccagtattctctccacattcgtaagttggctctcagcattctactgtaaagaaggaccctcctttctccccaggaaggtgtttttgtttttttaaatgaaggagaccgtggaaactcgccagatgacctgtagctcctggagcttggcaaaggctgggcaaacgcccacctgaagactatgcaggcaatcaggacatgacacagagccgggagaggcctgctcttcggctctgccctgaacctcattcggcaggtggaggtatttaggcatttgagggaatctcagctttgggaggccactttgtaagtgatcttaagagattaagtacatccttaattaaaagaaatggtaacacctccg

SEQ ID NO: 209361 - DNA, 465 bp, Homo sapiens
ccattttcccaacagcatgtgctcagttcgtgtctgtcacattttgataattctcacaatgtttcaagctttttcattattacatcacagtgagctttgatgtgacgatcgtcattgttctggggcatcacaaatgcgctcatagaaggtggtgaacttaactgaaaaatgctgtgtgtgttctgactgctccatccgtcagctataccctcatctctctccctctcgtcagaccgccctattccctgagacataacactgttaaaattaggccaaataataaccctacagtggcctccaaatgttcaaatgcaaggaaaacatgcacatctctcactttaaatcaaaagctagaaattattatgcttagtgaggaaggtatgtcaaaagccaaaataagccaaaagctataggtgcctcttgcaccaaacagccaacttgtgaatgcaaaggaaaagttcttga

SEQ ID NO: 209362 - DNA, 350 bp, Homo sapiens
ataacagagagaaaagattgaaaatgaaaatggccagagcctctagggcctgtagataatataataacaagattcaaaaaatctagtagtggtgtcattggcatctatgaagtaaagggaaaaactgattggtgaagaaaaatatttgaagatatagtggatgaaaaacttcctccaagttcagtgaaaaatataaatttacagaaaaaattcaagaagttcagaaaaatagtttaaacccaaacaagacttaagggaaattataacaaagggaaacttgtaaccttaagaatgaggataaagcaaaagaaatgcttgggtatctgaataaatataatttaatgtttttc

SEQ ID NO: 209363 - DNA, 349 bp, Homo sapiens
aactacagaaagcgtgacttgtaaaattgtagacccagaaaaattagggaacaatctcataatactaatgaaaccttttttcccataaaataaatacataattagatatagaagattttttttttggtttaagctatcttttcctatttctatcttaaataatttacaactctcctttaatccaggcaattatcaattctataataaaataacaacaatgggtactgtgtattaaactctaaactagggtccttcatctcatttgaattttgaaatgactccataatatattgttatactcatgctgtagttatagataaagaacgagggctgacctttgacaatcaca

SEQ ID NO: 209364 - DNA, 494 bp, Homo sapiens
tattgcttatcttttaaaatgtgtgtctcctttccccatctaaccaactcaaaggcaggaactctgttgtctctattttaggcttccacagtatctggtgcaatactggtattttaatacttagtacttatcttaggtgtcaattaaatgcgtgttgtttgtatttattgatttcacatggaattaaaaacaggaaatgggccgggtgcagtggctcacgcctgtaatcccagcatgtttggaggctgaggcgggtggatcacctgaggtcaggagttccagaccagcctggccaacatggcgaaaccctgtctctactaaaaatacaaaacttagccgggtgtggcggcatgtgcttataatcccagctacatgggaggccgaggcaggagaatcgcttgaatctgggaggcggaggttgcagtgagccgagattgcaccactgcactcagcctgggtgacagagcgagactctgtctcaaacaaaacaaaac

SEQ ID NO: 209365 - DNA, 354 bp, Homo sapiens
ttttttattatgtgtatttctatgtaaccgatcattcacttgttctctagtcagtaattccatttaattatgaaaagcttgtatatgtgaaagttactgtgcaatagcagttgtcattgatttagttttgttttctggtaaggtataatgtgatagaagtagtagtgtagtgtaggatagagttttacatattggcagatttcactagtttttttttctattgccattcaggcaccaaagccatgtggatgaatatagctgacttgatatcagtaagatcattttgtgtgacacctgcccttttgtttacattggataggttattaaaaagtttcagcatgtaagctcttgtgg

SEQ ID NO: 209366 - DNA, 587 bp, Homo sapiens
gtttcttgtgaaagatcatataataggtctctgagtgagaatttgaactctggtcttcatgactaaagatttgtgcaagctgcccttcatggcattttccttaatataacatttttatttttttgagatggagtttcgctcttgttgcccaggctagagtgcaatagtgtgatctcggctcaccacaacctccatctcctgggttcaagtgattctcctacctcagcctcccgggtagctggtattataggcatgcgccaccacgcctggctaattttgtatttttagtagagacggattttctccatgttgatcaggctgctctcaaactcccgacctcaggtgatctgcccaccttggcctcccaaagtgctgggattccaggtgtgagccactgcgcctggccgataacttcatttttaagtgaaccactttttttcttttaatattttattatggaaatcttcaaacatatataaaaacgaagagaaaagtataactgagcttccatacacctataacctgacttcaaaggttatcaatgcttggctagctttctttaatctatattccgtctgctcccggca

SEQ ID NO: 209367 - DNA, 533 bp, Homo sapiens
agttgcttaacccacactgatgtggcctgttgtacttttgtatgttgttattctcattgaagaaaatttaccttaccctttgcattttattttctctcgtgtataaatattatgtctcttgcatatgatgaatgaatgtttcagaaaggtcactcagttttttcatattgatatgtctgccttttttgagaaagtacaagtgtaacttatgaacttattactcattgtggtgctaacactagcagttgagttagcttttaggtacaaaaagcatatagtaaagacaaataagtcttactttgtgctttgtgtgtgtatgtgtacatgctacaaataagacactgcatctacttaaaatttattttacataacatcttagaactctttaaaaatggtatttttaaagctgcagtgaaatggataactttatgcagtaattaaaatatttatgttaattattttatccgtgacttaagacaatattcaaaatatatttaaaaagattcaatgtttgctgtgtataatgtagatca

SEQ ID NO: 209368 - DNA, 479 bp, Homo sapiens
  misc_feature (451)..(452): n is a, c, g, or t
  misc_feature (454)..(454): n is a, c, g, or t
  misc_feature (458)..(458): n is a, c, g, or t
  misc_feature (466)..(466): n is a, c, g, or t
gattacagatgcatgtgccgctcccggctaatttttgtgttttaagtacagacagggtttcaccacgttgatcaggctggtcttgaactgctgaccttgtgatccgcccacctcagcctcccaaagtgctgggattacaggcgtgagccaccacgcccagcctctcccagcttttctagtcaaccctaatggtgccatgccactggatttaattttaaaaatacaatgttacatcattctctgttaggtgaaccaggagttcttggccagagcagctggagggatgtagctgccgtgaacagacacagaaaatgtggaaggggcaggtttggggtgtcattaaccaggaagttggttttcagtatgttaaatttgagatgcctgtcagacatccaaacagaaatgtcaagtgagttgatcttttttagagtttggcattcaagggagcggnncntgcnttggggancctgagctctaat

SEQ ID NO: 209369 - DNA, 393 bp, Homo sapiens
agtctcctggtactgatgggcacaggcccactccacgtgatcggctcaaaatactaaggatccacgaacaggccttgcagctttctcccaaaccatactcctttctctgggagctgcctgccaagaaggctgcgcatggaaaccttaaaccttgctgtaagccctggccacatcaatggtgcaaaagtagcccctatcaggacctgtcaaggggaaacctgagctgcaagagtaactggagactcaggcagctgacctgcttacgatcccttagttgagagtttaaaccaactgtaactgggcagtacttgacaaccagcttccctaatgagaccaagagttaggagagctgacacacagcaccctcaggtcaggggtgggggagggagtatg

SEQ ID NO: 209370 - DNA, 411 bp, Homo sapiens
agccatcctagaagtatatagcaagtgaaaatgtccttgaaaaatgagttaacacaaagacattttcggataaaagacacttctggccttctgatgactacgagtttcataatataattgccaagccagatcacctaaacactaaacaaacaatactcacgcaaatgaagcttccaattattaacatgctctggaaaataagagtaattattgaatccagaaactagatcaggatattagaaacagaaaagggaacatttggaaaacaaaaagagtcctttgaaattaaaatatatgcaagatgaaagaacattaaaaaagaaaatataacacaaatgaaaaattcaatagaagagttaaaagatagaaattaaagttaccttttaggtattagtataaactgacaaatgg

SEQ ID NO: 209371 - DNA, 659 bp, Homo sapiens
ggataccgggtcggggtgaaggcaagcagcagcacccccagcatggggaagaaggcctgaggctgtctctggccactgcatctctaggccttctcttggagcgggaggtggctgggtttccagggaattttgtgtgagtaaaattttcccatgtcattggagagttaggaagagctcctcttttggggcctttttccaagcgggtccccctcaccccgctacaggcttcttgtcactcaggcttcaataaaggccattctgggggctgcttgctgtaacctagaagacagaattgcctaggatcattagtagagtcattttttttttttcctactctacaggccaattaatttgaaacaagcttctatggtcttttaactgttagcatcaccactgttgtaacaggaccataaacccagtctgccccactctagtcccatgtttttaataactgttggctcttttttaggggtttgggtggggggattcctacctcagtgatccctgctgagcctggctgttgtctgtggtccagaaggttcctttacctgactcactcctctcagatcatgtccaaataccaggagactgacccaggtcctcaccaggtgagtagaggtctggctctgagcgacattaaggaaaagacacagacagag

SEQ ID NO: 209372 - DNA, 418 bp, Homo sapiens
aaatcttaaactaactcaaactcctagtctgcaaattgtattttatcaccataggttaccatctacaaaagaaacagctttcacgctaagtagaaagtatattaatcaaaaagagaaaatcagctttatatcaaaacctagattattagctatatttctattctagtaaagcatgagattagaaggcacaggccaggcacagtggctcagggccaggcgcagcagctcacacctgtaataccagcactttgggaggccaaggcgagtggatcatctgaggtcaggacttcaagaccagcctcgccaacagggtgaaactccgtctctactaaatatacaaaaattagctgggtgtggtggcacacgcctgtagtcccagctactcaggaggctgaggcaggagaattgcttgaaccca

SEQ ID NO: 209373 - DNA, 706 bp, Homo sapiens
gttttttttttataagcatagggtggggtgggacagggccatgggtggtttaggaaaaggcaacattcgagtggaaaaacagggatatgagttctcactttggactgtggtttcaggctttttggcttgaggatggggttttgccagggacctacccttttctgcctagaatttctctgcccccctgtccctgtcactgtgttgcccagggtggtctcaaattcctcggttcaagcagtcctcctgcatgagcctcccaagtagctgggattacagacatgcaccaccacacccagcaagatgcttattttaggtaatagtctgatggtagccactgatctgatagtatatttgcaacagttacagatgtcatttctttcctgaggacttctccactgaactcttgatgtagtaaaagaatgtatacacaatactgtgaaacttgctttccctaaacggcaattatcggttaaaagaatcccctcgagtaatgaacccagtatgcaaatttctgtaatattatgttgatgttaaagtgatgaaaatgttaagactagaaactgtgttaatctgagtaattaaatgtgtgtctatttcaaaagttatttctcattgaaagcaaaatttattgaactgataagttatgaaatagtgtcattttcatgttaataatggcatattaatgttgtcctgaaattatgtcagt

SEQ ID NO: 209374 - DNA, 386 bp, Homo sapiens
ccaatcaacatccaaccatcaaacaatctagacaactttagtttggctgcagcaagtaaaggcagattgtttgatggagggacgtgtgggattgatggagtttttcctttttatatgtttttgtatttttcaatggaatacattagaaagtgttgcatgtttatgggggggatttagttcagtgtgtgttaaggagctagaagaagtgaagaaatgggagaggggaatctagacaactttagtttggctgcagcaagtaaaggcagattgtttgatggagggacgtgtgggattgatggagtttttcctttttatatgtttttgtatttttcaatggaatacattagaaagtgttgcatgtttatgggggggatttagttcagtgg

SEQ ID NO: 209375 - DNA, 177 bp, Homo sapiens
cttcattgtttgaccaacaaaaccttgcccctttgttttaaatgaaaaccgtgacaggagaggcacacgccatagagatcattgcaacgcatgctgcctgcttttcacttttttctgcatctccccttcctgaattgttgagcatgtcccaccctcccgggacatccttcagtcccc

SEQ ID NO: 209376 - DNA, 222 bp, Homo sapiens
  misc_feature (157)..(157): n is a, c, g, or t
ttttttccccataggcctcaatgggctccgaaatgtccctttgcagattcaccaaaaagagtacttccaaccagctgaatcaaaagcaaggattaactctgtgagatgaatttagatgacccataggcctttgggctccctgtcccataacagattntccagagtgtttccaactggctgcccttctgtccgtcttctcgcagccgtgcgcgcggccgcgtt

SEQ ID NO: 209377 - DNA, 349 bp, Homo sapiens
catgcaaatttccattctactgtcattgtccccttcattggccttccatgaatactaagggtggtagttcataggtgccactgtggtacaatgaacaggggtgggaccctcagccaggcccaggcaagtacttgtatggtccttcttcctgacactcaggatggataggtctcctccaagaatcttggggcagagatgctcaggattctctggtggcttcaaaaccaaccaactgcactttggtggaacagaattttcttcccactctgcctagatccctacaactgagaacagagagcagaggagcctgggtcaggctcctggatcactttgtcttgctgtcttgctt

SEQ ID NO: 209378 - DNA, 180 bp, Homo sapiens
tgaaatttatcttgaggaaaccatcgaagagttttaagtaagggaatgatgaaatcagattcccatttgtaattctactctgcagctttgtagaaatggactcaagagaagccagtgtgtgtggccaggagaccgtgtggaagattctcaccttatcaggtgagggtgatggttggtcta

SEQ ID NO: 209379 - DNA, 666 bp, Homo sapiens
gcgcctgtagtcccagctacttgggaggctgaggcaggagaatggcgtgaacccgggaggcggagcttgcagtgagccgagatcacgccgctgcactccagcctgggcagcagagcgagagtctgtctcgaaaataaataaataagtaaataaataaataaataaataaatgtaaataaataaatagattaaaatggaaaactaaaaaaaagtaaaataattaaaaaaataaataaataaacgtagccggccagtcacgatggctcacgcctgtcaccccagcactttgggaggccggggcgggcagatccactggggtcgccagttcgagaccagcctgacccacatggagaaatgccgtctctactaacaatacaaaatcagctgggtgtggtggctcctccctgtaatcccagctactcaggaggctgaggcaggagaatcgcttgaacgcgggaggtggaggttgcggtgagccgagatggtgccactgcactccagcgtgggcaccaagagtgaaactccgtccgaagggaaaaaaaaaaattaattaagtgctgtattctgttatttttgcttcctaccctgagaagaacataatacagctgttgtctttctgcctgcctgcctgcctgcctgcctgtggcagggcctcattctgtcttt

SEQ ID NO: 209380 - DNA, 511 bp, Homo sapiens
gtcaggaggtgataggtgataagtctagattaaggagagtgtcaaagatttagccctgaggcacttcaacatttagacttcaggagaagcccattagatgcaaaggaaacctatagagagtagtgtccctgaagaaaacaaaggagggagggagcgaccaagtctatcaaacattgatgggagagtgagtaggatggccccagatctgttgactttggcaagtgtgaattcagacaatggtggcaacaaaagcatgattgtagtggtttgagagctgacagaactacaggagcaccttgctcaagctcccatattaagtggtagagttagaagtgaaccaaagtcttgattgtggtgatagtttactgggtttatgcaggtcaaaacttatttaagtgatactttgcagtttattttgggtgccattttattttgtgtacagtttattgtatgtcaattatatctcagtaaagctgttaccaaaaaaaataaatgaaccgaagctccactg

SEQ ID NO: 209381 - DNA, 306 bp, Homo sapiens
atttacatagctggattgagaaagaataatacaaagtaagcatgtgacaccaaggttggaaaaaaaatgtgtttttgaatgtttgatgaggattcaaacatgttttaaatgagaaaatcggtaggaggttgaggattgtagtagaagtaccagatgctttttcttttagctgttttttttcgttgctgttgtttggttggttttggttttggtttttttttttttttttttggctgttattgttttaaaagtaaggactaggccgggtgcagtggctcacgcctgtaatcccagcactttgagagg

SEQ ID NO: 209382 - DNA, 546 bp, Homo sapiens
tgtgaaagcatggcgcatgggggattcacaagtagtgagaatgcctagattataggttcacctaggggcagatagcaagggtgagagctccaaggagctgacttgtcttacgaagatttgaattgcaacctaaaggcaaaatgtagtcacagaggcattttatgtagaagtcacataataagttatgtatcttagatcattctggcaccagagagtaagatagattcgaatagataggttacatgtaggaaaaaaggtattttccctgctctcacacagctactcaacacttctgactccagatgtgtggggattttcccacaaacatcaagcagttctgctatgtacaccatctgggtgtccgctaattcaattctgttgacactatctacctggagatagcatcagatcccataggttgaggacttagtcttacaaaactgtcccccacttcagatgccaatcacaagccccaggttgcagtctgtacttctgacaactataaatcagagttcccacaacccctcctaaatcattctattaatt

SEQ ID NO: 209383 - DNA, 389 bp, Homo sapiens
aggtcaccagggtcccttccctggctcgggtgggggtggggggcgcaacccctcacggctcctccccaccaagccgtcgggaccccagcgggggcgcctcgcgttgggcgacagggacgcggggagagagcgacaagctggaagcaagggctgcctgcaaaactttcggtcctccagcggcaactctgcgggaaagaccacccttccttcggccccgcgtcgggcctatccccgtgtgccccgacccctgcgccccaggcttgggcggcgccgctgcatcccggctgccgggcgcgctgcagccttcgctctcccgcacgcggcgctcgcccgtccgcgctgcccctccccggcaggcgggcggccccggcgggcgggcgggcgcggac

SEQ ID NO: 209384 - DNA, 413 bp, Homo sapiens
ttgctcaagacgctggggttagacgtgctccggctacacagcggagtgtcagggggccaagaatatccctctcctttttcttccctcctgctggctttggttgctttcctaaacattgccccggacggcaaagtcggcttcactcttagcccttgttagggaaacgctggatccaagattagctgcgcccttctttgcttcagttgaacaagcaccagagtcgctgatttggcagtgtcggagcgggaggaactggtcttaaaaaggtacctcctgaactcgggaagactgctaaccctccagattattgttttgcatctgtgtgctgttcatgaacatacctcagagctgctcactgcaacttgaaatttcattatatttttaatcacaaagtttgcatcctacccttgata

SEQ ID NO: 209385 - DNA, 535 bp, Homo sapiens
cattgtgattaaaaagataatcagcttgatttttgataaccaaagagttaccagggatatctgaaaaaaaaagaaattcccaactatgaattcacacatgttattttctaatttagattttcacaccaaataatatgtaataagtaaacacgtattttccatattatttctattctattcttctggtgcagtttttcttagaagtgaggttttgtcatgaattggtgctaccataagtagaattttaaaattgactgtcttccaaaacaaaaataaaaaagacagtaaggtaatttttaaaaaactgtttccttagttcacagtgatataatatttatgctgagattgttttaaatgaactctgtgatagaattgttgatttattaatatttggatttgggttgatgttccttttacatttgctgtaggaaatacccacgacatgaggtttgtaagcttttgtgtttttctctattctaaccactctgcttgaaatataatttgaagatgctagtaaaaaatataacaaattccc

SEQ ID NO: 209386 - DNA, 251 bp, Homo sapiens
ttccatagcggattttatacattgacctctgtggttatcaaaaagagcagtccaacgacgtgtcacacaatgagctggtctgatgggagaagatgcgcgcagtcttcgtcccatcaggatcggtatttccattgcccagctgcccaactccaaacctgctgtcctttaacccaattcaaatgccacttctccatatggtggaaggggaatgtggtgaatctggctgatgggacgcaagatgggtaccgaac

SEQ ID NO: 209387 - DNA, 329 bp, Homo sapiens
caggatcggtatttccattgcccagctgcccaactccaaacctgctgtcctttaacccaattcaaatgccacttctccatatggtggaaggggaatgtggtgaatctggctgcccaggtgagtatttctcccagcctcagcactcaggtgcatgccttttgagagcttgttctgcgcaagaaggatggcctttgcagataagggaaggcactttactagctaggcccagggatcatgccctcactgctagactgcctcagttacagcttccagatttcttgatgtggaattcttgctcgcctggggctatgagaatcagggcccattcc

SEQ ID NO: 209388 - DNA, 404 bp, Homo sapiens
tagcccctacaaactccacaaatttaatcgtaccttaataccctacttgtatcatggtaattcctcagatcaaaaacctcctataagagtaactatttcctaagtaaaaggcaatcagttcagcttttcacaatctggcccttcttggatttcttggtctcttattggcaggcctcccttctgctccaacaggtgtgcgcatcactcaggccacacatcatgcccctatgtccttacacccagtgatgctctcctatcatcatcaaagtctcccttatcatgtcggccctgcctgacacgtttctcttgattctcccttaccctactcacatgtcaatataccccatcttccaggactgaatccactaacagaactctgtaaggaatagccaggcatggtggtg

SEQ ID NO: 209389 - DNA, 208 bp, Homo sapiens
gcgcccggccctcttacacatcttttttaacaattggtgtttatttagaattttacattgtgttgtgaaataccttattcctatttcaatatgcctttttactgttcttcataattttgatattatctgttgacatgttatggtagcttgaggcctaaactgttaaaggcctcagtctcccttccctacttccttacaggtgttacaa

SEQ ID NO: 209390 - DNA, 753 bp, Homo sapiens
agtgtttatttattgttcatagtcatctcttacccagggaattccttattttgtattcctgaaatcgaaatattctttcatactcattatttagatgctaagagaaaacttggggaccgctcttcccaacaagattgtctcaaattttgtgcccatctgtgtgcattcacgcacatgagcatgtgtgtggaggagaagaggaaaagaacagagatggaaaagattttgaagtgggatgcttggcaagaggagtaaatagatgataattatgaagaagaaattggcaggatttcttaactgactagattatgggaacaaggagtagagaaacaggtcaaagttggctgaagtccatagaatgtatattttaatttaagtgctaaatttcctccatacatttttcatgaactttgaaaaatttgttggctttatacgaacctgtgaacttcagtgagaaaaacagcatctttatatttttgagcatagtctcaatgtcattaattcttctgcttaaaaatcctcaaatgacttgccaaattaggataaaatctaaattctgttaccaaggccccaaatttctacgtatctgactgcaactgcctacttaaactgatcttaccattattcccattcatataccacccacataggctttatatctgctcttacttaagagtttttatacttcctggtccctcatcctggttgttcctccccagtactcagcttattcagttatcagctcttccatac

SEQ ID NO: 209391 - DNA, 396 bp, Homo sapiens
  misc_feature (324)..(324): n is a, c, g, or t
  misc_feature (339)..(339): n is a, c, g, or t
  misc_feature (361)..(361): n is a, c, g, or t
  misc_feature (377)..(379): n is a, c, g, or t
  misc_feature (382)..(383): n is a, c, g, or t
  misc_feature (385)..(385): n is a, c, g, or t
  misc_feature (390)..(390): n is a, c, g, or t
  misc_feature (394)..(395): n is a, c, g, or t
cagacaatctctgtccccaggaaagctcattccagtgctccagggccacaggccacctctgctccctgtcccctctcttcccagaacccagcagtttggcttgtagcccctcgccatctgagacagttcccagaacccaggttctcagggactcagcagttggagttgagcccagcctcttctctcaggaatgcaggaccctaaggcttgggaactgaggtatcttcgcccccaggaatccagctccttcccctgccagaagcccagatcccagcccctgacctcccgggtctctcgccctcattctcctgctacctccggctncagtggagatatcancatgggggtaccgagctccganttcggaatcatgggtnnnagnngnttccngtgnna

SEQ ID NO: 209392 - DNA, 379 bp, Homo sapiens
  misc_feature (6)..(6): n is a, c, g, or t
  misc_feature (20)..(20): n is a, c, g, or t
  misc_feature (33)..(33): n is a, c, g, or t
  misc_feature (35)..(35): n is a, c, g, or t
  misc_feature (41)..(41): n is a, c, g, or t
  misc_feature (46)..(46): n is a, c, g, or t
  misc_feature (66)..(66): n is a, c, g, or t
  misc_feature (71)..(71): n is a, c, g, or t
  misc_feature (307)..(307): n is a, c, g, or t
  misc_feature (322)..(322): n is a, c, g, or t
  misc_feature (344)..(344): n is a, c, g, or t
  misc_feature (360)..(362): n is a, c, g, or t
  misc_feature (365)..(366): n is a, c, g, or t
  misc_feature (368)..(368): n is a, c, g, or t
  misc_feature (373)..(373): n is a, c, g, or t
  misc_feature (377)..(378): n is a, c, g, or t
aaaacnactggccatttgcnaagctttgcattntnttgcanggtcngactcctagaggatcccccnttgantgatatctccactggaggcccctcgccatctgagacagttcccagaacccaggttctcagggactcagcagttggagttgagcccagcctcttctctcaggaatgcaggaccctaaggcttgggaactgaggtatcttcgcccccaggaatccagctccttcccctgccagaagcccagatcccagcccctgacctcccgggtctctcgccctcattctcctgctacctccggctncagtggagatatcancatgggggtaccgagctccganttcggaatcatgggtnnnagnngnttccngtgnna

SEQ ID NO: 209393 - DNA, 203 bp, Homo sapiens
cacaccacctgagtccagctcaggcctaacacaggaaccccaggattaatgggtaggatgaaatggcagagccaccgcacccagcctcagtaggtctcttgaactgtatttaattttaactttttgttttgaaatagtttcagatttgcaaaaaagttgcaacagcagtgctaacaattcttgagcgccctttacccagattt

SEQ ID NO: 209394 - DNA, 465 bp, Homo sapiens
taatttataaaagaaaaaaatgataaatttataaaatggacttcatgaaaacttaaaaacttctcctctttgaaatatattcttcatgaggtcaggagatcgagaccatcctggttaacacggtgaaaccccgtctctactaaaaatacaaaaaattagccggtcgcggtggcgggcgcctgtagtcccagttacccgggaggctgaggcaggagaatggcatgaacccgggaggaggagcttccagtgagccgagatcgcgccactgcactccggcctgggcgaaacagcgagactccgtctcaaaaaaaaaaaaaaaagaaaagaaaagaaaagaaatatattcttgggaaactgaatatacaagccacaaaatgtgagaaaatatttgcaaagcacatatttaaaacaagtaagtatatataaagaattaccgaaactccataataattaaacagacaactc

SEQ ID NO: 209395 - DNA, 275 bp, Homo sapiens
gcaagaggaagagctgtgcctcagtgtcccatttgtaaatagctagtggagcctgtgttcgtgtgtgtgcatgtgcgtgtgtttgtgtgtggtggcattggtagtggcggtggtagttgtttgaattcagagggtttttgtttgtttgttttgagacggaatctcgctctgtcacccaggctggagtgcagtggtacaatctcagctcacgacaacctccacctcctgattcaagcgattctgcctcagcctcctgagtatctgggattacaagt

SEQ ID NO: 209396 - DNA, 831 bp, Homo sapiens
tgaatatatatgtgtgtatgtacatacaaacacatgcacagcctcagtatctatgttgaaatctggttttgtctttaacacacagacttttcctagcattttgcgggcactttccctttcttcattctgtattgttctgatgaactgtcagtgacacatgctccaagtaagacaaccagattcattctctgtattttgattagagacacagggacaggaacagggccaatattcagctttatgaaccagtatggccagaatggatgttttgttttagtcaatattcattttgattggtgggacctttattatacctgctgtgaagtatgtgggatatgactcctaggctggaattcgtttgaattaagtcatcctttggcagcaacctaaggattcctccacctgtcactgagatccattgagatgattcctgctttctcacatcttggttttgagttaaattctttgagtctgtgaactacctggtattctaatatttctcattttaagtcagagtcaaatactttggttctcaagcaaagagagctagccaatgcagaaatttatactacagaatgattactagactgtagagaagcagagtattcaagatggatgtccagtgagacagatcaaagcacagatgaattcctaatcctattttgtgctgtgaaaggatattcatgatatagcaggatcctaagcccattgtgcactagggtctggatagctcctaccaaaaacaaaggtattgaggaatactacttccaaaagtatatatgatacctgtttataatgaaattgggtaattaaaatttcaaggctacttga

SEQ ID NO: 209397 - DNA, 161 bp, Homo sapiens
tctccttccacagaatgctcccttcaggttaacagcccttttgcccacttaacgaaacattcctagacatggtgttatagttgagacacttgttcccacaaacctcatgctgagatttgatccccaatactggaggtggggcctggtgggaggtgtttggg

SEQ ID NO: 209398 - DNA, 389 bp, Homo sapiens
aaatgtctcctgacggcgacaaaatcactgccataaaactactggtttcaagaaagagaacaacaaattcaaattcctaaacctcctataaaagcacagactgaaaaccagagactttccaagaacacattcaaggagtctctttgtttgcagctgaagggctgagagggccctttaaaagactttaaaagcttaattccgtgagttgccgaattagggtgttaacttaattcataagctcaccaggtctcttatgtgaaaataggacctagagaattttttttttgagacagagtttcgctcctgtcgcccaagctggagtgcaatggtgcgatctcggctcactgcaacctcagcctcccaggttcaagcaattctcctgcctcagc

SEQ ID NO: 209399 - DNA, 180 bp, Homo sapiens
atacatacacacacgcacacacactggcacacccacaagcacacggcctatgggggtgacactgccaggccccactcgaagctccaggtactgccagcaccacactcctccctctgccattcccacaagcccacaacctcacaacctcacaacccacaagcccacaagcccactcctccc

SEQ ID NO: 209400 - DNA, 269 bp, Homo sapiens
caggactggaaaactgcgattataatccaccccttattaccctgaaggatagatacaaggaataaggcttcagagcctcccaaacaaacagacaaacaaaaaactctgggctatgctttatttacctttctagatgtatatattgtaccaagaagaaatatttacatggaatcaggaagcacacaaaagccagctgtgagtgaaatactaaatactatgtataagatatattaggtcctcttagatattagaaagatgatagcccatct

SEQ ID NO: 209401 - DNA, 167 bp, Homo sapiens
acacccattctatgagtccatgggataatgccagcattacctacacaggactttcccttggagctgcattctctagtccaaaaacaggcttagggcttgggcccggagctcaggcctgggatccaggggctgagatgatggggctggtgggtgctatcagggggagg

SEQ ID NO: 209402 - DNA, 472 bp, Homo sapiens
tcactctctcttgcccttctgcttttctgccatgtgaagacacagagttcattctctcttgttcttctaccttctgccatgtgaggacgcaatcagaagacttgaacacttttggaactatgagagaataaatttccgttctttatacattatccagtctcagatgttctgttacagcatcacacaacagactaagacaggttgccataacaaagaaccacagattgggtagctgaaacaacagaaatttattttctcacagttctgggggctagaagtctgagatcaaggtgttgagagggctgattccttttgggagccatgagaaaaggatctgttctaggttctgttctctccccttggcctatagatggctgtctccacatcatctttcctctgtatgtgtctatatctgaattttctcttatgaggacaccagtcatagaggattagcatccaccctaagacctca

SEQ ID NO: 209403 - DNA, 446 bp, Homo sapiens
aaggccttccaccttccagacccaacttaggctttattccaccacctggccctccatccgggcttcctaggctctggccagtcctgctcctccctccagagccatgaccagtcgccggcccaggacagaccgggtgcaactgaggaccctcccggtggtcacctgatcgtactgggggtatcagccggacaccccgcctccagaacccgctgcctctgtccagagcggcccagccccagcaggctggcagctcggtgcaaacaacgggatgcagcgggcgggatgcgagccccacgatccctgggtcggaagccaagggcttaagcccccacgttctttctggctcgcggcgggcacttcgtgcgccccaccttccccgcagttctgagagaggcggtagcagggttcagatggagggaaggacagggcgcggaaaggggagggga

SEQ ID NO: 209404 - DNA, 148 bp, Homo sapiens
tctaggcattcatatgtacaattatttaagtgctgtagatgtagttggtcagagaactgaactaatttttcactagccacaagacatatctcagaaattgcctgcagaaaaaaattcttggttaagttgtttacttggacgaaatgag

SEQ ID NO: 209405 - DNA, 300 bp, Homo sapiens
tggtaggtccctgtgtgccgtcattcatcagagtttggatatacctagataagtaagggcctgccagtaagctttagcttcttgcagagtgtgattacattgtgcaggacaggagaatacacagctgtagacagctatatagcaggcaatgtgggagcttcagttaagtgtgccgtcattcatcagggtttggatatacctagataagtaagggcctgccagtaagctttagcttcttgcagagtgtgattacattgtgcaggacaggagaatacacagctgtagacagccatttaggta

SEQ ID NO: 209406 - DNA, 376 bp, Homo sapiens
tttattgagggtaattgatatataaaataccgcacatatataacagtttgtaatgtatacatttaatgtatacagtttgaacatgtgcatataccatgaaactaacaccacaaatgtctacaactctagcatggtaaattcttatctttcgaagaatattagaattttctcttttagctatactgtgtgactcataaataagcatcatccttgtggaatgtagaaatgtgtttgcttatggatccaaagctagtaaaatttgtttttttttaattgatacctttagtaactcttagtatttatacttttatttaatcgggaagtaggaatatgtgtaaagatactgattttactgaaaatagggaaatgtgaataa

SEQ ID NO: 209407 - DNA, 447 bp, Homo sapiens
ggatatgcttcccacctacacacccaacatagagtcttgtggctggtcaggcacagtggctcacctgtaatcccagtactttgggaggccaaagcaggaggactgcttgaggcaagagtttgagaccagcttaggcaacatagtgggacctagtctctagcaaaaaaataaattaacaaaaatgtgtcaggggtggtggtgcacaccggtagttccacttccttgggaggcggtgacagcctcacccttgacagcctcagccttggaaaaagaaagtactgttaatcttgaagactatggaatcattttgtccctgaccagtggaagaggacctaagcaaccccctttgagggaaagtgggtcacctgggctggaggtagggatgtgatattgttttgtaagctagcatttcctacaaaatatgaatttatactttgaacagatctt

SEQ ID NO: 209408 - DNA, 247 bp, Homo sapiens
agcccctgcctgcctcttggccacttagctactcttctacttatcccctccctttccactgaacttcctggcaatggggtaactgcctcattccagccataatctctccatgccccctgcctcacccccaccagccacacagacagcaaggcacctgtggcacagcctccaaaacacatgatgttttctcagttgccaaatgttctctcgtgagttggcttcctttgtccattgaatcttttttagt

SEQ ID NO: 209409 - DNA, 503 bp, Homo sapiens
cttattatagcaataagtgaaaaaagggcaagatgcaagataatattttggtaaaattccattggtatttagaaaaaaagatatacgtgctgtttgtgtgtgtacaatatacacatgtacatatgtatgtatgtctatctatatttatgtatatagatctgtaggtgtgtatatggaaggatacacaaaagttatctacaataattacttctggggagaagcatgaagacctaggacttttacgtttcttttttttttgagatggagtcttgctggagtgcagtggccagagtgagaccctgtcaaaaaaatgaaaagaaaaagaaaaatagaaaggaagaaaggaaggatggtctcaatctcctgacctgcctggctcggcctcccaaagtgctggggttacaggtatgagccatcactcccagcccctccataaatggtttaagtatacatatattgttgttgactatagtggcaatattgtacagcagcttgtgcctccc

SEQ ID NO: 209410 - DNA, 309 bp, Homo sapiens
cttattatagcaataagtgaaaaaagggcaagatgcaagataatattttggtaaaattccattggtatttagaaaaaaagatatacgtgctgtttgtgtgtgtacaatatacacatgtacatatgtatgtatgtctatctatatttatgtatatagatctgtaggtgtgtatatggaaggatacacaaaagttatctacaataattacttctggggagaagcatgaagacctaggacttttacgtttcttttttttttgagatggagtcttgctggagtgcagtggcgtgatcttgactcactgcaacc

SEQ ID NO: 209411 - DNA, 508 bp, Homo sapiens
aaaccctatacccattaaacactaactccccattcctcctccccaggcccaggcattcttttgagagggggaaaaaaaaaagcctgaagcctgactcacagctcccaaggaccccagggatggcttcatcagaaaagcctgggaccacagaaatgcttgtgatctggggatctaaacatcagagaaaaacacacagtaaatttcccttgaagtaatcctttctacacggtcaggaagctgtagtaagaaatgaagggtgggccgggcacggtggctcacacatgtaatcccagcattttgggatgctgagacaggtagatcacctgaggtcaggagttcgagaccaacctggccaacgtggtgaaatcccatctctactaaaaatacaaaaactagctgcatgtggtggtgggcacctgtaatcccagctacttaggaggctgaggcaggataattgcttgaacccaggaggcggaggttgcagttagccaagcttgcgccatttgca

SEQ ID NO: 209412 - DNA, 267 bp, Homo sapiens
gctatgtggtctgagtcacatagcatgcagttacaacttctgctttttcctataaatgattaggaaaggccacagagatgacaccaaggataagacccctttagatcatcacccctcctcatggaatgttaaagcattcttccttggaacgtagcaagctgtaaccaatcaaatcactgtaatgtgtatagtgatctcgtgtagagagggttgcagccccattcactgtctatataagtaaaaatcttactttcccactttgcaatg

SEQ ID NO: 209413 - DNA, 270 bp, Homo sapiens
caatgaagtaggataaaagtggatatatcagaatggaggagttatcagagaattagacagattaagtcgctcttctgttgctcctttaggacagctagcaaggatctgaaatgacatacatgcatcaatagtccacaggtttcaagatttctggcagagcctttccttgtcttagagaaaataaatgcattttgtcttctctagggccagggtgaattgatggtggtgggcctagtctggcatgggcaaggacaagagttgagttcttag

SEQ ID NO: 209414 - DNA, 330 bp, Homo sapiens
aaacacaaaagtcatgaatgaaagaccagacctagatcactatgcataaaagagaagactgaccaagctcacgggtgttctccaggccatggcttactaaaccacaagagaaaacacaactgtaagcacagattgaagacatcctggaaaacctaaaaactgcctgatggaagctttgagcataatttgtaatctattagtcctcaagataggaaaacacattttccccttttcggaatcccatattgggctagaactcttattaatatactcccagttagtataatttatttaactaaaagtatcagctacagtggtttgtagtatttt

SEQ ID NO: 209415 - DNA, 409 bp, Homo sapiens
cataattgctgggtcctacctccagagtttctgattcagtaggtctggggaggagtccaaggatggatatgcaattttaaaaactcaggtgatgctgaagctgctgttctgggaaccacactttgagaaccagctggcttggtagaagaaaaatctgttcttaatcagaacacgtgggttctaatcccagtgttgatattagctagttatgtgggatagtactggtcacttcaactctgcacctttccttggtaagatggttatatctaccttttctatttcacagatttcttagaaggatgaaaatatgatgacatctgttgaaagtaatttgaaaaagctaatttcaatatgaaatatccaagaccatgggatttgaaagattcctcaataaccagggggaaatgat

SEQ ID NO: 209416 - DNA, 340 bp, Homo sapiens
agaaaccctcagggctagtttttcgcaaaggaaactaacaactgaaggtaacgccccaaacatactctaagttcaaagttccaagaggaggaccagctgaatcaaacatgtccagaatgagaaacagcttacccataacttctgcttcacatacttctgttatgataatgttaatgaatagaaaaaaaatgcatgcttgtgatcaaatgtttgaatcgctggttggcagtggatagagctgcacagaccctataggagcagaggtatttgcccttcaagatttatcttggtccagtgtggaaacacacaagtgcagaccaaccactcattgcagctccca

SEQ ID NO: 209417 - DNA, 306 bp, Homo sapiens
tttagattagtcataaggaagaaatccaggaaaacctcttctgccgtgctagctagggaggagtggggtgacagttaagatgtctcacgacacttgcatccagacatggccaggtagacagagggtggcccaatcaaaaggggcgccagcggccaggtgcagtgactcatgcctgtaatcccagcactttgggaggcagaggcaggtggatcacctgagcttaggagttcgagacaagcctgggcagcacagcagaaaccccatctctacaaaaaaatatacagaaattagccaggtgtggtggtg

SEQ ID NO: 209418 - DNA, 305 bp, Homo sapiens
tttttttccttccttttccttgtgaacttccccagaagacttctgtgatcagtctgttaataattttctctagcacactctctctctgctctttagcaccatataactttctattacagaacttaaacagagctaatattatctttgcctgtatgatcatctgatttctgtctgctttcctcaccagaccataatcaccatgagtgtggggaccatgacgattattttacaaatcttcagcttctggctcaatacaggatgtgaagttaatgctcaataaatctgtaacggtagagttaacgaaa

SEQ ID NO: 209419 - DNA, 682 bp, Homo sapiens
tgcacacccagtgagaacacgcctacagaaagcttggcccggctggtggccatggtgtttcagtggtttcactccactgcgtatatgatggatgatgaagtgggaagtctggtggaaaagctgaagcctcagtttgtcaccaaatggctgaagaccgtatgtgatgttcgcttcgatgtcatggtcatgtgccttcttcctaaacccatggaatttgccagggttggtggctactgggataagtcctgtagcacagtgactcagctgaaggaaggtctcaaccgaatcctctgcctgatcccctataatgtgatcaatcaatctgtctgggagtgtattatgccggaatggctggaagccatcagaacagaagtcccagataatcagttaaaagaattcagggaagtattaagcaaaatgtttgacattgaactctgtcctctgcctttctcaatggaggagatgtttggttttattagttgtcggtttacaggatacccctcctctgtgcaggagcaagctttactgtggcttcatgtattatcggagttagatatcatggttccacttcaactactaataagtatgttttctgatggagttaattcagtcaaagagctggcaaatcaaagaaaatcaagagtcagtgaactggcagggaaccttgcatctcgaagggtaa

SEQ ID NO: 209420 - DNA, 524 bp, Homo sapiens
catccatccatccagccatccatccttccttccttccttcttccttccttcccaccttggcccagcccctctcagccccctctgcatcccatccatcacttctcagacaggcctccccagccaggtagtcacctcctagcagctccatctgtctgtctgtctaccaacccatccatccatctgtctgccagcccatccatcatgccacaggccacttgtccattcttgccacctttcacatgttccctagttaggcccctgtggtatcccccagccagcgcagtgtaggtggggggcgtgtgttcatgtcagtagatatgtctgtggccgccagcatgccttgtgctgagcagagggcaagggacctggatgaggagctggggaggggttggggacaggaagactgggaacctcttggtggggggcacagcagcttccctgtgtattctccctgtggtctgttgcaccataggcatcaatggcctgctcaaaaataaatacacgactggaaaactctcccacct

SEQ ID NO: 209421 - DNA, 319 bp, Homo sapiens
atcttttgattacatttgttaatattattgtacctacctatatctgacttgacttacaattttacttcattaaatacatagcaagtcatctgagaacccaaagtaatcatacagattacttgccatatagttaatttgtgactgtgatatggctgctaaggtagaggtttgaatttaaaagcacaaagaaaaatgtttacttcaatggttacaaatagattaatcatataaagtacatatttctatgatcatgccactgcgctctagcctgagcaagagagtgataccctgtctcaaaagtaaaaacttacaacaatat

SEQ ID NO: 209422 - DNA, 774 bp, Homo sapiens
gattactggctgcctttttagagagaacctgcaaagtggtagatttaccacagttcaaacctggctttccatcttacagggcagagtgacattaaccaaaactacaaggcagacctgtgaaaccacaatgccaagaacccactgtcttaggaaccaaaccaggttcatcctcttgacatagacaggcccatagcagtggtcaagaaaatcagcagtaggaagctaagaaaatcagcaacaggaagctgcttggtgaccacaggatctgatcaagagggccagaccggcagagcactgaccagcatcaggcttacccagcccgatgaacctacttcatactaccagacagccatctccactaagaggcacaaaagagccctctctccaggacaattactaattgactaaaactaccggagtgacacattcattctttagctttattatacatccagtcaggtcatccaggaagttattttatttctctaatgtgcccacaaattgttactctattacgttatgcttccccctccgctccccacaagacagtctcactctgtcacccaggctggagtgctgtggcacgatcttgggcttaacctccttgggctttacgagggccttgatagcctcggcacgtgcactcatggccttggcattgttggcctgcatcttcttcaggccctttttgttgtgcttcttggcaaagcgcatgttcctcaggaacttggggtccacccccttaagagattcgtatctttgtccggggttgtt

SEQ ID NO: 209423 - DNA, 676 bp, Homo sapiens
gaaaccctcttccttccaccctgccctgtggtgtcccaaaggccaggccagcccagcttccccaacagtgaccagatgcatacaaggatctgtaagtgtctcatgaagctagattaccacacatgagtggcagtagacatggttccagaagcagacaggacaccagtccgattctggctaaggagtcctgcagacatggggagccactgaagggcctgatgctggggactggcaaattctgagttgccttcccaggggctgctccagaggagacagggtggatgtattggagagagaagtactaggagcaaaggaaaaaaaatgcatggaagaccattgcactagttgagcaagacgttgagtaggagacaaagtcaggcttccctgccttttgtggctaagacaatcatggacctccctgaaggcaggggcagaacagacctgaggtccccctcactctctctcgtgattctgattgttattgaaagctgcctcctaccacatcactatcatcattcctcccccgattctctacctcctgcttcttttcctcctcctcctattcctcctcctcttcttcctcctctcgtctctctccctccctctgtccctgcttcttcttcctcctcatcctccttcatcttctttctctctctccctaaagcaatatgccttg

SEQ ID NO: 209424 - DNA, 676 bp, Homo sapiens
gatggcacctggcctctcttacttccaaattagacgagaacatactacattttagctgggcacattactatcccaaaccaaactggggtgctattagtaaggaaggaaaagagtagatactgggcaggcaattagaaatctttgcagcaagacattcgggaaaggtattatttagaaaagtaccaaagtctttttgtgtccttgatgtggattgaatagagtgagaaaaattgcctgtgtgccggtttcccagtggaggtacatggagaaataagaattgtttccttctgcatggtaagcagctctccttgtccaattgtcccctattactgaccatggtcccacagcaatatagttctatttctaggaatggactaggaaaaaaatcccagaggagaaactcccacactgatttctacttctaaaattcaatgtatttgtacctcgcgtctctagaaaaattgtgttttagtatatcagcttttgaagacagctgtacctaaatccagccatccaaatgggacaaaggaagccgactttcaccttcagaagcagccatgagtttgtgtctgctgcattgcactttcaatatctaggacagaatttcatacttattatataattacagtaatacaatttgttattaaatagttgccaaacaaaatagaaatacaat

SEQ ID NO: 209425 - DNA, 735 bp, Homo sapiens
acagcttctggcaacccctgagggtcttggaacataacccccaaggataaagagaaagactatttattggatacaatatttgcaaaatgtttaaaatatccaaaacaatactctatacacactgctgaagcttccagtcacatgtatggaaggaaaaagacctaacggggaggaaaaacaagtccaggaaggtggctctctacgggggcagctgggttatcaggttccatttcttaacctgggtgttgcgtacacatgtttatgataatcacttttccacttttcaaatgtttcacaatttaaggagcaacaagcaaaacagtcagtagaatatactactatttgtgttaaaaagaaaaaaggcagaaggaactcacacatgggatgtacctctgcaagcttctaagggagctgctaccaggctgtttggggagggcctggggacagcagtggcagggacaaaccttgtactctatactccattctactgactgacctggcttcccacgtccatctattatctactctaaacagctcgcctccatttacgaatggggaaaccgaactagggggctggaacagacaacctcaggtccaggattagtgacaacagatctagacccaagcattcgggttaccaggaaccagctctgatctgctgggctgctctgatgtcaagatcccctggcagctaaacctagtttggctacctagactatgaactgcctgccaact

SEQ ID NO: 209426 - DNA, 625 bp, Homo sapiens
tcccctttgccttccaccacaatgctaagtttcttgaggcctcccgagacatgctgaactgtgagtcagtcaactaagcctctttcctttataaattacccagtttcaggcaattctttatagcaatgtgaaaatggactaatatacaactgaagtcatttggtaaaataagcttcaagattcctcttttcatctctcactgaagaaatataccccttttcataagaaaatctacaaagagtatttataagaaattggtgcatggctgtgcttcaactcctcagtgcatgatatgaaagaaaatcagatgaggttgcaagaaataaattttgtgttagacatcagagaccatttcttgacaggaaaagttgtttgtgatgtgtgcagcatggtttctcaagatctggctgtataaacaatggacagggctgagaaccaggaagtgcagtgtctctgggatctatgcttgatgcctctaactctgcttagcactgagtatgtaggatagtccccatgtattgacaactcatattaaactgtatatggaagcacaaacattgaagaatagccaaacattcttgaagaaaagaaacaaatggagagaacttgtccttcaaatatcatt

SEQ ID NO: 209427 - DNA, 521 bp, Homo sapiens
acaaggtaaatgaagtcagggtcacagaagggcttctcacccaaccctctcacttcacaagtggggaaaccggcccagagagggcaagtaaacaaacagcgtaaggagtttgtggttgtggaaggttgtgaaatggcccctcaaaagatattcccattctaatacctggaacttgtcagtgttaccattctgatgttgggaagattatcctgcggtatctaggtgggctgtaaatacagtcacatgcatcgttataatcagacgacaaagagagatctgaaaacacacagaggaggccccagtgtggagaccagtagagggaggcttgagaacacgggccttgaacatcggagttggtgtggccatagccaccggaccctggaagaggcgcgtaacagattctccccgccagcccctgagtgagtgcagctctgccaactcttgatgttggcccagggaaactgttttcagacttctggcccccacaactgcgagagaataaattacgttgttttaagcta

SEQ ID NO: 209428 - DNA, 307 bp, Homo sapiens
aattcaagcttctaacgatgtacggggacatgcatcgttataatcagacgacaaagagagatctgaaaacacacagaggaggccccagtgtggagaccagtagagggaggcttgagaacacgggccttgaacatcggagttggtgtggccatagccaccggaccctggaagaggcgcgtaacagattctccccgccagcccctgagtgagtgcagctctgccaactcttgatgttggcccagggaaactgttttcagacttctggcccccacaactgcgagagaataaattacgttgttttaagcta

SEQ ID NO: 209429 - DNA, 250 bp, Homo sapiens
tcttctggatatcgatggggatgcatagaggagtagggtgaggaaactagttagtccgatataataaatttacacagtgcctttggctaatgctccatttctctaggtaaaatgccatctctctcagaatccctccaacacatacgcacaattcctctgtaagtagatgtaagggtagagcctgccagctgcttgtggtgatgtgtataatgtctttatactacctagtcgttgggacagcctctgatgc

SEQ ID NO: 209430 - DNA, 541 bp, Homo sapiens
aataaaggaagggggtggggaggagttcaagtatgccagagcttacagcagattaactattttatgagaacttctggcactctcagaaagtaaaagccactgtggactggagctaaaataaatctttccaacctaaacactgcacaacagcttttctaaatagaggtgaaaaattcagatctggaccactagtcttaagaacagaaacaaggctggatgaattgaagatcctgtcctggagcagcaaagcataatgctttagatatgctctggagccagagtgacaaggttaaaattccagctccaccatatgagagctgtgtgactttaagcaagtcattaatctctttgtgtctctatttacacctccgaaaatgggcagaagatcagtactgagcttattaaaggctgttgcaaaattaaatgaactaatatttaaggcatacagtacagtgcttagcacatgataaattttaattagccatacttctcctccttttccaaggaatccacttcaaattgacataccaaaaggggttat

SEQ ID NO: 209431 - DNA, 297 bp, Homo sapiens
tgggctccagcgctgtttttgcgactgtgcctggaacagagctaagtaaggactggaacctttttctagctctgcctgggggactctttagttggccagctgggtcccacccctcctgtttacagctctcactcctaggggtctggcttccccataaaaagttgattgcacccaggctcctggggaggaagggttgaggaggaggaggaggaggagagggagcagcaggaagtgaggtgtcagctgctttgggtcttaactagcttgggagggcctgatgcagcagcgtttcaggtg

SEQ ID NO: 209432 - DNA, 388 bp, Homo sapiens
tgttggccaggctggtctcgaactcctgaccttcaggtgatccacccgccttggcctcccaaagtactgggattacaggcgtgagccaccgcgcccaacctgtatttacttttttaatgccacctagctgaataatgctttgggttttactgttgtcaataaaaccccttataccttttattgtcctgcttacttataaaagccaaattttaggcgaacttaaataaatcagtgctgaaaaactagttgaacaatcagtcactgacaagttttcaatgttttgagttaaccaagtgggcttttcagattaggttattcaagagcatgagctagaaaataattaggcagacaaaacatatgttctcacacacacaccacttccaaaaca

SEQ ID NO: 209433 - DNA, 179 bp, Homo sapiens
acagtatagtgacatacagtgacaccatcaacttcccaggtgatatacctgtgtaaagaacaacagtctgaaagacagaacactaaattcaatattctagcccagactcagtcactactatttctgaatgtgattactttttaaaaatgtattctggctgggtgcggtggctcatgccg

SEQ ID NO: 209434 - DNA, 409 bp, Homo sapiens
tttttctattgcctgggaaattacactgttccttggcaaaggaaataagttttgaaaacggaaaccagctgtgtagctcagctttaggactacagttacttcatcccctgtgcccattcccttcacagaaggatgcccaactcactgggaaacccattcctaatcatcaaccagtctcactgtttgaaagctcttcctaaagcaaacccacttccacttattttgtgttcagagacgtgaagaattgttgattgttttcttttaatataaaattactccatagtcttaaagaacaataataagttatcttagaatctctataaaggtggtctattccaataataagcttaaaaagcatttttaaaggaacttttttggttctcataaggcacctcttacaagtatttca

SEQ ID NO: 209435 - DNA, 403 bp, Homo sapiens
agggccagagaggaaaattccaggatgagctcttgagatacttaaagctacagaattaagtattcataggggatttcaacagcttagacatctgttgaataacacacatcactaaacatttatcatctgaggatggctctggttacgtagaggataaattcaaaaaaggaaaccacggagaagcagtcttggttttgtttcatgcaagaagggaaggagtgataattcaaacttgatgtggatttagtatttactctgcatgaactggcctgagtattctgtcctggcactcaggttctctcacgtaggatattatatattcaaatgttccagtggttttcaaacagtggtttgtgaccctagagggttggtgaaatcaatgtagtaagttgaactactatta

SEQ ID NO: 209436 - DNA, 862 bp, Homo sapiens
gggatgacaagtttttggggtacagtccaagttaggctggtgtctggaatgagactggggcctaataaaaaggagcatccataggagctcaaatgggctgtaccctgtagcgtcccgaggacaggcccgaattctgagaagggcaagtggtaaaagtattgtccagtcctttttaagttggaggctgagcttggcgaggtgtgtttttaaaagatcattagtccgttttaccttttccgaagattgaggacggtaaggggaaggttctactgaataccaagaacctgagaaactgcttgggtgatttgactagtaaaggctggtccattatcggactgtatagaggtgggaaggccaaaccaaggaattgtgtctgacagaagggaagaaatgaccacggtggacttctcagaccctgtgggaaaggcgtctacccatccagtgaaagtgtctacccagaccaagaggtattttagtttcctgactcggggcatgtgagtaagtcagtttgccagtcctgggcaggggcaaatccccgagcttgatgtgtagggaagggagagggcctgaacaatccctgaggagtagtagaatagcagatggaacactgagaaatgatttccttgagggtaaaggcctggggcaggactggagatctaaggagctacggtggaactaaggcttggaatttggtagcccaccggatatgggtttttaccactgcgttatggaaatctggtgtattcccgttagggaaagtattcccacagactcagggttctacaagattacacgtggtgtttttgttgttttttataatattatatatgggggaagacacgacgaatagcgaatagtcgag

SEQ ID NO: 209437 - DNA, 576 bp, Homo sapiens
cctaacagtgaatttttttttaagagatgggatctcactagattgcccaggctagctagaatgcagtggctattcacaggggtgatcatagcacactgcaggcttgaactcctgggctcaagcaatcctcccaactcagcttcccaagtaactgggactagaggtgtaagtaattgcacctagtttataacagtgaaattctgacgcaggtcatggtccttacagatcacattcattcatttgacaaaattcataaaggtgtttctatgtgccaggtgccagagatacacaatgaatgagaggacacagtccttgccttcactgaagttacagattattctaatgattaataaataaaacatatatttgagattagtcattgatttgcagtgaaacatgaattactagcccttgctgaagtccctgatgaacagaacatcttatattttatattcttttgcactggcaaatgggcatttcagactgagctcttcagagtgcttataaaatacaaacccacacagacaatcacagaaggtgaaagttagaagaatgtttggatatcatcttgtccaa

SEQ ID NO: 209438 - DNA, 964 bp, Homo sapiens
gggagaagacaggcatggagtatatttgagcttttttttcgctggacattgagtctctgacagtgttgggccggtgctgggccctgggaagtcaatggtgagggcctggcgcacttgagaagtgtgcagtgtggtgtgaggtagacattgaataaatggacacacaaaaggtagtgaaatggagggaaatgcagactgctgtgaaggcatacaacaggagggtttaatctctctgggcattagggaaggcttcctggaggaagcagtgctggagctgagagctaaggctggagcaggagttagctgtgctgagggagtgagtgcagaggttccaggcagtggcgccatgagcaggcaggtgtggctggggcatagagagcaggggccaggaggctgtgactagacccattgatggcagtggctctggagacaggctgtctttgcgcatgtgagtgtgtgtgcctgtattgagcatctgtggttgcaaggggtgagttctgtgggacagaaggttcagggagggcatcctggagctgtgtgccagccagggacccctgtgttagctgtgtattccaggggtgtggggagtggcagtaggaagggctgtagggcatcccccagggtgggctgtaagttagaggtgacattggggatctcttgtggtggtacctccaaacccagaccccctccatgtgacagaggtgagcaggtgtcctttgggatctgggtgactttgggatcttgtttctagagatggggctgccctgtcaaggggcttctacctgttgtggcccaggtggcatggagaggggccgggaacaggataccctttcatttaccccttcccctcccaatgtgaacttccagagcctttcccattgttgcctgtgggttgtctaaggagtgagtgtgcatggtggccgtggccactcactcatgcccacctgggagtggcatgtgttgg

SEQ ID NO: 209439 - DNA, 549 bp, Homo sapiens
catttctgggaacctgaatactaggatgcatgaattattatattaatcctatttttactaaatgcatactacaggcaaagcactatccgcggcactgaggatagtgcagggaatgagaaaatgtctctgctttcacagttgaaaggaataaaaaccaataacatgcaagtctggagttgatgctgctatggaaaaaaacaagcagagaagagggatgggcagtgctgctgaggagggatattattttccacaggatgaggaggggctaactctctgataaggtgatatttgagtggagtcctgaaggaaatgagaaaacaaaccatatcaacatagagaagcccattacaggcagaaagaatgaattctaagagtctagacaaaggcaaacagccaacggagaaatgggcaaggtatggaaaggctattaaagacatggccaaacacaacaaaatgctcacccactcctgggaggattataaaataaaacctcaaatcagactggcaaaacctaaaaccctgacaatggccaggcacagtggctcacac

SEQ ID NO: 209440 - DNA, 197 bp, Homo sapiens
gttggagactggctaatgacaggctcattttgttcaacaatgtttcagaaacatttaaatttgttgctagcatttaaaagctgggagatacctacaaaaacccagattcctggcatctgttgaaaaatctgatggtcaagcaatattgtttttccatggcagtagtcgggagtttattagaaaacagcaccccaaga

SEQ ID NO: 209441 - DNA, 554 bp, Homo sapiens
tttccttgagacaaccgacaacctgaaaaaagactgacctacaaccaataggactacactaatacaatttgctactatatgtagaagaatgtatacaattaattttaccccaagaccgctaatgatgatgatgttgtgaaaagagaatgtactaccaaaatctatcctattggcaaatttaccagtaacatgtacaaagatatagaaagaatattcatctacagtgacaaaagaggacagtaaatattcactacctgacaaaattaaaattcaaagagctttttcatcaggtgaaaaaaaaaggaactgatgtatcaagaaaaacagtcaacttgcttaagttatttaactaagaatcctgaaatcttggacttttctgaacaccattattactcaagcagcactcttggtgaagaccctttctgtatattagagagaaagcaacatcatgagaaaagaactccttaaacttcctaggagcaaatctccaaaccaacctgtatctaacatccaaactttccttcctacacctactgctactgcggttcgcagaa

SEQ ID NO: 209442 - DNA, 463 bp, Homo sapiens
cgaactcctgaccttatgtgacccgcccacctcagccccccaaagtgctgggattgcaggcctgagccaccgcgcctagctccatggccttttaaatgggctcaagacttttacgtgttgaaaacaaacaaaaacaagaaactccttcaaccccatgaacctcttcagctgtgtccctactctcatcccacagccacattccctgagggaattgtagtctctgcagtcccgttccccagttactcctcaagaccctgcaccccgctcatccagagtcagaaatagtggagagttcttggtcttgcttggtgtctggtctgtcctcccagctctgaacgaccacatcctctgccaacatcaagcaggacttcagctggacaggatgtggctcatgacagccactttcacatggttcccagaaggggagccaaagggtaggaggtctcagaggtggcagccttca

SEQ ID NO: 209443 - DNA, 765 bp, Homo sapiens
agggcatctccctggcatcccttgacataattctcgtcggttggtcagtggcccccagttggagccgtcttactgctttggactctctgccttggtccgctccatgttgataaaacccgagcgttcctgtgatctccacagactctccgaggagtcgtgccgaattcggcacgaggtggtggagccctgtgtcagtggacttgcagggaaggcagtctcggcagggtagcacgagacgagaaaggccggaagagccacagagagcaggtcgtgttggcgcaggaggcagggtgtcctgatttgccggcagccccagcgctgatgtgtgcgctcagctgctttgagttgttctcttgtttaaggagaagagagacttgatgaactggcctgataatgtcgatgcgagctctgttcacacgtgtgctgtgagggatgtgtggatttcactctgggcttttccagtaaggtagctgtgttatgggttcagttgtatgtgtggttttttgttgttgttgtttgtttgtttgttttgagacaggagtgagaatctgtgtcggggaagaaaaaagaagtggaagtccttccctgtgttcctgattttcattattagaataaagcaaaaacttcccactttaagaaagaaaaagccaagaaaatccccttggctctgggtccttagacagtgttgtatagggtgctctgagcagcctccatgtcttcactcttgcccaactcccaagatagaggtccattctatttaatatt

SEQ ID NO: 209444 - DNA, 567 bp, Homo sapiens
tatatatttgaatatatattctttttatgtatatacatataccctaaaaatagaaaaatgattttctaaaaacagaaatatggagcactatacactatacatacacattcattttaaaataatcttcactagtgagcacattaaaatatatcttaatgaacattatgaacaaaatataattttaacttatgaagtgtgctagacagcacactattttctacgtttattctaatagaatgggttatggaagagattagaattgaataatttgacactattttgtaaacacttaaatatgttaggcatagtgtaagtcctcaagagaataagactgtcccttttatataaaatatgaaaaggggaaaaacatggtgttgttgataagatacttttcaagtgaaaatgcgactgagattatctaatcggttacccttgcaggtggttggatatacacctgcactgaatcttagacctaagaaatgacagagctgaacatcttcatgggtttcatgacagagccacagcaaaatgatttcctgagatcaatatgtggttgagagaaagctg

SEQ ID NO: 209445 - DNA, 486 bp, Homo sapiens
tgggaatgcaagcctctggagataccttgcacatttgtccccacagtgagaagttcctcttatctttgagccaatcctaccattatttcttttttatgtcatatataaaacacaatttaaaatagattatatgtctaaaatttacaagttcgatttactcatcttctggaagaaaatttaggataaaatctttgtaatcttggcttaggcaaatttttttcaacaggacatctaaacataaaacatgaaaaaaatgatttagacttaaaactttatgctcttataaaatttgatttcatttaagaaaatgaaatcaacacacagactggaaaaaaatatttattgtttatccaaaaggaacttgtatccataatatataagtgtccttgcaattcattaacattatcaagtaacaactcattattatgtacaattaaaaattggtctgtaatcccagccctttgggaggccgaggtgggcggatca

SEQ ID NO: 209446 - DNA, 841 bp, Homo sapiens
agggagcggggggcgggtgttccagggctgagggtaccgagacccttctgcgtgcgctacactcccgggaaagcaagcccagggcctctggactcctgggtgcccggggcgttcggcgcgcccagtgcgccgtccgcatccaagacaccctctgggtaataaccgcgctgtgtgtgtctgagactccctcgacatacagattgttttttcaagagcgaaccccagctgggtttacggggtcgctcggtggtccgtttctacagccctcggccctgcgctctggccacttggcttgtttttgtttcactgttccccggagtctctgcctggggagtgaaggagttggatccatgttcagtgagcacttggatgtaccaggaacgagacaggttcaaaactcaaccctgagagttgtgcccccattttaaagatgagctaactgggcttagccagacattgaggagaaaccattttctttcgtgagtcccgcgggtgtcgaagccggatcccacgaagggatggtggcatcagagtctggtgcggggaggaaatgtctctctgtggtctccgcagccagcacctccccggcaaggttctgagcttcgccgggagcgggctggggccagaagcgcacgggctcttcttggctcacagtaataattaaccgcattccagcagggcttgagagtttgcagagtgatgttcactagctcaccagatcgagatcctcactagaacccccaagtgtagacactggacttgtgactaccctatttttcagacgtggacgctgaggcttttaaagaagacggcctttgcttgtcccaggttaccaacaacc

SEQ ID NO: 209447 - DNA, 181 bp, Homo sapiens
acaatggttgaactagtttacagtcccaccatcagtgtaaaacttttcctgtttctccacaaccacactactaggtcatctggagtgaatccagctagctttgcaaatgctttcctgaaacagtcgaaccaggaagcgttcttggcagctcaggggccctcctcggtctcccaaagggctg

SEQ ID NO: 209448 - DNA, 418 bp, Homo sapiens
agaactagaatgagcaaatgactgtcgtgagttgatccctctatttgggactagtgggatatgcacttgcggtgagcagggctgtgattcctggtgctgtttgctgcgcggctggccgcgacaatgggctggactcgaaagaaagagaagtgaaagtctctctttgtgaagcgtttgccttatcagagaaagtggtaccagagaagagacacgagaactgctctctagggtgtgggcagtaagaagactgtggggtgcagaggtcagagctagaccgactctgagtcccatcctggctttgtgattaatatgaataaaacaataatacccttatttcatggtctgtagcagtgctgtccagcagaaatataatgtaggctttttatgcaattgtacatttcctaagagccattatttt

SEQ ID NO: 209449 - DNA, 315 bp, Homo sapiens
gcattgaataatttgagagtctgagaaactgaataaagtgaccttgtcaaaacaaaacaattagaaataacaattaatttcccagtagtgaatacatacaaagttaaaactattttctcaataaccacgtagaaaggacttaggtttggaatcatagccctagcttccaattttagctctgctactctgtagtatggtcccaggcaagttacttacctctttgagccttctctcctctattaaagagatcactatcaacaaccttgcagtgtggaggtgaggattaacaatagtatttataaagcacttaccagt

SEQ ID NO: 209450 - DNA, 571 bp, Homo sapiens
tgcctaagcacctatcattgaagaatgggaaacttttaaggagccaaagtaaataaaaacacagcatatgtgttgcttttgagaaaagagactgaacataaggagactatttaagacactattgcaacggtcccggtgagataaaactaagaatatgaattagtgttgtaattgtaggactagaaatgagagaagagtgtaactacatatgtaaattccacaggtcttggctgtttgtattcccctgaaaagggaaggttgagaaatatgaggcagagacaccaagcaaataggaaggagaaatcccatcattgctagcattctcagcaatgcttgtttttctttcttcagttggaaaacaagacatttgttaaattatgtctctcctctttccttttcctttccccgttctttctctcttcctacctgcacagaactacacagacataggcatgcacacatacacacgtaagcaattacaatcaatataatagcagtcatcatcctcactgccaccatcaccaccaccatctttaaaccctgccatcctgtttcagattaataatgttaa

SEQ ID NO: 209451 - DNA, 308 bp, Homo sapiens
aagagtcctgggtgcgggattcctggtagccgactcgtcgtctgaccagggccgtgcccgcatcttcctaaggcactggttccggccctggggagactggaattgagacgacagggcctccgctgaccagtccttggacacaacgcggagcggggctgaggggccgccctgccaggcctgcgctgccgtgcttttaggtagcagcgaacagttagcctttgaaccggagcccggggtggaatacggggagacggaggggctcaccacacccacgcttcccggagagggcggcggaggcgcgcggccgc

SEQ ID NO: 209452 - DNA, 277 bp, Homo sapiens
gttccaatctgggaccagtttttatattcagcagggttttatagaactccagcacagtgctgctagactttacttgattaacgcctaggtgaaaagttttatttacttagtgatatcgacgtttattaatgtcagtagtaatcatatgaactttaaataactgtgaagtgttcagtcattttgaatgtgtgtatagcagctattcatacattttggactacttgaaaatctcaacatatagagcactataaatactcaaaaagccccccccccccca

SEQ ID NO: 209453 - DNA, 373 bp, Homo sapiens
tttccgctaggcatgagagggaggaaagaggccaagaatcttaccccagaaggggtgggaaataggtttctcctctccccaacaagacagttgtttatattttatctattttgtaagtaaatgatagagtttattgtcacgagttaggagtgctttcatgaacagccccctcttgctcagcaatgactagctgaagaaggcttaacgttatctttcccaaaatgcaaatcatgttttttctctacaatattgctaacagtcctgttgaacaagtaagttcatttagtaactgaaaaggacacgttgccatctgtgtatcacggagggttatcagatgctagattgcttgaaagtagatgtcttctgagagctt

SEQ ID NO: 209454 - DNA, 585 bp, Homo sapiens
caggatggccaagacaagccactgggtcaattcaatatccaggcacgatttttcccttttgaatttacatttgtttaagttttaatcctaacccacttgatgaattcaatttgaattcattttgaattcttaatatcacaacgtatttcctcattttatgaaaaggggagacactgtattatggaagaagtcttggcccagaagctaatatatgtggtttgtcatttctattgtgccactaaatatgtgatattagcactaatcgaaattttatgtatctatttgaaaatacaatcaaactatataataaggctataagactagatgttcataaagatacctcccagagaaaaattgtcttttgaatattttctattgtcctcggctcaaatgctaatgagtctcttcgtctttagtcaacataagacttgaaattgtttccattggcaaccacctcacaattattagttaaagagaaaccagctctaggctttgaataatccatcatttttagaattatttatgggtttcaattcctcatttgattttctttttaactgaaatataaatggaaggaatatgaac

SEQ ID NO: 209455 - DNA, 446 bp, Homo sapiens
gtcttcaactcctgggttcaagtgatctgcccacctcggcctcccaacgtgttgggattacaggtgtaagccaccacacatggccaatttttgtattttttgtagagacggggtttcaccatgttgcccaaggtggtctcaatcacctaggctcaagctatccacctggcttggcctcctaaagtgctgggattacaggagtgagctatcatgcgcagtgctgggattacaggagtgagctatcatgcgcagcccatgtcacgtgtttcctaataggttttcaaagaattttgccacagtaagaagtttttatttcacatattcaagtcccacatacctgatcatggcaaaatggcaaattaatgatgtagttgaagagaaaccagcaaagagctgtagatgctagctcagaaatgagtaacatttttagtctttgggatgtcagt

SEQ ID NO: 209456 - DNA, 501 bp, Homo sapiens
attttgctaatatacccacctgtgaaaccaaggacaaaaattagaattcagctacaaataaagaccctgcacaaaggtcttggccttctgaaaacatccagaaaagaagtcaactgacgatattcaaattataccacagttaaaggaatatcagcctacacaaatgagaaaggacctgacccgtagaagaactctggcaattcaaaaagccagagtttctcctttcctccaattgattgtgctggttccatagcaaaggttcttaaccagactgaaagtactgaaatgacagacatagaattcagatatggatagaaatgaaaagcatcaagattcaggagaaagtcaaaattttattctaatccaaggaatctaaggattgcagcaaaacaatacaggagctgaaagatgaaatggccattataaggaagaaccaaatggatctgatagaactgaaaaaacacactacaaaaacttcataataaaatcacaattattgta

SEQ ID NO: 209457 - DNA, 290 bp, Homo sapiens
ctctatatcttaaaaatgtttctagaaaaattctgccatattaaatgaaaggtactggccaggcatagtggctcatgcctaatatcctaacactttgagaggctgaggtgggtggatcatttgagcccaggataccagccgggacaacatagcaggattccatctgtaaaaaaaaatttgccaggtgtggtagcttgcacctatagacccagctacttgggagactgaggcaggaggattgctttgaaggtcaaggctgcagtgagctacaattgtaacactacactcca
